United States Patent 7,214,786 (NUCLEIC ACID MOLECULES AND OTHER MOLECULES ASSOCIATED WITH PLANTS AND USES THEREOF FOR PLANT IMPROVEMENT) - sequence listing, part 27

SEQ ID NO: 117972 - protein, 274 aa, Triticum aestivum
  Clone ID: PAT_TA_12390.pep
MAASAAHVAALAAVLLFIPSLLATVAAQQGKAKAFCISQFAIASQACSILPPSPPEDDHHHHHDDDDDDDDDDDDDDDDDEHHGGDGDRRLRGRHGHAAVINISSLGLMATRPDSNGVHVARNGTGHHGGNHTRHGRGRRRGRGRLRGTGHGRRGRVRDGNEDPDHDDDHEEDPDHDDDHEEDPDHDDDHDDEHDDDDDDDDDDDHEHNDDDHEHHHDEELRAYRDCCRWLQEVQKDCVCEALLRLPPFLVKPQHKYVVRVGRTCRIVYRCGGV

SEQ ID NO: 117973 - protein, 149 aa, Triticum aestivum
  Clone ID: PAT_TA_12391.pep
MLQGYAVPRAPGKVTRSSQLGDGCCWSHGNFVARRKHSGCFSFLPVPRTLFFFEHVCRADFEGVVTCIPLDEPVIEAYTFLGFRLLWGTRRLADCVCKTCYRLFNIPHPCLKRTCTCGHSRVEKICEMCYNRSGVLHPFRGEFQFGYHK

SEQ ID NO: 117974 - protein, 91 aa, Triticum aestivum
  Clone ID: PAT_TA_12392.pep
KAGTAVTSMTPSLLAGSATTSSPSGTHRRRGCRGYHPTREEQLAVGLPRLHLQAPRERRQSPRPGEEGDCGWICRTRGGGAMWPCNTLRHW

SEQ ID NO: 117975 - protein, 228 aa, Triticum aestivum
  unsure (1)..(228): unsure at all Xaa locations
  Clone ID: PAT_TA_12393.pep
TENRAKTVTTGPQKQGTQGDLATHTRTHTRRRGEASRLAPADAKQSTTRAGDQAASTPSTNIAGESVGLASSQRQSGDSSNTPEETNYQEPSANLTPPEAAIVATNRKPRNIRIARRAPADHNAASVQPMKHATGIRSSSRRRPKEGSDDVDAVARPNRALGFHPKSKIQGCKRMPDSTTTPPRRLNDVHRRRRRRPARPAKLSPGVSQHHQHPHALHLRXPPLXPNS

SEQ ID NO: 117976 - protein, 226 aa, Triticum aestivum
  Clone ID: PAT_TA_12394.pep
KVRAGSRFAEPRLLDDPGFVSVLSDESESDDDEQGARGVAVKSARQPERRARRVRAAMKAAKSFSDRRPVTASSRKKRVKGCRNSLGCFYKMSGRKLLTAKQEVELSQGIQDLLKLEAVQKEVAHYIGGEPTFGQWAVAAGTDENTLRKRLSHGIYCKNMMVKSNVRLVISFAKEFEGPGTEFSDLIQEGIQGLIRGAEKFDASKGFRFSTYSHWWIKQAIRKSVL

SEQ ID NO: 117977 - protein, 138 aa, Triticum aestivum
  Clone ID: PAT_TA_12395.pep
RFGEFIPILLQYVWSRQVAGKPVMWVAHNGKTFDVPFLIFEFQRCKQEMPADWLFVDTLPIARQLVDSDGEKISSASMKTLVERYKIPVDGKAHRAMHDVTALCYVLQKLTFELKLTVPQLLEKSFRVSDITTTPPKK

SEQ ID NO: 117978 - protein, 76 aa, Triticum aestivum
  Clone ID: PAT_TA_12396.pep
HVSSLYIVIVVEVHADLTPFLHICIYQWSIFFLCFPTDIYILLCVLKATNSFLCADHEEMHLRGQAMPCFHCTENT

SEQ ID NO: 117979 - protein, 134 aa, Triticum aestivum
  Clone ID: PAT_TA_12397.pep
LSEAQKQQEEHDDSEEPIAFSKNLLAEKKKTKAAKEKSKKRARDDDDVPAEEDVVEDLILSSDEEAEDENDGLGSDEDGSAPVEDDSDEDFVDPDSAWKKQKKEKLKKRSKYKPSNKASSKTKRKPHPKKKAKH

SEQ ID NO: 117980 - protein, 160 aa, Triticum aestivum
  Clone ID: PAT_TA_12398.pep
FLFVAEFPEAGSSGLREPTPAGTSAGTFLRASAVSVVATVVIMCSRPQRRVVARPAVLSRLSVKVDGVRSFTLEEMATATNNFDDSAEIGLGGYGKVHKGNLADGATVAIKRAQEDSLQGSNEFCTEIGLLPCRLRRDLGPLIAPRVVGVLQLLVFHLAP

SEQ ID NO: 117981 - protein, 91 aa, Triticum aestivum
  Clone ID: PAT_TA_12399.pep
LYKTPHVERCVVILEGQSFSALVRPLQQRHSLQNDPSPPTVELNQHFQPPPPLIRLPVAILKEIRVTQAGSSRHQLPLNLILPLQTPLVFS

SEQ ID NO: 117982 - protein, 51 aa, Triticum aestivum
  Clone ID: PAT_TA_12400.pep
YPRSKYQSNIDGAYFGTTFPHLFLMTYPHLKPQKPSQQYVPKVFGFKLHKP

SEQ ID NO: 117983 - protein, 134 aa, Triticum aestivum
  Clone ID: PAT_TA_12401.pep
STSSNGAPTNGLDICFSSLHREAERIPANNPVNFSPAVVDELDELASYQAKPDDKHVLPVHGTSLEGCSGRTVGQTCNLSSHGNNHLKRKAEEELEPLELAGPPVGATRASTSTVQRKPLRLRLSTVPQPKQAE

SEQ ID NO: 117984 - protein, 95 aa, Triticum aestivum
  unsure (1)..(95): unsure at all Xaa locations
  Clone ID: PAT_TA_12402.pep
LPSPRPGRYKLKAPITGARRCYLLLLLRPSTEGSPTTSSTPDYWPTITHWRRCRKPYTLLGQILKNEAAVNRRPLVGHHLHVRVVAALTSAATTX

SEQ ID NO: 117985 - protein, 197 aa, Triticum aestivum
  Clone ID: PAT_TA_12403.pep
MASHETDPSPAASSKKKKRHSKKRKAIEVTVDASFPGAAAPVVGYFPTGYDPLAAAEPPRARLFRHEKHHNRVELVVGAPGGGPDFVGRSYAGEAAAPQLCGYALGVLDKATGTLKIVPIASNKILRLEPHFEAQQPAHSQQSAAEAGSSVADTELNRQDLTQAYGTKKDKDKDNKWKSLKEQRNDPSAYLDLDLGE

SEQ ID NO: 117986 - protein, 158 aa, Triticum aestivum
  Clone ID: PAT_TA_12404.pep
CCFPLPVVPQHTKKHPAPVTTRHQERMCLEFGSCFGGRRRDDYGRSRGHHGHGYWSEPAPVYRQPPIVAVHEAGHKAYQEGAPKAEHAAYLQDQAGSETPPRHPAWHSKVGVEAGNGDYTPRPHEAATDHRVREHAAMDYHHYPTTTTALARYEVASR

SEQ ID NO: 117987 - protein, 332 aa, Triticum aestivum
  unsure (1)..(332): unsure at all Xaa locations
  Clone ID: PAT_TA_12405.pep
MAAASSDAQPSPGYYPSSRFRPVAFNRGYRNKWGPQHQTLSGDHSAITIWLDKTCGSGFKSKHAYRNGYFATRIKLPAGYTAGTNTAFYLSNNEAHPGFHDEIDMEFLGTIPGEPYTLQTNVYVRGSGDGRIIGREMRFHLWFDPAAGFHNYAILWNPDAITFFVDDVPIRRYERKTDRSLTPEXEEPVNQRWRACLXLISSCRLRAAVRLLPAPARSVRLLVAGGRAGAPPSRPPPRAPPAGAGPSPRLVAAARGARLRPMGVSCRPVSRGVRAPSPACRGLVPPDGADARARAWLIRRVFACYTTGLLTGPPTKFGSSLGWLSESKVWLP

SEQ ID NO: 117988 - protein, 221 aa, Triticum aestivum
  Clone ID: PAT_TA_12406.pep
FGTRDIRKGGGPALEELALEGDPNSINFRVPMRQHKDCNFSYAGLKTQVRLAIESRNLCTDDIPISSATEEDRQLRANIAASFQRIAVLHLEDRCQRAVEWALKMEPSIKHFVVSGGVASNQYVRARLNHIAEKNGLQLVSPPPSLCTDNGVMIAWTGIEHFVAGRFEDPPPADEPDDMQYELRPRWPLGEEYSEGRSVSRSLRTARIHPSLTSMMKSSRS

SEQ ID NO: 117989 - protein, 151 aa, Triticum aestivum
  Clone ID: PAT_TA_12407.pep
AEILTTMEELEVYMQNHKKVMVDSLWKLNVADIEATISHVCQMVLQDPLARKDDLRLRAKGLKTLGKIFQGVKLNSGEGEGSHMKNIDNMDDNAGSSPDSSPKREPSFNPIPNPPLTQSPYVEAPQFGGTYCSFNFPMPTAPPGAQRDPVP

SEQ ID NO: 117990 - protein, 62 aa, Triticum aestivum
  Clone ID: PAT_TA_12408.pep
KETKEACISDQASMSASVLAFHVDVCYLWMNRLPAESFLFQCWRCCSSLQLLGEISYQIKKK

SEQ ID NO: 117991 - protein, 218 aa, Triticum aestivum
  Clone ID: PAT_TA_12409.pep
MGRLKARMREASESNQKNEHRSICLHSFSDLSHVSAATFMYLLKDCYFYGTHKATAKFRILQQQVKRALNNDPQPGPFTYIVQCMYIIPLLGQSHAEGFSHMLISSLRHLKSVESVQKDFIDAKCLAARLVLDVLASVVPHEERILVKLLETFDIELKDMAHAFCGSGLGDEDLAAAREHLHQHVQYFMSSESYVSAVALMTRFSIQCCDESFLIKLI

SEQ ID NO: 117992 - protein, 151 aa, Triticum aestivum
  Clone ID: PAT_TA_12410.pep
LSPSHRRSGYRATRLPHFPLPYIPIPSSTRHWINVGPMPHNLQHAPAIVDAAPGAPRSAASWPDSWRTVAAAARSCIHETKSDDWFFFQCTPCTRAVQLMGECSPALPFVGDAVGLPAAHLRRVVRRHRACGPATRVLQRLGPAAVLMPGT

SEQ ID NO: 117993 - protein, 204 aa, Triticum aestivum
  Clone ID: PAT_TA_12411.pep
MAPKIYIVYYSTYGHVAKLADEILKGVSSVQGVEVKLWQVPETLSDEALAKMGAPAKRDDVPVISPAELDDADGLIFGFPTRFGMMPTQFKAFMDGTSELWCPQRLAGKPAALFFSSGCQGGGQETTALTAITQLVHHGMLFVPVGYTFGAGMFEMGQVKGGSPYGSGTIAGDGSRVPTELELQQAFHQGKYFAGIAKKLKGSP

SEQ ID NO: 117994 - protein, 82 aa, Triticum aestivum
  unsure (1)..(82): unsure at all Xaa locations
  Clone ID: PAT_TA_12412.pep
SLPTTGTTVSVPSGRLTLSIRXRWPECVNQQYELNXAIATKGIQKFAXRKLQHIRECVAKASSIYKVLGSLPVHALYKGLKL

SEQ ID NO: 117995 - protein, 81 aa, Triticum aestivum
  unsure (1)..(81): unsure at all Xaa locations
  Clone ID: PAT_TA_12413.pep
ANIVCKTFLYYGTEGVVHTQTNQMFLLFRSLIFLLHDHQPLLAFNHFLLLSSNRLVSCNIILDSSVSXQSSLPPSLPPSLS

SEQ ID NO: 117996 - protein, 142 aa, Triticum aestivum
  Clone ID: PAT_TA_12414.pep
FGTRQYAHARLHSPILISRETQPASPTKKPATSPSPSPSLAPSLRPDGARANKAARLTAGAGRLPNRDSISVLVPLSRRSQPESLCGLRFVPLVNAFPNCSSAPPPLGPPLSSSSYSPLLLMPAITSCLICAAPRPRRAVAC

SEQ ID NO: 117997 - protein, 238 aa, Triticum aestivum
  unsure (1)..(238): unsure at all Xaa locations
  Clone ID: PAT_TA_12415.pep
EFGTRVDMSCGNVGRVSSMGLIGLENLGNTCFMNSSIQCLAHTTKLVDYFLGDYDSDINRTNPLGLNGELALAFGELLRSLWTNDRNTVAPHNFKXAKIACFAPQFSGFNQHDSQELLAFLLDGLHEDLNQVKCKPYEEAKDASGRPDEEVADEYWRNHLARNDSVIVDTCHGQYKSTLTCPTCNKTSVTFDPFMYLSLPVPSMAKRTMTVTVFSTDGSREPFSYDVSVPKFGTLSDL

SEQ ID NO: 117998 - protein, 268 aa, Triticum aestivum
  unsure (1)..(268): unsure at all Xaa locations
  Clone ID: PAT_TA_12416.pep
MSFLRALADSLSSLLFAPPMDAPAPSAAAVVGERVAVKLRGYFELAKEEIDKAVRAEEWGLPDDAEAHYRNALRVMLEAKAARVPDAVSSSERGQXGCTRTRSPSGRRRWRSGSGCSAGGAERLHQSPRXVVTNNQVNRPERPASTSFRKSAVQSNPTFNRGGQASSHQKNSDGGSKPVQRAGGKDDDKLVEMINTTIVDRSPSVRWXDVAGLDKAKQALMEMVILPTKRXDLFTGLRXACERLLXFGPXGXGXNMLAKAVAXXSEAH

SEQ ID NO: 117999 - protein, 434 aa, Triticum aestivum
  unsure (1)..(434): unsure at all Xaa locations
  Clone ID: PAT_TA_12417.pep
GPELRLVLWGDRAVEFEAEAVHARDKKXAVIAIFVGTLPKMNQGVKGLSGSSACRWYIDEDLPVINDFRNRLGTNFTPIDVNAAIDGGSLPARIYDAPVEMTVSELLKLDPYESGLWFICTVTVQRLTPDQCXWFFSCSSYSKTSTMMGSQYRCTNPSCSAKEAQETYCVSVLTRDDVDEAEFVMFDKVGKAAMGKPLLTLLKFRNPGLVTIEEIARVPMVDRIAPPEVNQVVGQKYKLLVSISRRSFSTTSHQLSFQVVKIMETYKPQLSSSAFDYIPGTSGASSSTSLIDGPATSAMFTPNTPNIHQVQPRSSSGSLAIGYQTPTSETRTPTSKLSVNLLPTASPGKSPCPTGSARRALFPGLDNKAAPLEEPMKKPDETAEVHQEESDGKVEAPLVAVEEKNDKDEQNQTTKNKRNPTARKGTGTGKKSRQ

SEQ ID NO: 118000 - protein, 276 aa, Triticum aestivum
  unsure (1)..(276): unsure at all Xaa locations
  Clone ID: PAT_TA_12418.pep
AVSSAVAGKIVTLLLWVLFLILQTATKVVGGLLQVAPPAEPQEEPQPEAAPRPRSPPAARNSAGGGPADPYDPRSQPWDPPPPPHTAPVTDEYHSSSIYRRRVSAPQAAEDLVVSSSSYSRSAVAAVPASPAHAVPAPPVSRTIKTPAVASKRPKLERKYSKIVDQYRSLDEVIEALAQAGLESSNLIXGIDFTKSNEWTGKRSFSGVSLHHIGDAPNPYEQAISIIGQTLSAFDEDNXLIPCFGXGXXFXLDQNVFAXNLNKXXCXGFXEGLIKK

SEQ ID NO: 118001 - protein, 38 aa, Triticum aestivum
  Clone ID: PAT_TA_12419.pep
GAVELERLLRSYLSLNAPRHHPVILQAFSDIWVVLHGG

SEQ ID NO: 118002 - protein, 88 aa, Triticum aestivum
  Clone ID: PAT_TA_12420.pep
IDLAQLSRSSFFVAVVVDDLVLVVGEVGPWVVVVEDVDPDVGVKVGRGTDRIRTSSRTIPSHLYQWYNNILYRDAHVIMHGSVSARPF

SEQ ID NO: 118003 - protein, 76 aa, Triticum aestivum
  Clone ID: PAT_TA_12421.pep
MSMEAQNLRFVRCPKCLQLLVEYPSIPVYQCGGCGTILRAKNRGAQVTQPDSASGEQNNFPHSLEGPSDQQVYLFR

SEQ ID NO: 118004 - protein, 171 aa, Triticum aestivum
  Clone ID: PAT_TA_12422.pep
IRHEALLTLVLVIVVNLALGILPRVDNFAHIGGLISGFLLGFVVFIRPQFAWINQRRVAPGPQAAPAERKHKTYQYILWIVAAILLIVGFTLAIVLLFRGYNANDHCSWCHYLSCVPTKKWKCNSSPTTCTAMLQGNTLNLTCEGKGIYRSYIVAEATQDKIDQLCNQLCS

SEQ ID NO: 118005 - protein, 202 aa, Triticum aestivum
  unsure (1)..(202): unsure at all Xaa locations
  Clone ID: PAT_TA_12423.pep
PAAPPAWGSPPGRPPPPGLAAPPAGGPSPPPAFPWPPPPCPPGFPAPGVCPPAPPPRPPPPVAHRPRWARRSPPPRLPRAAPRPAPAPPLPPXRAGPLTRRASPPPSPSPPLPPARQPSGRPTXAPPPTRSAPLFPPRSPSGGPIPLLGGSGRGRPFPSCPPPRAPFPRWEDAAGAICGPLAPLRAPRLREDVVPPQVCALR

SEQ ID NO: 118006 - protein, 124 aa, Triticum aestivum
  Clone ID: PAT_TA_12424.pep
YTLFAVSAVCTQKPKTTQESKRFMYRYSPQTCQLARGLLRGTAEIIQLRKKKTSCLMTAEVQATGAQHRIPHEGRAGGKNPAKQEQDVLLDDLTDHCEVRASSFPSSSNGLRGGGRGTGALSPL

SEQ ID NO: 118007 - protein, 103 aa, Triticum aestivum
  Clone ID: PAT_TA_12425.pep
VASKTTYQVGYPVPSSHFIDCLICERSAKNRNRNFSQTCIVDKMQLLLLGRGCMCRALLWIFPSGPLSINRQGSTETESYKRIYFKKIYMFNHWPYCHEFSRQ

SEQ ID NO: 118008 - protein, 160 aa, Triticum aestivum
  Clone ID: PAT_TA_12426.pep
DEGDNPPTVAEVDTSSARGKAISRARFCHLCGTGSGYWQLVFSDPGHDRGALAIHWAGRSATTDRVVVHHFGPDSRCVGGAACERFVQMTNWDYTESLKRLQHVLEACGVNKTLVKLGVKEGDTVVIGEMEMFWNEEPKRVTARTMISRDDDAVRWPKFS

SEQ ID NO: 118009 - protein, 173 aa, Triticum aestivum
  Clone ID: PAT_TA_12427.pep
MAGEGEEDEAAEIELQLEQHLEEQRSSLAAVDAEIAADESNGDLLEVHGELLSAIKDAEEGLLHLKRSRLVKQIDEIFPNQESASLSTEAAIEPLDPDDVEPEPLEPQEFSVGSKCRFRHNDGRWYNGCILGLEGSGNARVSFLTPTSEKKAIGKFFLQQRCRFANNCRLSHG

SEQ ID NO: 118010 - protein, 303 aa, Triticum aestivum
  unsure (1)..(303): unsure at all Xaa locations
  Clone ID: PAT_TA_12428.pep
REKESTFAAGRTRRVEVERTLTETQRDEFEDMLRALTLERSQIRAAMGFALDNADAAGEIVEVLAESLTLKETPIPTKVARLMLVSDILHNSSAPVKNASAFRTKFEAAIPDVMESFNDLYCSITGRITAEALKERVLKVLQVWADWFLFSDAYLNGLKATFLRPGNSGVTSFHSLCGDAPEIEKKTSSEDNNGFRLDEDGALATGKAAATKELLSLPLAELERRCRHNGLSLCGAXEMMVARLLSLEEAEKEQVYQKDVAMKYVQGEPHRAGREDVGLNARRLGDSTGDSESDMLGLSRHSM

SEQ ID NO: 118011 - protein, 214 aa, Triticum aestivum
  Clone ID: PAT_TA_12429.pep
IKPSQFQNQAEPPLVVFSSTAIQATSCIMEPWSWVSTPSPLSLVCASPTPQKLKFEAEFRRHVDAEDQQSVEVEIWRRVEEEIAARSTSSTADRPLLLLPSPPLAKMRRCPGRFDQQPSAAPPLPVTGATPATRHVRKPPVPSPSLVRSGRVGGEGPVPADADRSRCSTEERNPAANEGRVRCVSCRRRCWREERDPGGVLWRRRGGEGRVGGP

SEQ ID NO: 118012 - protein, 123 aa, Triticum aestivum
  Clone ID: PAT_TA_12430.pep
RGPPSRSTNGKGRIAAMLWFQGETDTIRREDALAYTGRMEALIRDVRRDLGIPNLLVIQVGIATGQGKFVDLVRKAQRAVRAPNLRYVDAMGLPVANDFTHLTTPAQVRLGKMLADAYVATLH

SEQ ID NO: 118013 - protein, 189 aa, Triticum aestivum
  unsure (1)..(189): unsure at all Xaa locations
  Clone ID: PAT_TA_12431.pep
VTXSGQYMFVQCPDVSPFEWHPFSITSAPGDEFLSIHVRQLGDWTRELKRVFSAACEPPMNGKSGLLRADENTKKTFPKLLIDGPYGSPAQDYSKYDVLLLVGLGIGATPFISILKDLINNIIKMEEEDEASTDLYPPIGPSKASVDLDTLMRITSKPKRVFKTTNAYFYWVTREQGSFDWFKGIMNEI

SEQ ID NO: 118014 - protein, 93 aa, Triticum aestivum
  Clone ID: PAT_TA_12432.pep
KRRLDYREISVDRDLLDCLVLDFLKGGYFSRVMEVISYMPTHNIYCDKWKYRQAFLRLHKNLYRNLNSLHDKTEAQSKRIDDVRAFRTWAGIK

SEQ ID NO: 118015 - protein, 123 aa, Triticum aestivum
  unsure (1)..(123): unsure at all Xaa locations
  Clone ID: PAT_TA_12433.pep
XCRXFGTRLFLGRVKKHSTRVYRGRRRHRHGRLKGIARSLQEVQQRGPSDHGGTSAAGPPRAASPPPSACPACASFLPGVDRSHGERPEEQGRSAPASSPARLHVMGITSDVHDFASTGDKDS

SEQ ID NO: 118016 - protein, 169 aa, Triticum aestivum
  Clone ID: PAT_TA_12434.pep
GYSLEELPKKTGAKVRDWQRLGSFPQKIDGVELFGFKNASVQRLLRQLLVDSTGFGIDMPSPKIYGAASPSTDTVAADVSDDHKEQHVCLDKTVVTAKRSMNPIQEEGTAKRAHNQDMLTSVDNSTVELDKSARQSFNKGDPVSNSQLSVVSTPICMPPAPPELPCDSK

SEQ ID NO: 118017 - protein, 131 aa, Triticum aestivum
  Clone ID: PAT_TA_12435.pep
FFFTLSKRRGWRQNILDHEPLQHWKHLQLQMGSRETHTRTHNQTRERKKQKQSKGTRNMIKQFLYSSNIYLLGYNKHTIKLPQQHAARAKRRKGVASAMNPYEQHEGGRSQQQNPPPYLSESEQRQTRTKK

SEQ ID NO: 118018 - protein, 261 aa, Triticum aestivum
  unsure (1)..(261): unsure at all Xaa locations
  Clone ID: PAT_TA_12436.pep
GNIDDAVPFFGRRFNRIYPLIMVVYTLLVASNFFGRVIDYFGSWKMFKFQREEEHMDGFDPSGIIILQKERSWIEQGYKVGEQVIPLARFNGASTDVESGKIEDAVEMKAGTTSSRVDGRAGQSKYIHNREMISNKYSSVRDQSRQATKPVKKETVSTSASLLEEGNPENRSAAGISQTWASVKNGFQNFKANMXAKKFTPLRQDPGFAPHSNASSPESLDDIFQRIKRRSAESPVDYLDDDDDDDDNTGDMDPPFAGSRR

SEQ ID NO: 118019 - protein, 352 aa, Triticum aestivum
  Clone ID: PAT_TA_12437.pep
RGRVDVPRAFLQTLLVQDGKPYGRDLFCDVISRALSLPDIIGDKEFQSNEFVVQLGQLVTNLLKILCTNTAWQRRKLGKSLQDWSTISIQLELALKREFGETRNVLADENMCMRVSKQLLVWSQEHTYWIASRFLILGFELDLYSPSEYCMVYWYMHVVFIKLIEKMQLRILASNENSRRKGKKKKDHSKDSVRDTPFPPSCLLLQCYVLLSEGLSMLLAALRKESKSFQSPSIFNTEQERFMQHFDLLQKAQIPECITYYSFKEAAAQAYMADVMKYNFFKEIQKIIPSLKGSFASEPEKLAELRQIEQVAEHNRIALNIINHVGASDPKLRVSFEFTHHPHFAVAVVKRS

SEQ ID NO: 118020 - protein, 317 aa, Triticum aestivum
  unsure (1)..(317): unsure at all Xaa locations
  Clone ID: PAT_TA_12438.pep
RLLGGLLIEGFDERSCRSRYQFARYHRNAARVPSPYLIERLRRQEALQKKCGPGTKSYNNAAKQLMSTQSINGISDCNYLFLTIHAGMGNRMLEITSAFLYALLTGRVLLVDRYKQIANTFCEPFPGTSWLIPSDFPLSYNEFTKHSPESYGNMLQENVIRGNTYRSLASARPPYAYLHLDGDYAFHDKLFYCEDDQQFLQGVPWLIMRTDMYFVPSLFLIPSFQDELSKLFPEKDTVFHHLGRYLLHPTNDIWXSATTYYRAYLAKADKVVGIKXRIFEKKGSCKEMGSHVLEQILPVLKVKTAAKTCDDELRSDN

SEQ ID NO: 118021 - protein, 139 aa, Triticum aestivum
  Clone ID: PAT_TA_12439.pep
SMGKWIDSLLKGYQDAVRGQKEVVSAMQVGTFIAIKDLDNIRVLINRVEMEISSMVDCVDFAERDEEAVRLAGVAVTSALQAPSCCVGAPGVPADRRGRGIRRAGTVVLRWSLRLPDRVAGAMYIGGAPGRLLHRNRSI

SEQ ID NO: 118022 - protein, 77 aa, Triticum aestivum
  Clone ID: PAT_TA_12440.pep
CQAFAVCHCRQTDQMGQLPGSTGGCHVASLPSAADGKEPVAVGGRRQRACIASFFCFFLYPTIFTAIDDTYIFFKKK

SEQ ID NO: 118023 - protein, 238 aa, Triticum aestivum
  Clone ID: PAT_TA_12441.pep
RNSARGSYIAPSSRRTRQFAWRACVGLSQNSSQLALRAGFPGAPLASEEFLSPDQIPSDGRSSDADFSALRNAVVCDKKIVDNKIRYALKFPNQKHLPVRVTKNILEAEGNQDQNGKFWFSENHVPLYMVREFEQKPGVSSLPTPGIVHSFMNLYKRRVKASTGDVFSYLFHKGDIYPCSSCKKDVPFRDVIRCSDCQGYCHKECTVKSVGGKGGTAASSLICKLCLQKRNLILTNYS

SEQ ID NO: 118024 - protein, 164 aa, Triticum aestivum
  Clone ID: PAT_TA_12442.pep
MAQGPGTARSGSHAVAAISQLRSQSRALDAAATPDRCRSSISWPGSQRRDHLEYPRRRHLDPAAHPPPGPFPAPLGARTRAPRPPLLLPCQAPPLRCAPRHAPPHQKKPPALPAWRPTPAGGEPTGARRPRPSPSTAWGSTRRRLAGLGIWPPEPPARAAREEG

SEQ ID NO: 118025 - protein, 262 aa, Triticum aestivum
  Clone ID: PAT_TA_12443.pep
MNTVVPSCEKLSPQTTGCHKVSKTAKVVRNEASAGSEGCSLSDQQPKKRTYESSSSSLKSKRVRCSGHTDHTQDMRQNDICDKSLTINSTPLTPSMVVHVDNKISGDAKATTCSNGRPSVMLMNIADETKKTRLTEVVETLGGVVTCEGSSCTRVVTGKARRTMNFCIALSSGAWIVSPNWLKQSFKQGKFVGEAEHVLDDEEYKMKYKSEMRDAVMRAKERPCLLFSGYTFCLTKHIEPSPGVLSPVIKSSGGKDQSVKPR

SEQ ID NO: 118026 - protein, 289 aa, Triticum aestivum
  Clone ID: PAT_TA_12444.pep
AVNYGEGLRVSGDQRQMHSSLPSHLMEVLATGDGAHNFGDNSGAYPKNTPAFSPNNVSAQGNPMQASGGQLLGRSAPSPGTAGTPNFENVSTPPMPYANSPRSGTNMMNTPSPQQHLTPQQQRQKLMQASQQQHVRLRPSAAGMLAQSSVPQLQDLQGQAQQKVAGQQQMQYSQAQALSQFQNRQMQAARMQPGMSQSQLNQGNQLRSHLGQFTGAANSAMFTAAQASSNSQMMANIPGTMQTMQSQSMMPQMQQFGLTGGHPQRSHQMMTDQSMYHSSSFRLSSLLIN

SEQ ID NO: 118027 - protein, 90 aa, Triticum aestivum
  Clone ID: PAT_TA_12445.pep
IVHHITDTTISCIYLCRKTESERATSQTNSPKQQQPNQSIYLSRHTLEKQSWIKKHPSSIITHESKNNLRGVQAERSSSMSHHPSSLMKE

SEQ ID NO: 118028 - protein, 335 aa, Triticum aestivum
  Clone ID: PAT_TA_12446.pep
VRSCDSNFLNMDLLWQHIVSDHAHEFGLLDAPQRPKGQSVRTEGTSFKALYDNHDLGKDDGSQKLTCRLCGLRFDLLADLGRHNQVAHMDQGTVGHIPPGRGKYQLNRGRHYYSAFKKNLRPSGSLKKRSSSGVEKHFDISSSDLSMITSQVAEPETANLGKLVDFQCSDVAQTLFSKIQKTRPHPSNLDILSVARSVCCKTSLLAALEVKYGTMPENIFVKAAKLCSDIGIPINWHQEEFTCPKGCKSGYALNTLPPLQLTHVDFPTVASVMNPPENDGTWGMEEYHYVLDSEHFMWKLKNERVVLCENVSFGREKVPIVCAIDVDAKDLSYET

SEQ ID NO: 118029 - protein, 51 aa, Triticum aestivum
  Clone ID: PAT_TA_12447.pep
FFFTSKAPPILVVFHCRHRTSYVVLHRSCSRSTAHALVTLTVSSLAREIFP

SEQ ID NO: 118030 - protein, 116 aa, Triticum aestivum
  Clone ID: PAT_TA_12448.pep
MNPVTPSSPPLTDESTSVLRKAEGEYQGHRSLMMRTHGFLTMMQRQDVLDGPILTIGFLVFSLAVLYVVSRRIGLLALQRTLADAIRSGSVSAGDILAKVQEGPAPTDAPPIYDEL

SEQ ID NO: 118031 - protein, 156 aa, Triticum aestivum
  Clone ID: PAT_TA_12449.pep
SNLTLQPPKDGEWYERLAYGLPKARKSAVLVTCRSEDGARVMVRTGGVFHPPKLEGEEGWKLFHREYKEAKDKEKKEKGEKEEEDKLYKELQEMKEEIVGKCLGLPVAIVQAAKGFAALEHEPEADAKDNAAADQTATSKTEPAATEAMEANQSAN

SEQ ID NO: 118032 - protein, 244 aa, Triticum aestivum
  Clone ID: PAT_TA_12450.pep
LEWSSASRILTPVTDYEVLENLQPHQNLKELHIVRYLGATAPSWLQYAALRELQSLHLVNCRSLGVLPPLGLLPSLQQLHMKELCTVKRIGHEFYGTVDLSFPSLKVLVFDDFPSLVEWSEVRAVPFPCLQKLEIVDCPKLIQVPAFPPSVSELTVERTLLISNMRLAPYSSSRLEIFTLSVSTTSVLCRGLFHQSHLESIVVLNINAGCKQLVSAEGLHTFTSLQKLQLCHSDISDQNLGSLL

SEQ ID NO: 118033 - protein, 129 aa, Triticum aestivum
  Clone ID: PAT_TA_12451.pep
SCEGRAPGCCYGRRASGDRDVASTVVEGSSCECAARLRPVPEPASFSATTGSAGCWNQQVLMLPPAPPSAGTSDLRCCYRLCPVLELARRRVSTDAGTRRRRELLGPAINFAGTGRKFCCAQAKIVFGW

SEQ ID NO: 118034 - protein, 92 aa, Triticum aestivum
  Clone ID: PAT_TA_12452.pep
PRVRSDYDESDMMVDEEMVHSESKGDTAEECSDVDVENVIMGLSGSRVKYKELHSVVGPIDRRHLSELERQLSRYAKVVGKELSDRIVYSLS

SEQ ID NO: 118035 - protein, 650 aa, Triticum aestivum
  unsure (1)..(650): unsure at all Xaa locations
  Clone ID: PAT_TA_12453.pep
MADGASSSGARAGGRGGGGGGCGESVVIDYGRRRTTCGYCRSTGPTSISHGLWANSLKADDYQALLDRGWRRSGCFLYKPEMERTCCPAYTIRLKASDFICSKEQDRVLKRMQRFLDGELDPQVGSPQCKTNPTKRSLNEPMNSPTLKVSRVSAYEFQTTTGPTLEKRIRGSVRVLSSTSXGGGCDALPGWRCMFSSLFSLQALVPALRPLLRHKRWGLQHKKRKEEHCKIWCTHVIVKFPXLAAANLNVHCLKKNRGVLGDLSPNCIAERLVLTMEHHGEIAGFAVKACNGHLNFYSATIQPIQNHTSIDASAQASSDRPTSSKQSSANKNDARHNKKARKLEFKMARSHFDPEEFALYQRYQTKVHKEKTVTESSYKRFLVDTPIVPIRPRSGDNTVPPCGFGSFHQQYRIDGKLVAVGVVDILPKCLSSKYLFWDPDLAFLSLGKYTALKEIDWVKTTQKSCPSLEYYYLGYYIHSCNKMRYKAAYRPSELLCPVRYEWVRYDAAKPLLDKSLYSVISDFSTMAQDEIPQPHACGPCDGSSAQNDHSETPIDEDDEDSESDYDESDMMVDEEMVHSESKGDTAEECSDVDVENVIMGLSGSRVKYKELHSVVGPIDRRHLSELERQLSRYAKVVGKELSDRIVYSLS

SEQ ID NO: 118036 - protein, 83 aa, Triticum aestivum
  Clone ID: PAT_TA_12454.pep
RKQEETSGMGGGQNESIISLRNKDRSNGKANAVCLTVLVGKRNARSSPCRRNLLTHATWVQDSMNRPKHSGCLKLNRMPRFVR

SEQ ID NO: 118037 - protein, 137 aa, Triticum aestivum
  Clone ID: PAT_TA_12455.pep
MASTTESACTTQTVQGTHRFQICQFSYGNVGDEDYIRSGTFRVGGFDWVIVYCPDADGDDGVEYISVYLELMSKYAEALAFVDLRLINQVTGDACTIYAENRVPNQFKSTSFEEASWGREKFISKRALKDSGYIRDN

SEQ ID NO: 118038 - protein, 334 aa, Triticum aestivum
  unsure (1)..(334): unsure at all Xaa locations
  Clone ID: PAT_TA_12456.pep
DPRVRGALSPFGQVLQAIHCKRMGQLLKDVDAASSSYQGATDVSFDVPPPRSNDVDKSDRHGCVKESYSKKAADEPTTDKVVEPGEGARSNHASGIDHESNGGRPVEMGTRTSGEDIEHGDQLIERNDSVVSEPPAQSFENAREKVSSGEDIEHGDQFIERNDSVHTSVTGHWSDAPSMCLFQEGTEEYDWWISVQSQDPNSNAPTHGNTATTPKSCGVFDVTPQGCNIKRSRSPVYDVTPSPWVHYQVGAADGPSKAQEETVVLVXQQGTKPTXDEEKXEEQGWRTNPRVRKEXGXXSTGXXYKKLSSXTRNMYNTIHGRXQXRVXRGSVALX

SEQ ID NO: 118039 - protein, 109 aa, Triticum aestivum
  unsure (1)..(109): unsure at all Xaa locations
  Clone ID: PAT_TA_12457.pep
MERTPVMVRQGGQEVLRQLPPGFRFRPTDEELVVQYLXRKALALPLPAAVISDVHNLYSLDPWDIPGAREGEKYYFAVRPAAGARGWRTQGNGVELSQESRVVRRRQSR

SEQ ID NO: 118040 - protein, 458 aa, Triticum aestivum
  Clone ID: PAT_TA_12458.pep
PLAEADPDVHALMERERERQVRGIELIASENFVCRAVLDALGSHLTNKYSEGHPGARYYGGNQHIDAIERLCHERACTAFGLDPACWGVNVQPYSCTSAHLAVDPGLLLPNDRLMGLEPPAGGHVCLGYYTPSGKKVSGASIFLDTLSYKVNPQTGYIDYDKLEDRAMDFHPKILICGGSSYPREWYVQRMRLIADKCGAVLMCDMAHISGLVAAKECRSPFDYCDVVTSTTHKNLRGPRGGIIFFRKGKNMRKRGGSFSQGDENDYDFEDKINFAVFPSLQGGPHNNHIAALAITLKQVATPEYKAYIQQVKKNAQALASALLRRKCRLVTGGTDNHLVLWDLRTFGLTGKNFEKVCELCHISINKTPIYGDNGSISPGGVRIGTPAMTTRGCLEDDFEVIADFLIRATQIAGSVLKQHGKVQKEFLRGLENNKDIIELGNLVEAFASQFAMPGFDV

SEQ ID NO: 118041 - protein, 101 aa, Triticum aestivum
  Clone ID: PAT_TA_12459.pep
MERNGGKQQQQQQLETAAPAPAPRKAAWRDGAVTYFHLLFYIAISGGQIFFNKWVLSSKEINFPYPVALTLLHMLFSSVVCFAATKIFKVIKIDEGMTTDV

SEQ ID NO: 118042 - protein, 139 aa, Triticum aestivum
  Clone ID: PAT_TA_12460.pep
RHVMAPPSSRGAWVVANDAAFPRRASLSSEVEVVVDGDGCGRGPFLRCSHWSMRGRRRRQRRWTGGLQLLIRPRVGGSIDGPRGCSCGGVVDRWCADAELGGAVSWIRGVFLDLQVGMWDPVADGVCVSHGGAMGVRWC

SEQ ID NO: 118043 - protein, 96 aa, Triticum aestivum
  Clone ID: PAT_TA_12461.pep
HEENSLPVSTPPAPPLSSPVTSRLELGSAPAPLATPSPCVVATLVLLDLAQALTKKIEAIATMSRTAMTAPRSFAGADDFFRWRATCSWRCQCQLP

SEQ ID NO: 118044 - protein, 273 aa, Triticum aestivum
  Clone ID: PAT_TA_12462.pep
MSSSGGGGAGQQFRYTQTPSKVLHLRNLPWECTEEELVELCKPFGRIVNTKSGVGANRNQAFVEFTDVNQAISMVSYFASSSEPAQIRGKTVYIQYSNRQEIINNKSPGETAGNVLLVTIEGVQASDVTIDVIHLVFSAFGFVHKIATFEKAAGFQALIQYTDAPTASAAREALDGRSIPRYLLPDHVVSCHLRISFSAHKDLNIKFQSHRSRDYTNPYLPVNSSAIDSTLQPAVGADGRRVEAEGNVLLASIENMQYAVSVGCSSNTVPPAF

SEQ ID NO: 118045 - protein, 261 aa, Triticum aestivum
  Clone ID: PAT_TA_12463.pep
GLAGGRARPSCDHGFNKASAVVNSGLLLMAVLGLMFPAVLHFTHSEAHYGKSEVSLSRFSSCIMLVAYASYLFVQLRVRRSLYSPIGEEEESTEDEEDEKEIAQGEAISWLFVLTIWISILSGYLVDAIQGAAESLNMPLAFISVILLPIVGNAAEHASAIMFAMKNKLDITLGVAIGSSTQISMFVIPFCVVIGWMMGEEMDLNFQLFETATLFITVLVVAFMLQEGTSNYFKGFMLILCYLIVAASFFVHVDPKSSDNK

SEQ ID NO: 118046 - protein, 284 aa, Triticum aestivum
  unsure (1)..(284): unsure at all Xaa locations
  Clone ID: PAT_TA_12464.pep
MDAAKDPNPSCKLHTRLRLWEFADRYIFEPIDGLADLYLTVSRASGSMNSVEELPPRSPSRFPCVRTAHAGSGVLFLAGRSPCLGGTVRGAGGSYRGRAICPAPRRLALRCFRALNTSXSEISELLDAAEKTMGLYFSYDINLTLNSQRLSDVADEVXVDDVGDSRPLWRQAEPRFLWNSVRLEPLIENKLDQYLLPVIQGSFENIQAEVGSEKVNVTLIARRCTGRIGTRMWRRGADSEGYXANFVESXQIMQSKGYTASYVQGRGSLSFLWEHIGDLHTNLA

SEQ ID NO: 118047 - protein, 151 aa, Triticum aestivum
  Clone ID: PAT_TA_12465.pep
TRPSAHRCIHGMHPAKKVAFVYAATGRRFLGCPLSGDDMCHWFLWIDEPWGPVLSRSIKNLWDQTSRVADRAAMLETKKKEMEHAYLDLWTERSNMEIEHEQVVNGLKNRLVDNEIKMSRRLDFHIKLCVASISSAVTLASVLAYVLSTLT

SEQ ID NO: 118048 - protein, 156 aa, Triticum aestivum
  Clone ID: PAT_TA_12466.pep
PAQWPPHDRGRFHVNFLATPKSPCGGKPTLFFAEIQSDGTYDSFCCPVALPLPCAAQIRCVYCEAMGTRIVHPVAINFRGRDSAFEMLAREKDPCQREEATLRIISHRRLMAENVHCKEKEDILYDGVDGHRNKFDNVSSLKVEEAMLLAPLCRYL

SEQ ID NO: 118049 - protein, 622 aa, Triticum aestivum
  unsure (1)..(622): unsure at all Xaa locations
  Clone ID: PAT_TA_12467.pep
RVRPTPRANSQTIEARVLDRVHKRPSIHAPMNPNLNYQRNGDPSPASYESRVYLVSTSKSITRFVGLEGLEGPDNCEGDMYYXYGYDPNGPYPLGSHVPTVGHDGLSYGTQQYQYPGQYYQQPAPTNAMHGVNSANPQSELPSAAAHQARATVVSAKVTTGTASGIANAASSLPRKQTHHHVSVTNSGSYGRGPSQGGPSASNFGHTGHRSPAQWYDGPVYSNGHHGSIASSTSYGSNSSSAKNQSHRPPTKLMGMHTHVPSSXVGLTGSRGPSSMLYTCXHRADYWPLGNTLKAGLGFXGSNVYNSRNNGQWGVVDTVKYKPRNRATFGFGSENQDGFTELNRGPRSGGFRHQKPFGPTVTIAVKGQVLPSAGKQDNSVLPDKSQFNQEGFSATYKDAKFFVIKSYSEDDVHKSIKYNVWASTPNGNKKLDAGYREAQEKSSECPVFLFFSVNTSGQFVGVAEMVGPVDFDKTVDYWQQDKWNGCFSIKWHIVKDIPNNILKHITLDNNDNKPVTNSRDTQEVKLEQGLQMLKIFKEHVSKTSILDDFAFYENRQKLMQEKRAKQQPLQGQGVDEKEKSAVNGNSAAQKQTPSKESTTPAAGEEPNASKPTTAESGGASAN

SEQ ID NO: 118050 - protein, 170 aa, Triticum aestivum
  Clone ID: PAT_TA_12468.pep
VLAGCHRPVSTPGGFHRQPLTFRSAPPGIITSRSSQPWHADRFKMLVLDAGSKLVAVARRRHRVACAGDGRHLPLGLCTQLTGSTQRRPDGQRDARSTGIIPLKRGTTEDGAEWGGCGSIDEDQSARTLGAAALDLVDQDINHPGLFEGGFDQARSLLSRLREGDVGCKT

SEQ ID NO: 118051 - protein, 275 aa, Triticum aestivum
  Clone ID: PAT_TA_12469.pep
STHASASTPASKIQRTPMVTPGGSSRAQEEKILVTVRVRPLSKRELAMKDQKVAWECADSQTILYTGPSQDRAAPTSYTFDKVFGPACQTDLVYEDGAKDVAMSALTGINATIFAYGQTSSGKTFTMRGVTESAVRDIYKHIDNNPEREFIIKISAMEIYNENVKDLLRPDSGPLRLLDDPEKGTIVEKLDEEIAKDSQHLRHLIGICEEQRQVGETALNDASSRSHQIIRLTVESRLREASGCVKSFVANLNFVDLAGSERAAQTHAIGARLKE

SEQ ID NO: 118052 - protein, 462 aa, Triticum aestivum
  Clone ID: PAT_TA_12470.pep
AELCYYIQFIHDETQLGQLLKDLEYDAESKQRVDKSKGDVDKDSISKRLEEIYKRLEFIDADAAEARAASILAGLSFTPEMQCKNTKSFSGGWRMRIALARALFIEPDLLLLDEPTNHLDLHAVLWLETYLLKWPKTFIVVSHAREFLNTVVTDVLHLHGKKLHAYKGDYDTFERTREEHLKNQMKAFETNEKARGHMQAFIDKFRYNAKRASLVQSRIKALERMEHVDAVVSDPDYKFEFPTPDDRPGPPIISFSDASFGYPGGPILFKNLNFGIDLDSRIAMVGSNGIGKSTILKLISGDLQPTSGTVFRSPKVRMAVFSQHHVDGLDLTVNPLLYMMRCFPGVPEQKLRSHLGSFGVTGNLALQSMYTLSGGQKSRVAFAKITFKKPHIILLDEPSNHLDLDAVEALIQGLLIFQGGVLMGSHDDDRSTGSVDELWAVTDGKVAPFPGTFKEYKKMLTT

SEQ ID NO: 118053 - protein, 165 aa, Triticum aestivum
  unsure (1)..(165): unsure at all Xaa locations
  Clone ID: PAT_TA_12471.pep
RVGKEKETSLHNAKRRSQGVQLPAFLRDALSHALSFPSVXRALVYSTCSIHQAENEDVVSSVLPLASSLGFELATPFPQWRRRGLPVFHGAEHLLRTDPEDDLEGFFIALFVRKAAAADALEPSEDGCALGRKRKRACTTRSGGLRAFSSLRLSRMDVLCSIWGI

SEQ ID NO: 118054 - protein, 121 aa, Triticum aestivum
  unsure (1)..(121): unsure at all Xaa locations
  Clone ID: PAT_TA_12472.pep
ACCSRLLPPLTLCLPSLSSFALPLAVFRVISRSGALTARVSGAAWGSCVALLSPAPVAVSVLPFFMVXSIFLQCTAIVGVVAYNNHKLKPQVNQQQGADSKVSPGSPRHVEIPLNSTKESS

SEQ ID NO: 118055 - protein, 263 aa, Triticum aestivum
  unsure (1)..(263): unsure at all Xaa locations
  Clone ID: PAT_TA_12473.pep
MHRLRRPRVNQXDMNRGHISSSELIDAKLEEHRXSTARHCPNCRHKLDCKPKDWLGLPAGVKFDPTDQELIEHLEAKVREEGSRSHPLIDEFIPTIDGEDGICYTHPEKLPGVTMDGLSKHFFHRPSKAYTTGTRKRRKIQTECDVHKGETRWHKTGKTRPVMANGRQKGCKKILVLYTNFGKHRKPEKTNWVMHQYHLGDLEEEKEGELVVCKIFYQTQPRQCSWSASSDRGGAGGAVAIAAAAAVTVQEQRMRDSGSGSSS

SEQ ID NO: 118056 - protein, 204 aa, Triticum aestivum
  Clone ID: PAT_TA_12474.pep
LGHHTPRWLSLFKLKIWWMAPKTGADAAGVPAETQMLLLEKTGNGAEDTVYALMLPALDGDFRASLQGCPENELQFCFESGDPDVQTKDAVDAVFVNSGDNPFKLMKESIKILSKIKGTFSHIESKETPANLDWFGWCTWDAFYKAVNPVGIEEGLQSLREGGAPPRFLIIDDGWQEIVNEFKEVDGALLEETVFAERLVDLKE

SEQ ID NO: 118057 - protein, 194 aa, Triticum aestivum
  unsure (1)..(194): unsure at all Xaa locations
  Clone ID: PAT_TA_12475.pep
FGTRDLDSRNLSVNPCAAEMEETQCVKSNSAAVHMSHKWVPIGKKDITHLDVPEASVVEASVPANDVSVSANIQVQRNVSDAPASTKCEGSEVATELTATPKLSGQLDSKCQGHTGNGTVFSKIREAVSDAHRAQQSAEDIQLHIGRPLADFEQFIYSASPVLHCSPCPTGCSSSSQEWVXRWLVLSSXLRISL

SEQ ID NO: 118058 - protein, 59 aa, Triticum aestivum
  Clone ID: PAT_TA_12476.pep
NLSTSKQYFLWFHLILNFVFCLFPLTFFSFGLETKRLSVSVDLRCGKFSIRIAGGCDLQ

SEQ ID NO: 118059 - protein, 248 aa, Triticum aestivum
  unsure (1)..(248): unsure at all Xaa locations
  Clone ID: PAT_TA_12477.pep
VCPFIFGINHVQPNLQGAWLSKIKLPNNWTMEHIRQLVTLWARLRAIPLAVDXKDTITWKHTASGIYSATSAYSAQLLGLVSSPMGFAVWKAWAPPKMKFFAWLAIQNRVWTADRLERRGWPNXGLCPLCKQTLETASHIFFKCRYSIRLWGLIKGWLKLDYLDISSWITMRSIKDCWLNMSNSSMPNRKAMASLAMLTCWTIWCERNARVFRHKSTLPSVLFSNIKTDANLWVIAGAKHLGQIMPGE

SEQ ID NO: 118060 - protein, 436 aa, Triticum aestivum
  Clone ID: PAT_TA_12478.pep
MLHKVSSAQESLMETAKSGRKRAGKKKASNAVSFFMQLTVDSAKMVEEGRLKRAVARRNEENPGVAPIVPEALTEQERAALVQCEIAREKILSRERSLLMHAERLWEKEERPRSPPGPNQEDESEQDYNRYRLIWDVKRSKQHGSFEDTTSIPAMCFTDIPMPHFAANQTTLRFVPVKVTEITGGLQWPLDVFGMIAMRDDLDHNRNIIFNRSRDNCQTLTQQGQHLVLTGPARAVVHEGHPSVYFEAILKVKGATCSEDRDLSLLISRCNIRQSPSKSLVGTRCYRSKLSTLELAYGIIVACAEATIAVEVVEGSWPQGFHGQLTACTANVPHMKVLLLDSGEKEAVAGDSGKMELSRRVVSVERSGRLMVCALLSRGGEKVVEAETSFAPLEAGRSHGMLDVGSCKLRVTVAWSPILKGYPLRGFSPTFQRGCC

SEQ ID NO: 118061 - protein, 79 aa, Triticum aestivum
  Clone ID: PAT_TA_12479.pep
LKIPSHIMSWIENLVRLSDENTYRLCADTKHHDGSPKIRCVKEEGRGEDLQPRAGTRAGIVRVWMAAEQAQRNRTYGLA

SEQ ID NO: 118062 - protein, 343 aa, Triticum aestivum
  Clone ID: PAT_TA_12480.pep
GEGKEINLEERCPRSKLLSQCIKYLGPKEREEYEVVIEDGKFMYKNSRQILDTSGGPRDAKWIFVLSTSRNLYVGQKKKGTFQHSSFLAGGAASAAGRLVVEDGVLKAIWPHSGHYRPTEENFQEFQDFLRENKVDLSDVKMSPTEEDEEFWSRLRSIPSERCTDADKPEEEMVPAAETIPCLAPQVTETTPENVIQLQETSKDHSQPEIFTRLDSSKGAVNIEKSTTSMPEDHQEDSDDDHSAVPREKVIGRVNSYQLGKQGSFKWTTGAGPRIICVRDYPPELQHRALEEVHLPPRRSGRPTSRFSSPQRGGSPMSRGCEPLAPREAFHATHLQQGLLISL

SEQ ID NO: 118063 - protein, 118 aa, Triticum aestivum
  Clone ID: PAT_TA_12481.pep
PPPLPNGEHVGDPVITTPYPAASSSPLALAASLSGKEHSIASSPLPLAASLPPSYSSELITLSADFSLSKPPSTSREPRTSPGVLRRQTRTTRVLLRAERRRRSHGEGRHRAGNARNK

SEQ ID NO: 118064 - protein, 166 aa, Triticum aestivum
  Clone ID: PAT_TA_12482.pep
DSARGTCTLAFQTDPRACPALLLELAAPTGALVREMASGLVRIALECERAKAATGGGDGGGRKLVEETVWRAYVNGKSCGYAVRRECGAADWRVLRALEPVSMGAGVIPAASCGGGEGDVMYMRARFERVVGSRDSEAFYMMNPDSSSSGSGINGGPELSVYLLRV

SEQ ID NO: 118065 - protein, 129 aa, Triticum aestivum
  unsure (1)..(129): unsure at all Xaa locations
  Clone ID: PAT_TA_12483.pep
MSCSVSFQVPLAIGKGRRRELWEKETGFADHVQRQKLISCLPSTFDIIFLIYQSRQRTVLTKQELIHKIIESNPKIVDKGEVEEQVRLLLEFVPXEWISEKTARNGDVLCWCQYRTEPLRFDKGLSRVV

SEQ ID NO: 118066 - protein, 114 aa, Triticum aestivum
  Clone ID: PAT_TA_12484.pep
PVESLPLNRIKLLPSGIYVCKCGFDWCLGRLQNQLLTVGRLGQDSTIDRDELGASILGHDAHQLATRRALRPPGHCSCRCGPMAGEKKSHGQWKTLSSELFSSRPLSWFKLRAA

SEQ ID NO: 118067 - protein, 65 aa, Triticum aestivum
  Clone ID: PAT_TA_12485.pep
NFQEPIHCRCSAHFTISRVAQQPYTDKHHVHAWSVARGAICSVPANKPHQIKSRLSSFKSLMLFM

SEQ ID NO: 118068 - protein, 274 aa, Triticum aestivum
  Clone ID: PAT_TA_12486.pep
TSGLDDYPRASHPNDDERHVDLRCWMLLATKCMRLIAELLKMDTYLEKDYYNLSIQLSDFGTLNKMHLDVKSGGYFDYGKHTEKVRLRWYELEGKYAMRRVLLRETLQPHLQLVPHVGYVSLFPFMMGAIPPESWVLEKQLDIISDRSILWTDYGIRSLSRTSSMYMKRNMPHAAPSWRGPIWINMNYMILSALHHYSHADGPYMGRAGELYDELRSNLIRNIVHNYHETGFFWEKYDQKNRGKGKGARSYTGWSSLIVLIMSESYLSIADLSN

SEQ ID NO: 118069 - protein, 144 aa, Triticum aestivum
  unsure (1)..(144): unsure at all Xaa locations
  Clone ID: PAT_TA_12487.pep
AQERRPWRLPPIICIPEKINLKLQAHSVSLWSPSQSTAIEQFFSYHILPMAASPASTVSHPLSPPPRRVEERSKLREGQWGVEGAGSRKTCRPCCRSAHFIYFLKISKEVVIHLARKTKAMEYSVSISRPDLPXWIHXLESHKR

SEQ ID NO: 118070 - protein, 88 aa, Triticum aestivum
  Clone ID: PAT_TA_12488.pep
PGPFPVHVLVAALGVNQTNPSKQCVHVDVLAVNRRQWRAPAKKTRGVPLDPVPTKVGIQLQSLVSTSSSICCDSEHIVAPLLHSAKKK

SEQ ID NO: 118071 - protein, 116 aa, Triticum aestivum
  Clone ID: PAT_TA_12489.pep
WITVPYPFQWGALTFHAAESFAMMAAAFVALVERYGYEDDVLKKHHRLQCHHPPRHAEDTPKSSLYCIQDGEVERLKVESPDPQRHQLRRRPHLRSSSRSPMAVWSGPAAAMDGDA

SEQ ID NO: 118072 - protein, 228 aa, Triticum aestivum
  unsure (1)..(228): unsure at all Xaa locations
  Clone ID: PAT_TA_12490.pep
MXNATVKEFGXLTQLCKLKVGGLSYRNISELWSAIAGHNQLQSLSVEMGYPYEERNVLDGCLGEGLLPPSSLESLTLHGKLVNVTGWTHTLQNLSKLVLKWSRLKQDDDAIQALGLLPNLAVLRLGVDSLYGTQLHFESSSFPSLMVLELYGLGNLRSALFEKDAVPKLELLQVGRCAELEAFCGLPALTSLKEIQLDSHCLSETLKELVQSQVAEHMKHVRVNFVDL

SEQ ID NO: 118073 - protein, 189 aa, Triticum aestivum
  Clone ID: PAT_TA_12491.pep
HASGRNCGKSGHIAKDCTAPPMLPGEVKLCNNCYKPGHIAVECTNEKACNNCRKSGHLARNCTNEPVCNLCHVAGHLARQCPKSDEINERGGPPPFRGGDALFRGGDALFRGGDAPFRGGDAPFRGGGGALFRGGYSDVVCRACNQVGHMSRDCMGGAFMICNNCGGRGHMAYECPSGRLLDRFPPRRY

SEQ ID NO: 118074 - protein, 273 aa, Triticum aestivum
  Clone ID: PAT_TA_12492.pep
MSSRSPPPRDRRMRTERTSYRDAPYRRDRDGRRGPSRSASDLCNNCKRPGHFARDCPNVSVCHACGLPGHIAAECSSKDLCWNCKEPGHMANACPNEGICRNCGKSGHIAKDCTAPPMLPGEVKLCNNCYKPGHIAVECTNEKACNNCRKSGHLARNCTNEPVCNLCHVAGHLARQCPKSDEINERGGPPPFRGSDALFRGGDALFRGGDAPFRGGDAPFRDVGCALFHQGYHDVVCRACGQFMIMSRCCIRGHMAYECPSGRLLNRFPPRRY

SEQ ID NO: 118075 - protein, 65 aa, Triticum aestivum
  Clone ID: PAT_TA_12493.pep
VALPTTRKVSYFFLPVNLPLIPSIMEYHLECIFPLKKGFALTSLNLLEMPRTEFIHLPSSPTPHS

SEQ ID NO: 118076 - protein, 261 aa, Triticum aestivum
  Clone ID: PAT_TA_12494.pep
RPRKYPLEKGTPPPWWPAGNEEWWAALGLPRGQIAPYKKPHDLKKVWKVGVLTCVIKHMSPNFDKIRNHVRKSKILQDKMTAKESLIWLGVLQREERHVHGIDNGVSEITHRSAPEDRNGTRNAHSSSNEYDVDGFEEAPLSISSKDDEQGLSPAAQSSEEHVSRRDRERANTKHLYQAVVLKEGTKKQPPKRKRARHSSVAVEQEVQRTDDAPENPGNLIPDMNRLDQVEIPGMANHQITSFNQMAVTSEALQHRGNAQG

SEQ ID NO: 118077 - protein, 299 aa, Triticum aestivum
  Clone ID: PAT_TA_12495.pep
GGDPGYWLDLQCSADNSYSGFSWRLFSCFCTSMAWFWKKVPRVRSSVDSGGLGRDGRMLTKAGDNGGKAEESRVDKAKRKAEEKRLARLEREMLEEEERKQREEMAKLVEERAFPSSSSPEAEERSKGATPVGEKDSRKEAERRRQERRRKEDKGSSKSNSDCEDVERRVSREGERKRDFDRRNETDRRDAARVGTDGHKPNNFEANSQGSKIAQSKTKYFGRMTGGLLSSSRGFGGGSFFGRSAQAPVHQANKVTKPLVTATDESIKRDTQPAATPAMVKSATAGETRNSLTNLMSTC

SEQ ID NO: 118078 - protein, 205 aa, Triticum aestivum
  Clone ID: PAT_TA_12496.pep
EAPTSPPLPHPPPPPPPPSYSRHDPLLPTPTRPPPAPSWPDLANPQTDRGLTLPQLAPAAHPDGGENHQPILRPQRRRVPRIDAAPTARVTRRAGCGCCRSSELCALVAGPAGAGLAVTLDWVVSNCPGVGGDETVLPPLSSSLLISASAGARVHVIIVSLWVPSWLGLDAWIFCNPEELATQKWMTVNRRSYGFLICCYVYVLS

SEQ ID NO: 118079 - protein, 240 aa, Triticum aestivum
  Clone ID: PAT_TA_12497.pep
LAPVRIEVEADETTLSCFASGAKHEAGYDAFMTGCVFAQLCAHIGVKFEDFTPKESLEMNKKLTKYINLLPPSFNSGTVLDLRTGMERPDACYKLRYPAAVHDNTVLIWGFQSGLSAKAIKGCICKVFGSASVTTVFSIDSTAVLVQFSTQESVNDFMDLKATLEKQDSAISVLHPLSTILEGGQTHAANYDTYTDICSSSVTKYLFADQANAVCSTSISELGGENVVDGDALGTNSVLC

SEQ ID NO: 118080 - protein, 57 aa, Triticum aestivum
  Clone ID: PAT_TA_12498.pep
LALGKFTLSPVLKSILSSSLVPWCGLEVRSISANTEGLLFFGKRTEIYYKDVLMSLF

SEQ ID NO: 118081 - protein, 186 aa, Triticum aestivum
  Clone ID: PAT_TA_12499.pep
MDRPQVVSENYANPITCLFHVLFKASALAFYILFSLFVKSFVIIFVITVLLAALDFWVVKNVSGRILVGLRWWNEIDDDGNSVWKFECLDGESLARMNKKDSWLFWWTLYLNAAAWIILGIFSLIRLEADYLLVVGVCLTLSLANIVGFTKCNKDAKKNIRAFAENAAQNAITSRITSSLQSAFGI

SEQ ID NO: 118082 - protein, 230 aa, Triticum aestivum
  unsure (1)..(230): unsure at all Xaa locations
  Clone ID: PAT_TA_12500.pep
GNSISVAAEVPRKKSNGDKVSEQEGVNGDDVNKEGGNGTNDKPKDGKEKKIRDLKKDPKQKSLNDAKEKKKSDEPPKHPGFILQTKKSKESKLRPISLSLDGLLDYTTNDTEESVFELSLFAESFSEMLQFRMGCIILSFLEKLHXTMLQRRTRRKRTREDDLTKEGTKSSEKRSKTTEGAHIESTPPGGRAPKNDKITEDDKKKMSIDQIPLPATRDEPVAAEKMEDED

SEQ ID NO: 118083 - protein, 196 aa, Triticum aestivum
  Clone ID: PAT_TA_12501.pep
AFPLTKMIGGGWRRGGEERATDGESATAGHSKRSSGKSVLSEELYQGVYMAANSIQESILWIQAQEKKMVAIGCRGDSADHKNLLELKSGLSELLEKLLRLAESETQRKIRAQQNACWIGNKGKAEKRIRSMKSMDSQSKIAEDAEMEFVGKSSKRTSSQSRSVNKQSKICDGGKSIFNRFREQELQAMKELFEEL

SEQ ID NO: 118084 - protein, 170 aa, Triticum aestivum
  Clone ID: PAT_TA_12502.pep
LSLPLFHYSRGAGHLSSAHGTATPNLRSNDAPVTEATAGALLLFHYGSQTTRIPRHLPLRRPDQFEFGQHEICRGRGPRPRIWPSEIIFFIVFVREAGSRPVLAFLLVVHLFQICMFLVIFLFCSFYSFGTADLAGFAGVHVCIKASRGCSLWWCRRALLLYLLLGRASC

SEQ ID NO: 118085 - protein, 274 aa, Triticum aestivum
  Clone ID: PAT_TA_12503.pep
MAAATAAAVSSPAVTAPLPRAASSAARRGFVSFSGAAARPSALRSDRLRAAAAGFSSGVRTHVAAVEQAVVQDATEVEAPVVVVTGASRGIGKAVALALGKAGCKVLVNYARSSKEAEAVSEEIEASGGQAITFGGDVSKEADVESMMKAAIDKWGTIDILVNNAGITRDTLLMRMKKSQWQDVIDLNLTGVFLCTQAATKVMMKKKKGRVINIALVVGLTGNAGQANYSAAKVDHWFTKNCEDEHQNSTDQRPRIGRLKTATPWCTIRLLGLR

SEQ ID NO: 118086 - protein, 151 aa, Triticum aestivum
  Clone ID: PAT_TA_12504.pep
PSLHTRCSQQRNDAKTPPSPVQDLGFHLETATQARREDADTPKRRLQGGERRPRAPSSRHRSKTAGFSSLTSPTCHPSRRNKACLCWITPPPPQHLAIVVIASQNTRYPAWRGHTFQQPPPSRSEEEHHQHISHIQHGQELHHLLAVHTAA

SEQ ID NO: 118087 - protein, 149 aa, Triticum aestivum
  Clone ID: PAT_TA_12505.pep
MADQLTDDQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYEEFVKVMMAK

SEQ ID NO: 118088 - protein, 41 aa, Triticum aestivum
  Clone ID: PAT_TA_12506.pep
FFFVFFFFFFFFFFFFFFFFFFFFKKQLSLCQLVLLLQWSG

SEQ ID NO: 118089 - protein, 149 aa, Triticum aestivum; identical to SEQ ID NO: 118087
  Clone ID: PAT_TA_12507.pep

SEQ ID NO: 118090 - protein, 58 aa, Triticum aestivum
  Clone ID: PAT_TA_12508.pep
VFDKDQNGFISAAELRHVMTNLGEKLTDEEVDEMIREADVDGDGQINYEEFVKVMMAK

SEQ ID NO: 118091 - protein, 181 aa, Triticum aestivum
  unsure (1)..(181): unsure at all Xaa locations
  Clone ID: PAT_TA_12509.pep
MADQLSEEQIGEFKEAFSLFDKDGDGSITTKELGTVMRSLGQNPTEAELQDVINEVDADGNGTIDFPEFLNLMARKMKDTDSEEELKEAFRVFDKXQNGFISAAELRQVMTNLGEKLSEEEVEEMVREADVDGDGQINYDEFVKVMMAKRREKRIEERRAPSAKKSAAGASGAKGNKCIIL

SEQ ID NO: 118092 - protein, 66 aa, Triticum aestivum
  Clone ID: PAT_TA_12510.pep
GVPLPYSFRAGSCSSCAGKLVSGEIAQSAQSFLDDAQMEAGWVFPCPAYPKSGIVLETPKEGGLPA

SEQ ID NO: 118093 - protein, 149 aa, Triticum aestivum; identical to SEQ ID NO: 118087
  Clone ID: PAT_TA_12511.pep

SEQ ID NO: 118094 - protein, 142 aa, Triticum aestivum
  Clone ID: PAT_TA_12512.pep
MLDCLSLLDLREWRSLIGGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMVREADVDGDGQINYDEFVKVMMAK

SEQ ID NO: 118095 - protein, 170 aa, Triticum aestivum
  Clone ID: PAT_TA_12513.pep
RRNKCSLSSEESDSINSYLACDSSKNDVGGPPVEVSERIHDGHVEPSHDSVQGNGKIFTDHPEKDDSARTKDHMDACKSDELDKTENNRNAQGTGNNAPKSGKGVLKSVAGGITLIGAVFFVAHLRRSKGISFTTILPSLSEKSIQSDSRAKNVDNGKTTEVYPGGWLKV

SEQ ID NO: 118096 - protein, 73 aa, Triticum aestivum
  Clone ID: PAT_TA_12514.pep
LRFLLYVCSPKPKSKVLQELSPVLFTLMKSTEPFQDEYYMLDLEEALSQAGFVNVCSVLTDPRHRTVTATVPY

SEQ ID NO: 118097 - protein, 173 aa, Triticum aestivum
  unsure (1)..(173): unsure at all Xaa locations
  Clone ID: PAT_TA_12515.pep
FFFFFFFFFFFFFFFFFFFFFFFLDTTIASIYIFRYVQYKLHIHISKLAIKTQAVKKERGKLKEHAATAHGYTGNRPAGNLAGLISLGAPEQQVHHLGRLAVAAVAILRAPPQLPSXGPAPARGRCCLCSPSRAGTRIARSRPHPPSRPLSLMLSITPARSSAVQLGLYPALN

SEQ ID NO: 118098 - protein, 104 aa, Triticum aestivum
  unsure (1)..(104): unsure at all Xaa locations
  Clone ID: PAT_TA_12516.pep
MAYVDHAFSITDEXXLVXGAAGXXPRGAPVKEIAFAAALLAFGALGVVAGLVMAGHRVGGDRSHGIFFTVLGVVMFIPGFYYTRVAYYAYKGYQGFSFANIPPI

SEQ ID NO: 118099 - protein, 98 aa, Triticum aestivum
  Clone ID: PAT_TA_12517.pep
PKVKCDIYYRSFRVKNCIGDLSLFIIQSNFLIKKKKMGAHLPRLPQVRHRHRDPQGGGAHRISCYTYLSLQRDRADIILSPYHACIDMARYSDLFVLE

SEQ ID NO: 118100 - protein, 102 aa, Triticum aestivum
  Clone ID: PAT_TA_12518.pep
MNTDITASVKPEYPVVDRNPAFTKVVANFSTLDYLRLSTISAVSVTVGYLSGIKPGIRGPSMVTGGLIGVLGGFMYAYQNSAGRLMGFFPNESGVTRYKYKL

SEQ ID NO: 118101 - protein, 157 aa, Triticum aestivum
  unsure (1)..(157): unsure at all Xaa locations
  Clone ID: PAT_TA_12519.pep
MADQLTDDQIAEFKEAFSLFDKDGDGCITTKELGTVMRSLGQNPTXEAELQDMINEVDAXMGNGTIDFPGFLNLMAXRKMKDTDSGGRLKEAFRXFDKDQNXFISAADSGHVMTTPARTNGDKSTDVRETRRDAVTTRSSVMMAMITMYVVEYFGRR

SEQ ID NO: 118102 - protein, 138 aa, Triticum aestivum
  Clone ID: PAT_TA_12520.pep
MPSFSFPALSATPRRAWISIVFFPLLFLAPGERKTKADLPLPVCRQGKRGDCRRGASHEPMDASALNDPRFQALLEEEKKKAMMNEMIAKLTDTCWDRCITGSIGSSFSNSETSCLSNCAKRFIDVKMLTMQRANSSS

SEQ ID NO: 118103 - protein, 149 aa, Triticum aestivum; identical to SEQ ID NO: 118087
  Clone ID: PAT_TA_12521.pep

SEQ ID NO: 118104 - protein, 232 aa, Triticum aestivum
  Clone ID: PAT_TA_12522.pep
FGTRGRRTPPAKSASAPASATTTSSSPTRSTTASGPSSLSPPAPGTGASGTTSARPRRSSRSPGSARGDAPSSAPPSATSSATPRRRAASTSSPRPRRSRTARTGRSARWRATSASPASTSPPRRWPCSTWCPATAPTRSPGPGRASSTPTRWATTGHGRMTLLRSQGAAEVVMWDPLEQLVLAADFDGRVTRSIGPLSGGMYYLDFIPYVNSYTEIYISLSLLKKSPLPRR

SEQ ID NO: 118105 - protein, 113 aa, Triticum aestivum
  Clone ID: PAT_TA_12523.pep
FGTRRPLLPSFLPPPPSLSPQSRSTSPPLSNPSFPSPAVAPSFARPLLLPSSRVSPQRHESQRPTPSLRPPRQPPSLRVRVPSVSAPAPSPSPFMGGDPHPAPQQGRGGGGLV

SEQ ID NO: 118106 - protein, 183 aa, Triticum aestivum
  unsure (1)..(183): unsure at all Xaa locations
  Clone ID: PAT_TA_12524.pep
MADQLTDEQIAEFKEAFSLFDKDGDGCITTKELGTVMRSLRARTPREAELQDMINEVXPDGNGTIDFPXFLNLDGEEDEGHTXEEXLKEASACFDKDQNXFISAAELXQVMTNLGEKLSEEEVEEMVREADVDGDXQINYDEFVKVMMAKRREKRIEERRAPSAKKSVAGASGAKSGSKCTIL

SEQ ID NO: 118107 - protein, 78 aa, Triticum aestivum
  Clone ID: PAT_TA_12525.pep
MDASALNDPRFQALLEEEKKKAMMNEMIAKLTDTCWDKCITGSIGSSFSNSETSCLSNCAKRFIDVKMLTMQRANSSS

SEQ ID NO: 118108 - protein, 92 aa, Triticum aestivum
  Clone ID: PAT_TA_12526.pep
MREDIPYIFTPQGKLQPAERKKGLLCVASSPCLDIKDEHRISVDVCARKVVGCKVYELVEPPREDITSRFVHAWPLPSALCSAARQRHATMR

SEQ ID NO: 118109 - protein, 173 aa, Triticum aestivum
  unsure (1)..(173): unsure at all Xaa locations
  Clone ID: PAT_TA_12527.pep
MDGDADXLKSGRHGAGDVCQICADGLGTTLDGDVFTACDVCRFPVCRPCYEHERKEGTQACLQCKTKYKRHRGSPAIRGEEGDDTDADDGSDFNYPASGTEDQKQKIADRMRSWRMNTGGSGNVGHPKYDSGEIGLSKYDSGEIPRGYVPSVTNSQMSGEIPGASPDHHMMSP

SEQ ID NO: 118110 - protein, 298 aa, Triticum aestivum
  unsure (1)..(298): unsure at all Xaa locations
  Clone ID: PAT_TA_12528.pep
FKMHARGWRSIYXMPSDRFQGSAPLNLSDRLXNQVLRWALGSVEILFSRHCPIWYGYGGRLKFLERFAYINTTIYXPLTSIPLLIYCILPAVCLLTGKFIIPQISNIASIWFISLFISIFATGILEMRWSGVGIDEWWRNEQFWVIGGISAHLFAVFQGLLKVXLAGIDTSFTVTSKASDEDNDFAELYMFKWTTLLIPPTTILIINLVGVVAGTSYAINSGYQSWGPLFGKLFFAFWVIIHLYPFLKGLMGRQNRTPTIVVVWAILLASIFSLLWVRIDPFTTRVTGPDIQMCGINC

SEQ ID NO: 118111 - protein, 75 aa, Triticum aestivum
  Clone ID: PAT_TA_12529.pep
MGSFARAARFLVLLQIVLFVISAVLMSGPVCHGARPGIGGGALDPNRPTVTVPPGDPYTGRRCSSLYRCSPSVQP

SEQ ID NO: 118112 - protein, 139 aa, Triticum aestivum
  unsure (1)..(139): unsure at all Xaa locations
  Clone ID: PAT_TA_12530.pep
MADQLTDDQIAEFKEAFSLFDKDGDGCITTKELGTVMRSLGQNPTEAELQDMINEVDADGNGTIDFPEFLNLMARKMKDTDSEEELKEAFRVFDKGXQNGFISAAELRHVMTNLGEXLTDEEVDEMARXADVDGDGSQL

SEQ ID NO: 118113 - protein, 120 aa, Triticum aestivum
  Clone ID: PAT_TA_12531.pep
GSSGRDGQRERQRARGRVGAAPGYLGAGARRRAEAAPAPCRRGGGEGAGAARGGRRRPRQRQDGQGDAPAALGAQVRRDRPGFPPASLPRARGGGGAAGLYTSCCMLLQFAAFFLHPLVF

SEQ ID NO: 118114 - protein, 75 aa, Triticum aestivum
  Clone ID: PAT_TA_12532.pep
MLLSIPSPSSPQRNLGFDPSRCCVQKSGRHGAGDVCQICPDGLGTTMDGEVLTAFDVCRFPVYVHERKEGTQACL

SEQ ID NO: 118115 - protein, 471 aa, Triticum aestivum
  Clone ID: PAT_TA_12533.pep
MAAAGRLRGRRRTKEVEREPEPFTIEEEVSHLTRVRSEPCPGTRAAIHGAKRKRDVSAFEMLSSRESGLSGGGGFCSADRAYAAGKHLPSEGPWCVEDMDSEAYVSQFSSDGSMLVAGFRGSRIRVYDVDRGWKVHKNISCRSMRWTVSDIALSPDQRYLAYSSLSPIVHIVNVQNAGRESDANVTEIHDGLEFCDDDEYSFGIFSVKFSKDGREVVVGNNDCSIYVYDLGANKVSDRIRAHTSDVNTVTFADESGNLLYSGSDDNLCKVWDRRCLVREKPAGVLTGHLDGITCIDSRGDGRYLISNCKDQTIKLWDIRKMSATVKGRQPRLYDWDYRWMSFPSHARYYKHPNDLSLATYRGHSVLRTLIRCYFSPMHSTGQRYIYTGSSDDSVHIYDVVTGATVKKLSWHGSIIRDCTWHPYRPTLVSSSWDGYLARWEASGNNEDPSVLTCDEQRTSPYDQTYGLSFAL

SEQ ID NO: 118116 - protein, 180 aa, Triticum aestivum
  Clone ID: PAT_TA_12534.pep
TGMNCCYKDLLLQTYITWSNDTDRIHIYFAMYSTNFAYTAANWPLQTKAVKKERGKLKEHAATSVQSGRSATAHGHAGSRPAGNLADLISLGPPEQQVHHLGRLAVAVADAVLRAPPQLPPRRRAGTGQVLPLLAVARRRPQRRQPPPPALAPVVAHVVHPTRSILSWSALCTPLSTRAF

SEQ ID NO: 118117 - protein, 149 aa, Triticum aestivum; identical to SEQ ID NO: 118087
  Clone ID: PAT_TA_12535.pep

SEQ ID NO: 118118 - protein, 156 aa, Triticum aestivum
  Clone ID: PAT_TA_12536.pep
ILLVVALLEIGLLDSWSCVGFLLIYSRRPRPSFMNSGRRPGGHVGSSRTARARCRLRWQGHPLHRLPLRRDVLVRFHPLRQLIHRDLHIGQVFVDLQACLRAGLAGPIQHGAECMLKLFVHQASPRRLRPPRRRPRLRQPPLLHEVICFLQFGRGR

SEQ ID NO: 118119 - protein, 149 aa, Triticum aestivum
  Clone ID: PAT_TA_12537.pep
MADQLTDDQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDDEVDEMIREADVDGDGQINYEEFVKVMMAK

SEQ ID NO: 118120 - protein, 195 aa, Triticum aestivum
  Clone ID: PAT_TA_12538.pep
MAAILGRAGTTASGGFGRHHQETSRGGRRRDAVVVAAVTGAAPQEGSLERPAWSGETPVSRLVAALIAFKPLYSLMKLASREVIIRTAEKSNIPWREMTRKVLESDVYEVFERIRDPNIVYPDYYLSPFHAYDEGNLSWLAAAEAEAATLSIAKRAIPEATSIEEANQIVRGNWMNAIEEHHLKHGGENCQINDI

SEQ ID NO: 118121 - protein, 68 aa, Triticum aestivum
  Clone ID: PAT_TA_12539.pep
VFLCAPPESFCWSSPPVFMSGPRLPWSPAQGSVVELSTLTGQQLQSRLVPPTPRRCGSLNRCPPGVQP

SEQ ID NO: 118122 - protein, 102 aa, Triticum aestivum
  Clone ID: PAT_TA_12540.pep
MNTDITASVKPEYPVVDRNPAFTKVVGNFSALDYMRLSTISAVSVTVGYLSGIKPGIRGPSMVTGGLIGVLGGFMYAYQNSAGRLMGFFPNESEVARYKYKL

SEQ ID NO: 118123 - protein, 103 aa, Triticum aestivum
  unsure (1)..(103): unsure at all Xaa locations
  Clone ID: PAT_TA_12541.pep
MNTDITASVKPEYPVVDRNPAFTKVVGNFSALDYMRLSTISAVSVTVGYLSGIKPGXSAGPSMVTGGLIGVLGGFMYAYQNSAGRLMGFFPNESEVARYKYKL

SEQ ID NO: 118124 - protein, 102 aa, Triticum aestivum; identical to SEQ ID NO: 118122
  Clone ID: PAT_TA_12542.pep

SEQ ID NO: 118125 - protein, 173 aa, Triticum aestivum
  unsure (1)..(173): unsure at all Xaa locations
  Clone ID: PAT_TA_12543.pep
MADQLTDDQIAEFKEAFSLFDKDGDGCITTKELGTVMRSLGQNPTEAELQXDMINEVDAXMGNGTIDFPXEFLNLMGRKMKDTDSKEGAQRRPFRVFDKXTKNGFISAAELRHVMTNLGEXKLTDEEVDEMIREADVDGDGQINYEDSSRHDGQMTPCSVLPSRRRMVHCILI

SEQ ID NO: 118126 - protein, 149 aa, Triticum aestivum; identical to SEQ ID NO: 118087
  Clone ID: PAT_TA_12544.pep

SEQ ID NO: 118127 - protein, 184 aa, Triticum aestivum
  Clone ID: PAT_TA_12545.pep
MTRSEVGYAAQVSTHPASILSCLVELSVYGVVPPKLARRSAAMATVLSSLRLPFSICPAAPAAPMAASRVALPLSSTAARGMRLRAQATYKVKLITPEGEVDLEVPDDVYILDHAEEEGIDLPYSCRAGSCSSCAGKVVSGQLDQSDQSFLDDDQIEAGWVLTCAAYPTSDLVIETHKEEELTA

SEQ ID NO: 118128 - protein, 262 aa, Triticum aestivum
  Clone ID: PAT_TA_12546.pep
AYLHQTYEVFERIRDPNIVYPDYYLSPFHAYDEGNLSWLAAAEAEAATLSIAKRAIPEATSIEEANKIVRGNWMNAIEEHHLKYSGENCQINDILDIGCSVGVSTRYLAERFPSAKAVGLDLSPYFLAVAAQKEEQLSRQNPIRWVHANGEATGLPPNSFDVVSLAYVCHECPARAIIGLAKEAFRLLRPGGTIALTDNSPKSKVLQELSPVLFTLMKSTEPFLDEYYMLDLEEALGQAGFVNVCSVLTDPRHRTVTATVPY

SEQ ID NO: 118129 - protein, 150 aa, Triticum aestivum
  unsure (1)..(150): unsure at all Xaa locations
  Clone ID: PAT_TA_12547.pep
MADQLTDDQIAEFKEAFSLFDKDGDGCITTKELGTVMRSLGQNPTEAELQDMINEVDADGNGTIDFPEFLNLMARKXMKDTDSEEELKEAFRVFDKDQNGFISAAELRHVMTNLGEKLTDDEVDEMIREADVDGDGQINYEEFVKVMMAK

SEQ ID NO: 118130 - protein, 149 aa, Triticum aestivum
  Clone ID: PAT_TA_12548.pep
MADQLSEEQIGEFKEAFSLFDKDGDGSITTKELGTVMRSLGQNPTEAELQDMINEVDADGNGTIDFPEFLNLMARKMKDTDSEEELKEAFRVFDKDQNGFISAAELRQVMTNLGEKLSEEEVEEMVREADVDGDGQINYDEFVKVMMAK

SEQ ID NO: 118131 - protein, 149 aa, Triticum aestivum
  Clone ID: PAT_TA_12549.pep
MADQLTDDQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMVREADVDGDGQINYDEFVKVMMAK

SEQ ID NO: 118132 - protein, 142 aa, Triticum aestivum
  Clone ID: PAT_TA_12550.pep
MATVLSSLRLPFSVCPAAPSAPMAASRVALPPSSTAARGMRLRAQATYKVKLITPEGEVDLEVPDDVYILDHAEEEGIDLPYSCRAGSCSSCAGKVVSGQLDQSDQSFLDDDQIEAGWVLTCAAYPTSDLVIETHKEEELTA

SEQ ID NO: 118133 - protein, 248 aa, Triticum aestivum
  unsure (1)..(248): unsure at all Xaa locations
  Clone ID: PAT_TA_12551.pep
ERPPGQVGXGGRLKFLERFAYINTTIYPLTSIPLLIYCILPAVCLLTGKFIIPQISNIASIWFISLFISIFATGILEMRWSGVGIDEWWRNEQFWVIGGISAHLFAVFQGLLKVLAGIDTNFTVTSKANDEEGDFAELYMFKWTTLLIPPTTILIINMVGVVAGTSYAINSGYQSWGPLFGKLFFAFWVIVHLYPFLKGLMGRQNRTPTIVIVWAVLLASIFSLLWVRVDPFTTRLAGPNIQTCGINC

SEQ ID NO: 118134 - protein, 149 aa, Triticum aestivum; identical to SEQ ID NO: 118131
  Clone ID: PAT_TA_12552.pep

SEQ ID NO: 118135 - protein, 401 aa, Triticum aestivum
  unsure (1)..(401): unsure at all Xaa locations
  Clone ID: PAT_TA_12553.pep
PCSVTSDCSSVASADFEGVGLGFFGAGVEGGAVVFEDSAASAATVEAEARVAAGGRSVFAVECVPLWGFTSICGRRPEMEDAVVAVPRFFGLPLWMLTGNNMVDGLDPISFRLPAHFFGVYDGHGGAQVADYCLXLLHAALVEELSRIEGSVSGANLGAVEFKKQWEKAFVDCFSRVDDEIAGKATRGGGGNVGTSSVTAMAIADPVAPETVGSTAVVAVICSSHIIVXNCGDSRAVLCRGKQPVPLSVDHKPNREDEYARIEAEGGKVIQWNGYRVFGVLAMSRSIGDRYXLKPWIIPVPEVTIVPRAKDDECLILASDGLWDVLSNEEVCDVARKRILLWHKKNGVNLSSAQRSGDSPDPAAQAAAECLSKLALQKGSKDNITVIVVDLKAQRKFKSKT

SEQ ID NO: 118136 - protein, 150 aa, Triticum aestivum
  unsure (1)..(150): unsure at all Xaa locations
  Clone ID: PAT_TA_12554.pep
MADQLSEEQIGEFKEAFSLFDKDGDGSITTKELGTVMRSLGQNPTEAELQDMINEVDADGNGTIDFPEFLNLMARKMKDTDSEEELKEAFRVFDKDQNGFISAAELRQVMTNLGEKLSEEEVEEMVREAXDVDGDGQINYDEFVKVMMAK

SEQ ID NO: 118137 - protein, 149 aa, Triticum aestivum
  Clone ID: PAT_TA_12555.pep
MADQLTDEQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYEEFVKVMMAK

SEQ ID NO: 118138 - protein, 149 aa, Triticum aestivum; identical to SEQ ID NO: 118087
  Clone ID: PAT_TA_12556.pep

SEQ ID NO: 118139 - protein, 149 aa, Triticum aestivum; identical to SEQ ID NO: 118087
  Clone ID: PAT_TA_12557.pep

SEQ ID NO: 118140 - protein, 149 aa, Triticum aestivum; identical to SEQ ID NO: 118131
  Clone ID: PAT_TA_12558.pep

SEQ ID NO: 118141 - protein, 149 aa, Triticum aestivum; identical to SEQ ID NO: 118130
  Clone ID: PAT_TA_12559.pep

SEQ ID NO: 118142 - protein, 149 aa, Triticum aestivum; identical to SEQ ID NO: 118137
  Clone ID: PAT_TA_12560.pep

SEQ ID NO: 118143 - protein, 149 aa, Triticum aestivum; identical to SEQ ID NO: 118137
  Clone ID: PAT_TA_12561.pep

SEQ ID NO: 118144 - protein, 149 aa, Triticum aestivum; identical to SEQ ID NO: 118087
  Clone ID: PAT_TA_12562.pep

SEQ ID NO: 118145 - protein, 114 aa, Triticum aestivum
  Clone ID: PAT_TA_12563.pep
LDESIQAVQSFHCSGEVFVRVSGLNTWWAPIQAAAPTGVGGTRRDCNCWPVRVESSTTDPWAGSMANGAAHEHGGDDEQNDLEEHKETRSSGEGPHPMVDGARVGWLTSLCELV

SEQ ID NO: 118146 - protein, 143 aa, Triticum aestivum
  Clone ID: PAT_TA_12564.pep
MAAALSLRAPFSLRAVAPPAPRVALAPAALSLAAAKQVRGARLRAQATYKVKLVTPEGEVELEVPDDVYILDQAEEEGIDLPYSCRAGSCSSCAGKLVSGEIDQSDQSFLDDDQMEAGWVLTCHAYPKSDIVIETHKEEELTA

SEQ ID NO: 118147 - protein, 143 aa, Triticum aestivum
  Clone ID: PAT_TA_12565.pep
MAAALSLRAPFSVRAVAPPAPRVALAPAALSLAAAKQVRGARLRAQATYKVKLVTPEGEVELEVPDDVYILDQAEEEGIDLPYSCRAGSCSSCAGKLVSGEIDQSDQSFLDDDQMEAGWVLTCHAYPKSDIVIETHKEEELTA

SEQ ID NO: 118148 - protein, 143 aa, Triticum aestivum; identical to SEQ ID NO: 118146
  Clone ID: PAT_TA_12566.pep

SEQ ID NO: 118149 - protein, 920 aa, Triticum aestivum
  Clone ID: PAT_TA_12567.pep
MPPARWIEAREAASERARSGRRRGRGWARRTREQTERGLSGSIGNVAWKERVDGWKMKQDKGAIPMTNGTSIAPSEGRAATDIDASTEYNMEDALLNDETRQPLSRKVPIASSKINPYRMVIVLRLVVLSIFLHYRLTNPVRNAYPLWLLSVICEIWFALSWILDQFPKWFPINRETYLDRLALRYDREGEPSQLAAVDIFVSTVDPLKEPPIVTANTVLSILAVDYPVDKVSCYVSDDGASMLTFDALAETSEFARKWVPFVKKYDIEPRAPEFYFCQKIDYLKDKVQPSFVKDRRAMKREYEEFKIRINALVSKALKVPEEGWIMQDGTPWPGNNTRDHPGMIQVFLGHSGGLDTEGNELPRLVYVSREKRAGFQHHKKAGAMNALVRVSAVLTNGQYMLNLDCDHYINNSKAVREAMCFLMDPNLGPQVCYVQFPQRFDGIDRNDRYANRNTVFFDINLRGLDGIQGPVYVGTGCVFNRTALYGYEPPMKSKESGLFSKLCGGRTSKSKRSTGSKKSDKHADGSVPVFNLEDIEEGVEGAGFDDEKSLLMSQMSLEKRFGQSSVFVASTLMEYGGVPQSATPESLLKEAIHVISCGYEDKSEWGTEIGWIYGSVTEDILTGFKMHARGWRSVYCMPKRPAFKGSAPINLSDRLNQVLRWALGSVEILFSRHCPLWYGYGGRLKFLERFAYINTTIYPLTSLPLLVYCILPAICLLTGKFIMPEISNLASIWFIALFLSIFATGILEMRWSGVGIDEWWRNEQFWVIGGISAHLFAVFQGLLKVLAGIDTNFTVTSKANDEEGDFAELYMFKWTTLLIPPTTILIINMVGVVAGTSYAINSGYQSWGPLFGKLFFAFWVIVHLYPFLKGLMGRQNRTPTIVIVWAVLLASIFSLLWVRVDPFTTRLAGPNIQTCGINC

SEQ ID NO: 118150 - protein, 261 aa, Triticum aestivum
  Clone ID: PAT_TA_12568.pep
ADLVWSWSIDDCLDGFVVLDNWSTQQIAVYNPLARTLDVFPLPPHQEHCKNCERQYSDYYILAEKEEDSLPYRVLCVRHSEHGARTMVLSSDTSKWQIFPWVDIDGLWPRTAKLVNGCIYWTIGMMDARVLNTATMQFSRMDKPPRRRGSDVLTAGETKDGRLCVVSAPLGPLTFESVLAVWIRRADDDGVERWMLDKSLPLQEIAGIVRCEFKEDNVKYQVTVRTIIDGFVYFSAYCGVWQHHHSTLWLLSFCLETAALN

SEQ ID NO: 118151 - protein, 163 aa, Triticum aestivum
  Clone ID: PAT_TA_12569.pep
GGRGRLRHRSTLSSPPPLDLSPFPPPKERDGAGSGGDGTCWARSIHSQARPPNNEPGGSQAAGWACAHHAYGVAWAEIWPLAQWTAGHVLWCGVDGGLCRVLSGNPIQSNPIEKKLLAPHNICAVPSSLCPTTASQVAKRAFCRRGRRHWERRRRRRRGLCDV

SEQ ID NO: 118152 - protein, 235 aa, Triticum aestivum
  unsure (1)..(235): unsure at all Xaa locations
  Clone ID: PAT_TA_12570.pep
MRLVGLTGGIASGKSTVSGLFKSAGVPVVDADVVARNVVQKGTGGWKKIVKAFGNGILLENGEIDRAQLGQVVFTDPEKRKLLNRLLAPHISCGIFWEILKLWVKGCLVIVVDIPLLFETKMDRWTDPVVVVWVDPKTQIERLMSRDSCGQEQAQARIDAQRGLPWTKSEADIVIDNSGSLDDTKEXLKQGSGPLTWKEGMMCTDGVLSLLSRSXVCMAAGVILARKNLLLSFQA

SEQ ID NO: 118153 - protein, 243 aa, Triticum aestivum
  Clone ID: PAT_TA_12571.pep
MAWIWVVAVAGAILLLWAVSLGRILSSPAPYCLPPSPRFLLPLHGDRRCRNVLLVLAHPDDESMFFTPTILFLESKGHKVHVLCMSLGNADGFGDTRKEELYNACATLKIPAEQVAVLDHQQLQDGFHEEWDHGLLAELTMEQIQLWDIDTIVTFDSYGVSGHPNHRDVHHGICKLLHENQQENIEAWELVSLNMFRKYSGAVEIWLSPLISSSSKQLICCLVNCNPSRTFKAMAAHRSQWVW

SEQ ID NO: 118154 - protein, 190 aa, Triticum aestivum
  Clone ID: PAT_TA_12572.pep
ISRKYDTGQCEPPGQNFDTEDISGKHGSGIKGRQIDRARPPGGTWGNGLCRAAWGSDGLMAKRPYPRKENIASGLKWCSRLIAGPAPKRPDSSRPQPLPSAATVLPRLPLIPKRNRKTARLLALKTRRMNSPHRPVRPAPGRSLATASRGAASPSGPHSEPPLVHAVDQIGAQRQEAVEIGARLGSGRRR

SEQ ID NO: 118155 - protein, 264 aa, Triticum aestivum
  Clone ID: PAT_TA_12573.pep
MFPGSSEALRRLGNIIPDSYFPFNSIPPISGKGLCDPVENPLPSIASFQGKMGLPNFGLEDNIPLSHMKSVPDLFPNFPLGTNKEYARNSIPELPNSSFLPNFMADIAGSSKKVRSKFMADMSALLPGLGISPVQPIHSAMPENHKKVLDNIMMRAQYATNKLMKKRSKPDYWSEDELDALWIGVRRHGRGNWDAMLRDPKLNFLNHRTSEELALRWILEEQNIMEEPMPTATRSSNSTFPGLSDAMMSRALSGSNFSKLKMEP

SEQ ID NO: 118156 - protein, 303 aa, Triticum aestivum
  unsure (1)..(303): unsure at all Xaa locations
  Clone ID: PAT_TA_12574.pep
AAAVARAAPAITAFGNVDVVGRPXRGHPLGSSGLAATLRAAAALLRLDAEWDWFVTLSAADYPLLTQDDLVHVFSSVPRHLNFIDHTSDIGWKESQRVQPVIVDAGIYLAGRNQFFQSTEKRAAPDGFKFFTGSPWVILNRRFXXYCIFGWENLPRTLLMYFTNVMLPLEGCFHSVACNSDFRNFTVNNDLRYVACDDPPQMEPRFLNITHYEEIVESGVPFARKFREKEYLLDRIDEKILQRWRHRPVPGAWCTGRKRWFSDPCSQWSNVNIVRPGPQAEKFRRYMDRILEESKSSNSSCAQ

SEQ ID NO: 118157 - protein, 354 aa, Triticum aestivum
  Clone ID: PAT_TA_12575.pep
MPLPPPPPAEPAAPPTRPRRARLPPRQDGPPEPEPPELPRHRRTPKDPTPPRTVVPPQEPGWAAVPLPMAPMPAPGMPINYSTTGWTTMLVFGDSTVDPGNNNRLQTVMRANFLPYGAGFLGGRPTGRFSNGRLITDILAERLGVARSLPGFREPRLRPRQLRRGVSFASAGSGYDDATARISNTLSFSNQGEDLWRSRGNLQRLVGPRRAGQLLRRATFVISAGTTDLFNHYLATNRSGTESWPPYENLLITRVANYTQAMRALGGRRFVFVGVPPVGCSPLVRTLLGTGAETCHENMNSMATYFNRRLGEVVRFLRNQRDIRATFIDGYPIVSMVTIDPKNFWLTETSRGCC

SEQ ID NO: 118158 - protein, 85 aa, Triticum aestivum
  Clone ID: PAT_TA_12576.pep
IFYNTLIKHNKAYGFAILVFIVLLFMFHTNQISSKYNANIPVTTCEVSSSFFLTQVSSSCYKRSKLHIRASTTRAPISVKLTALL

SEQ ID NO: 118159 - protein, 313 aa, Triticum aestivum
  Clone ID: PAT_TA_12577.pep
MSSEGGGTAITGKKRNRAQIQTLVREGSLYNLTLSEVESHLGAPLLSMNLDDFVRSVLPDEKNLPLPNGAGNSGSHSTSAFGLERQGSSITVPLPLSKKTVDEIWRDIQQEEESSDDEKRSSGCEAQMSFGEITLEEFLQRAGIVTGQYQKDAEELIDLVGTGESAHLMTRVQDFPQGTSAIDAYIVRQSIAQPLSVAIPSTMDSIYPDRQMSISSSLELSDLQSPSHKRMSSQDVVYKVADRRQKRMIKNRESAARSRARKQAYTNELECKLSCLEEENKRLKREKELDMLLKSAPPPEPKKHHRRTRSTSF

SEQ ID NO: 118160 - protein, 455 aa, Triticum aestivum
  Clone ID: PAT_TA_12578.pep
MPNPKRPAVTADDPDPKRRALHDPVPERRAGEDPDSERRAGDDPDPERRRGDDPDPDPKRRRGDAPDGASPNRLPDGASPNRLPDGGDPSGQRTAMAYGGGAEGWSTEDKVEKVYAQKEVAMDITERKEQIETICLQMQVTASFLTKINASQTALLMEREDTANQISVLCDNLSKIRTLLVEIRFDMEPKEQIETICLQMQETASFLTKINASQPALLMEREDIPNQISALCDNLSKFRTVLVEIGFDAAGSKSSMKKKDLVGIYAANRMREMQEEISKKEKIRIRDQLQLIPLQEPEEYMHEYYRLHPHQEEETKLTRSLKKQIAEEESLYATYRRGRKGLLAGSTFEAESMISPMHFTFCPPGVASEDDVAVTTGTSLEIFSIKIAQIKGDLNWPLYVYGVVAARDRVDFNRNILFNRMRNNAQKVTEADPFLCLTGPARAILPEVEFEVELM

SEQ ID NO: 118161 - protein, 99 aa, Triticum aestivum
  Clone ID: PAT_TA_12579.pep
MGSSRGNRNVRARRAVKAMKLLGISREQTAPVLRRLVELYDDNWQLIEAESYRALADAIFDEAGQRRASQWRGSGAGAGGARSGAGGDGHHAGNVHAGG

SEQ ID NO: 118162 - protein, 213 aa, Triticum aestivum
  Clone ID: PAT_TA_12580.pep
MEIAMVCTRVNLLILILSLCSPYKFIQSPMDFGPLNLLPTTIAASSDFGRILFHSPSAVLKPQSPRDISLLLSFLSASSLGKVTVAARGAGHSIHGQAQALDGIVVEMRSLPAEIELHKGGEGDASYADVSGGAMWIELLEQSLKAGLAPRSWTDYLYITIGGTLSNAGISGQTFKHGPQISNVLQLEVVTGRGETVTCSPTKNAELFSAVLG

SEQ ID NO: 118163 - protein, 93 aa, Triticum aestivum
  Clone ID: PAT_TA_12581.pep
TMDEIALSLPAIRARRALCTACTAGPPICRNDGSWEDRRTARCRRPYCKPSLAALQVHASSASGHYGSSPMTRALNITREVDSGSAPRAELPA

SEQ ID NO: 118164 - protein, 292 aa, Triticum aestivum
  Clone ID: PAT_TA_12582.pep
MGEVRAPALEVDTPRRLPAAGGVETKFTTTLSASCDCLLEARRVPLAVLFLPAAPWLNAASSLVRGLSEMETKGPPPRRAAQEPEIKFHNPKFVSLLNHLRFYIPQILPNLEKVVFLDDDVVVQKDLTQLFSIELHGNVIGAVETCLESFHRYHKYLNFSQPIISSKIDPHTCGWAFGMNIFDLIAWRKANATSLYHYWQEQNADQLLWRTGTLPAGLLTFYGLMEPLDRRWHVLGLGYDVDIDDRLIESAAVVHYNGNMKPWLKLAIHRYKSIWERHVNFSHPHVRECMFH

SEQ ID NO: 118165 - protein, 171 aa, Triticum aestivum
  unsure (1)..(171): unsure at all Xaa locations
  Clone ID: PAT_TA_12583.pep
GNVGNPGLARCVHASMGPAGLGPKTVPGIGPANRGVLRSAGQFRIVANAVPVTEEDSRVHDYGLTADDSLAHLNVAFQXFKLHQAPDVHGVLGQTYRPXDYVSAGVDMGAKIPVMGXAAKYQVSDIFGTDCEVARFAGEDVVRVGAVDMIDEPADTMCGSGKGSAGLVCKK

SEQ ID NO: 118166 - protein, 65 aa, Triticum aestivum
  Clone ID: PAT_TA_12584.pep
ANLDRMFTSMGRGWDELGGGRRGGAELREKFLGDAGGRKRKVGADDEDDGADSGEDSGVESLYID

SEQ ID NO: 118167 - protein, 457 aa, Triticum aestivum
  Clone ID: PAT_TA_12585.pep
MDKGLFANEGFFMAEMRAVASGGCSRGTMHRRLFAIDGSSMGRPSQMQQEMLDKEKPAAPATTAGAVSSAPAKPVNPKTPLVIVANKRPLEVKKSGSVLSGGKLAFSLKKNKIPIVPVKFGAEEEDDEDVAGVERGDHAKRHKSIDAHSAAAPARVVASAPPNDMTVRQVADKLASFVAKNGRQFEDITRQKNPGDSPFKFLFDKNCSDYKYYETRLAEEEKVHAQTKDAQASKIVNSSTASSIAHTGAHRSSFEQRSNYQTPASALYGAYEGSSSQGSSSGHGGLRVAAPPVPVPFLGFRATKAAQEERKRPPRQSKDEMPPPPCLIQGPPKKGHHMGDFIPQEELEKFMARCNDAAAQKATKEAAEKAKIQADNIGHKLLSKMGWREGEGLGSERSGRADPIMAGDVKQDHLGVGAIQPGEVSSEDDIYEQYKKRMMLGYRHRPNPLNNPRKQYY

SEQ ID NO: 118168 - protein, 328 aa, Triticum aestivum
  unsure (1)..(328): unsure at all Xaa locations
  Clone ID: PAT_TA_12586.pep
SLLAHLVAQSTADVRHEDLIRXHIILHNHDQKGHELAMHVLYQLQCVNVADAPESSISTSEHYEKFFISLAKLLIDVLPASDKSFSKLLCDAPCLPESLFRFLEGLCMSQGNNQQTKDSEGDRVTQGLGTVWSLILGRPPLRQACLDIVLKCAIHSQDEVRGKAVRLVAKKLYDLTYASEKVEQFATDSLLAIANKHGVSTDVNFTTSKESTSEVEVSNQEASVSGSQISDAGPSATAPTSPSLSAISVSEAKRHTSLFFALCTKRPTLLRQLFNVYGGSPKVVKQCIHWHIPTLVRNLGSSCPEMLDIIHGPPEGSEELVTMILQTL

SEQ ID NO: 118169 - protein, 205 aa, Triticum aestivum
  Clone ID: PAT_TA_12587.pep
QDPAETLNKDLISHFVLRLVYCRTEELRKWFLSMENTLFRYRFRLESPESQRLLMSEFQLPYKALPHSEFEAVKDKLSQVARSIGQSASVESVFFKVPFEEVPDLVASRRVFLSKGYAYVAMSQVVSLVVTQFRCNISKALVLTNRKWTATIKEQEKDRLTPIVEALSNAYFGPDYSQPNDATEISSKDIDQLARTSFPLCIRHM

SEQ ID NO: 118170 - protein, 157 aa, Triticum aestivum
  unsure (1)..(157): unsure at all Xaa locations
  Clone ID: PAT_TA_12588.pep
ASKQXSXIQGLAKKTPPTADPWPPPRDPAPSPTSPRTRWPRRRPSKSCTCSGCASAGRRKGAWSPSPRRRTPMPTTPKSPPARPAPAAAAAAALERPFLARSFDRPGLDAGLIRCTEFGLASPSQLELGALSGTPVQFMYSSVISPCINSCELAKKK

SEQ ID NO: 118171 - protein, 150 aa, Triticum aestivum
  Clone ID: PAT_TA_12589.pep
NHQKLERKKKLKGSKHWRIRKDPPHNKLHSRKITSQNSSRTHRAAGAKNAVDPCDTPSNVYADKYAPETLTFSAPLVASGRKLGIVMNACLAPPCLPLVVAVAPPSRAYIGGDALVGDAMGARGGGGTVWLSEMSFAVAAPASGKGRAEV

SEQ ID NO: 118172 - protein, 175 aa, Triticum aestivum
  Clone ID: PAT_TA_12590.pep
MASPLSEIPEDVLHLIIDGLVSSTDRRGLVSTAWSGLRRLLHFSDGFEAARRARHSVSADRARFRAVCRSWHLAMRQHVLRPRKIPWIVMSDGSFLTPSDVAGTSPARIPSLPRNARCVASADSWLLLDRTDVRKKMHSYFLHDPFTNTTVPLPELDAVIGHASELFGVHKLRMR

SEQ ID NO: 118173 - protein, 70 aa, Triticum aestivum
  unsure (1)..(70): unsure at all Xaa locations
  Clone ID: PAT_TA_12591.pep
GITCSSNLASFSLFLCGFAPCWVWCAVVGRVLVLVDGMKDSLMACPFLYSTDHRCSNERGLXLDSIALFV

SEQ ID NO: 118174 - protein, 193 aa, Triticum aestivum
  Clone ID: PAT_TA_12592.pep
SVNILYRFPSLQRTASSKGGGSREYVGTRWSTMSSGIEKFMEEKPWEFSKANALERAMVAGLGGLNLFGVIILGNLLKQMTMTPGGLISFAAQLFPLLQIYAGSFFAIPLFRWLLLRKTNNDIARRNKAREERAQELLSPEPSLRRKLLSARDMAQRKVITPGEIVYTTEKDLLDQEYEVREWERRFKKLESD

SEQ ID NO: 118175 - protein, 219 aa, Triticum aestivum
  unsure (1)..(219): unsure at all Xaa locations
  Clone ID: PAT_TA_12593.pep
MQAPACTNAPACPFPFAMMQSHGARIVRLHTYDWVALLLLIAMEGVLNAIEPFHRFVGEGMIADLRYPMKSNTVPVWTVPIVAVIAPMLIFIAIYIWRRNAYDLHHATIGILFSVLITGVLTDAIKNAVGRPRPNFFWALLPWMGIAVMTLRSDSSEFHRHPSVSLGPLLPXVFXQHQHSIICHGDXSVXQRSHKTSQSGHXSRSFAGXGFLSWYXPGX

SEQ ID NO: 118176 - protein, 192 aa, Triticum aestivum
  unsure (1)..(192): unsure at all Xaa locations
  Clone ID: PAT_TA_12594.pep
WRLGYWWKNRRDGGKKSAENGNAKKRDRDKEDRVRERDSSARQKRSAHLWADREVREKERNSRDSREEKSSRDVGNKVRWLQSNIXVRVVNERFSRRLYLQKAKIVDVVGPTTCDIMMDDGSELVQGVEQDMLETVLPRTNGQVLVLCGKHKGVYGHLVEKNSEAETAVVEDADTKDMVRVKYDQIAEYVGD

SEQ ID NO: 118177 - protein, 281 aa, Triticum aestivum
  Clone ID: PAT_TA_12595.pep
MMSSPADTAPSSSSAAAAAPNQHPQPPAQQAGPKERRMESLGWLTESTVMPKKHKAIEGVGAASILDLKAQLYRTQEEARNSTAADAASSEFRRAKKRSGPADPLGAKNSGVDARAHKDKLELKAVKDGTACYSALEKKAELYEKLSRGELPDEEDQEKYCVDFFQKSFHQVSERRQPETATASEHVEQENESVDSMPNPKPMGLGRTGTTVDQDEHKRFVREVHDEVSQARQKASTMKHRRQEQESARREKLRQAFLKKRLDKLMAEKQASSASDDQPVS

SEQ ID NO: 118178 - protein, 143 aa, Triticum aestivum
  Clone ID: PAT_TA_12596.pep
SGGTSGQDGHQILPRHWITWRNTLEGFLQSPGVNKGGGIQCCIQDALRYNCCRSVQKGNLNKGQGASEEHPAGVAGAKEISSSIALKDAIAASLDANTAMCNNALLDIFVSEKFAMLCDLLVGTFHVSKVHEVIDLGKIDANM

SEQ ID NO: 118179 - protein, 142 aa, Triticum aestivum
  unsure (1)..(142): unsure at all Xaa locations
  Clone ID: PAT_TA_12597.pep
MAAASMLTTVFSPLALLRPSASFARLRRAAPAAAVAVRAAAKSTTAAAAPKKKRAAPTGITMPRPVSPALQGGVMGAADVPRXTEAHESASWAYIKXNNLQDPQDKKVIVCDEKLKALCAGRDRVGFLEIAKLLTPHFVKTP

SEQ ID NO: 118180 - protein, 183 aa, Triticum aestivum
  Clone ID: PAT_TA_12598.pep
MTRHRPWPPSHPPPPPHPHPLRAAAAAATGTGAGKKMARLSPGAAAPQVDTGKYVRYTPEQVEALERVYNECPKPSSLRRQQIIRDCPILCNIEPKQIKVWFQNRRCREKQRKESSRMQTVNRKLTAMNKLLMEENDRLQKQVSRLVYENASVKSLKTKIHKASAATTDTSCESVVTSGQQQA

SEQ ID NO: 118181 - protein, 284 aa, Triticum aestivum
  unsure (1)..(284): unsure at all Xaa locations
  Clone ID: PAT_TA_12599.pep
VSWSTMISGCVQNNQSSDALAVFDNMRAQGVRPDEVTIVSVISACTNLSALEKGKSVHDYVRQNKCYITLVLGTSLIDMYMKCGYLEAAMDVFNIMEEKGAPCWNAVIVGLAMNGLVTKALEMFSEMEASGTAIPNEITFIGVLSACRHAGLVEEGRHFFKLMXTKYRIVPNIRHYGCMVDLLGRAGYVKEAEDLIESMPMLPDVPAWGALLGACWKHGENEVGERVGRKLVNLDPRHDGFHTMLSNIYAKEGMWQSVNDLRDSMKQRHVPKVSGYSAVEMSHS

SEQ ID NO: 118182 - protein, 81 aa, Triticum aestivum
  Clone ID: PAT_TA_12600.pep
WDGHLLAALEIEIPGDGVLLMPQRKKNWASGGQGSTSGLLTLMELCQATVDTIPLFSFLNESTVMCCKYHNWTTVGPSCLP

SEQ ID NO: 118183 - protein, 185 aa, Triticum aestivum
  Clone ID: PAT_TA_12601.pep
MGAPKQKWTSEEEEALRRGVLKHGAGKWRTIQKDPEFSPVLSSRSNIDLKDKWRNLSFSASGLGSRDKLRVPRPKAPSSSPSPSPQLLLLSAPNNVAEASPPEDCEKSPQDDKTPSPKLYSSMILEALDELKEPNGSEVATICNFIEIDKSYKLTDSYAKRALAPMKDPSLKKKDSAKSSKAAKG

SEQ ID NO: 118184 - protein, 141 aa, Triticum aestivum
  unsure (1)..(141): unsure at all Xaa locations
  Clone ID: PAT_TA_12602.pep
RILKAPPAPQPPSSSAFATICNFLEIDKSYKLTDSYAKRALAPMKDPSLKKKDSAKSSKAAKSLGQLIHALVAAEAGSXMKVSRTRRPNAHLRKPKHMMEXERIGKMAEETESLLELASELYERCSRGEALTILQVAHREF

SEQ ID NO: 118185 - protein, 70 aa, Triticum aestivum
  Clone ID: PAT_TA_12603.pep
FFFCPNGALGKAFLQKKKDTAGDARCMTRGLVALAVGAGLKTTDGSIYRCLVAHLVSTFTHTGGELLILV

SEQ ID NO: 118186 - protein, 70 aa, Triticum aestivum
  Clone ID: PAT_TA_12604.pep
ETKKEYNPGLNEIGARLGLQRGNANAVDSLARYRRIVKSKLTKNFQKMNRLVPRLVQAMYGTLPPKCLFL

SEQ ID NO: 118187 - protein, 86 aa, Triticum aestivum
  Clone ID: PAT_TA_12605.pep
LPLIKPIYLTIHLSTTHAHLHAPMSLPPWPLLHFVPRSTVVSSYSLIPQLHASFAFSSPSSGSLLLLRFVRYVHMGREPHEYASDD

SEQ ID NO: 118188 - protein, 146 aa, Triticum aestivum
  unsure (1)..(146): unsure at all Xaa locations
  Clone ID: PAT_TA_12606.pep
RAAPRPSAPPPAPPPPPPRXTPARRPGCRRLRGPGGPGGPPAPPPRASATHVGQGSAAGASLLRFPEPAAHSPSGDSEQQAPDEDRNLLEARAPAGGPSATSSTATTPRTRSVGALCLSNSMDGDDRDPTLKPDELERRGHPCRPS

SEQ ID NO: 118189 - protein, 378 aa, Triticum aestivum
  unsure (1)..(378): unsure at all Xaa locations
  Clone ID: PAT_TA_12607.pep
MASATASISSHSIALRDLKAARIGAVRQQVAVVPAGLPATAPKGQRARAVRPLCAAEPARKPVSASAASSPVAPVEEEASRTTREVQDLVRSKGLFSFYEDGHQECCRVRRXSALRRALKGLKACITGQRKDQSPGTRASIPVVQVDPSFEGLHGGAGSLIKWNPVANVDGKDIWTFLRTMDVPVNTLHAQGYVSIGCEPCTRPVLPGQHEREGRWWWEDATAKECGLHKGNIDKGNIDKEGQAPKVGVNGNGSAEASAPDIFQSQAIVNLTRPGIENLLRLENRAEPWLTVLYAPWCPYCQAMEASYVELAEKLSGSGIKVAKFRADGEQKPFAQAELQLQSFPTILLFPGRTVKPIKYPSEKRDVQSLLAFVNSLR

SEQ ID NO: 118190 - protein, 164 aa, Triticum aestivum
  Clone ID: PAT_TA_12608.pep
LHTTPVINFDSTIGMLCSDTVSRRSCRWCGRPPRNGMHTFAPESAWNGLVMQIDRAAARLCSGAQLGRRPEPTTRAAFLFLAAPQSCARCRPAHIRTGQLGIRHERRAANPSAPTGRIWLHRMLYRRARGLARGGERRGRSTPWREEEGPDDVEGRGGAMERSG

SEQ ID NO: 118191 - protein, 116 aa, Triticum aestivum
  Clone ID: PAT_TA_12609.pep
NYLAPIVPLRKIRVFMDYALWVDKFDCRGWQSKCSVTVAHIFRATSNFSQKNMTRQGASCSIGSESLVYNQCRLHSAPPLCFFLDGNAGHHAAHFACNHFISNLSLESIADRADKR

SEQ ID NO: 118192 - protein, 407 aa, Triticum aestivum
  unsure (1)..(407): unsure at all Xaa locations
  Clone ID: PAT_TA_12610.pep
SARAEARKIFDSMIGLGQKPVVTTYSILLHGYAMEKSFHDMHCLIDLMVQNGIAPNHPVYNILISACAQEEMVSEVMHIFTKMRQQGLNPNVANYGVVVNLLSRIGRMDDAMSLFNQMITEGLAPDIIVFTPXARGFCSCGKWEKVGELFSEMLDRGICPDTVFFNTIMDRLCKNERVMEAQDLFDLMVHMGVKPDVCTYNTLIGGYLFVGKMDEVSKLLDNMVSIGMEPDVITYNILIDGYSKNGKIDDALVVFRGILERKDKPSVITFNIMIGALLKCRRKEEAKDLFDGIWAKGLVPDVVTYSLMIQKLIEEGSLQESDDLFLSMEKNGYPANSCMLNAIVRRLLQKGEMPRAGTYLSKIDERNFTLEASTTSLLTALASVGKCQEYKGLLPEKYHCFLEQGTD

SEQ ID NO: 118193 - protein, 151 aa, Triticum aestivum
  Clone ID: PAT_TA_12611.pep
DIDFGAPHSRQMDEISTSEIVGVHDPRAIDFYDLRGVDEATKEKKKEQQRMRAERIKTSGLSIKKKRLRKQRKREEAKAIVDRALQLREEMYQKRLEFEASEKGKEEQEKYRSTLPGAGGRQFPLLKSLTNHQLSNGFHLLTLISLGEYLY

SEQ ID NO: 118194 - protein, 343 aa, Triticum aestivum
  Clone ID: PAT_TA_12612.pep
MTVMELKALPLGFRFHPTDEELVRHYLKGKITGQIKNEVEVIPEIDVCKCEPWDLPDKALIRSEDPEWFFFAPKDRKYPNGSRSNRATEAGYWKATGKDRVIKSKGEKKKQHMIGMKKTLVFHRGRAPKGERTGWIMHEYRTTEPEFESGEQGGYVLYRLFQKQLEKTERSIPEEMDRSGYSPTPSRSTPDNMEANEEAITLINKESPESGLHGCPIELPGTIDTPGTPVTRWLADRNGNSGIDEANVLGMPFHGNVDESPKADMPVGSLAHLIDSQTKNLGSHEFATVSAPMLSLDDVDKLLLQLPHNSVEDFLNETIADPDEHSSTACKGQYDSDTVFMQA

SEQ ID NO: 118195 - protein, 196 aa, Triticum aestivum
  Clone ID: PAT_TA_12613.pep
SEAAWAGHHQILAHAAAVDVYRRKFKAKQGGQVGFVIDCEWAEPMSDKMEDQAAAARRIDFQLGWFLDPIYFGDYPESMRQRVGEYLPKFSEKDRELMRNKIDFIGLNHYTTRIIGNRPNPQPQEIHFYQVEQIERSEKWSSGEAIGERAASEWLLIVPWGIRKTINYIVKKYENPIIYVTENGLDDEDDPSAPVD

SEQ ID NO: 118196 - protein, 300 aa, Triticum aestivum
  Clone ID: PAT_TA_12614.pep
SARGLVLAGALGPRRSAGPVPWPSQGFGAYRFSVSWSRIFPDGLGTEINEQGVAFYSNLIDFMIEKGIQPYATLYHWDLPHNLQKTMGGWLSDKIVEYFALYAEACFANFGDRVKHWITINEPIQTCINAYGVGIFAPGLCKGVAAEPFLAGHHQILAHAAAVDVYRRKFKAKQGGQVGFVIDCEWAEPMSDKMEDQAAAARRIDFQLGWFLDPIYFGDYPESMRQRVGEYLPKFSEKDRELMRNKIDFIGLNHYTSRIIGNQPNPQPQEIHFYQVQQIERTDKWSSGEAIGERAASEWL

SEQ ID NO: 118197 - protein, 273 aa, Triticum aestivum
  unsure (1)..(273): unsure at all Xaa locations
  Clone ID: PAT_TA_12615.pep
GVAFYNNLIDFMIEKGIQPYATLYHWDLPHNLQKTMGGWLSDKIVEYFALYAEACFANFGDRVKHWITINEPIQTCINAYAVGIFAPGLCKGVAAEPFLAGHHQILAHAAAVDVYRRKFKAKQGGQVGFVIDCEWAEPMSDKMEDHAAAAKTINYKXKKMMKTPIIYITENGMDDEDDPSAPVDQFLNDTKRVNFFKGYVGAVAQAIKDGADVRGYFAWSFVDNFEWAMGFTKRFGIVYVDYKNGLSRRPKASAMWFSRFLNGEAADSKPDTN

SEQ ID NO: 118198 - protein, 102 aa, Triticum aestivum
  Clone ID: PAT_TA_12616.pep
FYFCSTLFACTQESTSSYFLLVYQLYKHHIVEPASIQVTISCLCLWNSAKRLKTTETLCHETKHCLRPCFVFNFYIMVLLMTDAIVALAPLFIKKHSLFFFT

SEQ ID NO: 118199 - protein, 278 aa, Triticum aestivum
  unsure (1)..(278): unsure at all Xaa locations
  Clone ID: PAT_TA_12617.pep
AEVLFARXQSSKKHYSSILHKNNLSIDANSVTCNTDRDKYKLIEDFFNLEVANVEESEICEQGARCGYIFQDGSDLIQREVALLRSSQNKLYVLLVDMEQDEQEIMPRVLGCYRLEDLEKVLTGLGLQALRVHMADHTAHLFLTRTSKEAQDVLWLLNLFSFPQLTSGVSLQSWEKIQVKLLEKCICASLKMGIFLYSMLMFWKNDAEEESLXLFRSLVVTEGSICVCIENLHQFGXFPDDSHPPYXSLDXCCSINSIKEVVVGTRQGMLDINPCTNT

SEQ ID NO: 118200 - protein, 195 aa, Triticum aestivum
  Clone ID: PAT_TA_12618.pep
LSLSVPSSLPLASMVPELVLGAPPTPPLSGTSGEHAGGQAQADAVSSIGQARVIHMHNLLQHGNGGGASMADLCLLVQRTLHSTARTEIATLEIRRQIADLSEVVKDLALRLRGPSVHDLIRVLNARPEARRAIKLPITCWAEFVEATEAVLAAEERLRSGSPSPPAPPVADPAPSSSPKRKAPEQPAAPFTLDD

SEQ ID NO: 118201 - protein, 367 aa, Triticum aestivum
  Clone ID: PAT_TA_12619.pep
SVLWIEVPSPLLLKASSQNQSPPPTQGRLLLPSFVVLPITGSPTQPSSVTSASNLRRRLHHADVDGRRNEHVDISHVDSLDEPLLGKSSYDGGGSEVYDPRRQDLWDDDDRKKEQLHWSFLFSNLIAQWAQWLANIIVSSGSIFGRLFPFSSDNETSNPVYLSPLQEERLDNLRRRLKIPFDGSRIEHQDALKQLWKLAYPSREIPPLKSESWKEMGWQGTDPSTDFRGGGYISLENLIFFARNYPASFQMLLNKVQGQRADWEYPFAVAGINISFMLIQMLDLQSTVPSSKSGSRLLARLGRAVYPFDHLYCVAFRMLDAQWLVKRASYMEFNEVMKSPRTQLERELVLEDVLAVKDLPSYTMLDK

SEQ ID NO: 118202 - protein, 82 aa, Triticum aestivum
  Clone ID: PAT_TA_12620.pep
HHNPRRPHGSGEGAIRLVTCYSNTCACHCINPHYYFREKVHHILRSAEAHRDGASATCRRDWDRDRSAEEGIYTLMSQKQKM

SEQ ID NO: 118203 - protein, 134 aa, Triticum aestivum
  Clone ID: PAT_TA_12621.pep
HEDDTGTMNLMIFAEEAEGLIGIAAELLKEIAGDDRCTMPDAISNILGTTHTFEVAMDNRSLSFVVKWALDNDELTLLQHSGSVQLTVGGDNNHLLKEEDYSLVSGCSSQLMEEKMVIIKQETELKAVDEADAE

SEQ ID NO: 118204 - protein, 60 aa, Triticum aestivum
  unsure (1)..(60): unsure at all Xaa locations
  Clone ID: PAT_TA_12622.pep
DNLTRITKRLEEEGPASLGWLQIYSASKPLLVADTVNLQPPKACWSLFFQTFGNXLSSCP

SEQ ID NO: 118205 - protein, 300 aa, Triticum aestivum
  Clone ID: PAT_TA_12623.pep
MEMKERQRWRPEEDAILRSYVRQYGPREWNLVAQRMNVPLDRDAKSCLERWKNYLRPGIKKGSLTDDEQRLVIRLQAKHGNKWKKIAAEVPGRTAKRLGKWWEVFKEKQQREIRDSRRPPPEPSPDERGRYEWLLENFAEKLVKERQQVGVGATPLHHHLMAAPMLPPWMSSTATNGAPVSPAPPSPSVTLSLASAVVPPPTAAPWMQQQQQMAEDGAAFGFARPPPAPGMVPDAPQAALAELAECCRELDEGHRAWAAHRKEASWRLKRVELQLESERACRRREAAEEFEAKMRALWEE

SEQ ID NO: 118206 - protein, 176 aa, Triticum aestivum
  Clone ID: PAT_TA_12624.pep
SYFNATSFVGNPGLCGPYLGPCRPGGAGTDPSAHTHGGLSSSLKLIIVLVLLAFSIAFAAMAILKARSLKKASEARAWRLTAFQRLEFTCDDVLDSLKEENMIGKGGAGTVYKGTMPDGDHVAVKRLSTMSRGSSHDQGFSGEIQTLGRIPHRYIVRVLGFCSNNETNLLVYEYMP

SEQ ID NO: 118207 - protein, 123 aa, Triticum aestivum
  Clone ID: PAT_TA_12625.pep
EEVEEEEDDGNGDLLGSRGEASAQCAASGNEGDREMGGGEEEDDGNGDLLGSRGDVGDGAKVEECAVRSSLETMTLQEWFDRMEKYLPRMINEAADQMIAELEEKQKRVHEYISTLSKSSDPS

SEQ ID NO: 118208 - protein, 153 aa, Triticum aestivum
  Clone ID: PAT_TA_12626.pep
RDCCAGVYGSAEVIVDFGWLRGSEGSASPGESFGWFLAGRRRRRPWASLSLLGAPLRSFMQPLLSGQNLRAKVRILLVDRTATSSLRCFPFWGAVFEILAPFALPAGWTCTTSWSVDVRPAVWEVGVVTCVATTMMACGAGWSGVPMGVLLLV

SEQ ID NO: 118209 - protein, 136 aa, Triticum aestivum
  Clone ID: PAT_TA_12627.pep
TRRNSGLSSSQWQLEKIVSLGSSQWQWAGSPRPNLFLRHCGSPSLDGGLFSLDIKTLQLERVLGSESSMLYPWPCTNFPPFLSTPTVSSDTQEGDEKEMPEQGAEMLQDDEPTGSLHDERTADDVNAGGQVGVSRT

SEQ ID NO: 118210 - protein, 204 aa, Triticum aestivum
  unsure (1)..(204): unsure at all Xaa locations
  Clone ID: PAT_TA_12628.pep
MAKVPAAEAXDVRAPPRPPSATTAPKPRSPHDLLAETRASVEEVAARILAIKKDGAPKSELRELVAQMSLLLITLRQVNREILMEEDKVKGETEAAKAPVDSTTLRLHNLLYEKNHYVKAIRSCLDFQTKHPGIELVPEEEFHRAAPADIRDKTLAADTAHDLMLKRLNFELVQRKELCERHEKLEQQKNSLLGTIANQKKFLS

SEQ ID NO: 118211 - protein, 145 aa, Triticum aestivum
  Clone ID: PAT_TA_12629.pep
AANKIVRHQKHLEEGCIESTVTDLSSMVYQHSEEHRSCHRSGGCRDGDPALARQRRGRRRVGAPQPGGGTTTLRRQRRQKARLPTSACRCHARSTMKEAPFPAVGSGAGEGGGVDLAAPGAIDSDGGRLGRRTEAAEEEGGGGRR

SEQ ID NO: 118212 - protein, 187 aa, Triticum aestivum
  unsure (1)..(187): unsure at all Xaa locations
  Clone ID: PAT_TA_12630.pep
PSHASNCWKIVQFEFHFRDXYVKRLPFXFRTSNNVADVEDAFGWRSRGGKRFHHPHTKDGSKLAARDEIHAHITCTDADSNNTAQMDDLAYSLRSSTLGPATPPSPFASLGDREGVHGDKPAVVEGHPMAGPANRAAGVAAGEDEEAHGNESRKQADGELSGGSNFGVNGENKEERKGIRRAQHASV

SEQ ID NO: 118213 - protein, 306 aa, Triticum aestivum
  unsure (1)..(306): unsure at all Xaa locations
  Clone ID: PAT_TA_12631.pep
MEAGVGLALQSRAAGFGSGRRRSATYGGESGARTVSLRASDQVGSPAAVRARVAKPVVPLRAKKSSGGGHENLHNSVDDALLLKRKSEEVLFQLNGRCIYLVXGMMGSGKSTVGKNLVEVLGFSFFVSDKLVDLAVGMPSVEQIXEIRSEALLWVSCSSVLGQLSXPRQLDKDDEGPAVLRPGDFRNTWKXIAILWNVPLALPXRPTGELGTASRPLLDQPSGDPYTMAFSKLSTLAEQRGDAYANADVRVSLEEIASKLGHDDVSKLTPIDIALESLHKIESFVVEDTAVADPQTESQAQRIHTL

SEQ ID NO: 118214 - protein, 85 aa, Triticum aestivum
  unsure (1)..(85): unsure at all Xaa locations
  Clone ID: PAT_TA_12632.pep
VATXYPPPTGGYXRRXAAAGPKEGTRXGGGGGGAYPTPPPPNPFLPYFPFYYYSPPPQLKSPAPAVSSSAAAPLLLLALSGLLLW

SEQ ID NO: 118215 - protein, 204 aa, Triticum aestivum
  Clone ID: PAT_TA_12633.pep
MDGLTDEERAIRYALYWYHDGTRKHSIEAFVSCTTDLPTEELVKAVLDKYNEDNGLVGDLACELEDIVSHNSCFDGKDCYRSYDHFNLTMKTKGAANNDLYFAEVTCMDGDYEAYVLTCICVVKPDDNGECHVCGADMKHPAHDGYNRGRPQKSYGHGRRRARGVPLFEKLFDVRDEVWLKEEEDRVRRMIKGGKEERRKFHTG

SEQ ID NO: 118216 - protein, 114 aa, Triticum aestivum
  Clone ID: PAT_TA_12634.pep
QGYHNNSQLHNSQYHSSGYFKLLRYISCTTNLNCEFPFRGESTKRQQTYLSFASSFVCTARRSCLFMIKLQSFQFSIPFTQLPFQLNNVLLSFTKWRLFNLDASFVYNRRKDRL

SEQ ID NO: 118217 - protein, 178 aa, Triticum aestivum
  unsure (1)..(178): unsure at all Xaa locations
  Clone ID: PAT_TA_12635.pep
MDYYNILKVNRNASLEDLKKSYRRLARTWHPDKNPTXAPEAEARFKQITEAYEVLSDPEKRAIYDQYGEEGLKGMPPPGSQSRTATASGSSGPSNFRYNPSDPDDIFNEFMASNKPYTFDQDRRRFQPAHRTSAVNGRSEASSSSQKEPGTSTSHLEKPPPVEKTLLCTLEELYNGTK

SEQ ID NO: 118218 - protein, 198 aa, Triticum aestivum
  Clone ID: PAT_TA_12636.pep
LTPLTTERPLFIRAAETNGDRITPLAQRASEFTQHYVLNADNVASLPSKDEAETSEDELIRRIPPSQKCTLQVQRSKPEPGCRFMYDRMEDRFNYLEDRIGRSARLFSATGLCGQPADATLASEENMFAVGMVICDGEGRLNEKSILLQGSVEHSRGQRVRLDLKDINQFSLFPGQVVGIEGHNPSGHCFVASKLTDS

SEQ ID NO: 118219 - protein, 137 aa, Triticum aestivum
  Clone ID: PAT_TA_12637.pep
AEQLGPPGGGGEHEWGRRNPWWERMYKQPRSEGENNVWRRKHRDFIRSFDIPIKTIALECYEGSKSEVDFVTFFVPAGGAAGLMTFHIQSHVYTEEFFAEQHRELQLEKKASKGAQFHFTVGRCVRSVGLCVMCLGL

SEQ ID NO: 118220 - protein, 271 aa, Triticum aestivum
  unsure (1)..(271): unsure at all Xaa locations
  Clone ID: PAT_TA_12638.pep
SNQMTVVQYFWGRYKYRLRFTSWPCLQSGNDSRPIYLPMEVCTIIEGQRFTRKLNEKQVTGILRATCERPRDRENSILKMVEHNNYSADKLAQEFGIDVTDKMVNVQARVLPPPMLKYHESGKDKACAPSVGQWNMIGKKMINGGNVQRWTCLFVSRLHIDGVKRFCGDLVKMCTPXGMVFNPMPVVEILSASANNIEGALKHAYQRAHNLQLLIVILPDVTGHYGKVKKVCETDLGIVFQCLKPDKVERAHKQYFGKVALNVNDKXGGRN

SEQ ID NO: 118221 - protein, 149 aa, Triticum aestivum
  Clone ID: PAT_TA_12639.pep
LVTEESRFHSVAYLQQIWWLEVGGELDFCFPAGSYSLFFRLHLGRAHRRMGRRVCGTELIHGWDARPTRFQLSTSDEQQATSEYYLDGPGSWILYHVGDFVISNSDELTSLKYSMMQIDCTHTKGGLCVDSVAIYPKGYRRENMNTVYM

SEQ ID NO: 118222 - protein, 360 aa, Triticum aestivum
  unsure (1)..(360): unsure at all Xaa locations
  Clone ID: PAT_TA_12640.pep
MPLKDAARAACVSQSFLSSWRCHSNLILSRESFGLEGEKETARDFRRKIDHILRNHSGTGVRKLSLRLVPNYNAKDRDYINKWLEKAVTPGIEELTLSLPINNKCKYEFLCTVLSNGRGDSLRCLYPTNCSFHPMALLGCLRSLTKLELFMVRIPGDELCCLLSRSSALEWLSLTYCNKVNCLKIPCHLQRLSSVRGEDCSKLRVIEXNKAPNLSSFQFKGGLKVQVKLGKALQVKSLYMSSTVFGCNTRAELASSIPSREMVNSPMVSSKLTDLKSMIICLGEMSFCLSFDCQSIVSILGASLTLETFISHVSDELMQHALVFGDPSRSWMLDTSGGVVSPLNKSLIKLACHVLRGWLT

SEQ ID NO: 118223 - protein, 100 aa, Triticum aestivum
  unsure (1)..(100): unsure at all Xaa locations
  Clone ID: PAT_TA_12641.pep
XGXGVXXDSIFRXGIWGTXAPPPFFLPKRGKKKXPNCSLSIRNLCFKKGAXFLKXEXGIWRGLFCVLSRRVFCVSLPKPHCPNSCTPSNPVLLSSLGRLH

SEQ ID NO: 118224 - protein, 149 aa, Triticum aestivum
  Clone ID: PAT_TA_12642.pep
CSSRSSSHPARAPGKCIASPLSMPRLSKVARILGPRGLMPNPKLGSVTNDVSGAVKAAKSGRVDFKIDKTAIVHVGLGKINFSEESLRENIGAFVNALLLAKPVGLKKTSKYVGYVKKFTLSSTMGPGFPVTIPSLSAAADDYSKAHVS

SEQ ID NO: 118225 - protein, 189 aa, Triticum aestivum
  unsure (1)..(189): unsure at all Xaa locations
  Clone ID: PAT_TA_12643.pep
APFSILKAKSPFLFTSLGAAGPCCLAATSDGAGRGALLCPEPPPAGQPVATPPWSSPPPTTSSSASFSSASIPSATAGSTLEERPDPPPPASPAVGSRTXRESPVHSQRGARSCLGPSLPGKPSSSISMSNSSGGGGGWRGAGRGGGGREGAAVLGDRREEARGPRGGHRRRRRDRGPVREERLPRSSA

SEQ ID NO: 118226 - protein, 382 aa, Triticum aestivum
  unsure (1)..(382): unsure at all Xaa locations
  Clone ID: PAT_TA_12644.pep
MVNAQMVSGYLDNSFNALMVSGGGESGQTQNGGTDTTLSGWKDLPMELLLRIISVAGDDRMAIVASGVCTGWRDALGWGATSLSFSWCQDHMNELVISLAHKFTKLQVLSLRQIKPQLEDSAVEAVANSCHDLRELDLSRSFRLSDRSLYALAHGCPHLTRLNISGCSNFSDAALIYLTSQCKNLKCLNLCGCVRAASDRALQAIARNCSQLQSLNLGWCDTVTDGGVTSLASGCPELRAVDLCGCVLITDESVVALANGCPHLRSLGLYYCQNITDRAMYSLAENSRIRSKGMSWDTAKSSRLRAAAAALASPALPHCTALTPPACAXAVVHAGLAIHSRRATHFPLSGGCLCLTXRLHCACAHHRHRARAGRAILSNHAY

SEQ ID NO: 118227 - protein, 185 aa, Triticum aestivum
  Clone ID: PAT_TA_12645.pep
YKAVTVEFDRQVNASRITQEDDSFEYCYSASPLEMPDVPTVTLNFAANKSFQVVNPTIVRKDGEGSIAGFCLAVQKSPEAIGIIGQNFLTGYHIVFDKENMKLGWYRSECHDLDNSTTVPLGPSQHHSPGDPLPSSEQQTSPTVTPPAVAGKAPTSSGGPSNLHRLLANCCSLLFLTISTVFFIS

SEQ ID NO: 118228 - protein, 264 aa, Triticum aestivum
  unsure (1)..(264): unsure at all Xaa locations
  Clone ID: PAT_TA_12646.pep
SADAWGRMDLGGKALTNYLKELVSYRSLNVMDETLLIDDAKEKLCFVSLDVPRDLRLASLSFKDNPFRCSYILPDGITYKKGFVKDLDEARRYCSLPVEGELDKKDGDSDTVKDRKKPELSQNEFALTNERFLVPEMLFHPIDLGMNQAGLAECIVRAAQACHPYIQPVLYQSIILTGGSTLFPRFAERLQRELRPLVPEEYQAKIISQENPILGVWRGGXSVLASSPDFESMCVTKSEYEEXGSARCRRRFFHWKSCSVDRTM

SEQ ID NO: 118229 - protein, 198 aa, Triticum aestivum
  unsure (1)..(198): unsure at all Xaa locations
  Clone ID: PAT_TA_12647.pep
TRPHKLKRQTSDDPLIRSEEKHCHLSVFSIKKTEEGAQHHLVTKHEAHKRIIWACSWNPFGYEFATGSRDKTVKIWCVQDASSVKLLATLPQFRESVTALAWTGRDRARNAGIIAVGMDNGLIELWSVSXGESXSDSSSDPPPLSVACMLRLDPLLCHVSTVHRLRWQKPDSADEKAAIELASCGSDHCVRVFAVRDT

SEQ ID NO: 118230 - protein, 172 aa, Triticum aestivum
  Clone ID: PAT_TA_12648.pep
SAHASAERRRIRRDPPPHPSPVPARRLDPPTPPIPVLAGHGSGKILHPSPPMPSWRRIRQDPPAAPSSTAASSSLPSPRSRPPLSPFLLPPLPANYLRRGLVHVHPRQLAYSLANDGVQYDVRWHAVPRLSLACNATSVQCSLLWRAVQLALACSVARPCMRAPSPVVSLLL

SEQ ID NO: 118231 - protein, 207 aa, Triticum aestivum
  Clone ID: PAT_TA_12649.pep
FCNGKAFPEHVLQWIALNFLLAGRDTSSVALSWFFWTVMQRPDVERKVLLEIASASGETRGDDTGRWAEEPLDFDELDRLVYLKAALSETLRLYPSVPQDSKYVVADDVLPDGTVVPAGSAITYSIYSVGRMESIWGKDCVEFRPERWLSADGSRFEPVKDAYRFVAFNGGPRTCLGKDLAYLQMKFIASAVLLRHSVELVPGHQVE

SEQ ID NO: 118232 - protein, 206 aa, Triticum aestivum
  unsure (1)..(206): unsure at all Xaa locations
  Clone ID: PAT_TA_12650.pep
WIVAGTAGDRKGWIYVYNYDTWEEVKNLKAHNASITSLAVHPTKTYVLSASHDYDIELWDWKKGRKSAQTFKGHKGSVYQIAFNTKDATIFASVSQDKTIKIWSLDSPRSNLTLXGHTSKVRCXDYFSRGDKQFLITGSDDKTAKXWDLQTNSCIKTLEGHTSRVSTVCSHPMLPKVMTGSRGYLTSASMKFMHCDVVLRKPCEGV

SEQ ID NO: 118233 - protein, 249 aa, Triticum aestivum
  Clone ID: PAT_TA_12651.pep
PLSPVSSSSNLNPSPPPASSTALPSQEASSTSPSSSADRSLRGASRQELANHQQSLAAAPAPDAELAGETEEQRGKFLVLRLYEALNARDARRAQELLAPDLEWWFHGPPAHQHMMRLLTGAGTNAEFRFCPRSVDAFGSTVIAEGSAGQLLYWVHAWTVGPDGVITQLREYFNTDLTVTRLSAAAATNNASAGSPSHSSSSSASSSPSSSTSSGLSSPAHTPKWPKCLWQSRRTDRARKSLPGLVLAI

SEQ ID NO: 118234 - protein, 241 aa, Triticum aestivum
  Clone ID: PAT_TA_12652.pep
STQRLHPPHLVAPRRHERRFHQLVAIKPSSSPHPSPPPTSGRAPGAGSPGSPCWASGRRGGRKARGALPHLDSLQGGFASARGHETEEHAQQVPGCSASTRRSTAATTPPCTPSSPPTSTWWSHGPPAHQAHDAPPHRLHAPPPSASRPRLRGPPSAPPSSPSGRPPAGRPRDTKGRPTGCTPGTRRAPDGVITQLREYFNTRPHRHPPRRRRRVQVRLAEPPPRPRPQLPPRPRPRPLAA

SEQ ID NO: 118235 - protein, 269 aa, Triticum aestivum
  unsure (1)..(269): unsure at all Xaa locations
  Clone ID: PAT_TA_12653.pep
SADAWGRERKSLQFEDPPISQNFQESSSPKMAKSPSLQRTHGMLQFWRSDTTRNSHDSPKDRSPPPEQTTDNGIPLVATERAPSIKRHDSFEMELPNLPKVDIHPIQRQSSKNAGPDSPISPLLTSDPKNERSHSQTFSRPQSERDDTSSEQSEPDELQHHKPPSFWRLAALSIAEWPYALLGTIGAAIFGSFNPLLAYTIALTVSAYYQIEVSDMHHEVNRWCLFIVGMGVITVLVNWLQHFYFGNMGEKMTERIRXMMFSAMLRNEA

SEQ ID NO: 118236 - protein, 255 aa, Triticum aestivum
  Clone ID: PAT_TA_12654.pep
MEGSGRQGKGGAPAWAPSEGTVFRPFVAAAGAASASPSGSGSGVAARISKLHGVKRKPCVARLTADIINTFERCHPEFKYSETLNPKRFLTHPSTPAHNDGVDNANWDLILYVNLELVNKTSNRRFIVKEMLGQGTFGQVVKCWDTETNKYVAVKVIKNQPAFYQQAIMEVSLLRTLNQKFDPDDKHNIVRMLDYLSFQNHLCIAFEMLGQNLYELLKRNHLRGLKVQFVQAFSKQILDAMIVMRDGGIIHCDLK

SEQ ID NO: 118237 - protein, 420 aa, Triticum aestivum
  Clone ID: PAT_TA_12655.pep
LDNELLEYGGSDLVAFLQSAGRKHQEERPGAPRLDDLGAPISTSQTKYLELLARYYVLKGEHVAAARMLLILAERQCSNAEEAPALDQRYQYLSNAVLQAKSAGIAADSSRNPIDSSTVDLLEGKLAVLRFQMQIKQELESMASRLETIPGSSESPSDPFPRDNVLADAESAKEAKDKAKELSLNLKSITQLYNDYAVPFNLWEVCLEMLNFANYSGDADSKIVREIWARLLDQTLTRGGLAEACSVVKRVGSKLDPADGACLPLDIICLHLEKAALDRLSSGQELVGDEDVARALLGACKGLAEPVLAVYDQLLSNGAIVPSLNLKLRLLRSVLAILREWGMSVIAHKLGTTTAGASFFLDGTFSLNQTGSLQKGVRDKIISLANRYMTEVRRLNLPQNQTDNVYRGFRDLEEKLLSPY

SEQ ID NO: 118238 - protein, 191 aa, Triticum aestivum
  unsure (1)..(191): unsure at all Xaa locations
  Clone ID: PAT_TA_12656.pep
RTLXCANLSLAWHAVPRSLACTSCRFRSCPLLSRSRPSLLPRSRSTRLPRLLHHAFRMIFTYMYTQVVCFAQKVESSTKDRRDHVFSWVLSATPDSLLDRALIQLGCGVLLGAAAPILSLLLQPSAWGFIFPVDSSDVGGELSILSAAASFAGRVGASPLSTLRFCVTSPSANNKQTSKKNRKKKTKEYLK

SEQ ID NO: 118239 - protein, 102 aa, Triticum aestivum
  Clone ID: PAT_TA_12657.pep
CKSEYNYSLNPLRKYTGIRCITRTYKPAMHHKNSHNSSATNNSVITLNLHCKISYQLHCKSTTQFHYKNSSELHSNSTRGYSANPWQLHYKSAIKLHCTSPD

SEQ ID NO: 118240 - protein, 140 aa, Triticum aestivum
  Clone ID: PAT_TA_12658.pep
TPKHEVLNFKQREGENLKDAWHRICNAQNRSTRKLSTSVLLRSFYVGITPWNRCVLDTVAGGDFLSSHAFDAYNAMLDLFGPPPLLVNGTVLTLEHVMQRLDIIENKMATIELIDNLDKKIHNHITQYGSRVGVTLKNLK

SEQ ID NO: 118241 - protein, 145 aa, Triticum aestivum
  unsure (1)..(145): unsure at all Xaa locations
  Clone ID: PAT_TA_12659.pep
ALTLNSFGFNRCPPSMDEEDIDLDLDDDVVHPTQDPYVVVGGGWRGDAGRRGGVVDEREKEEDIPYSCPPLLTSMARPPLLCXQTTQGEAEVIHRRCSTPTPLGSKGKGLWRQRHWEEAAALGRGSGARRGGTYFISTSTFPLGL

SEQ ID NO: 118242 - protein, 192 aa, Triticum aestivum
  Clone ID: PAT_TA_12660.pep
MGLSVIAPPAGDSASPAHRRARRAFLVSNYMILGAASGCGFLTLSLRLVPPVDGFLLILLHALTVAAAVAGCAVIAAPDPPRGRVYTAHMSATVVVSILQGAAAVLAFSRTAEFLADGLRSYVREEDGAVILRMIGGLGIAIFCLEWVALALAFVLRYYAYVDRECGGNPMRRSAKVGGEDGAGNWPWPFQV

SEQ ID NO: 118243 - protein, 267 aa, Triticum aestivum
  Clone ID: PAT_TA_12661.pep
YLHASGCCTSSDFRLENVQRPTSLLLSHQVSLDACLLAGVRLFSVAGTPALFFGEASATTDGESFLAEESAAEDGESLLSWLFFSRRKFTGFAYELVHGHLLEWMVSPSTIVSSSKIFPPSEALLEKYLALMRAASSAWYLFTFCSCSSISGSPTASIAVAGSDLTLSMVPQCPAERRRTSWKVSRHASPQETELNALEKNEHSDYREQNASRLGFVASKPTESTPRQSSATGEKKPTAGLMGRNLSGVASFGGGGWGSAVAEGRGG

SEQ ID NO: 118244 - protein, 324 aa, Triticum aestivum
  unsure (1)..(324): unsure at all Xaa locations
  Clone ID: PAT_TA_12662.pep
VLINSYGSRALHSYKNNGQKKAEVAVREMLGVVASRVEKETGXSCVIEDEDYMDDGSVLHLKLTLDSXRGEATFDFKGTSPEVYGNWXNAPEAITAAAVIYSLRCLAXVDIPLNQGCLAPVKIIIPKGSFLSPSDKAAVVGGNVLTSQRVTDVVRMAFEACACSQGCRNNLTFGDDTFGYYETIGGGCGAXGRARNGTSGVQCHSXTNTRLTDPEXILSSRYPVLLXHKFNIRESRVGYGFHRGGDGLVREIEFRRPVVVSILSERRVHAPRGLKGGENGARGANYLVRKDGRRVFLGGKNTVTVNAGEILQILTPGGGGFGSP

SEQ ID NO: 118245 - protein, 110 aa, Triticum aestivum
  unsure (1)..(110): unsure at all Xaa locations
  Clone ID: PAT_TA_12663.pep
VPIXRMKLRQLEAQQGDASYAAQQSKVYPSTSSCSQQQSKVYPSASSCSQQQFAEATKDAASSEVRPKRVKIRLPRSANRLVEQQQQQQQGSSGQRFAVDDKPPGFWHTV

SEQ ID NO: 118246 - protein, 80 aa, Triticum aestivum
  Clone ID: PAT_TA_12664.pep
GLRIKYKRNGARCITTQSRRRCYFIVALSLSMQSNMGLFWCPVFIVACVCNMGAAVSIDRLDYFFWATKIYEETSRSEIN

SEQ ID NO: 118247 - protein, 110 aa, Triticum aestivum
  Clone ID: PAT_TA_12665.pep
MSHSNQVRYTARSITPPADRDSGSKSPPPRRRAASKSPPLPPPPPFPPKGVRTISRSLLHLVVQDAASRGPLRQRGAAGPGPGPGPGPATRSRSRSLDPRPRAGILPTSL

SEQ ID NO: 118248 - protein, 291 aa, Triticum aestivum
  unsure (1)..(291): unsure at all Xaa locations
  Clone ID: PAT_TA_12666.pep
MPAAVASSSLLSPPPANEIQPASEIRPTDRRLQAEADRDRPLRRLVPPRGRNMSQSNQLRYTARSITPPADRDSGSKSPPPRRRAASKSPPLPPPPPFPPKGVRTISRSPPPTSTRRSVSRSPPPKRRGRSRSRSRSRNRSRSRSRDKDDVRNPGNNLYVTGLSTRTQEPGLEKFFSKEGKVXKDCRVVIDPRTKESRGFAFVTMENVEDARRCIKYLHRTVLEGRLISVAKAKRTRERTPTPGEYCGPRGGRSRVEPRRSRSPRRSSRSSRDRSRSPSTRRDRDRDRKRD

SEQ ID NO: 118249 - protein, 266 aa, Triticum aestivum
  Clone ID: PAT_TA_12667.pep
SPGSSQRNISESDSFASISSAHASEAVNEDNNTGVPRNNFPIASPRVYALVACLKLALDCFFAVWFVVGNVWIFGGRSSVHDAPNLYRLCIVFLAFGFIGYALPFILCTMICCCLPCIISMVGFHEDLDMNKGATAEVINTLVAYKYKSMRIRDGGEVGEDNGGVLASGTDKERTISAEGAGWGARRPRLPRQAARGEPPSGRAGQEARTGQRGRSTAAWPHGQGEEGGWTAASPGGGPGGPPEQTGHRERGDAGPQRPLWRSCVA

SEQ ID NO: 118250 - protein, 449 aa, Triticum aestivum
  unsure (1)..(449): unsure at all Xaa locations
  Clone ID: PAT_TA_12668.pep
GTRVAVATRRPGSDYRHIEVIDLSSGADNAAYFEVTRPVAPRAHHFNPFVSPDGARVGYHRCRGSGNGDSPLLLESLKSPASESLFRIDGSYPSFSPDGKKIAFVGLPGLYVVNSDGSGGRRKIFSGNAFPTSWDWKRKGVISRGDGGASASESTEVDVVAVSLGDEDDDGSSVSQISIKKLTIGGENNAFPSPSPDGKWVVFRSGRSGHKNLYIMDAEDGEAGGIRRLTDGPWTDTMCNWSPDGEWIAFASDRHNPGGGSFAIHMVHPNGTGLRRVVHSADGGRTNHPWFSPDSKRMVFTSDLAAVSAEPISNPHHYQXPTAQIFTINIDGSGLQRLTHNSFEDGTPSWTPHFLXPRDVGETLRASGSCAFQDCHWLSIEDDAPACTVLPFRYAPWQQEDRLLEGSCALMMMPRESMSFLCWYIQVCPPGLEHPHRKTRICCEMRERQ

SEQ ID NO: 118251 - protein, 199 aa, Triticum aestivum
  unsure (1)..(199): unsure at all Xaa locations
  Clone ID: PAT_TA_12669.pep
MLKALPARFLVSPEPGGRRRRPRPRSLRPISAALMTNPAYFEVGRLLGNYGFMNITSYSSSQSGGLPNDAVNQDLSLGYSPEEIERLRVQDVGEGQVKISLXRLYEGRVVQGPLKGTQTVFKVYPGAIAGASEANLMALNELRTHAFFQSDARDICENIQFLLGAFETATGEQWLAFRDDGRYSAADYAKITSERQLKE

SEQ ID NO: 118252 - protein, 250 aa, Triticum aestivum
  Clone ID: PAT_TA_12670.pep
QCGICHELAEDVVVSRLPLESHLSSCIVFHWLSSTYELSFQVDLTTENSRRKVPANLKGGKRSGILGRLQSLADFKTSTKIDALREEIRNMIEHDGSAKGIVFSQFTSFLDLIEFSLQRSGIKCVQLNGKMNMVEKGRAIDAFINDPDCRIFLMSLKAGGVALNLTVASHVFLMDPWWNPAVESQAQDRIHRIGQFKPIRSTRFVIKDTVEERILQLQEKKQLVFDGTVGDSPEAMSKLTEADLKFLFQN

SEQ ID NO: 118253 - protein, 279 aa, Triticum aestivum
  unsure (1)..(279): unsure at all Xaa locations
  Clone ID: PAT_TA_12671.pep
DVFCLLLQINPTKGNKSWSSTAVAAALELVDPPGCRNSAPGGRLPPGDVGSPLARGLCPLRRASFAGRPDAFIGAGARGVGRAGRGSAAAGRGPAGRRAAPGARVLLLGVAGPRAARRPAAARPRVAPRPRLXAGLRALRPRRPLSAAPSFARGALTSYLAFIDHTVVTTLRGWSDPGDDFEHXFTEAGARMTXRRILRVLPGRCPTPRTAAERASTATDTSGRTRPKATDPPGSPSHKAIGAPRRPLLAAPFGPAAVRPPPSPGGAPIRAGRAPKRFR

SEQ ID NO: 118254 - protein, 169 aa, Triticum aestivum
  Clone ID: PAT_TA_12672.pep
MSGGGRGGGEEEEVVHMEDAVNMLVEHLVKPVLPRGAIFGAAQGERHMEPDKQRAVAQQIHTAIILYNYYHRKMSPQLAFADPKRFFVCASLSAGEDLLAYLSMVHERESNPGKHVRLSVTDRAAIQACEIAEELDASKDSPDMAMWPISKVAVLLLDLTRKKCLIEYS

SEQ ID NO: 118255 - protein, 153 aa, Triticum aestivum
  Clone ID: PAT_TA_12673.pep
YSSVIPFFFVAFRRTVCALMASGGVRRAPAGAPCHGHQPAPLAVSRVSLDMASPPLPPRAAPVSPPPRVAPSPSTELHIKHGELVGGAEQAGIALLQLLDEAGEHTGLGRHGHARRLHLHGVERRASSCAIHELTMPKLMARGRGELGTRRAV

SEQ ID NO: 118256 - protein, 173 aa, Triticum aestivum
  Clone ID: PAT_TA_12674.pep
IWRIWHLYELLRERDNEQKQEKVASTTSITRSEPIENKIILHSPTNVIFFGPPGTGKTFRLQQKMKEYTSHAVPADRDAWLDSRLESLNWMQVITLVLLDLGKRAKVRQIIEHMWFQRKALLNGRNGNLSNTAWAALQSYTVPESLTVDYKNRREPAVFNKTDNSEWFLVDSQ

SEQ ID NO: 118257 - protein, 299 aa, Triticum aestivum
  unsure (1)..(299): unsure at all Xaa locations
  Clone ID: PAT_TA_12675.pep
LQITRSAGIITETAWAGAAFNLIIYMLASHXPGRXPWYLLSIQRKDACWKQECGLNPGCNPAYLYCGNGXTNANAGNAFLQSVCIPSTXQDNLPDPPFGIYLPAINNVSQSNKFLPQNYFTVSWWGLQNLSSLGQNLKTSTYAWENLFAVFVSISGLVLFSLLIGNMQTYLQSATLRIEETRVKSRDTDQWMSYRLLPDNLKERIRRYEQYRWQETSGVXDEEHLLMNLPKDLRRAIKRHLCLSLLKRVPMFEKMDDQLLNALCDCLKPVLYSFLTSSTSLITCVASVHPNIGSFHIVQ

SEQ ID NO: 118258 - protein, 69 aa, Triticum aestivum
  Clone ID: PAT_TA_12676.pep
PGGVPTLPSDHIAPSFASHMLNLLLPRLITPRRHNGPPISIRDRLRGPRFILLHPRASVASHHHHHPNY

SEQ ID NO: 118259 - protein, 250 aa, Triticum aestivum
  unsure (1)..(250): unsure at all Xaa locations
  Clone ID: PAT_TA_12677.pep
SAHAYARLLLACAAIKSRGSSLIERKGYCEEALGFFSDLINLDXSHKRYYEDERSLVLMDQLTCDMETFMKYCSVQVKSNSAPLNHVQLCRLSLTRIGFTERVLWIQMLDLSHNSLRSVEGLEALQQLVCLNISNNQISSFTSLEPLTKIVSLKALDLSFNKIGAHLIDTTRYMCSSPFLHKVERCEAFEECRKKNVNVEEFWDAILFFKSMDLVQLDFKGNAVADKDSFAAVVSTLSPSLKWLNGTCIH

SEQ ID NO: 118260 - protein, 235 aa, Triticum aestivum
  unsure (1)..(235): unsure at all Xaa locations
  Clone ID: PAT_TA_12678.pep
PRVRADMPSERLLAHFASYGEIEEGPLGFDKLTGKFRGFALFVYKTPEGAQASLVDSTKVIDGQQLLCKLAIEGKKGKQQPQQSGPAGQQQPXMLQGGPPDMTGSGLGLGGAQMGGQYGGPGNGMPSFGAFGGPNPYANMPSSMGGGGGAGLGSMGNPMHSGMGSAGAGGFTAGGLGGGSFGGSSQFGATPTRSARGSPPRATSRRPWLQQTRPPAAPRATDSSPSATQTPPSSL

SEQ ID NO: 118261 - protein, 101 aa, Triticum aestivum
  Clone ID: PAT_TA_12679.pep
RPAPAASATRRRSARSRSSWPATAAAAASMATSTSPLPARLPPPVAELIEATTTTRPQPVVDRTISYLAGMPDIFYVRSRMHACARMVMALHFSFVRVCIS

SEQ ID NO: 118262 - protein, 138 aa, Triticum aestivum
  Clone ID: PAT_TA_12680.pep
SHKVYGGEARISSLRKLFPLMEDKRSLALADELANVEGKASVLAALDYHISMHSDVFISASPGNMHNALLAHRAYRNLKTIRPNMTLLGHIFVNKSMEWSEFQQAVQAGHKGRYGQIRLRKPKQSIYTYPAPDCMCQG

SEQ ID NO: 118263 - protein, 342 aa, Triticum aestivum
  unsure (1)..(342): unsure at all Xaa locations
  Clone ID: PAT_TA_12681.pep
PGILECPEFFPVREPPKTNGVDTSPFGPXKSACSRNCFDNTRYDYYTVGTYNNGRERYVPDKPTGDVCHRGQYGFGNFFASENFYDPAKXRRVLEVWDNESDSVAHDNAKGWAGIHAIPRKRXLDPSGKQLLQWPVEELDQLRGKAVSVGDKLVKPGQHFEVTGLQSYQSDVEVSFEVSSLDKAEPFDPAYANDAQKLCGMKNADVKGGVGPFGLWVLASDNLAEKTAVFFRVFKDGHGKPLVLMCSDPTKSSLTPGLYKPTFAGFVDTDISSGKISLRSLIDRSVVESFGAGGKTCILSRVYPSMAIGKDAHLYVFNNGVTDIKVSKLTAWEMKKPMMNGA

SEQ ID NO: 118264 - protein, 100 aa, Triticum aestivum
  Clone ID: PAT_TA_12682.pep
MAEEGKHLETGRADRSVWLMKCPTIVSRAWQEAAADAGGPNPNPNPVVAKVILSFDPLSTDEDPNQFKMEMAQTGNGNTPKNYSLNMFKDFVPMCVFSES

SEQ ID NO: 118265 - protein, 82 aa, Triticum aestivum
  Clone ID: PAT_TA_12683.pep
STHASAPSVATPNSGEAVSMHAAVEKDMDEVTDDSPGDGEVNASNFVSELDVVASGAQDCEGVLVEGSLNLSRIPNSPESTH

SEQ ID NO: 118266 - protein, 382 aa, Triticum aestivum
  unsure (1)..(382): unsure at all Xaa locations
  Clone ID: PAT_TA_12684.pep
MMLLLARSLRSRVRPPLASAVSAAPFSSVSAAAAEAERAVRDGPRNDWTRPEIQAIYDSPLLDLLFHGAQVHIXVHKPTQPQQCTLLSIKTGGCSEDCSYCPQSSRYSTGLKAEKLMKKDAVLEAAKKAKEAGSTRFCMGAAWRETIGRKTNFNQILEYVKDIRGMGMEVCCTLGMLEKQQAEELKKAGLTAYNHNLDTSKRIXYPNIIPTRFRYRWFRFTSSFXACPXXGCAGGRPGPGEAEDDPLGLLHTLATLPTHPVSVPITALIAVKATPLQHQKPVEVWPILRMIASARIVIPKAMVRLSAXGGVRFSMPEQALCFLAGANSIFAGEKLLTTANNDFDADQAMFKILGLIPKAPNFGDEEVMVAAPTERCEQAALM

SEQ ID NO: 118267 - protein, 152 aa, Triticum aestivum
  Clone ID: PAT_TA_12685.pep
YLRSVLEKAHETLAKQNTGSGGLETAKIQLSELVSKVSTECFHNAFTSFEEIEGSQMLRRQTMQLGDGSVDSCLTACEGSQKDQDILSMSLSAQKGKEIGGMAFDLQMKERGPRGFVSQQAKQKASKPPRRTREERQLEYDIPGNEIGFKHE

SEQ ID NO: 118268 - protein, 148 aa, Triticum aestivum
  Clone ID: PAT_TA_12686.pep
LKGERWYVGAAAPEVVRRPWSAGSHPVQRGLRVAASCNVVAGGGAVVCRGSGPGRWCRWTAQGATERWMSGRRLRDFAALRTSASCRLGDEVAFDVARCHIREAGHVECMLFISTGGSRGCSSHSGHGFFSPTAVEVVCSTCCRQKWA

SEQ ID NO: 118269 - protein, 199 aa, Triticum aestivum
  unsure (1)..(199): unsure at all Xaa locations
  Clone ID: PAT_TA_12687.pep
SKKIGAKLRDLVPCVLLSFDKEQILIYRGQGWKSXRYLKPLTPVPKVEKNNRAVSSVVDSSGESAGASNNVTIREVLRPRMFKLWKRAIESSIALSLDDDEANALAPDTLLMRVEEFSITSQAVEHSFPALLVGNGKEGPEALNEPGDGIIRPQENQFEKSLDAGDDDHFEYDMLERLEPSAPLGSLPIDSVIEQLNSE

SEQ ID NO: 118270 - protein, 208 aa, Triticum aestivum
  Clone ID: PAT_TA_12688.pep
TNWGRQSVVDGLGPHAAAPPALAPPAAPRAAAAPLPVEVLHQLHPGPALHRLGGAPAGALLLVLEQDLLELLHLHLQPAHLLGHLPHPLQDLALAPAPEVHAPAVEPVRPAAPPRPPPRPPPAPPRPPAAPRGRARRPPPAPRPAPPPRPPAPPPRRAAPWGAPRPPPGPARPPPRPPPPRAGRLGPGPSRTPPRSVAATDRRACRCR

SEQ ID NO: 118271 - protein, 441 aa, Triticum aestivum
  Clone ID: PAT_TA_12689.pep
MISSEKLCLGADGNRLSHPDAGYLDSVCADLSDLGLPSDMGHDLREGETESLVKIGDSHPCPIGRDDVCLDDMFDDIFGDWPLTGDPILWDDIRSENSDDYVVPDSDEGDRFADVKTNCPGRNIPRQLAKKMDSAWLRSIAEQNEKYDARCQEILSQNEDADLPPVPLDVFPEATGLCVERGCCYHIEYMTHDTSTTNSDLGYSGPELMLQIFSLRLSSFSASYSYPINVYGVFAVRDVLEPLRNHVFNRSRDDPVTVDQDPFTLALCSPCRGMYIPYDQVLLEVDLWIKKEGDGSADQKLLSKYLELDVRTRGDGFIYGCIPGDSVSLEIDCAYLTESVEAVIEVYAEVSHPCHVRFVAFSSGYDDEIVLFDGKFSGEKLFKHVVAVKAERELKVQLEVEKSVFQWIFQGGNAGPLSFPDDSMLKYGQFDVGVCFYPSTG

SEQ ID NO: 118272 - protein, 170 aa, Triticum aestivum
  unsure (1)..(170): unsure at all Xaa locations
  Clone ID: PAT_TA_12690.pep
GYVDPEYHRTCQASTKNDVYSFGVVLLELVTGKPAILPDTEAISIINWARXRLARGDIEGVVDTRMQGDHDINAVWKATEIALKCTEQVPLQRPSMAEVVMQIQECLDLEEDCTGRDDEFYTGSSSVGMDPNMGYNASTNRCTDLRQNNATLEIEYNHRRGPQMTSMATR

SEQ ID NO: 118273 - protein, 164 aa, Triticum aestivum
  Clone ID: PAT_TA_12691.pep
MAAPPVARKVPRKLAEHGDVRVDDYYWLRDDARKDPAVLAHLRAENDYTAALMSDTKQLEDEIFAEIRGRIKEDDIDARPRKGQYYYYKRTLTGKEYAQRCRRLVPTDGPVTVHDEMPTGPDAPAEHIILDENLKAVGHDYYSIGAFKVSPSSKRIWLLLVHHG

SEQ ID NO: 118274 - protein, 92 aa, Triticum aestivum
  Clone ID: PAT_TA_12692.pep
KNACWFGQERRGCWFGQEWRGCKIGWCKDDCSFGQEKRVCWFGQERRGCWFVQEWRGCKIGWCKDDCWFGQEKRVCWFGQERRGRWFGQERG

SEQ ID NO: 118275 - protein, 166 aa, Triticum aestivum
  Clone ID: PAT_TA_12693.pep
MAAALAAGVGVLLPFPFYWALWTRPQRWVDLCGRGADPCRRMAQVSHVLKALQLLALASVASFSWPPPLCALPLLAFGQYLNFKVYQLLGESGTYYGVRFGKKIPWVTEFPFGYIKDPQYVGSILSLVALLCWVPFQYIVLWCLGYVFMILVEDKEDPATRAKLLS

SEQ ID NO: 118276 - protein, 68 aa, Triticum aestivum
  Clone ID: PAT_TA_12694.pep
TLCSQASSGRLKAPLKMKIFSLLFAPGKCLAADKLAKRGWPHNPICQLCHLRMEDGLLPRAEGKTYPI

SEQ ID NO: 118277 - protein, 183 aa, Triticum aestivum
  Clone ID: PAT_TA_12695.pep
AGDFYLSSSDDARDNFLMPSSSSSSVALSGNSSSHDGAHGSQEGSRPGHGGRGVDVVASARGERALQSAAPGREPTLWLRAPGGEPWDVEHVQSAATGGEPGCGGPTQPAAPGGDQPWSLRLAPGPVPDAAPQPVAGPALPVPLRPSALLLIDGLELVTSSRSISRGELKAELMVISCEFGCA

SEQ ID NO: 118278 - protein, 110 aa, Triticum aestivum
  Clone ID: PAT_TA_12696.pep
VLEHTEVSTQNRVPPPIHRSSKSSRCFVASMEMFATVVFEAFLNHLSIRLLGVHATKSTHKQIDEEPKAHKTPLLLLQHVSISTSIFFTLSKTRRRESQPQHPSPIRLDL

SEQ ID NO: 118279 - protein, 121 aa, Triticum aestivum
  Clone ID: PAT_TA_12697.pep
MAEAPSMDVLAPPADQVLAEDPGAGGQSQPPAPPRHEVHPRAEQGGRPEASTSVDIAAAVAPADQVMAQAPADQSQPPAPCSIAAGQVVPVPPRSADPPGPTPPNPRSWPAVIDIPDDDDD

SEQ ID NO: 118280 - protein, 247 aa, Triticum aestivum
  Clone ID: PAT_TA_12698.pep
SEILKRFDGVEDVIADSKAHKVVVKGKKAAADPMKVVERVQKKTGRKVELLSPLPPPPEEKKEEEKKEEPEPPKPEEKKEPTVISVVLKVHMHCEACAQAIKKRIEKMKGVQSADPDLKASEVTVKGVFEEVKLTEYVHKRTGRHAAIIKSEPVAPAEKAGEGDAKDEKKAAEGGEEKKDDKEEKKDDKDGAADEKKEEKDKEDGGAGGEEKEKEKDPGAIAAANLYMHYPQFAFPGGYYPPRPGYA

SEQ ID NO: 118281 - protein, 243 aa, Triticum aestivum
  unsure (1)..(243): unsure at all Xaa locations
  Clone ID: PAT_TA_12699.pep
RREPHRPTSDPPTGNRTEPPPPPHATREGAEDKRDAREGWGGEEAQGGRAGHAAAEAPPGAGRNAPRQARPWERERGRGTSDVSGGGRGPQGRHKRNQEESEREENPHGGEEDRPENDKPKGGEGEGEMPNEEEAAPPAXPTPPEEVVMRVXCTCEGCARKVKKILKRFDGVEDVIADSKAHKVVVKGKKAAADPMKVVERVQKKTGRKVELLSPLPPARHETMDKYEPVAPDEKAGEGDAKG

SEQ ID NO: 118282 - protein, 124 aa, Triticum aestivum
  unsure (1)..(124): unsure at all Xaa locations
  Clone ID: PAT_TA_12700.pep
GSTHSSAKAWGSGLLQWLEFTKLRGLSIQGRGTINGRGQQWWTYSDPNDDEDDDTYNQELERMPRVKPTALRFYGSSNVXVAGITIVNSSQCHLKFDNWLGVLVHDLTISFPENKSNTDGKHLQ

SEQ ID NO: 118283 - protein, 89 aa, Triticum aestivum
  Clone ID: PAT_TA_12701.pep
ATGFSWLDNHMSNQHAFSSTLFGSLFCIFHAEFSSNLPTGTLLGSLFCNFDADFPSSLPRGTLSGSLFFIAFDVSLSITLKPPYAKCIQ

SEQ ID NO: 118284 - protein, 76 aa, Triticum aestivum
  Clone ID: PAT_TA_12702.pep
SGRRGRRSDVTPTAEVYPQEANPRASRTVPFVTKAIDHPVARYGPLMSSGVTLSELGFMTKVIPKHVTMNGGVTFI

SEQ ID NO: 118285 - protein, 127 aa, Triticum aestivum
  Clone ID: PAT_TA_12703.pep
YFTKSRPVIYVWAVDVCGSILLLAPTPCLCCSGPVQIEKLKWSPSSQPTSAPSFSRLHAPAGPFPSIEVAVGPVATPQATAALLAPATPARSPSAAKPARTPPAATPARPTPAPTRPPTRPPTRPRT

SEQ ID NO: 118286 - protein, 111 aa, Triticum aestivum
  Clone ID: PAT_TA_12704.pep
LYRENICSYSCTVVLANKTRPAVICTNTSPGGIDCSLSRLSLPPRSTTYGRRCSNHPPPLSVADACNHVQPPTGCGHRGRAMPRELELHHPQPVPLQVAAEKQKAEVQDEI

SEQ ID NO: 118287 - protein, 201 aa, Triticum aestivum
  unsure (1)..(201): unsure at all Xaa locations
  Clone ID: PAT_TA_12705.pep
MEIAVGALSGMVEALPGKLGELLQQEYDLLSGARGDVAFFQSELRTMNAAVLRCEALEEPDVQTTGWIAQVRDLAFDIEDWVDLFAHRVDAGGTHDATSHRFSRWIRRLTTIPDRHVIATELKELRARVVEVSELRKRYSLGPQMPSRHAPAVDPRIFALYADSAGLVGMDGPRDEVAGMVTGQGSDGLKXVVSIVGMAGS

SEQ ID NO: 118288 - protein, 86 aa, Triticum aestivum
  Clone ID: PAT_TA_12706.pep
QLASLMDLLDEEGFFSTDDSSIDWEKESFKKLLDPFNALTGHCFDGCYAIRAIMDLQKFLPRKDDDTCHDAVKMVDLCKRGVEGKS

SEQ ID NO: 118289 - protein, 455 aa, Triticum aestivum
  Clone ID: PAT_TA_12707.pep
GVQRMQKELETNPGLYPFDEIIYCNLSNPHYLGQQPIKFFREVLALCDYPHLLNCSVTSSIFSSDAITRAREILDLIPGRAMGGYSHCQGTEGLRNAIAAGIATRDAFPCNAEDIFLTDGAAAPVHMVMHLLIRDEKDGILCPIPSHFLYTSSMALCGATLVPYYLDESGGWAVSISNLKKQLDGARSEGITVRGLVVVNPGNPTGQVLVKENQCEIVEFCRNENLVLLADEVYQENVYTDEKKFISFKKIARSMGFGEEDISLISFHSVSNGYYGECGRRGGYMEVTGFNSEVRKQVYKVASLSSCSNLAGQVLVSLVMNPPKVGDESYTSYREERDRIMLSLSRCAEAMVQAFNSLEGLTCSKAEGAMFVFPSVRLPKRAIAAAEAMNAKPDVFYALRLLENTGIVVLPGSVFGQVPGAWHFRCTILQQEEKVQLIIYRFKAFHKAFMEEFRD

SEQ ID NO: 118290 - protein, 125 aa, Triticum aestivum
  Clone ID: PAT_TA_12708.pep
MDSLWHASVIVLVLLFIGGSDANPAARRHSQLDVNHKKQPLQTFRPYNIAHRGSNGEIPEETAAAYLRAIDEGADFIETDILASEDGHLICLHDVTLDNTTDIASRTEFAGRKRPMKSGSNMTGW

SEQ ID NO: 118291 - protein, 300 aa, Triticum aestivum
  Clone ID: PAT_TA_12709.pep
MPWFYTLTHENGNNNVAMHDPSLNKWHHPSVPLAPADIVMPVASAGGLVCLLDHSHRNFYICNPLTQSLKEIPPRSVQAWSRVSVGMVLNGRTSNEGYKVMWLRNDGNHEVYDSVQNMWSQPGEFPPSIKLPLALNFRSQPVAVGSTLYFMCSEPEGVLSYDVSTGIWIHFIIPLPLHLTDHTLAEFQGKIMLVGLLCKNAATCVCIWELQKMTLLWKEVDRMPNIWCLEFYGKHMRMTCLGNSGLLMLSLKAKRMNRLVMYNLVSKEWQKVPDCMLPCSRKKQWIACGTAFGPCPSASP

SEQ ID NO: 118292 - protein, 299 aa, Triticum aestivum
  Clone ID: PAT_TA_12710.pep
MSTQWVLCKFFMHCACLKGEYCEFSHDWGDQANNVCTFYQRGSCSYGNRCRYDHVKVSRNNPVPPLPSSSIATRNSPLRPPPSSSTATHVASTSPQLLSSGRPLHLGHQTNSSNQRQQISMDKLAVSESKPAWRNEVQLDSVSEDGIGWSSIQTAQNQTSMKLADMPICSFAAGGNCPYGEECPHMHGDLCAFCGKMCFLPLRPGERQEHIKLCEKNHKRLEALKRSQEIECSVCLDRVLSKPTAAERKFGLLSECDHPFCISCIRNWRGNSPTSGMDVNSALRACPICRNLSYLPGRS

SEQ ID NO: 118293 - protein, 167 aa, Triticum aestivum
  unsure (1)..(167): unsure at all Xaa locations
  Clone ID: PAT_TA_12711.pep
LKRKQCACHDSNARLMLTEQHHAAKCSPPPPSSPSXRRPPKDTHLLQLARFSPPTPPPRPLANSSLHPPPPSSLPCRPCGCLRQPPGGQPLLVFSLGSGKQNDWEMELQNLQLLASPCPCTQTTVFCQSEIRCSLAFIVFALSTQIIPVSWEYEFLSCSEYPELLLY

SEQ ID NO: 118294 - protein, 118 aa, Triticum aestivum
  Clone ID: PAT_TA_12712.pep
LAELCTGNVLFQNDSPATLLARVMGIIGSIEQAMLAQGRDTYKHFTKNHMLYERNQESSRLEYLIPKKTSLRHRLPMADQGFIEFVSYLLEVNPKKRPSALEALKHPWLSFPYEPISS

SEQ ID NO: 118295 - protein, 272 aa, Triticum aestivum
  unsure (1)..(272): unsure at all Xaa locations
  Clone ID: PAT_TA_12713.pep
GPAWPPAAAGGAINGWTPRRADTFEKIDKIGQGTYSNVYKARDSLSGKIVALKKVRFDNLEPESVRFMAREILILRRLDHPNVMKLYGLVTSRMSCSLYLVFDYMVHDLAGLAASPDIKFTLPQVKCYVHQLLSGLEHCHNQGVLHRDSWGSMLXPPASLCGASESGVGRRPSTPACSLPGPVAGWPSGPGRPGGGRLLQILERAGSPAVPDGSKSKLPHATIFKPQQPYKRRIMDTFKDFPQSALRLIETLLAIDPADRLTASSALRSDFF

SEQ ID NO: 118296 - protein, 232 aa, Triticum aestivum
  Clone ID: PAT_TA_12714.pep
MAARHLRSGLPLLQARLAANESAAVAQVSRGLATEADKPKENKIKVPKALYGGTGNYASALFLAAANSNSLEKVESEILDVVGAAKKSPMFSQFMKDTSVPKETRVKAITEIFSEAGFTDITKKFLSALASNGRLKYVERIAERFVDLTMAHRGEVKVVVRTVVPLPEKEEKELKETLRDILGKDKTILVEQKIDQSIMGGLVIEFGQKVFDMSIRTRAKQMEAFLRQPFDI

SEQ ID NO: 118297 - protein, 179 aa, Triticum aestivum
  Clone ID: PAT_TA_12715.pep
GNSGATLAGARGSRSTRAASSLPPLTRPDLLLGFAPHHRGNQLVIGGPTPPILPFAPPRRRSEPEMAARHLRSGLPLLQARLAAERIRGRRSGFEGAWQRTRISLRQNKIKVPKALYGGTGNYATCVVPCSRPNANSWEQIESESLHDGEGHPTKSHVFYCNSLKDTSIAYRNQGVQGL

SEQ ID NO: 118298 - protein, 134 aa, Triticum aestivum
  unsure (1)..(134): unsure at all Xaa locations
  Clone ID: PAT_TA_12716.pep
XASTPNPFARRSSAAGPKKAELEQPKDVKDNTPKVSPVVTPLAKIPKKNDNSEGKAKRERDGAAEQILKGGIDQAGAKNKGSEDSNRGEPQRPLNPFAKSSSNKEQSSSLLDSTGPEKAGRATGAKANSKKVKV

SEQ ID NO: 118299 - protein, 113 aa, Triticum aestivum
  Clone ID: PAT_TA_12717.pep
VNDFKTVPEVSVMIMSLKAASLGLNMVAACHVLMLDLWWNPTTEDQAVDRAHRIGQTRPVTVSRLTVKDTVEDRILALQEKKREMVASAFGEDKSGGGQTRLTVDDLNYLFMV

SEQ ID NO: 118300 - protein, 617 aa, Triticum aestivum
  Clone ID: PAT_TA_12718.pep
MWRHAAARRSAQIRRLLSTSAPSSGAGSAVRGPCIVHKRGTDILHDPWYNKDTAFPLTERDRLGLRGLLPPRVMSFEQQYERFINSYHSLEHNTQGEPDSVVSLAKWRILNRLHDRNETLYYRVLIDNIKDFAPIIYTPTVGLVCENYSGLFRRPRGMYFSAKDKGEMMSMIYNWPAEKVDMIVVTDGSRILGLGDLGVQGIGIPIGKLDVYVAAAGINPQKVLPIMLDVGTNNEELLEDKLYLGLRQPRLEGEEYLAVVDEFMEAVHARWPKAIVQFEDFQMKWAFETLQRYRSRFCMFNDDVQGTAGVALAGLLGAVRAQGRPLADFTKQKIVVVGAGSAGIGVLNMAKHAMLRMPGTHKIGELGEGHNQFWVLDKDGLITKSRKDLDPAVARFARGYGPEEVEDLHEGASLVEVVKKVKPHVLLGLSGVGGIFNEEVLKAMKESDSPCPAIFAMSNPTTKAECTPEDVFKHVGENAVFASGSPFSNVTLSNGRKGYANQANNMYLFPGIGLGALLSGARHISDGMLHAAAECLASYITDDAIRKGILFPSISSIRHITARVGAAVARAAVDEDLAEGCPDLDPRDLRSMSESDTVDYVARKMWYPVYSPLVNDK

SEQ ID NO: 118301 - protein, 139 aa, Triticum aestivum
  Clone ID: PAT_TA_12719.pep
TRPVETHNWRQLLERDQLRIERRCGHVFLGWKEGRIYFPPTYKYSFNSDRYSGYGVRPKEKRRTPAWCDRILWHGTGLIQLSYVRGESRFSDHRPVYSIFMAEVEILHQRRRNMGYFSSRVEVEELLPYAHSHGNIKFY

SEQ ID NO: 118302 - protein, 169 aa, Triticum aestivum
  unsure (1)..(169): unsure at all Xaa locations
  Clone ID: PAT_TA_12720.pep
SDILKGIAHGRGASRRLHPRLLAVVGLLACAAVPRRASPAPHVGLPTLDAEAEGVSKQQACGRTGESARCTAAPCLRYGQDRGSLXSGCPGERPCDPLDACCMHHDNCVLVKNDYLSTECNEGLLECLAELRAGTGTFEGNKCMIDEVIDVITVVIEAAVVAGRVLHKP

SEQ ID NO: 118303 - protein, 91 aa, Triticum aestivum
  unsure (1)..(91): unsure at all Xaa locations
  Clone ID: PAT_TA_12721.pep
SEEWGWXXMGGXGSXXXANGLRMAVTNNAMAMNGRMGMHHSAHDLSQLGQQQQQQQQQQQQQQHDIGNQLLGGLRAGNSFNNLQYDWKPSQ

SEQ ID NO: 118304 - protein, 161 aa, Triticum aestivum
  Clone ID: PAT_TA_12722.pep
HPISTLPDWSIDGIISHVKHFGLKSMDKQKCAKIRTELKQKASGAFKEGEYYMASEMYTGAMAFDPSPDDCAIILANRSLSTLRGGNGRAALSDASMCRMARPLWPKACYREGAALMLLKKYERACEAFADGLKLEPSNGDLANALREAQEAAKNARSREK

SEQ ID NO: 118305 - protein, 160 aa, Triticum aestivum
  Clone ID: PAT_TA_12723.pep
MGQEEDALTVALSWEQEEGMPESPRKAPVVLSWEHKPAVKKPVSTEARGGGMREGQRKVPALARRLSVPPPPGRPAARGYSRAVRPEDDPFLAAYLACTKSSGDGGKKKTGGAAREPKGERRWSVLGRGLGVLSCKRCNGVMEQSMVRLAKLPELDPRDA

SEQ ID NO: 118306 - protein, 333 aa, Triticum aestivum
  unsure (1)..(333): unsure at all Xaa locations
  Clone ID: PAT_TA_12724.pep
VLESRDRIGGRVHTDYSFGCPIDMGASWLHGVSNENSLAPLISHLGLRLYHTSGDNSVLYDHDLESCSLFDKNGLAVPMETAAKVGVIFEKILKETVKLRDEQEHDMPLEQAIWMVLERHPDLKLEGLDDRILQWCVCRLEAWFAADADEISLKNWDQEHVLTGGHGLMVDGYFPVIQALAQGLDIRLNQRVKKIARQQKGVTVTIEDGTQYSADACIITVPLGVLKANIIKFEPELPSWKSSAIADLGVGIENKVAMHFDKAFWPNVQVLGMVGPTPKTCGYFLNLHKATGHPVLVFMAAXGRFAQDVEKLSDKEAVELVMCHLXKMIPDAP

SEQ ID NO: 118307 - protein, 348 aa, Triticum aestivum
  Clone ID: PAT_TA_12725.pep
FSHASDEALFGDPVSEFAGQNVGVVIAETQKYAYMAAKQAVIEYSTENLEPPILTIEDAIQHDSYFHPPPFLAPKPVGDFEQGMSEADHKILSGEVKLESQYYFYMETQTALAVPDEDNCITVYASTQIPEVTQNVVADCLSIPYHNVRIVTRRVGGGFGGKAMKGCHVACACAVAAFKLRRPVRMYLDRKTDMIMAGGRHPMKVKYNVGFKSDGTLTALHLDLGINAGISPDVSPALPSAIVGALKKYNWGALALDVKVCKTNVSSKSAMRGPGDVQGCFIAEAIIEHVASAHASDSAPPLAHSHDYVIDLKRRSLTKFYGDAAGEASTYSLVEIFDKLASSPEYRS

SEQ ID NO: 118308 - protein, 204 aa, Triticum aestivum
  Clone ID: PAT_TA_12726.pep
HEGSPDLAAGTRLARAAPEFFNIYPYSFDPAALHNSDASTPSPDWVLLDTKAYIADRRNGTTATALASNGEAVEVTFWIADPPALSHFSVHCKELFDMAEEPRVICSDKKVAILCLHWIYSKFGRCKVLRDYFVYTARSLNKAPSLMRLPNPSPRVFNPREMGLLPTVDGEGFVIAVVRPQLIIPGRYDLHLFISKNWRWSTKS

SEQ ID NO: 118309 - protein, 308 aa, Triticum aestivum
  Clone ID: PAT_TA_12727.pep
AEIRSLVSRATGRSLVLIDEICRGTETAKGTCIAGSIIERLDDVGCLGIVSTHLHGIFDLPLSLNNTDFKAMGTEVVNGCIQPTWRLMDGICRESLAFQTARKEGMPDLIIKRAEELYLTMSRSNKQTSSTANNGPSVGYSNVNGLVDMPDGLGNMFEPPSGATGLLRKDVESIVTAICKDKLLDLYNKRSISELVEVVCVTVGAREQPPPSTVGRSSIYIIIRRDNKLYVGQTDDLVGRLGAHRSKEGMQDATILYIIVPGKSVACQLETLLINQLPTKGFKLTNKADGKHRNFGMSVTSGEAMAAH

SEQ ID NO: 118310 - protein, 142 aa, Triticum aestivum
  Clone ID: PAT_TA_12728.pep
PEEGLDPSRARAGGQGGQNADKGEGAVRQGDLPTGIAVRRAEEGGGPAAKKKALRRLEAKLLVVAEEQRASEIKQIRGDAVKAEWGQQIRNYVFHPYKLVKDVRTACETSDISGVMDGELDPFIKAYLQYKLSAAAEEQSVK

SEQ ID NO: 118311 - protein, 89 aa, Triticum aestivum
  Clone ID: PAT_TA_12729.pep
LLHHPEGCPREKLCQELDFLVNCISGIIIKPKAAFRLYSHTPPSNMFKELQPCLTMATLETINKDLTYIYPGTITVQARQKNSKCTENL

SEQ ID NO: 118312 - protein, 119 aa, Triticum aestivum
  Clone ID: PAT_TA_12730.pep
NTVLLSQLSVYRNSGGLQAIMNSKLRKLAERDEEVVLASGIPSTIIRSASLETTPGGEKGFSFTEGIAAKGKISREDAATICVEALDAIPQTTLIFEVANGDENVTDWKTWFAERMAKG

SEQ ID NO: 118313 - protein, 248 aa, Triticum aestivum
  Clone ID: PAT_TA_12731.pep
MEDGKMGNVATVRAVLAILQWWGFNVTVIIINKWIFQKLEFKFPLTVSCVHFICSSIGAYIAIHVLKVKPLIHVDPEDRWKRIFPMSFVFCMNIVLGNVSLRYIPVSFMQTIKSFTPATTVILQWLVWSKHFEWRIWASLVPIVGGILLTSMTELSFNVFGFCAAMIGCLATSTKTILAESLLHGYKFDSINTVYYMAPFATMILALPAMLLEGGGVIDWFYTHDSVFSSLIIILGSGVLAFCLNFSI

SEQ ID NO: 118314 - protein, 365 aa, Triticum aestivum
  unsure (1)..(365): unsure at all Xaa locations
  Clone ID: PAT_TA_12732.pep
MESAAGGGLGSMRAVLAILQWWGFNVTVIIINKWIFQKLDFKFPLTVSCVHFICSSIGAYVAIHVLKAKPLIQVEPEDRWKRIFPMSFVFCMNIVLGNVSLRYIPVSFMQTIKSFTPATTVILQWLVWSKXFEWRIWAWLVPIGGYILLSFQSEVGFHIFGVTAPMIGGFGFCSSTVLAECLFHKYHPYSNTFSVYMAPSATTLEATWPRLPLGASGNKRSYTHETALSTSCTILRLXSFTFCYTFADYHPTVQGLLAFCLNFSIFYXVIHVNQPARDLQWLPGNPLKFAXVAVLVSWLIFRNPISPMNAIGCAITLVGXCTFYGYVRHLISQQQAAAPLGSQGTNSPRSRVEMLPLVGDKEDKV

SEQ ID NO: 118315 - protein, 76 aa, Triticum aestivum
  Clone ID: PAT_TA_12733.pep
QQQLNCRSSKPPAPTCRSSKPRSTCVSLGNLQQVGNSSYIGINNFHEIMNISRPYHLIISSNTLFFFHHPHCRCIF

SEQ ID NO: 118316 - protein, 104 aa, Triticum aestivum
  Clone ID: PAT_TA_12734.pep
LFRWMLISVPSNRDSSLILKSAIMTNPLGLVNLTECWTPFQHPPYIHDLSDTESIIMLYLNIDDHNPPPGQDLNQARLIRAAVALEIPPHPSGQFMISRYICRP

SEQ ID NO: 118317 - protein, 152 aa, Triticum aestivum
  Clone ID: PAT_TA_12735.pep
LLDSSTVQILEVILSSQICSPAPLPDAAPVAGLIPVEPTRTNLPNGVGAPLARIESETKGKDHVSTAVISTKHTGIWEIVGKNDLKIREMNLVQREGGKGHCTGSTHLSPTKPRNLRYSVASLKHSRSYHGREIFVERGRRRIVKGKRLGGG

SEQ ID NO: 118318 - protein, 391 aa, Triticum aestivum
  unsure (1)..(391): unsure at all Xaa locations
  Clone ID: PAT_TA_12736.pep
PRVRPVMLKPPPSMALPPASQAGSTWDILLSFAPEGQGQPQAIRSVPDFGDPDAEDDEDAAEVLTLEDLRLGASAHASAGTSSISTTNDDETTESMFYISPNGRFKKKIRSWSRGVLLGSGSFGTVYEGISDEGVFFXAVKEVSLHDQGSNAQQCIFQLEQEIALLSQFEHENIVHYFGTDKEDSKLYIFLELVTQGSLVSLYQKYRLRDTHVSAYTRQILNGLNYLHERNIVHRDIKCANILVHANGSVKLADFGLAKQTSKLNVLKSCKGTVYWMAPEVVNPKKTYGPAADIWSLGCTVLEMLTRQLPYPDLEWTQALYRIGKGEPPAIPSGLSKEARDFISQCVKPNPEDRPSAAKLLDHPFVNRSMRSIRSMRTYTRPNSSTRGTSG

SEQ ID NO: 118319 - protein, 254 aa, Triticum aestivum
  unsure (1)..(254): unsure at all Xaa locations
  Clone ID: PAT_TA_12737.pep
VYRADWHGSDVAVKVLTDQGVGEAQLKEFLREISIMKRVRHPNVVLFMGAVTKCPHLSIVTEYLPRGSLFRLISKASSGEILDLRRRLRMALDVAKGINYLHCLNPPIVHWDLKTPNMLVDKNWVRKXVVTLGLSRFKATTFISSKSVAGTPEWMAPEFPRGEPSNEKCDVYSFGVILRELLTMQQPWGGLGPAQVVGAVAFQNRRLPIPKDTIPELAALVESCWSDDPRQRPSFSSIVDTLKKLLKSMQGSGS

SEQ ID NO: 118320 - protein, 123 aa, Triticum aestivum
  Clone ID: PAT_TA_12738.pep
TRPLINPFSKYALMVTPVATAVEEKLLAGNKRSLNMLIRTFIVISTVIVALTVPFFGHLMALVGSLLSVMASMLLPCICYLKIFGTARCSRAEVALIVMIIVLGSLVAASGTYSSLQKIIHEF

SEQ ID NO: 118321 - protein, 226 aa, Triticum aestivum
  Clone ID: PAT_TA_12739.pep
VREAAAAVMARLAVHRAETYHVRDVIRWLDKMLIRFTAKFGNYVPEDPSTFRLSTNFSLYPQFMYYLRRSQFIDVGNSSPDETAFFRLMLNREGVVGSLIMIQPTLFQYSFDGPPIPVLLDVSSISPDVILLFDSYFYIVIHYGSKIAQWRKLGYHRDPNHENLRKLLEAPEVDAEALLADRFPVPKLIKCDQHGSQARFLLARLNPSVTQKSQLSEGSEVIFTDD

SEQ ID NO: 118322 - protein, 151 aa, Triticum aestivum
  unsure (1)..(151): unsure at all Xaa locations
  Clone ID: PAT_TA_12740.pep
RPRTRGFLSHIFLTSKGDGPKIAKRLVDVYIXVFKVLMSYPRDSKGEKQSXHGKKKVEYGKTNGREDKVNDSNSHGNHEMDPPAGTDLEMDSRLLSALLSGVNRALPYVASSEVDDIVEVQTPILFRLVHSENFNVGVQALMLLYQISTKK

SEQ ID NO: 118323 - protein, 177 aa, Triticum aestivum
  Clone ID: PAT_TA_12741.pep
PDRMTLLLHHLFYKCRDCGSGHDLLDPSVCIYRIPSIVSCWRLVLWWWLWFWFGFRLRFRLRHRFRLGFWLRHWFTLGLWLRHWFMLQVRKLLDGSKASASGGRFFFFFFFFFFGRQKSHLQNLALGDNKQDSGAQCSYKDSPSLDVIITLAPVILLFFAHPPPGYLKNKMDAYRTN

SEQ ID NO: 118324 - protein, 600 aa, Triticum aestivum
  unsure (1)..(600): unsure at all Xaa locations
  Clone ID: PAT_TA_12742.pep
VKEAGASIGLSGQIGVGIYWAFLVAMSVVVHAEAPTSDKQQLXEAEANRGSCVIREETDPGGLLTRGRQLSLFXCQEAGCDFGKPKRVQGXPMKRLEFFAGPIFIWXMNCRTVGVKXEESKEXGDAADGEKEKXERTISSKFWILQVASETKSMWLRKAKEVEXTDYNEFYKKAFNEFLDPLAHAHFTTEGEVEFRSVLYIPGMAPLSNEEIMNPKTKNIRLYVKRVFISDDFDGELFPRYLSFVKGVVDSNDLPLNVSREILQESRIVRIMRKRLVRKTFDMIQDIADKDNKEDYKKFWESFGKFMKLGCIEDSGNQKRLAPLLRFYSSKNETDLISLDQYVENMPETQKAIYYIATDSLQSAKTAPFLEKLLQKDIEVLYLIEPIDEVAIQNLQTYKEKKFVDISKEDLELGDEDEDKEETKQEYTLLCDWIKQQLGDKVAKVQISKRLSSSPCVLVSGKFGWSANMERLMKAQTLGDTSSLEFMRGRRIFEINPDHPIVKDLSAACKNEPESTEAKRAVELLYETALISSGYTPESPAELGGKIYEMMTIALGGRWGRSGTEEAETNADVDSSEGVVTEVVEPSEVRTENENDPWRD

SEQ ID NO: 118325 - protein, 147 aa, Triticum aestivum
  Clone ID: PAT_TA_12743.pep
VHPKSTAGRICTAQLTVLEAHGFVAWIAAYNIFYIVCRWKEEKDQRKTLLGLWCTTPALLQTEIPIGFHVFIGFLSPNRQCDRHDLVGDISQLFFECPLAKLWWPDLSKLVEINMGILLNVGSAVTRIGIVVAKEEETETARQRSSS

SEQ ID NO: 118326 - protein, 289 aa, Triticum aestivum
  unsure (1)..(289): unsure at all Xaa locations
  Clone ID: PAT_TA_12744.pep
HPSVFTMARTLLSGNNIVYNGDPLTDLSLPAFLDKFMEKKPKGNRIAEGKWHGGSQIAPAKKLDLNHHLIGQDLLELAENEVPPEDXVFHRFYMNKTGPIKPKAKKKASGRGGGAGARLPGAVGAVRGEGDDEMQEVDESDDEMQVLEDESAEDGEYDYDNLDAKAFEEEGDLLRDDSDADVLDDISDDDEDDDEDDGLNMSYVDESADDSDDDVTDVKAAAAARGQKRKSRSTPFASLEEYEHLMEGEAEKSTLKKQRKHKEAGDSVGRKERGQKQSGSRKRKSKRSE

SEQ ID NO: 118327 - protein, 108 aa, Triticum aestivum
  Clone ID: PAT_TA_12745.pep
AGRVPEFKFPQIKAHPWHKVFHKRMPPEAVDLVSRLLQYSPHLRSSALDALIHPFFDELHDPNTRLPNGRFLPPLFNFKPHELKGLPMEIAAKLVPEHARSQCPFLGL

SEQ ID NO: 118328 - protein, 408 aa, Triticum aestivum
  Clone ID: PAT_TA_12746.pep
MTSFGVAPASGLRDAGGSSEVDKLPDEISNMRISDEKEVEATIINGNGTEAGHIIVTTIGGRDGQRKQTISYMAERVIGQGSFGVVFQAKCLETSETVAIKKVLQDKRYKNRELQMMRLLDHPNVVSLKHCFFSTTEKDELFLNLVLEYVPETVHRVIRHYNKMNQRMPLIYVKLYTYQICRALAYIHRTVGVCHRDIKPQNLLVNPHTHQLKICDFGSAKVLVKGEPNISYICSRYYRAPELIFGATEYTTAIDIWSAGCVLAELLTGQPLFPGESGVDQLVEIIKILGTPTREEIKCMNPNYTEFKFPQIKAHPWHKVFHKRMPPEAVDLVSRLLQYSPHLRSSALDALIHPFFDELRDPNTRLPNGRFLPPLVNFKPHELKGLPMEIAAKLVPEHARSQCPFLGL

SEQ ID NO: 118329 - protein, 307 aa, Triticum aestivum
  Clone ID: PAT_TA_12747.pep
MHSVSKQVDSMSKNVLANSSSSRKNVMRIPRETLMNHGEKEKNVFSSEFSKGCEILQKSKAAIVLVTNGSDSDIVDAEFQRLLNSFSELMKVEENHISPPFVIVSPGDHVDSVRNYLIENDYFGFDTQKVWVLEEMKLPVVSLSSELGSKKILLKSPWEILQRPAGSGAIFSSLSSNKILESFNAMGIEYVQICSPSDELVLGHPLLFGAASSRSVDVGVKLRKTSDKTEDGFDLILSIDHLNKMCRDVAKARFSAHPEQHEHVELVDGQWVTVQPEGPNSHRLSTNVTSVLDSCSPDKLCVMEIVE

SEQ ID NO: 118330 - protein, 234 aa, Triticum aestivum
  unsure (1)..(234): unsure at all Xaa locations
  Clone ID: PAT_TA_12748.pep
MSSHEFTNLENWTNRPHETSSLMKAYSKQVKICIEIGLSCVQEDRHKRPTVKNIVDRLNETETECTYAYKKFDVQENPGGLTPNYFMNNGRPVSEVPLNNDAGPSKQARMAWQYPTDMTAQQELGERQAALLPNGIYEPPRQISAGFPESRGTTRVKLRFVDVEGPKDPLYTGCPVQWLNGENAKVVIFENDKQITQGDLSKLQIEILAVHADFFTERGPSDFTKXGIHKQILC

SEQ ID NO: 118331 - protein, 124 aa, Triticum aestivum
  unsure (1)..(124): unsure at all Xaa locations
  Clone ID: PAT_TA_12749.pep
FLRNNQQFQXVREMVHTNPQILQPMLQELSKQNPQLLRLIQENNDEFLQLLNETFDGGDGDFLDQADQDEMPHAISVTPEEQEAIGRLEAMGFERARVIEAFFACDRNEQLAANYLLEHAGDEE

SEQ ID NO: 118332 - protein, 367 aa, Triticum aestivum
  Clone ID: PAT_TA_12750.pep
MKLTVKTLKGTHFEIRVQHNDTIMAVKKNIEEIQGKDSYPWGQQLLIHNGKVLKDESTLDENQVSEDGFLVVMLSKSKASASSGASSAQPSSTPVTSQAPPVAQPQAPQPQVPSTTTSQPERPPTETPSSTVDLAASDLLSGSNLDTMINQIMEMGGGSWDRDKVQRALRAAYNNPERAIDYLYSGIPVTAEVAVPVVGQGANTTDAAPGETGLSGIPNTAPLDLFPQGASHAGGAAGGGSLDFLRNNQQFQALREMVHTNPQILQPMLQELSKQNPQLLRLIQENNDEFLQLLNETFEGGDGDFLDQADQDEMPHAISVTPEEQEAIGRLEAMGFERERVIEAFFACDRNEQLAANYLLEHAGDEE

SEQ ID NO: 118333 - protein, 122 aa, Triticum aestivum
  Clone ID: PAT_TA_12751.pep
LEENTSNRRLKFWQETSPIECVQSHLKTLSFCELQGNDSEFDFIMFVVENAPKLERLIIQIKLDLTYTERQVVVAKLGDLSCANWANTNCKVRFEVSSNPIGSSWSIEAGSDLSSDDPFSCL

SEQ ID NO: 118334 - protein, 174 aa, Triticum aestivum
  unsure (1)..(174): unsure at all Xaa locations
  Clone ID: PAT_TA_12752.pep
MGTRAHKIYAQKFEGYGRGGGECTPHNSXXQNDGRGXYLMPWRGXLEQSGAXADQIDYLNAHATSTPLGDAVEATAIKSVFGHHATSGGLALSSTKGAIGHLLGAAGSVEAIFTVLAIHHGVAPPTLNLEQPDLLFEGAFMPLTAAKKMPIRAAISNSFGFGGTNASLLFSCPP

SEQ ID NO: 118335 - protein, 117 aa, Triticum aestivum
  Clone ID: PAT_TA_12753.pep
VEPALDILDALASVPEGMTALKDCPRTIPNAVRLLMRVSEACTQRALSMLWVVCRMVPDESAPAALEVGLAAKLLLVIQSGCGPELKQQASELLKLCTVHCTSTVFLAKCKLTKTIQ

SEQ ID NO: 118336 - protein, 390 aa, Triticum aestivum
  unsure (1)..(390): unsure at all Xaa locations
  Clone ID: PAT_TA_12754.pep
RPLEEVESVLENVNHGEGLVDLSSEDNMKHLTFNEDLEARPWWTPTTSVNFLSEPIDESSTPACFRAEVCKHKSTEKDGPKMRDAERKCLVPQLVYLSMHGCVSSLRETEPNGSVSDITVGEMKTLLEKYARTIGYSMDDALSMILGISSGKKSMKDFAPDIVSWMSFAVFINAMNLWSNESVIPRTDPSSPSSWEIVDSLVKICIEEHLTDANRILTCPGNKIPLLVQMVTEPISWHLIIIQSCMRVVAPQGKKKKKSGXHRLRPNMPQLQGIQRPVQCLIETLRSVQKWLSDQMSLEEQGLDILMSYLQGTGDEGPGQTFRVLEEKPAAHASELGDRIAQSLEAWSSTGVVRRIVGAEHEVLAEFKKMVDSKLKLLMSESACLSSVLH

SEQ ID NO: 118337 - protein, 125 aa, Triticum aestivum
  Clone ID: PAT_TA_12755.pep
MEDPPGAGATWTGLPFIDPPGTQVVLLDSRYCDDGEMPMSTDGYLELMRRVVPVELPVDHFYYPEKLEETLKVQVEAYSESGVVSAKGHVKFTPKLCNISKAVCDIGDSKVEITVAWSVHVVCKT

SEQ ID NO: 118338 - protein, 486 aa, Triticum aestivum
  unsure (1)..(486): unsure at all Xaa locations
  Clone ID: PAT_TA_12756.pep
GGEGAPVAAPGDDAVDCYAPGCVASLTSTREQIGVVEFFAHWCPADRIYKPHYEKVAKLLNGIVAAHPDCILMANVDLASKVTVDLCSRFSGGHXPFLLCGPSPKYANTKWERKHEKSEIELIDDGRTAERLLSWFTLDVEKYXNENVRQYKNENILPDNASDPEHVEQTAHALQIAMAHAIIKTVNRDSLIRDFPNFRSSSFIXRGVEEDSAELLINFDDHWPSNLSLSSQDSSKLLESVAADNHKIVAADNPRIYWKDCRGSNCITCRGSCGLSGGLRSRPGLLRRRRTPLIRDGESQSTFTSICDFIHNFFICEECRKHFYDMCSSVSVPFKSARDLSLWLWSTHNKVNERLMKEEKDMGTGDPSFPKAIWPPKALCPSCYRSSSRTSDGALQVDWNEDEVFPFLVNYYGKTLVSSYKETYMESLQGRTQVGAALADDASSSHAARVPIGAALGVAAASCTFGALACFWRTQQKNRKQRKNWN

SEQ ID NO: 118339 - protein, 124 aa, Triticum aestivum
  Clone ID: PAT_TA_12757.pep
LSQTTSEDIQDPQACPPTPIRLRAPAALRSPSLPSGAAAWPFFSLGPRRTPFPLPGPPCFSHIAAVATSPPSQSTTYFSSPMEFSNPVTVDGSSFSSGDVGRRPDCVIPLVSGPLSIPILELSS

SEQ ID NO: 118340 - protein, 133 aa, Triticum aestivum
  Clone ID: PAT_TA_12758.pep
IHDPIQAAQQKLKRYIFIFCYMSQCFHFVNQTTGELSILYVPQQVVLLMQTVNCSRCGIVESSQSCLNKHICAEQRKVLKCTFFLAFILDPYKCFSTFQQSFSAYVALHCVIFTASDGQDLRFRSTTLPNEAS

SEQ ID NO: 118341 - protein, 94 aa, Triticum aestivum
  unsure (1)..(94): unsure at all Xaa locations
  Clone ID: PAT_TA_12759.pep
YGAIFNLLGILGTVIFQGPESFDILRGHSRATFFLICNNAAQGILSSFFFKYADTILKKNGSAXPTLCMGWQHAAFGGDPATQNSRQGITGRRS

SEQ ID NO: 118342 - protein, 132 aa, Triticum aestivum
  unsure (1)..(132): unsure at all Xaa locations
  Clone ID: PAT_TA_12760.pep
ISPDNFEGLILIYPLLRDKWGTNTSVVLPDSGSTEQVMYVVGILRSANPDEGCSHHCLQELLRRHRHXADTAGVRIGAKQYLAHHPTPAGWHQHFGPRWERFAERKNRFDPLSILGPGQGIFPKGSTGVYAS

SEQ ID NO: 118343 - protein, 111 aa, Triticum aestivum
  unsure (1)..(111): unsure at all Xaa locations
  Clone ID: PAT_TA_12761.pep
INIIARLHRRGPPAPIPRDTLQLGHAYRLIAVYEVTRAVQASKEEKTRRAQRQRLQAGGGAASPGDDQSLMDDGLDQLEQQDRDGHPSSSDXGSRHRQWRPSLHSIAEVSS

SEQ ID NO: 118344 - protein, 107 aa, Triticum aestivum
  Clone ID: PAT_TA_12762.pep
DHSLPFQLKLGKACLEGADSAVLQGMRAGVTALPPINHTTTNQILDSGLQRSDCKYWMAGGISVFCFPQLVVNTFFERATVRLHFYLFQIVPCTVMSLALIHAVPCW

SEQ ID NO: 118345 - protein, 100 aa, Triticum aestivum
  Clone ID: PAT_TA_12763.pep
TSEYARYGHCIRVEVIIRSLASLYSSVFCCVDWSTYHAPHHPPPRPRDGSCIRIRRRRGPAEAAAAAPSQVALVLPRLALLQAGGPHRLSAPDPLLGRVS

SEQ ID NO: 118346 - protein, 205 aa, Triticum aestivum
  Clone ID: PAT_TA_12764.pep
PLCARVMNQVTRETSRFVDKYDVTLDVCLSSVLSQSMILSPHKRVGHRIDVCVEDETVNYLNRKDVQEALHAKLIGVKKWAVCSSVLEYELLNLQIPTINIVGSLVNSGIRVLVYSGDQDSVIPLTGSRTLVQNLARDLGLKTSIPYRVWFEGKQVGGWTQVYGEELSFATIRGASHEAPFSQPERSLVLIRAFLQGRPLPETFS

SEQ ID NO: 118347 - protein, 77 aa, Triticum aestivum
  unsure (1)..(77): unsure at all Xaa locations
  Clone ID: PAT_TA_12765.pep
ASKLQACYIIYASSDQDDWXGTKAFPGIVSAIVNAQELNTSESWRLLRHEIYMGARTLSVMKWHIVIRMCIIDLPNS

SEQ ID NO: 118348 - protein, 122 aa, Triticum aestivum
  Clone ID: PAT_TA_12766.pep
MLKLKELNDRFAMAERAFYNQESPMGRPWSNHMMSIRAAGLLHSTIYTLSEQDDWWGTKAFPGIVSAIVSTQKLNTSEYWRLLRHEIYMGARILFVMKWHIVIRVYYWLAKFLTSYSMIRSI

SEQ ID NO: 118349 - protein, 130 aa, Triticum aestivum
  Clone ID: PAT_TA_12767.pep
MELLKKTLGCSDDMLKIAVVKHPSLLRSSEDNLRSTVEFLINKVGLEPEYIVRRPALITYSLKARHEPRYIVMKILQGKGLLSSDYCSVVAASERYFRSRFIESYKESVPELADVYAAARAGKIPPDLQP

SEQ ID NO: 118350 - protein, 96 aa, Triticum aestivum
  unsure (1)..(96): unsure at all Xaa locations
  Clone ID: PAT_TA_12768.pep
MECEAYWHTWSSMXDFPGKMVPLXSGXQSRIGFCMIXXGXHMLFGXVIGPGPRNQCIKPLSDVDILNVASERPTWRQGSPMTRCRGSIAGCALLKI

SEQ ID NO: 118351 - protein, 133 aa, Triticum aestivum
  Clone ID: PAT_TA_12769.pep
RMRRRGVSGGKVSNLFYAQGYLKLCLLRTRLLQPISNSTTEFLGPNIFVSKTGRDGLILFTGEYMTLKSMKNTFLCQKEKSKSSVNFLDYPQARVRQLWMVFVLFLLHKMITICINEGGWTRNVILFRQIQME

SEQ ID NO: 118352 - protein, 281 aa, Triticum aestivum
  Clone ID: PAT_TA_12770.pep
MFPDFVPLCVFCETHAGAGMGDEAKYLETARADRSVWLMKCPPVVSQAWQGASSSSGDANPNPVVAKVVLSLDPLSSAEPSLQFKMEMSQTSVASTCNLPKSYSLNMFKDFVPMCVFSETNQGKLSCEGKVEHKFDMEPHKDNLLNYAKLCRERTQKSMVKTRKVQVLDNDHGMSMRPMPGMVGLISSSSKEKRKPTPTKPSDVKRTRRDRRELENIIFKLFEKQPNWALKALVQETDQPEQFLKEILNDLCMYNKRGPNQGTHELKPEYKKSSEDAAGAP

SEQ ID NO: 118353 - protein, 145 aa, Triticum aestivum
  Clone ID: PAT_TA_12771.pep
MGSSEAETPAKANKASAPQEQQPPATSSTATPTVYPDWTSFQGYPPIPPHGFFPSPVVSNPQGHPYMWGPQPMMPPYGTPPYVIYPPGGIYAHPSMRPGAHPFAPYTMTSPNGNPDAAGTTTTAATAGGETNGKSSEGKEKSPIK

SEQ ID NO: 118354 - protein, 172 aa, Triticum aestivum
  Clone ID: PAT_TA_12772.pep
LASPPLQQQLRIQRNVRTRPHSARSVCQRRKMARARLSFVPISLLLLASLAAAAAAAADPEEGDLRISVQYATEEESRWLDRWAEKYKAQGSGEGFKVQPATDEESARMNNMFTGVGYDGHIEFDDDHPFGRMVVDAFHSRPRPSKPNENDDLQKKNLEEPHSRAEHDVKDL

SEQ ID NO: 118355 - protein, 109 aa, Triticum aestivum
  unsure (1)..(109): unsure at all Xaa locations
  Clone ID: PAT_TA_12773.pep
AKYSXCEWLAVVAFLLFVASWILLRLIVFPFWILRSTSYEIAMIVDNENRRIYRTSYYYLFNTLLFSLLVFHIYWWVLIYRMLVKQIQSRGHVGEDVRSDSEGENNHED

SEQ ID NO: 118356 - protein, 221 aa, Triticum aestivum
  Clone ID: PAT_TA_12774.pep
MKIADNTEITKAGLELQTEAAEEIKPCWTKPSPKDDQSNGFVTLSLTIGPEYHASQIADAVVIARYLGATLVLPEIRGNELGKSRKFQDMYDVEKFKMNLDGVVKVVDKLPAELTTKKPAVIRVPNRVTEDFILDTIQPAFQKNSFLRLAIIFSSVSLKPKGTNNKDLDSTACHAMFTGLKLNAEYSEVAEQMLGRLKELSKKSDGKVLAVDMRTDLLEKK

SEQ ID NO: 118357 - protein, 147 aa, Triticum aestivum
  Clone ID: PAT_TA_12775.pep
TLNSQRWLNCYNPQEVLNFLKKVGFSANTTIYLTETWWHKGLNNLKKAFPNTYTKEDIMPAEKKGEFLNSGDSDLARALDLEICSQTDVFVPAIPGMFYGNVAGKRIASGLTQILVPAPVVGGSAQASDFVSTYITKKSHFAYSCYC

SEQ ID NO: 118358 - protein, 151 aa, Triticum aestivum
  Clone ID: PAT_TA_12776.pep
QGQMLTLVEYLLLLYRALLPTPVWYRFFLNKEYGSLFSSLTTGLYLTFKLTSVVEKVQSFLSAVKALSRKDVHYGSYATAEQAIAAGDMCAICQEKMHVPVLLRCKHIFCEDCVSEWFERERTCPLCRALVKPADIRSFGDGSTSLFFQLF

SEQ ID NO: 118359 - protein, 147 aa, Triticum aestivum
  unsure (1)..(147): unsure at all Xaa locations
  Clone ID: PAT_TA_12777.pep
RPRTRGEEAASGVAVPTPSVEGATXVCGLFPGRGGATPAQRVKRLAXEQRQXSLCSRRRNPRFLMSMFTXCVHRRWRQAELLRHVVPSTLVMXDSCGYHLLMVLGLLAHQRXSYPRVRVPCTWSFHNGSDMIWYVEYYPNGINKXLR

SEQ ID NO: 118360 - protein, 102 aa, Triticum aestivum
  Clone ID: PAT_TA_12778.pep
KKNLSKQKRKAERAMLARQDVELRALHAAQQTSQQPNIGEKSPKLNLMVGEQLATSVPDQNNNNIPSASRSSSSSSSSSDSDSSSSDSDSDRPATAGANAAD

SEQ ID NO: 118361 - protein, 182 aa, Triticum aestivum
  Clone ID: PAT_TA_12779.pep
DPRVRSPHIVGGRDSRDESDLQITPSAHAYGSNQVGTTFSESSQDSRERLTRVEETGRLVHHDTVLNSQHTGTGRISDDKDITSLGIESTEEASIINVDMEQRGTILGTSETTARENIQGGSSTRKSVNESLLESAARLEKSSTFHVGQFVSELQRGFSDADTTSTKKTEKSIMEGTTRSSS

SEQ ID NO: 118362 - protein, 69 aa, Triticum aestivum
  Clone ID: PAT_TA_12780.pep
AKCLSSLSFVRKEIHYSEHRIHDMIFNKYELIKLVGCKHLSKSETYKSYTTPITGNSEYSSKKRERFKD

SEQ ID NO: 118363 - protein, 528 aa, Triticum aestivum
  Clone ID: PAT_TA_12781.pep
MDGLGNSALNASEAVMKRPRSVASRRPRPKEQLASEYKDISCAPSRSISPEDEAAAEASGQRRKELYLNGPEGRGSTHHRNALSKKIKKEEGSAGDNDIGHNRSSKPNDAKHITHGVLALASSRNSGSTDASQLSSRDTPVPVENRVRKVKLKVSGLNRIIPKQEPVDVGMPGTSDVSFHRQKQKDSGEQKHHSTRKDSHGNHVDGKRGDKHDISPSSDLVRKSKRVPKKRTLDSDDEDDELRYLEKLKAAKAAPEQPMATDQPLAYGYGEDGLRKKKLSKVSKNKSTPYEVDNDFTMSQFSRDVRKKVKLEDTSDFIVEEEFGLDESDRLIEADSPSGVKIEAPGLTTRQRALQGRGGHGESMIEFPDGLPAAPSSRRQKDKLSDVEIQAKKAEVAQRRKMQVEKAEREQQAEAMRKILGIDTEKKKEERKQKEREDKEKQAKFEEYKRSCIQCVMRPEGTVITFPDTMGLPSIFNSKPISYPPPREKCAGPSCPNPYKYRDSKTKLPLCSLECYKAVQGGAGTMAC

SEQ ID NO: 118364 - protein, 182 aa, Triticum aestivum
  Clone ID: PAT_TA_12782.pep
PRPRLLLHPRRLLLRPRAASSSPPSARLGGDPMEGGRVGAVPRVPPFPLGALYSQRSCRLPPLFPSRQSRRTRRRPALLHLELPVPFSPRSRRRRWRGARPPTFHHGLQRPEKMERPSCGCLVCALLHLARERVVVTSIEGGGGHWGRLPFRFGCQAPRVDIDCSQDTCSSSSTEGREQQPQ

SEQ ID NO: 118365 - protein, 116 aa, Triticum aestivum
  Clone ID: PAT_TA_12783.pep
SAASLLSATVSSQHNNPGLRVEYLLERWREPDADLSQCTPRAGAWREAAGAAVTGSSTTWPSQQVCDAALSPIEPAASPSFSFSCSALGSSGRNLILGVGDNHLLSKPPSTLRIII

SEQ ID NO: 118366 - protein, 146 aa, Triticum aestivum
  Clone ID: PAT_TA_12784.pep
RNIRAPYCTLVGHTKTVSYVKYVDASTIVSGSTDNSLKLWDLSTNQARVIDNPVQTFTGHTNTKNFVGLSISDGYIATGSETNEVFVYHKAFPMPVLAYKFNVTDPISGQEIDDQSQFISCVCWRGQSSTLLSANSSGNIKVLEMD

SEQ ID NO: 118367 - protein, 239 aa, Triticum aestivum
  unsure (1)..(239): unsure at all Xaa locations
  Clone ID: PAT_TA_12785.pep
MHPVSISFQPFTATSAGNFSSRTTNVRSRCDFIKLLTVGRSSGYRAMNSGPTSASRSETTGEQDYAVGENDGVIIVDHGSRRQESNLMLNDFVAMFRARTGYRIVEPAHMELAEPTIKEAFGKCVKQGATRIIVSPYFLPPVHHWKPVLPSLSAEASCXYTFASCIVPAHLARHAVIVDILKDTGKYCHPDSAYMKFPNSIQAPSFGYGTNSCWARSAGSSPVLSRHPVFGSLAAQIDG

SEQ ID NO: 118368 - protein, 532 aa, Triticum aestivum
  unsure (1)..(532): unsure at all Xaa locations
  Clone ID: PAT_TA_12786.pep
MASVPAADVDQGPTMDGTEVDDNLMGAGNSDMAIKIVTEPSKLPNSLLKPSRTDAIVIGFDCQGIDGISILLLALPDAVYLVDAIKGGQELVQACKIALESIAITKVIHDCXRHSKTLFDQYGIRLRNVMDTQVLYSVLQERKWEKPEHDRISLFAIRRYHEMTCAAEQRLKMLPCQEWARRPLSKVMIEMARDYVSFLPALHAIIIKNLSKSSLWQVAVQSDELSRHYYSPISVMFGPGSCLNDEPVEAYTNRCATTLCYTIDTELEILVATDDGRFLLAGFFKYLISMLLKRKSWKACFQLQNLVIRNKEFIISIPPTHEASLKNAFLDLQRMLSLLLPYFLRNNRYANYISSLITVIDKYSIEIDDSDLVKFLSELLGHMSFNSPVDNSSLLFHLITIYNNMLPEADKIIFEHAVNRAQFFDESGQQIDWREMAWRKALLISDNVSTTPVRKVHTFFADSMLCPVFNRHFKEHVAESASAIQTPEELDIFGHFYGNFTAQAVMAIFMAFNPGDNKEIDNLRDNLRRCRI

SEQ ID NO: 118369 - protein, 160 aa, Triticum aestivum
  unsure (1)..(160): unsure at all Xaa locations
  Clone ID: PAT_TA_12787.pep
SKQKYLKGLCPPTGLETLKLXGYNGSRYPYWMVRKETGGPNNLQRLELSGWKQPGPGPELVAFIHLRVLWLTSFSWDTLPGNLEHLISLKELFIYFCRRYSNVQWLPTLPQSIEEFHLRSCNHELIKSCXTVGHPNWQKIEHIPRKTFNGWLKKAVYDDV

SEQ ID NO: 118370 - protein, 144 aa, Triticum aestivum
  Clone ID: PAT_TA_12788.pep
TYSLGTYNLHNRKNETPLPVWLGRFLHEQPSLTSTPPPPFKAPNPGVQSGLVLDAAWTKSAGVAKFHVKSTPRVLAFLQLHFKHHNALRGRKLSAGNSEASLSTQRGQACQLLLLADHVSSSTERRFLCAMDKMAVSASPFSSK

SEQ ID NO: 118371 - protein, 82 aa, Triticum aestivum
  Clone ID: PAT_TA_12789.pep
AFSSVVRLLRQRRSQDGDNRSELQETEVCQPKEAVGRTTMGWSSTMMNGRPVGIAISYVLFCNVQSVFCFFNLMKSMVFRLK

SEQ ID NO: 118372 - protein, 326 aa, Triticum aestivum
  Clone ID: PAT_TA_12790.pep
AARPRSPSSEGEREGLPASSSSAHLAPPPRRAAPSSPSRECQRDPIEKMEEVENTSKRKAPELDSEDSSSAAVMNGQQSLPGSAAKRQNLARSCIHEVAAPNGYDLSKDEAVHGTLSNPVFNGDMAKTYPFQLDPFQTVSVACLERNESVLVSAHTSAGKTAIAEYAIAMSFRDKQRVIYTSPLKALSNQKYRELSQEFSDVGLMTGDVTLQPNATCLVMTTEILRAMLYRGSEVIKEVGWVIFDEIHYMKDRERGVVWEESIVFLPPAIKMVFLSATMSNATEFAEWICNLHKQPCHVVYTDFRPTPLQHYVFPIGGSSLYLVVD

SEQ ID NO: 118373 - protein, 121 aa, Triticum aestivum
  Clone ID: PAT_TA_12791.pep
NSGGNCDVIIDYDYLTSSSTVDIAEAQSKYGFFGWNIWRQPIGFLVFLISSLAECERLPFDLPEAEEELVAGYQTEYSGIKYGLFYLVSYLNLLVSSLFVTVLYLGGWNLSIPYISFFDFF

SEQ ID NO: 118374 - protein, 213 aa, Triticum aestivum
  Clone ID: PAT_TA_12792.pep
DEFPFKPDDFGRFDESSDTVFYSAPRFVTHIDDPAIRALTKYYSQVLPPSNTPGVAILDMCSSWVSHYPAGYQQEKIVGMGMNEDELKKNPVLTEYVVQDLNLNPKLPFDDNTFDVITNVVSVDYLTKPMDVFKEMRRILKPSGLAIMSFSNRCFWTKAISIWTSTGDADHAWIVGAYFHYAGGFEPPEAVDISPNPGQTDPMYLPGPRQKTA

SEQ ID NO: 118375 - protein, 284 aa, Triticum aestivum
  unsure (1)..(284): unsure at all Xaa locations
  Clone ID: PAT_TA_12793.pep
TSQRAAVARAPQKHQSPSHVVGVPRRQAPPPRRLFAAALHPIPTLRPLLRDVPRARFACPFPPRRRRRRPSPSGTTARRFLSSQSPASSSKISPDENLRRVIDSEIECVVESEEGSAQQIDPPEDFPFEIIDNPGDQSIVLKRELAGETIKATVYTNFDTEEDLNNEDSDAENDDDSFKPALQMVVTVEKPGNAVLEFECNFNDDELAIENMRLLNRDANFTENAYEGPQFSDLDDXLQKSFHRYLEVRGIKHSLHDWLHEYMXRKDEKVYVVGLKNMREFIEK

SEQ ID NO: 118376 - protein, 235 aa, Triticum aestivum
  unsure (1)..(235): unsure at all Xaa locations
  Clone ID: PAT_TA_12794.pep
ALHSFSSVAAHASAFAAFQFGPELSLHTPVECVAMASVKVFGSPMSAEVARVLMCLFEKDVEFQLIRVDAYRGPKRMPQYLKLQPLGEALTFEDGSLTLAESRGILRHISHKXYAMQGNPXLIGTGALERASIEQWXLQTEAHSLDEPKSPNGLPASPSSRPAMPPKAQPNARRRWPRQGQRGPVPTPPRRRGTSSGGWASGGRGSRELLPIYAHRLPGALPRPATLNIADCRTA

SEQ ID NO: 118377 - protein, 55 aa, Triticum aestivum
  Clone ID: PAT_TA_12795.pep
SARGNASASSSCVDTRCCYAIDCNVPGKPFGVCAFSPRTCGCGADAGAGNNCTTT

SEQ ID NO: 118378 - protein, 165 aa, Triticum aestivum
  unsure (1)..(165): unsure at all Xaa locations
  Clone ID: PAT_TA_12796.pep
HTSWRGEQGDMRRGGSGAAEEAGSRQADSGGSGPRPQDFVAATSTIYLIHXVKRAAAAAPRQDATLKPNAQIIPKKAAYICSDQISSELXQYRIKCFSLPLGVMYTERENAYEDPDCRCEVLWVYVCIFTWEMNLLYYDIVVENCVLCNIIYVPCLSIYSVMLLF

SEQ ID NO: 118379 - protein, 109 aa, Triticum aestivum
  Clone ID: PAT_TA_12797.pep
GGGGGQSAPRAAPEPDGEEDDNYKHLTAELCRVYRHAPREFTVIDRGRRNSVCLSRRGFEELYVFSPGSKYEWYGKFAYVCIGPAMLEPVVLPPGATWQGAQCIRNPNL

SEQ ID NO: 118380 - protein, 178 aa, Triticum aestivum
  Clone ID: PAT_TA_12798.pep
SETCEYRYLLSCHIQDHTGSTHATSFQEAGQEIIGLSAQDLFRIKHEEQDDVRFAEIIQQVRFQQYLFKLKVRAAGYNDEPRVKCNIVKAERYDPVKESRFFLGAIDSLLAEDASGSSPGLNGGPAVNAGFANSEAGQSVPASNNSYAVNMGWPKSVWAAIQRISRDADCTISDTSSR

SEQ ID NO: 118381 - protein, 357 aa, Triticum aestivum
  unsure (1)..(357): unsure at all Xaa locations
  Clone ID: PAT_TA_12799.pep
RHEGKXKGAVPHDLGTHDPWHEMNAYNIHDTSKWKDLNPTRPLQVYRDFAATGDMTFGRDVWPAVCAAMDYMDQFDRDCDGLIENDGFPDQTYDAWTVHGISAYCGGLWLAALQAAATMAHRLGDRPYAEKYKLKFMKAKAVYEAKLWNGSYFNYDSGTSSNSRSIQADQLAGQWYAVSSGLPPIFDEHKIRSALQKIFEFNVMKVKGGRMGAVNGMTPKGKVDETCMQSREIWTGVTYGVAANMLLHGMEHQGFITAEGIFLAGWSEDGYGYWFQAPEGWTTDGHYRSLVYMRPLAIWAMQWALSPPKAILEAPKVNLMDRIHISPQAVRAVGEIGVRKIAPDNRCIPSSTFQCEC

SEQ ID NO: 118382 - protein, 74 aa, Triticum aestivum
  Clone ID: PAT_TA_12800.pep
PRAQRWAGCATTSDEAEAQPAGGSMAPKQEDATRPARKEQKKQAGCPQAAQEIISGLPDHTVSPCPALYAPELK

SEQ ID NO: 118383 - protein, 90 aa, Triticum aestivum
  Clone ID: PAT_TA_12801.pep
FFSLDQTLQISEIIIKKLGKLRTLTNPCCKNEGHVSYPIWHSSNPPLQLQMVPRPPGVIPLRRRRLPPDRTRPNREANAAVSHAPESIRC

SEQ ID NO: 118384 - protein, 83 aa, Triticum aestivum
  Clone ID: PAT_TA_12802.pep
HLPHAVVLVEAHKLVLVVTSRFSVNFNSAKTLCLLQLTFFSCLRWILSSSSSWCGSPAASFLGFFYSSDPAFVVGNYLGVICS

SEQ ID NO: 118385 - protein, 117 aa, Triticum aestivum
  Clone ID: PAT_TA_12803.pep
DDGMVTSYSNIDSQFGRSQGMPGMDDSRQRQQGSVARGVRAGRGGAPHPGSIAERERRTRISKRLRRLQDLVPNMDKQTNTSDMLDIAVDYIKVLQDQIEKLKQDQGNCSCSADQKC

SEQ ID NO: 118386 - protein, 107 aa, Triticum aestivum
  unsure (1)..(107): unsure at all Xaa locations
  Clone ID: PAT_TA_12804.pep
KIKSLAGTIPRSSPRPLPPACPFFAGRRARPPPYQAVPAAVPGRARHPAPSXPAPLAPPPAXRPRPPPCPASPASMPRHARSRPPSHALARPAPLAPPPAAPSTASM

SEQ ID NO: 118387 - protein, 154 aa, Triticum aestivum
  Clone ID: PAT_TA_12805.pep
SRRKNRYIIWQTGPEDFCEMESLVRAHRRLFLTPFLHEMDMTYAATDVVVSRAGSVACTEILVTGKPAILIPLPTIVDDHQTKNAYIMADVMGARVITEDELDSSSLTCIIDEIVGDEKLMAEMSQKALNAARPNASADIIRHICSLIGPTNLT

SEQ ID NO: 118388 - protein, 63 aa, Triticum aestivum
  Clone ID: PAT_TA_12806.pep
SAPQGDSPLSLPPWRFYLSTATIFFSKSIYVKMLCYRRKTYPPFAMSVPSNHLRIFHVCFIKI

SEQ ID NO: 118389 - protein, 115 aa, Triticum aestivum
  Clone ID: PAT_TA_12807.pep
MIVAVRWTTCTQVRRNHVVRLPRIKDSSGGGVLRYALHLRFLCSASKKSSKSMLRCKSDPSSVPHSGNTVTEDRRFYLYNDLRVVFPQRHSDADEGELKVEHDFPADPKYFDISN

SEQ ID NO: 118390 - protein, 98 aa, Triticum aestivum
  Clone ID: PAT_TA_12808.pep
CNQPPKVVATAAAGPMAPPNQIQSADDPPSRHCAWGPILLELRSHGVEWSGVRPTPRRPPAPWRRLIRSSPLMIRRPVTARGAPFYSSFGLTEWSGAE

SEQ ID NO: 118391 - protein, 111 aa, Triticum aestivum
  Clone ID: PAT_TA_12809.pep
STFGCQQLKLSNCKITKVGIGGPLINFFNGRLVGMNFCDGRPDRTPYLPCKQIREVLHSTWRLTTDRSVLRLDKPDVNNKCRWPVPKPYWYHGLLEMNRFGPMPMIGWARQ

SEQ ID NO: 118392 - protein, 207 aa, Triticum aestivum
  Clone ID: PAT_TA_12810.pep
ATAATRSVAPFHTGRHGRGRVPAPPRGAPRRRRLPPAPPPPPRAPPQAPASGLLHLRAPDRDRGAVRGAPLLLVGLRRSAGAPGACQHQHHQQPRRHGVRGRAGRRVAPRGHAARGRPPRARPAPAPEGASPRAAPGGARRAGGRPGAAARRQGQGRHGRRRHGRVRRPLGPPARPAAVLDLQQARPRPGPLALDARTCHASFSVCT

SEQ ID NO: 118393 - protein, 127 aa, Triticum aestivum
  Clone ID: PAT_TA_12811.pep
SCCRRRRHHLFKLTQPITVFLEFTQKPTYNLRHCMDSTPYGWEVVNAFSIMQLVTLGKFKTLFLPSQANPYGRFSYEQVSRAILVKQPCMQTCHTCLASANLKIGSGTGVCVKHACVSPLSPLMYLT

SEQ ID NO: 118394 - protein, 54 aa, Triticum aestivum
  Clone ID: PAT_TA_12812.pep
RAISRYSVLLARHCTPFYLTRQFSIGYSALFFFQWIELIASPTGRPTYSTPCIS

SEQ ID NO: 118395 - protein, 216 aa, Triticum aestivum
  unsure (1)..(216): unsure at all Xaa locations
  Clone ID: PAT_TA_12813.pep
QDLIRLCSAAEGXLEAHYSDMLTALDNPLDHLGRFPYFDNYINLSKLEHDLLSGHVAAPAHVAFIGSGPLPFSSLFLATYHLPDTRFDNYDRCSVANGRARKLVGAADEGVRARMAFHTAEVADLTAELGAYDVVFLAALVGMTSEEKADAIAHLGKHMADGAVLVARSAHGARAFLYPVVELDDIGRGGFQVLAVHHPAGDEVFNSFIVARKVKI

SEQ ID NO: 118396 - protein, 202 aa, Triticum aestivum
  unsure (1)..(202): unsure at all Xaa locations
  Clone ID: PAT_TA_12814.pep
CRXFGTRRKSADRVFEEASASQCSSPKPQINRESPSSSAGDDAEVPAYPTVDCLEQPADVLMNDKTLSELPQDHDNQFGCNERNNGDLEDEGTDSAIEDNKKDALRGTRSFEGDALDENIACRNDSTNSLIKSSNVVVNEGSDMPSTVDTKESGEELAPSSHVPGTTNASLSGNDISTSNASEHPGSADTKPESSVGESSES

SEQ ID NO: 118397 - protein, 69 aa, Triticum aestivum
  Clone ID: PAT_TA_12815.pep
IPPLGYPGKVSILEEKQETRFTQVQALLTRYNPTVVYCDWGVQSTRYYPGIVCCLSTSSVPAYISYQGP

SEQ ID NO: 118398 - protein, 107 aa, Triticum aestivum
  Clone ID: PAT_TA_12816.pep
SAHASALPYPAATHPILHPAPSRPGPGPSPPRTVPLRQGRKDPPTSWLPVPLATAGRLTPATRSGQPTVGQLHPRRTKEQEAPGLLVWEQAGKYWVKCDAERTEEDP

SEQ ID NO: 118399 - protein, 136 aa, Triticum aestivum
  Clone ID: PAT_TA_12817.pep
GRREAIACVHGDFELIHRRLLWRKEGEGDFSLFFSWSAGCSASRSMGRLRKVSAKDVPQVSSVESQDSSKDPSVPNDFADENVMSLDFSADDEEFDKALYNFYVTNKVKQLKRKLSSVGRRNVMKKFPPLICSCER

SEQ ID NO: 118400 - protein, 66 aa, Triticum aestivum
  Clone ID: PAT_TA_12818.pep
DYPMISGCCVGPKKRVVTLRQSLLKQTSRLALEEIKLKFIDTSSKFGHGRFQTTDEKQKFYGRLKA

SEQ ID NO: 118401 - protein, 145 aa, Triticum aestivum
  Clone ID: PAT_TA_12819.pep
PTRGLRKVACIGAWHPARVSYTVARAAHASAHASAEMNKKIYKIGKAGQESHDASTEFDRTEKDITPMGGFPHYGVVKADYLMIKGCCVGPKKRVVTLRQSLLKQTSRLALEEIKLKFVDTSSKFGHGRFQTTDEKQRFYGKLKA

SEQ ID NO: 118402 - protein, 234 aa, Triticum aestivum
  Clone ID: PAT_TA_12820.pep
MSHRKFEHPRHGSLGFLPRKRCSRHRGKVKSFPKDDQQKPCHLTAFLGYKAGMTHIVREVEKPGSKLHKKETCEAVTIIETPPLVIVGLVAYVKTPRGLRTLNSVWAQHLSEDVRRRFYKNWCKSKKKAFTKYALKYDSDAGKKEIQLQLEKMKKYATIVRVIAHTQIRKMKGLKQKKAHLMEIQINGGTIADKVDYGYKFFEKEVPVEAVFQKDEMVDIIGVTKGKGYEGGVT

SEQ ID NO: 118403 - protein, 370 aa, Triticum aestivum
  unsure (1)..(370): unsure at all Xaa locations
  Clone ID: PAT_TA_12821.pep
GKGCPHRKFEHRRHGSXLGFLTEEAVLARPRRREGRSPADDQCKHCHLFAFLRHNFGLTHIVREVEKPGXSQLHKKETCEAXVTIVETTPXIVNVGLVAYVKSSSVGLRKSQCQVXQKHLQAKMSRKEGSYKIWXCKSKKKAFTKXYALKYDSDAGKKEIHMQLREDEEVCYCMSGVIAHTQIRKMKGLAXKKAHLMEMTSSMVAPSPTQGSRVCSRNVGKVPLDAVFQKDEMCDVSXVVIQGKGXEGVVTRWGPSPGLAPQGTHRMSSQGWPIGPAWHPARVSYTVARMLVKKWFPHHAETEHEQEGLKRAWASLDKGKLDDAPALEVRPGLGKRHHSPMGWPLFPHMVSVEGPDYHGSMAGYAVSGPQ

SEQ ID NO: 118404 - protein, 201 aa, Triticum aestivum
  unsure (1)..(201): unsure at all Xaa locations
  Clone ID: PAT_TA_12822.pep
MLSLARRPLSAAVPAGNLLGIHLFQCPDAVGIVAKLSECIASRGGNIHSVDVFVPDDAPVFYARSEFTYNPRLWPRDVLRTDFLRLSDCFGAQKSTVRVPDIDPKYKIAVLASKQDHCCXDLLHRWQEGRLPVDIHCVISNHDRPVDNHVMRFLXRHEIPYHYLPTTSWEXKREQEILELXEGTDFVVLARDMQVMSEGFL

SEQ ID NO: 118405 - protein, 200 aa, Triticum aestivum
  Clone ID: PAT_TA_12823.pep
QTFYSTPEADRDYLSYWETIAKELKWLEQYLLTNESSIEWAHKHSKATFQAIRIASKFPCMTLKLAAVGLHEYIWNARIHLMFVKDLDGILYNIWRRLNADHQLRFRDALKQVYEANLFPAHDRSMKYELEYGDSKMDLVFVKCTTGLSDGVPEDRARELIKQEIRWTRESSGTYERYARKKLKIAELIGLIPKDKIATA

SEQ ID NO: 118406 - protein, 232 aa, Triticum aestivum
  Clone ID: PAT_TA_12824.pep
MPATTGSARRVAVLRCIVAALVVTVLLAGLVVLVFWLVVRPKPIEYSVARAAVRRFHVTAPPGGGGGATLNASFYLTLAADNPNRRVSMRYKSVAVYVHYGAGEVAPQLAVADVPDFHQPSRNETRLEVRAVARSAPVPDWTARELEHDRSDGEVGVEVRVTAIVHFLVGGVKFRHYNMRAICSPGGHRLVAVVGEILPGRAVRRCNFVRQTCTCMASVRVINYCRVLVYTV

SEQ ID NO: 118407 - protein, 124 aa, Triticum aestivum
  Clone ID: PAT_TA_12825.pep
SLPCDIHVVNLKVPQPLRFAHTEAVEPRFAILLQRRGWDASYCKRGGLQCTNIGEEAVNLFDMFKDLSVLNVKATSLNLLNDDPEMLGYLEQIGDVAQEGNVLISPMEIQAYKLDLQPPSSPEE

SEQ ID NO: 118408 - protein, 182 aa, Triticum aestivum
  Clone ID: PAT_TA_12826.pep
TPARARVLHFLDPNPHPIDQSLTPSTSMTPYKCSLAPIRPIFHQLEISHARFASFRSRRSSAVAEGLVGRFRRHRRGASIRVQGPRPEALAAIAAPAGHYRHRSKLQSSRRTPNSSPSRSTPFCNLSITGYPLYPSAASPPSRPWPSSSSPALSILLFRLFGLGREPKLSVWVLPPLSRIFG

SEQ ID NO: 118409 - protein, 106 aa, Triticum aestivum
  unsure (1)..(106): unsure at all Xaa locations
  Clone ID: PAT_TA_12827.pep
EGEDGWTPELHHRFVEAVEHLGEKGAVPKAIVRLMNVDGLTRENVASHLQKYRXYLKRSSPGAAAPSPPPPPFFPRFDVQRPHQDSANRSGYCAYPYVSYQKLGCD

SEQ ID NO: 118410 - protein, 357 aa, Triticum aestivum
  Clone ID: PAT_TA_12828.pep
MASPPTAAPAAALRCAGVHVGRVPLPRHAGGPYLRSALSFRLGVLSSRTCRAGAGAVVSATRSPGLGNAGNLREGSNLSKNWDLSRQIGDEHGVLIECRDVHKSFGDKHVLQGVSFKIRHGEAVGIIGPSGTGKSTILKVMAGLLAPDKGEVFICGKKRQGLVSDEDISGLRIGLVFQSAALFDSLNVRENVGFLLYENSKLSEERIGELVTETLAAVGLKGVEERMPSELSGGMKKRVALARSIINDDTKETIEPEALLYDEPTAGLDPIASTVVEDLIRSMHVTGKDAMGKPGKIASYAVVTHQHSTIRRAVDRLLFLHEGKIVWEGMTEEFTTSTNPIVQQFASGSLDGPIRYF

SEQ ID NO: 118411 - protein, 188 aa, Triticum aestivum
  Clone ID: PAT_TA_12829.pep
CHPPSPRPLPAPGAGPPARRAGSAAGAAAPRRRAAAGAGGRTAGPTTGPGAAPVSPAPAPMSPAPAPIFAPTPSPTMAPEPAPTVAPELSPIMAPSLSPLASAGPAFAARGQRRARARRRRRARGHGGCRARGLVLIEQSRAGLLWRSCLGLRYTSVLSRGRSLGTSHVLRILSWCTAHYWSFVYFFL

SEQ ID NO: 118412 - protein, 115 aa, Triticum aestivum
  Clone ID: PAT_TA_12830.pep
GGRRCGVVGPARLQRRLAGAAAAAGGGTSCRWCGDEGVQGAELQMRMMETESFHDAIPLRHRVLPRLRRAGQRQQAVERTTQLSVRREHGATGASPPLKRARCGLTTSHARSAPC

SEQ ID NO: 118413 - protein, 87 aa, Triticum aestivum
  Clone ID: PAT_TA_12831.pep
PSFGNSWSDPCIEFAFKTLTGDIPVLDPTVADYFPLQQDLNKVAPPDYSAPSVDDTRNHRQHVNQGSQHSAPRPSNGFYNGGWFPPQ

SEQ ID NO: 118414 - protein, 80 aa, Triticum aestivum
  unsure (1)..(80): unsure at all Xaa locations
  Clone ID: PAT_TA_12832.pep
SPPNEFDNGYYRNLMSGAGLLRSDQELFNNGAVDSLVRLYSXTPAAFSADFAASMINLGNVSPLTGSSGEIRLDCRKVNS

SEQ ID NO: 118415 - protein, 87 aa, Triticum aestivum
  unsure (1)..(87): unsure at all Xaa locations
  Clone ID: PAT_TA_12833.pep
MGLGRERPLRRGVFYRDTLLLEAEGPKKVFAEEEAAWSVEVSELGRXDDVFATFIQVLHYKLYNDPWRQGLLLEKETGLPSICSKAS

SEQ ID NO: 118416 - protein, 175 aa, Triticum aestivum
  Clone ID: PAT_TA_12834.pep
MTAPLLTLVLLLLTSSVAVACASADPKGDLKRIRVYMHETMSGPNATLLTSVQSPLGGSATFGQIGVLDNELRDGLHRGSSSPLGRFQGLFAMTGLANTPGLLSAVDVVFTGGKYQGSTLAMLGTIQDLRASVERTVVGGTGAFRMARGYSPMVYIPEASTANNDVYRIDFFVDV

SEQ ID NO: 118417 - protein, 157 aa, Triticum aestivum
  unsure (1)..(157): unsure at all Xaa locations
  Clone ID: PAT_TA_12835.pep
MAHCLAAVASFSPSAVRRRLSSQXVANVIXRAGSSVSFRSQKMSFVSIXSRPSSLRFKICCXAKGEAQAKKETVDKXVCNDXSKEAAWAVPDGTPVTAESEILLNLVADSLDTVEIVMGLRGRSSTSAVDETSAQDIATXVQDAADLIEKLVTEKTA

SEQ ID NO: 118418 - protein, 126 aa, Triticum aestivum
  unsure (1)..(126): unsure at all Xaa locations
  Clone ID: PAT_TA_12836.pep
MGRIPCCEKDNVKRGQWTPEAYNNASAYASEHGTRNWRLIPKNAGLQRCGKSCRLRWTNYLRPDLKHGEFTDAEEQTIIKLHSVVGNRWSVIAAXLAGRTDNDVKNHWNTKLKKKLSGMGIDPVTH

SEQ ID NO: 118419 - protein, 104 aa, Triticum aestivum
  Clone ID: PAT_TA_12837.pep
FYLPPGSNIRAAYSFLGGVAVLVSFSWRTVRSCFDLVCYYGYFVGSICQRLEVNGRHKPTREYIDRECNGVKPPKKKGEVDPWTAWAYRPWTISLLLMGTCFLM

SEQ ID NO: 118420 - protein, 66 aa, Triticum aestivum
  Clone ID: PAT_TA_12838.pep
GGPLGCGREEAAVAGAGQPAAVARFNSFEVRFELRAGRSIKREAEDLGTSPKQKFQVPMRSSLNFF

SEQ ID NO: 118421 - protein, 92 aa, Triticum aestivum
  Clone ID: PAT_TA_12839.pep
EKHHRPSKKIYTRLQQKMMPVEAKTTNGSSIPLPGSSTVTILWAPSSPPCTGCSTATRRSQRCYVLVAARTCLVVAPRHAGSSSTRRGSGIS

SEQ ID NO: 118422 - protein, 351 aa, Triticum aestivum
  Clone ID: PAT_TA_12840.pep
GHGIPRITFLGTSMFARSCTEAMLCSNPFEACSDDPAAVVSLPGLPHPVVELRGQMMDPAKRPHEWALFQLIHAADRRSYGELFNSFHELEPAYAEHYRATLHRRAWLVGPVALASGSGKDVASRGAIAGALSPEAIGCLRWLDKKPASSVVYVSFGTMTSFSPEQTRELAHGLGLSGTSFLWVITNGSAAAASTDLCMPDGLSMAHRDRGYIIRGWAPQVLILNHPAVGGFMTHCGWNSTLEAVSAGVPMVTWPRYADQFHNEKLVVEVLGVGVSVGAEDYASCVETHQVVAGEMIAESIKKAMKKDGDGDTVWKKAEELGVMACKAVEKGGSSYEDVGQLMEELMARRT

SEQ ID NO: 118423 - protein, 58 aa, Triticum aestivum
  Clone ID: PAT_TA_12841.pep
QHSGSIMCCPLKAAPVSSLANQAGLHMLEAPLIALQVPQDHAAEKEHLAYSLWLSNLP

SEQ ID NO: 118424 - protein, 52 aa, Triticum aestivum
  Clone ID: PAT_TA_12842.pep
NTTIHINNLSKHMVVYVDLFDLLPKTLWKTGQMKKKNMRWHLKSDHLSNLST

SEQ ID NO: 118425 - protein, 172 aa, Triticum aestivum
  Clone ID: PAT_TA_12843.pep
KEVDDLHAVIQHFKEHKRDTRAIAGHSKGGDVVIIYASMYQDVSRVINISGRFDLKRGIADRLGSDYMERINQHGFIDVAQKTGQFMYRVTKESLMDRLRIDMQSACMSIGPNCRVLTVHGSDDDVVPSEDALEFHKYIGNHEVHITEGADHRYSSHRLELANIVLKFVTSG

SEQ ID NO: 118426 - protein, 106 aa, Triticum aestivum
  Clone ID: PAT_TA_12844.pep
ALHDEGVDLPRWARSVVREEWTSEVFDTELLRPPGAEEEMVEMLRLAMDCTVPVPDQRPAMPEIVVRIEELAAPGSASSMARPGRSISVDEADDRPLKPAGSIRES

SEQ ID NO: 118427 - protein, 291 aa, Triticum aestivum
  unsure (1)..(291): unsure at all Xaa locations
  Clone ID: PAT_TA_12845.pep
RPREPPEQNLPVKEVVYRSSLPHLEDNISSHMMNSRFNSFTGYPPLTEREESFQPKETTAVHCGFYSENGGFRVSDVDKDYMRSCRVVVATCAFGGGDDLHQPIGMTEVSVKKVCYVAFWDEVTLSAQHEEGKKIGEDLRIGLWRIILVRDLPFTDQRLNGKIPKLISHRLFPMARYSIWVDSKSQFRRDPLGVIEALLWRSNSSLALSEHGARSSLYDEGNAIVRKHKATPEEVKIQLVQYRQDXFPDDKRFNRKKALAEASAIVRDHAPSTNXFMCLRFNEVVRLTSRD

SEQ ID NO: 118428 - protein, 246 aa, Triticum aestivum
  unsure (1)..(246): unsure at all Xaa locations
  Clone ID: PAT_TA_12846.pep
ASRPASEQGGEDSDFIDVLLSIQQEYNLTRDHIKAQLEIMFEAGTDTSFIVLEYAMVRLMQKPHLMNKLKTEVRSTISKGKEMIAEDDLSSLAYLKAVIKETLRLHMPAPLLVPHLSMADCKINGYTIPTGTRAIVNSWALARXPSSWESAEEFMPERFMEGGSAATMDYKGNKFXYLPFGTGRRICPGINFAIVTIEIMLANLMYXFDWKLPSESMEAGISMTESFGVTVHRKEKLLLFPAVLED

SEQ ID NO: 118429 - protein, 118 aa, Triticum aestivum
  Clone ID: PAT_TA_12847.pep
HERQCDLATQDKDSGRNFILSRFSLREMPNITFFGDMLISSDFHSEEGTFICFMVIAMSCFLFPSSSDQIHIEFLTLLVNPKRTSGFDFCALVYDWILTGINKFVISGRVPGRKPEVF

SEQ ID NO: 118430 - protein, 71 aa, Triticum aestivum
  Clone ID: PAT_TA_12848.pep
FFFFFFFHTEHMELHATDYIHYMQNCCVFNAEFPNDLSSKKMFCYTCICSNLPPAVASVNSNANEGQKGAA

SEQ ID NO: 118431 - protein, 202 aa, Triticum aestivum
  Clone ID: PAT_TA_12849.pep
MARVHPNMVAAPGAIDEAPASSAVDGPTTLTVWRKSLLFDCKGFTVFDAEGNLAYRVDSYASESGDEVVLMDAAGRPAFTVRRKRLTLQGEQWLVFSGEETRRPVYTVRRSGRGKTLAHVTACAGTGAGPSYEVEGSYARRSCVVYDGERRAVAEIRPKEVVGTDVFRLAVQPGVGVPLAMAVVVALEQMFARPSLLRSWST

SEQ ID NO: 118432 - protein, 119 aa, Triticum aestivum
  Clone ID: PAT_TA_12850.pep
MEIESVKCECCGLREDCTPDYIASVRAGFYGQWLCGLCCEAVRDEAGRKKQAHPGVEEAVRAHMAFCKKFKSNPAVRVADGMRQMLRRRSGDLSKPPGSSSSNKYGTAQVGDDSPVSLY

SEQ ID NO: 118433 - protein, 97 aa, Triticum aestivum
  Clone ID: PAT_TA_12851.pep
FIKQPLACSWRRRVSLGPVAGGSPLPLHEGPQGLLEEVGAAVLGGWGVVVVGVSSGVAREDQHVADAAAEGGHLARSVRRRSARNVSMRPGRRSERS

SEQ ID NO: 118434 - protein, 261 aa, Triticum aestivum
  Clone ID: PAT_TA_12852.pep
EQTIRVLEEAKEARFSKLQALGLKLRDLWKFHNTAPENILEFAETFACIDAESANELTKEKSLSMELISKATEEINTLEASMVAKQKKMYLGKKQKLLKLLEETHMVPADMKFDPKKKVESDFPKAISDLTSVIKQVKVQILERKDIVMRIELLQHAVNNSLSVKTSERLLRSLKNMVVLEGTFLFDGKDVKVVINEIEYEMKPASTKPALPVKKRMSARLTELRDKEQSSPDLPPPPYPSRVRDGNRERRKGVWGKESKR

SEQ ID NO: 118435 - protein, 131 aa, Triticum aestivum
  unsure (1)..(131): unsure at all Xaa locations
  Clone ID: PAT_TA_12853.pep
KMGDLDXESFAIACKNKMSKEDAAVTASLLCSKWEEEIKDPEWHPFKVIMDEGKEKEILREDDEKLRELKEEYGEEVYGLVTKALLEVNEYNPSGRYSVPELWNFKEKRKATLKEAVQYVLRQWRTQKRKR

SEQ ID NO: 118436 - protein, 270 aa, Triticum aestivum
  Clone ID: PAT_TA_12854.pep
VKAKYLKMATSEQQRADENVLKLVAKHKREKKAALDEIIKLEQKLDAKQKLELEIKQLQGKLEVMKHMPGEEDSESKRKIDELSAELQDKYDEMDAVEALHHTLLMKERISNDELQDARKKLIDGLRDLTTGRGIIGIKRMGDLDLKSFAIACKNKMSKEDAGVTASILCSKWEEEIKDPEWHPFKVIVDEGKEKEILREDDEKLRELKEEYGEEVYGLVTKALLEVNEYNPSGRYPVPELWNFKEKRKATLKEAVQYVLRQWRTQKRKR

SEQ ID NO: 118437 - protein, 134 aa, Triticum aestivum
  Clone ID: PAT_TA_12855.pep
HLPPPATSPTQSCSSSTSPSISPPKRCSPLVVRAGWRATSRLAAWRRCVCYYGGWGGDGLLIGSRGRGGVPVRGGAPLPVGGWGQRGLAGPVCSGSVARQIWRSASMRGDWRVALDVGLLNLPPVKIPHLFLFV

SEQ ID NO: 118438 - protein, 145 aa, Triticum aestivum
  Clone ID: PAT_TA_12856.pep
YMIVKGRYEGPGRAACRVATSQRAPQARITSAQKAAAMAVRRGWVVGEGCDMHVPVGVAVAGEQVFTAPLSTRSTRHGTGRRGTVPHRRDPLLLTRTIQLFSFILRNSIARVTCPSLEPVYTIIFYVFAICKLPGNATWRSPFNG

SEQ ID NO: 118439 - protein, 142 aa, Triticum aestivum
  Clone ID: PAT_TA_12857.pep
PQPTAAGVFSKALRDLGQEADASEETVGQAGGRSSAAAGKAGGGAGGGPARGKPRRGGQQRPNEDPAGRAPASGLSPPRTRPAEDALGRLLPHWPRTNKKTNKPYVPAGGTRERKSFLSRTPRPRQPTEGRGPEAIVLPGKP

SEQ ID NO: 118440 - protein, 97 aa, Triticum aestivum
  Clone ID: PAT_TA_12858.pep
ARAAMPAVRFKAEARGDGSEVREECAVCLSAMQDGDAVRALPGCRHAFHVGCVDVWLCAQATCPVCRARPALPVPAAKDGSKRAETAGREPDLESPV

SEQ ID NO: 118441 - protein, 126 aa, Triticum aestivum
  unsure (1)..(126): unsure at all Xaa locations
  Clone ID: PAT_TA_12859.pep
VVFLQARNCLXQEIXDXEKDTXYKLRVLAQXYPGTPGLAIKDFWQVDDRTIVFVADPTFGNIINFNIGSLIDLDIPQSFWSRVAGKYGNMFYWKEKGEDASIEGAVMAISRCLREPTGASNCSEVF

SEQ ID NO: 118442 - protein, 126 aa, Triticum aestivum
  unsure (1)..(126): unsure at all Xaa locations
  Clone ID: PAT_TA_12860.pep
ELRLEGVAPVVNMRRSDWAWRAFLPEGADRNHPAAHVTGEAGPEPELAEAFXPPAMVAVGGLDPLQDWQQRYGAMLRRKGKAVKVLEFPDAIHAFYCFPELPDSGRLVEEIRAFIGTKTATHHPDA

SEQ ID NO: 118443 - protein, 65 aa, Triticum aestivum
  Clone ID: PAT_TA_12861.pep
HQITTNRLNKIFQASLIITNQPTDLPSTSFLACVQVNEARAMHSASKACPDLLTLYYTQITCPQC

SEQ ID NO: 118444 - protein, 175 aa, Triticum aestivum
  unsure (1)..(175): unsure at all Xaa locations
  Clone ID: PAT_TA_12862.pep
FTNAQRQVERAGGGGPPGDQSREDLGPQYGATREAGCEGRRGAXVVQVRVSPXSHAFKGQLKILGRMQDSNTERQASLVECGGGGIWNSXVDPANASVITQCGGIPLVVQCLSSPVKNTVNYALGALYYLCNPSTKNEILKPDVLRIIRDYSAAGAVNSSFSNLANAFLDKHVNS

SEQ ID NO: 118445 - protein, 92 aa, Triticum aestivum
  Clone ID: PAT_TA_12863.pep
AELRVEGSFGRRCCRVVAKGEDGEETVVAEIRRKVDEAARVVMGRDVFVLRVGAGFDAAFAMGIVLVLDQIAGDEADGGDAGQDVAVHARIW

SEQ ID NO: 118446 - protein, 105 aa, Triticum aestivum
  Clone ID: PAT_TA_12864.pep
MKKKQKKRYYAENKAAMAEAGPEEDVGLAVEKDSSDPRADFRESMVQMVVETGLCSWDDLRSMLRRLLALNSPRHHAAILTAFAELCAQLASPPPPATSSYHYQL

SEQ ID NO: 118447 - protein, 266 aa, Triticum aestivum
  unsure (1)..(266): unsure at all Xaa locations
  Clone ID: PAT_TA_12865.pep
MGAAIPVTAGATAPSRHAGGRRHRPRGSVAVRCSSAADERQALFSRIAPVYDHLNDVLSLGQHWTWKRICVSWSMAKRGDRVLDLCCGSGDLAFLLSQKVGLDGEVMGVDFSGQQLQTAASRQDQRWKACYKNIKWIEGDALDLPFTDRYFDAVTVGYGLRNVVDKPKAMREILRVLKPGSRASVLDFNKSSSFFTASLQSWAINNVVVPLASSYGLTEEYQPGRRPIAQYLTGEELEKLAKEXGFSSAKHYELGGGLMGNLVATR

SEQ ID NO: 118448 - protein, 98 aa, Triticum aestivum
  unsure (1)..(98): unsure at all Xaa locations
  Clone ID: PAT_TA_12866.pep
ARARAHLLQQQLDKERRAAEQKPRFSFGLGQSIGSWAKSPFWRGAGGGDQSAAPSRVGTPAASTSGRRGPAQXRRSVSGLSVDSTVSMPAGVGRRSFK

SEQ ID NO: 118449 - protein, 146 aa, Triticum aestivum
  unsure (1)..(146): unsure at all Xaa locations
  Clone ID: PAT_TA_12867.pep
LILYPCDLTMDLFSHVRALTDSHKEAINRVLQVGTEKLQQKRRRRTEMPVDDRRCPRESRETEPGPHGEHESPKKPNPSSPDCTEANHPGSPAAIGAINKVLAQRRLPPAQRXTKEANGRRDGYPRAWTTSSELGAPARRPPAEGD

SEQ ID NO: 118450 - protein, 150 aa, Triticum aestivum
  Clone ID: PAT_TA_12868.pep
MATTFTAPILCNLRANPRLNHSTRQQPRHLHLSSARMAPTLTGSRARSDFRAAAVYKVKLIGPEGKESVIEVAEDSYILDAAEEAGVELPYSCRAGACSTCAGKVLEGGVDQSDQSFLDDAQVGAGYALTCVAYPTSDLVIQTHKESDLY

SEQ ID NO: 118451 - protein, 169 aa, Triticum aestivum
  Clone ID: PAT_TA_12869.pep
RVCPSLRKVGSSATPPSTNPDRSKGRFFSTPPPQIPTLRRRIFLAMAGKQGRKKARSPPGCPQLRPIGSTVSGSKKPAAATVPSCKYHLSEASVQAVLNHKRVPFVIGGYFDDLTPEEQQLMLEVAAQHEEVEDRYAKYQERVRKELDEKGFVALPDDVDKRRAALNAR

SEQ ID NO: 118452 - protein, 83 aa, Triticum aestivum
  Clone ID: PAT_TA_12870.pep
IHFSVEARLAAVLDLSWHLFLGWVSLRSKLQNPQHSTCIPACISRTHTHTHTCMHEAGRMGSGNGCVEAKVMKALADRVNAPH

SEQ ID NO: 118453 - protein, 238 aa, Triticum aestivum
  Clone ID: PAT_TA_12871.pep
LGRVCRLGHFCRRSTATPPPPSPRPPPRSNSGRAVRAGARATSSSAPQAMEAKREEEPRVVTLRPVEATPESFAPFGQVIAASPDGDQFGPHDAQLDLSRGIPRFYIMRLESRPLKFSSITHHASVTQCLGSIGGQDWYLGVAKPSILDGATEQSGGGTAVQSRAGHFYLPPDPSEVCVFRVSGPKFLKLHAGTWHAGPLFKADAVDFYNLELSNTNVVDHTTHYFKKQDGVTFVIED

SEQ ID NO: 118454 - protein, 189 aa, Triticum aestivum
  Clone ID: PAT_TA_12872.pep
LDGGAGPPGPRVPPRPVEATPESFAPFGQVIAASPDGDQFGPHDAQLDLSRGIPRFYIMRLESRPLKFSSITHHASVTQCLGSIGGQDWYLGVAKPSIVDGATEQSGGGSAVQSRAGHFYLPPDPSEVCVFRVSGPKFLKLHAGTWHAGPLFKADAVDFYNLELSNTNIVDHTTHYFKKHDGVAFVIED

SEQ ID NO: 118455 - protein, 297 aa, Triticum aestivum
  Clone ID: PAT_TA_12873.pep
RRRTATAPSPSPPPPLTNRKRGRAVRAGARAASSSARPAEAKREEARVVTLRPVEATPESFAPFGQVIAASPDGDQFGPHDAQLDLNRGIPRFYIMRLESRPLRFSTITHHASATQCLGSIGRQEWYLGVAKPSIVDEHGGQHGGRAPGQSRAGQFYLPPDPSDVRVFRVPGAQFLKLHAGTSDPGPLFKAAALDFCNLELSDTNDVDRTTYYFKKQDGVTFVMRGVEWRRRTSADLGRIKPSAACASAGTLFLATSVPLAVDELPIVYVCTYVCMYGLNEQCDCCPSAGDLFSLLY

SEQ ID NO: 118456 - protein, 147 aa, Triticum aestivum
  Clone ID: PAT_TA_12874.pep
SPAVRRRRRPMDRFYDEQYVRLRNRKLDKYYLHADDDGVGVSISQRRNSLNVAWKVHIYQGACGPYLLLHSAAYGRYLAVTATPAPALYHGFRAELRDYDHPEVPDIMWLDVRAGLGPGVLLLNAGDGDRYLRANGKYLRWNTGVTV

SEQ ID NO: 118457 - protein, 113 aa, Triticum aestivum
  Clone ID: PAT_TA_12875.pep
KAQHFSAFLRACLCLFSFLFSPRVDMHNMPLHILCFFHDTFLQDCLSLSLSSSWLGTIIHALLIAGARHTRMSCRFCAYAFGLQWGHQKGAWSQPSYLGGPKPPTRTPEECKG

SEQ ID NO: 118458 - protein, 83 aa, Triticum aestivum
  Clone ID: PAT_TA_12876.pep
PPPSPPPPSKPSWPSKPHEAEAGSTPLGGGGELVEQRRGRTGRSGEGEEAGSCSARRRRPQAVVLAGIWEVEEELGLGMSGES

SEQ ID NO: 118459 - protein, 154 aa, Triticum aestivum
  Clone ID: PAT_TA_12877.pep
PVEEVCEQRIPDLCDQHVHVSQPAGCHLSTLTSSIWQHRISSMYGFGLEILSTSNFDNFVMKHERSSENAMFAVADEAQTVGEWWERLCSAGGSKEQNRLNMTVAAYTVWNLWKERNQRVFENKELTATALAGLIKDDIKCFGEATRGIPFVGP

SEQ ID NO: 118460 - protein, 210 aa, Triticum aestivum
  unsure (1)..(210): unsure at all Xaa locations
  Clone ID: PAT_TA_12878.pep
MAASSALLILVGSSSASRRQILAEMGYQFKLLSADIDEKEIRKEKPEELVVALAHAKADAILDKMRNNGMMKEIVDSQETTLLITADQVVVHDGVIREKPTTPXEEARKFIQGYSQSHAATIGSVLVTNVKTGTRREGWDKSEVYFHKIPNEVVESLIEEGNVFYVAGGLLVEHPLTSPLVEAIVGTIDSVMGLPKALTEQLIKDSLQEP

SEQ ID NO: 118461 - protein, 157 aa, Triticum aestivum
  Clone ID: PAT_TA_12879.pep
RGGLGAAAQAISRAFPSLECTVMDLDHVVDKAPAGTDVKYVVGDMFESVPPADAVFLKWVLHDWGHEDCVKILKNCKKSIPPRGKGGKVIIIDIVIGAGPSHVKHRELQSMFDLYMMIVDGIERDEQEWKKIFLEAGFSGYKIIPVLGFRSIIEVYP

SEQ ID NO: 118462 - protein, 218 aa, Triticum aestivum
  Clone ID: PAT_TA_12880.pep
NIIVSFFFDGFINLKSGLCAFSLKVDTGSGRLRQLRQAAASTRTHNNTQQTKTGHAKSPTKKKRQRWQTGDACMSRIFEVDLDGVGALAELAVEQLLGHGERRLLAAAVGAAVHQPVDVVEDGLPVPLCLPVHHRQRPLQRFLVGGLRAVAGQHFDGLRHGHLPQLHVVLVAGSGPCADDAAGGKGDNEEEEQVVVKRGHCSRYSAADACADAWADDG

SEQ ID NO: 118463 - protein, 88 aa, Triticum aestivum
  Clone ID: PAT_TA_12881.pep
IINHTFLKKKISLPIPIPVLTDKHCCQASWRSKENEAVVLSWTRLDMYIRVSSMFCLLIKRSSPLEGCLAEESFSALLRHSNGLAIGV

SEQ ID NO: 118464 - protein, 433 aa, Triticum aestivum
  unsure (1)..(433): unsure at all Xaa locations
  Clone ID: PAT_TA_12882.pep
MAIVLELHAGDETKLVLWGARASDFEAEEVRIASQSXAVITIFVGTLPKTYRGIKGLSGSSACRWYINEDLPDMNAFRASLPVSLAAVTAHIPGEQVIVPAPVRVPLVELSLQQLHALVPFNNLKIQFMVKGIIPRMGSDNRWCYLSRPECPTKANMYVRQYRCSDHGCSSVAADPSYCLCSLGSGGAAEAEFMFFDRAAKSAVGKPLMTLIYRKYPGFTSALDLPYIGGADVGLPVEISRLVTKKYRLVVSISTKSFQPASTQLSFQVGRVDETFKPELASFGFGGASSSAGSSGIAVPIPTSFATGSSTLVDLPPDEMNTPISAFRGKGQASMPKTPSKSPCPKSARRKLVLELSKSRDEELSGSAPELATQTGDVVPPGNVVQPTSMPNVSQENEAAATENSDSLLPDPSKTKRANTPAKGVGTPKKARQ

SEQ ID NO: 118465 - protein, 62 aa, Triticum aestivum
  Clone ID: PAT_TA_12883.pep
VQTVAYLFRALHSPTLYIHRREGGIRNGFCTNKCKNNYFLLHASSSSHLFLFFKKQTKKKKK

SEQ ID NO: 118466 - protein, 322 aa, Triticum aestivum
  Clone ID: PAT_TA_12884.pep
LANGNKARKLDALLPLLRRRGATDVITCGGCQSAHAAAVAVHCAEWGIRPHLLLRGEQLDVPTGYNLISLMFGNVTYASRSVYAHRDEMLYEHAKKVAGTGGSVLWADDIVRDDLSVDEETVLENDSRRVVIIKEGAGTVQALLGVMRLVEHLSSLSSFHNDEEVHVVVDAGTGTTAVGLALGAVCLGLNWRVTAVMLADTFERYKEQEKSLISDFKGLCHEDCHELVGTDGLVHWVDRFSPRRFGKVLGGEIASCRQVAQQTGILLDPVYTLAAWEQAVDLCRGDGRGAKVAMIHSGGTLGLFGLAQRYPQHFAATANGQA

SEQ ID NO: 118467 - protein, 155 aa, Triticum aestivum
  Clone ID: PAT_TA_12885.pep
ARGSSFPNPQIAPKTQTLAGGAMEVGGDSQARGDRAPQISDDEDEIIYYCAFSEPESDSDAPRPRPDYNKPIQFVPARTVFQQPDGEMKQVLERAHAKAERRRQRELAAAAEGIVKRPKITIRRSFAGAQRLKGPQIPRLYGHIKKRLPDQPTAL

SEQ ID NO: 118468 - protein, 212 aa, Triticum aestivum
  unsure (1)..(212): unsure at all Xaa locations
  Clone ID: PAT_TA_12886.pep
MKGVRGMAVVMALALALAGMVATSSAAVYQVGGSSGWTILGNVNYADWAGKQSFKVGDVIEFKYPQGIHNVLEVNKADYSSCTNSTPIATHTSGDDKVTIKSPGHRFFICGVPGHCTAGQKLNVRVLKTQKARSSAPSPSPAPSATAPAPAXASPRAGDTSGSSASTPPAAATTSDGGATTTAPAPNSNGAAVVRAGYAVALAMAASMAMLQ

SEQ ID NO: 118469 - protein, 141 aa, Triticum aestivum
  Clone ID: PAT_TA_12887.pep
MMMMALMGLVTTRTRPRWREILLLDSKDGSRPAPSDGYLYLSRQVVSVEPSGQLEVEIQAYAPPGVLPAKTQVCFEAQECNIDRGRCCLLGAEVEICVAWSRLASDVEMLAGVGGDFQREEPEVAFTQVGLNGEPDTERIF

SEQ ID NO: 118470 - protein, 273 aa, Triticum aestivum
  unsure (1)..(273): unsure at all Xaa locations
  Clone ID: PAT_TA_12888.pep
PTAARKKEKTGGLVYAIALNPLGLAHLVHNGCDKGLERLQISIWRQGPEDVGEVEAWVAEGHLHQHLLKNSRADLARLVGQLLWDLLPESLEGRRHAFEEQAELGAGLEVLIGGVPEILHPQLRQLPVDGCGNIHQTLGPVLHSLPETVLGGSSTRQQRLVGLDLLLQGHLLLLGTVQRLSQSNKLQLKICVGVLGGAKLFAPLSETTLQLAMSGGVLLALTLERSKLLVARLEXGSTAHLRLSSFLAARXCXYPLLPESXQMXAXPGNSPXV

SEQ ID NO: 118471 - protein, 185 aa, Triticum aestivum
  Clone ID: PAT_TA_12889.pep
ISSRRAALLALVLAASPARPAAAAFSFSFPGPKELLREQKRKSARFLLAPIAASRETLVKAQDLLASENASAADAEEVRGRLSAAGRDCVPRERNSVVAFQSRTGVEVCTFSLILKNAASLLDDKDPVKVEADASLAELIQSFSDLGTVVENSNFELSDDRKKMKDDLLSTISALDKYEQGVKDV

SEQ ID NO: 118472 - protein, 84 aa, Triticum aestivum
  unsure (1)..(84): unsure at all Xaa locations
  Clone ID: PAT_TA_12890.pep
FFEQTFVWKNXNFAXIWEFPRDEYELTQRFGXXDFKLKFVEHNIRFLQEILXQNRKSDFLEWLIIILISVEILISVYNIVQEQM

SEQ ID NO: 118473 - protein, 105 aa, Triticum aestivum
  Clone ID: PAT_TA_12891.pep
EENGSALLSRAGKGLALRPKSGTRPDMNKSHQNLIAMSEPSFDGGLQTVKKSSSTPEFQEPESNSSSSSIWSASKWSLKPDAFALPLFDSIPKPIAAWKNKAARD

SEQ ID NO: 118474 - protein, 80 aa, Triticum aestivum
  Clone ID: PAT_TA_12892.pep
STSSGHGGRLRGGHRARRRPPGGDQALRQHQGRRPLTDHFQTCRSSATLVPCIHSFVPSYENPISNAFFFLFFFFYSVWV

SEQ ID NO: 118475 - protein, 104 aa, Triticum aestivum
  Clone ID: PAT_TA_12893.pep
MEGEEEIGLVLARASDLRSRISACAAAARPPLRLGAGEEDDGGEEAEEEVEMESLVGINDALESLERQLASLQDLQHQQRYERETVLSQIDRSRTSLLNKLKEY

SEQ ID NO: 118476 - protein, 240 aa, Triticum aestivum
  Clone ID: PAT_TA_12894.pep
KFPKKGNCSFRRRELATSNATKTKFPELVVQEEKRVRFVVINGLVIIERPNNMRMQDAEWFKRLTGRSEVAISSRDYKFYSPRHKYRRTLQPVFDIPGTSVLSEDETSPLVCSSEFRPPFEMQNQHESSSKRHIEQIESQPYLHFLDQAEHDNIQQNQHSSQFPPIHPCASSSQLSDNPQQHQSYLSPHLSSMQAGHNHLGGRSNILPSSPAKFCDECGSPYLRATSKFCSECGTKRLGI

SEQ ID NO: 118477 - protein, 75 aa, Triticum aestivum
  Clone ID: PAT_TA_12895.pep
SPHAICASVHLRVVESSLLIEVYVSSYSLHISTEPTLLPDTAVYLHGVIEVRYPHGHIPELWSDTAWEVSQININ

SEQ ID NO: 118478 - protein, 97 aa, Triticum aestivum
  Clone ID: PAT_TA_12896.pep
MGLLALKMLMSRRRDSKHLCGQIQARNRLVTSVVKRKISSCQHNNNQGCKRVAFSGADLPEDINRHIHSLLPLRDAARVACVSHAFLRSWKCHPNLS

SEQ ID NO: 118479 - protein, 88 aa, Triticum aestivum
  Clone ID: PAT_TA_12897.pep
VPCPGTVLMLIAVFCSIRKYNYILFLIGQSYTGKITPECVQLYNVPTDVFCSIKNIVFLLSQLDGHCYVNLMATMFCYGRKFNYILLI

SEQ ID NO: 118480 - protein, 134 aa, Triticum aestivum
  Clone ID: PAT_TA_12898.pep
DSDEAELDSRRLLYSPQSPPPPQQARPRPMYAVADHEAAYLYAPKRQAGGLTGAPGFPELKQTFSNFRSPDGAVILGNRPDLLSTPKPGSTTPSAQATSAAAQPTEEEEDLIAEALYGRSGRRRLPIFREICPE

SEQ ID NO: 118481 - protein, 70 aa, Triticum aestivum
  Clone ID: PAT_TA_12899.pep
NTTPLMSNLQGNRHKIELQIGNRFPSIALIQPNYFRIIVEMYVQNLTECVLLGLALVISLSTHHRYNSHL

SEQ ID NO: 118482 - protein, 60 aa, Triticum aestivum
  Clone ID: PAT_TA_12900.pep
LCRPPRAEGDNMPESFHLAEAVCKLRGQDPEQFHGNGSNGWTIPLSWKSIYGPPPDMSIF

SEQ ID NO: 118483 - protein, 162 aa, Triticum aestivum
  Clone ID: PAT_TA_12901.pep
FTSPILTPSLAPDIHLSSYKACSATMAAGGAPLLVVVVVFSMLITSSLGGPRPLCSECETQCRTNCTAMVETSCRGYCTSGGGPRSSCRKYVFEDCNVKGTCCSSNGTCTCDCNTVAERGCMSVSDGTLQCDPCKRSIYDQCGSTCRNDCNNNCKKKGCRHD

SEQ ID NO: 118484 - protein, 111 aa, Triticum aestivum
  Clone ID: PAT_TA_12902.pep
PVYGCMGAILTLQQQVHALEAELAAVRAEILKHRYRPAAAAAASAVPNVPPSSHASQLLAAGGHRPAGSLGLAAPAVGPVASAASSTTVYATASSSTDYSSITHENVPYFG

SEQ ID NO: 118485 - protein, 127 aa, Triticum aestivum
  Clone ID: PAT_TA_12903.pep
LERFSWAEEEAELFLCVLYFSLCDLWRFTLRQPWSKLQHYFQSSDMTDRGFKIDTCWVAQVPSVEGDQFFTMELIKLMSNFLFFWTPTDSSPRNIRWLHLAPFTRSSHDLILLCMYTCSICYCYYGL

SEQ ID NO: 118486 - protein, 137 aa, Triticum aestivum
  Clone ID: PAT_TA_12904.pep
AAAGLRNSTSSLSKKKSKMAAAATLLLLLLLCPALALGCVCPGESSACTHEEKSCVQTLCDPGCREWLGSLICLEGCRQCLQKLPLRCRKAFQDCTFRCERADQYCHSDCHLGSKPGCVDGCYKKNDECVSRCLKGL

SEQ ID NO: 118487 - protein, 114 aa, Triticum aestivum
  Clone ID: PAT_TA_12905.pep
RHEVFSAVPRKLKYRQLMIYICFLRMRFSSSSSFALCFVLFFSCHRQIRLSSLVFECLKFTFSLCFFTFQTRSPFFFLPLFGAIYTGRYPAFVNTMDGQHLSRHQGRNGWQRRH

SEQ ID NO: 118488 - protein, 111 aa, Triticum aestivum
  Clone ID: PAT_TA_12906.pep
LCSQTMEPRKTNGKKEFMIEYHPISVVEKGTPSVDEARFIRKYILAAFIEHTFNLLFVATLAGYIYLMFGALMYCKLLYAVFAILLMSPYFIVMLHALPLLKGFYKERYAT

SEQ ID NO: 118489 - protein, 76 aa, Triticum aestivum
  Clone ID: PAT_TA_12907.pep
MCLLMTCLLAVPSFAIAMFMLLLWSEHNLFYLPCSEALATWMELTPWQEKSQPGKLFRQNGMRRLLLRFAVHMVWP

SEQ ID NO: 118490 - protein, 221 aa, Triticum aestivum
  Clone ID: PAT_TA_12908.pep
MAARNRSFVLWLHGLGDSGPANEPIRTFFAAPEFRHTKWAFPSAPNSPVSCNNGAVMPSWFDIHELPLSPGSPQDESGVLKAVENVHAMIDREVAGGIHPDNIFVCGFSQGGALTLASVLLYPKTLGGGAVFSGWVPFGSSVIERISPEARKTPILWSHGIADQVVLFEAGQAGPPFLQSAGISCEFKAYPDLGHSIAKEELSSLEAWIKGRLKASQDKQS

SEQ ID NO: 118491 - protein, 156 aa, Triticum aestivum
  Clone ID: PAT_TA_12909.pep
TFFANLQLAIACEVLCTMGMAEQGVGGEEGRADHQDAGPVPEHHGEEQASGGLLLGVCSVSDRQRYVVRTECLNHPLFLGTARRRPRRHLGTQTQGPSSCPATPRHSPRCWRRSRGRSRWAAPRRHGLPKGNSYRSLGTGLAYDRRPVVTVGFRIG

SEQ ID NO: 118492 - protein, 205 aa, Triticum aestivum
  unsure (1)..(205): unsure at all Xaa locations
  Clone ID: PAT_TA_12910.pep
SFVPPASRLLMIGCGSALMSEDMAADGYXEIINIDISSVLIEMMRKKYFNLPQLQYMQMDVRDMSKFSDESFDCAIDKGTLDSLMCGVEAPLSAAQMVLEVDRLLKPGGVFMLITYGDPSARIPHLNQPVCSWKIVLYILPRPGFKGNIRRSVFDPVPLTESGRLPEGFVLEDPDSHYIYVCKKGQELTGIDSPTLSHLKLQDSE

SEQ ID NO: 118493 - protein, 72 aa, Triticum aestivum
  Clone ID: PAT_TA_12911.pep
ISVATRGVSSSFSQKLRSQTSSSHHRKLYPPPRFHQQCWAALVSCRPVAVQSKHNSQKYQPRPVAASTSALA

SEQ ID NO: 118494 - protein, 165 aa, Triticum aestivum
  unsure (1)..(165): unsure at all Xaa locations
  Clone ID: PAT_TA_12912.pep
MKGGVLHRLLVNKLCLGLLLVLLVVPIVILLLGTTPEQLKLLSQGFLQQHGLEHIGDNVSALVVPAGPAYNDDTHTSITRRNKWNKDCNYAKGKWVADEKRPLYSGNECKQWLSKMWACRMMQRTDFFYESYRWQPHGWEMPEFXGPYLVSRLRHKTLAFGGGSL

SEQ ID NO: 118495 - protein, 222 aa, Triticum aestivum
  unsure (1)..(222): unsure at all Xaa locations
  Clone ID: PAT_TA_12913.pep
RSGILRSTHASAGNECKQWLSKMWACRMMQRTDFFYESYRWQPHGCEMPEFSGPNLLSRLRHKTLAFVGDSLGRQQFQSIMCIATGGKYSPDVEDVGWKYGLVKAPGALRPDGWAYRFPETNTTILYYWXSASLSELXPLNTTNSXTSYALHLDRPVTFLKKYFHGFDVLXVLNTGHHWNXRGKSSGNHWELYANGEPVGKGRLAVLNRAKNLTLYSIARWV

SEQ ID NO: 118496 - protein, 126 aa, Triticum aestivum
  Clone ID: PAT_TA_12914.pep
LLRRQMSPNPHCRGCVEHKKPRAKLSHPHKDITAPTLKDSFEGELCKAGAAEDHRTDHLLPVIVAIGAPPLQLRLHGNKTTRGNPTNTPEKSRLPQPLPRLRHCTRPSSLPLKPRRKTPPTSIDPA

SEQ ID NO: 118497 - protein, 76 aa, Triticum aestivum
  Clone ID: PAT_TA_12915.pep
DGEVRSELQELTDAREAGMSFITGRAHMRAKSGSGLVKKIAINYIYEFLRRNSRGSVTAANIPHASTLEVGMVCQV

SEQ ID NO: 118498 - protein, 205 aa, Triticum aestivum
  unsure (1)..(205): unsure at all Xaa locations
  Clone ID: PAT_TA_12916.pep
LSGLISFGRGMGKPAPSGSPAKTSSAEYKKQGREMSSPVPEKTSTSGGCGKGSSALSTKGKKRSEEERGSEGNVKKSKHESCSPTSSSPKGQVTKVKLGHKITALQQMVSPFGKTDTASVLYEAINYIKWLHEQVQLLSDPYMKSCSSKDYKPWVRSDGMEKEDAETDLKSRGLCLVPLSRTPQVYMDSNGPDYWTPPXRSCLFQ

SEQ ID NO: 118499 - protein, 138 aa, Triticum aestivum
  unsure (1)..(138): unsure at all Xaa locations
  Clone ID: PAT_TA_12917.pep
MPPSLALYAHLTPAATSSSATCSDSAASYCPFLSSVIHHLKWLLDRTSATRIADEEDDDVDNQIMDFAVADCVARTPSIEAGEALGSKGQXKRCTAADDVAQAPGQHISRMGLKVVPMIAPFSNLCAVNISGNFMGGV

SEQ ID NO: 118500 - protein, 103 aa, Triticum aestivum
  Clone ID: PAT_TA_12918.pep
HHHVTLHASKTYTFIVVVVIVIVISIIRVEESGLVMSSTERKHGDEEDRDEPSAKLDKCGVWRGDAHHLVVGLLGIRQPRLEHAPLLPAPRPHPFPCRLPALR

SEQ ID NO: 118501 - protein, 73 aa, Triticum aestivum
  Clone ID: PAT_TA_12919.pep
IGTGGKKRYNHKFSRGILGSTHLVVYSADLEQIVCKIYMFSSFPNRQGMMADNINTRTKEETCISNISKLREK

SEQ ID NO: 118502 - protein, 222 aa, Triticum aestivum
  Clone ID: PAT_TA_12920.pep
GNPPGIIRTFVSDPIPELFKVMIKRLVRWRILPTDCVPDSCIVNMYDPGDCIPPHIDSHDFVRPFCTVSFLSECNILFGSSLKIAGPGEFTGSFAIPLPVGSVLVINGNGADVAKHCVPAVPSKRISITFRKMDPAKRPFSFKDDPELLNITPLEAPAAPETSRSSDEGKGKQLGVQTRDPGSRSSRSRKSKGRTTPAGKAGWGGILGDQPPQAPTRAPSPV

SEQ ID NO: 118503 - protein, 126 aa, Triticum aestivum
  Clone ID: PAT_TA_12921.pep
SHSASAQRQTYYPLLTCHHFSYDAIYVNIVLFHVNLFWPPLRFSHVVHLFTPHKDFMFNRVFVSRFLVLCEHNTKSVTIVLQKVGANMIQEASSLRQVLDKVEALKSELKCMHCILADTKARMSRG

SEQ ID NO: 118504 - protein, 185 aa, Triticum aestivum
  unsure (1)..(185): unsure at all Xaa locations
  Clone ID: PAT_TA_12922.pep
RAPWVSIGNGPPPPGLPCGTPSIGTPGMLLANSAAPEASAAVGVLSPLIFLINKGVLLKCLSKSMYVSFLAGCFRSXIRFGMEEAHGKGQALQFNWLYDKGAFILHSDGKFSIDFTKVEEAVESLGREIMTIQAKGDKPAAQSLLQSRATLTQPLRVALEKIEHMQVPVDIAPIFGTASKLLANN

SEQ ID NO: 118505 - protein, 111 aa, Triticum aestivum
  Clone ID: PAT_TA_12923.pep
CSYGRLLNATRVVPNWTISFHEDLQITSCKYECAIQSFTGTRGVYLCPDFCWRLWSIEVLNPKPSSMLIFFLDSFVLLIQIIYCEIFVQFLDYMSVSRHLLTIWINLPQYI

SEQ ID NO: 118506 - protein, 107 aa, Triticum aestivum
  unsure (1)..(107): unsure at all Xaa locations
  Clone ID: PAT_TA_12924.pep
MHCSVIRGYGYCSVIGIITLXTYLKNSLQEEIVDETDEYVDVHQRIRVAAAVAASAVARVPSYRKLLSQKGAQGQGQPGQQPTGILKKPSGDSNKSKNKVSLVEPLL

SEQ ID NO: 118507 - protein, 296 aa, Triticum aestivum
  unsure (1)..(296): unsure at all Xaa locations
  Clone ID: PAT_TA_12925.pep
GNILLSFHHPSIVDVKEXVVGSSLDSIFMVMEYMEHDLKGVMETMXTYTQSEVKCLMLQLLEGVKYLHDNWVLHRDLKTSNLLLNNRGELKICDFGLSRQYGSPLKPYTQLVVTLWYRSPELLLGTKEYSTAIDMWSVGCIMAELLAKEPLFNGKTEFEQLDKIFRTLGTPNEKIWPGYAKLPGVKVNFVKQPYNRLRDKFPAASFSGRPNLSEAGFDLLNKLLTYDPAKRISAEAALEHPWFSEVPLPKSKDFMPTFPALNELDRRTRRYMKSPDPLEEQRLKELQAKGNRGLFG

SEQ ID NO: 118508 - protein, 142 aa, Triticum aestivum
  Clone ID: PAT_TA_12926.pep
SAICIILDTDVGIDTSTNITRHNFQVICIDHYMILYFITRGKNTTPIYFLRRIVEGICKISIKMRDYALEAYTGHTNAPMHMQPSQGSTPVHACVRKVQGGASLACYDAHVHHVGATHLVNRRKHQFRLRRVQVGLRTSCVP

SEQ ID NO: 118509 - protein, 76 aa, Triticum aestivum
  Clone ID: PAT_TA_12927.pep
SLEFYDALTNKRHDNYSYNMMFPSFLTSAVTQSLTSPKMLVRRTDGGALFQRNTRTFLSFQMVQKTSIMRKIIVWR

SEQ ID NO: 118510 - protein, 93 aa, Triticum aestivum
  Clone ID: PAT_TA_12928.pep
DHRPEKHPHTGGQFIQGKEAKGQHDKYWYISNVLFSFFDSLLLLQCLSHIGISVEIQRTPSSNTIMVQPLVIDVSFIGSIIQQIFHGSLGSTV

SEQ ID NO: 118511 - protein, 96 aa, Triticum aestivum
  unsure (1)..(96): unsure at all Xaa locations
  Clone ID: PAT_TA_12929.pep
FFFFFFDKLFFCLAMQNRIWTDXKHDYTNCGLCTLCKREQEYVAHLFYKCRFTKALGIVLESFDISSWNDKHSVKEWWLNMSVKTSTPSTRRRTSS

SEQ ID NO: 118512 - protein, 99 aa, Triticum aestivum
  Clone ID: PAT_TA_12930.pep
SPLPSEGHRSSSSLQAMRGRGGRPAASSTAACFSFFLAEHANMAEYEESNTLCMTEEILSTNSVNNHHMDQTRIWKNKSYVLPLSSSRFSTMIFLILSI

SEQ ID NO: 118513 - protein, 70 aa, Triticum aestivum
  Clone ID: PAT_TA_12931.pep
FTFMAGQAAGYAAADSVQALPLVSTLWGVVLFGEYRRSSRRTYTLLGSMLFMFVVAMAVLMASSAHRKPL

SEQ ID NO: 118514 - protein, 81 aa, Triticum aestivum
  Clone ID: PAT_TA_12932.pep
NLTDSLLKFISVLAHNQAMISRLRTSRRTYWIHARCTGSMLGTGTNGPYEPGQMIPFLLVLAHDGARYISYAVSHGSFTFL

SEQ ID NO: 118515 - protein, 120 aa, Triticum aestivum
  Clone ID: PAT_TA_12933.pep
CIHSVVCSSSGRKFHSRKQEVFHYLTPVIQCIHLLLVVLATMGGEQADRILAKSNDEILPKSAKRRQQCQAWKAIEHGFRAEGVHGVLIAKAIRSSFCTLISCLQILLSIYPHSSPCAIL

SEQ ID NO: 118516 - protein, 374 aa, Triticum aestivum
  Clone ID: PAT_TA_12934.pep
SLQEILAARDLVGCKRFAERAVEADPLLPGADELLAVADVLLTSQAMLYTGEPDPYAVLQVPSKTTDHGAISRAFRRLALLLQSSNPHPGADVALRIVNDAYELLSDPSRQPLRSARTNIPSGAPSHPAAAAAPAAEATDFWTACPFCCYVHQYPRELVGRALKCPNESCRRGFVAVEIPTQPTIVPGTEMYHCAWGFFPLGFPNSADLGGNWKPFYKVFPWNNAPSGGGAIGRNYSNHGGGSNDRQPQNGSARGGSSRGRVKKTTARKKVGAGPKRRSFGGGVESGIDASMLGQDGWAEGEEGEGGQREEVRGININEEAQATDGTGRANVTGGVEDLGSFHLDVDPTEDILGNLGNLHNLPFLRVDNLGRML

SEQ ID NO: 118517 - protein, 145 aa, Triticum aestivum
  unsure (1)..(145): unsure at all Xaa locations
  Clone ID: PAT_TA_12935.pep
RRRAGEEARGGVAAWQLAVXAKVNNRFKREEVVINGWEGDQVEKASAWLNKYERKLEEKRAKAMEKAQNEVARARRKAEDRRASAEAKRGTKVARVLDLAACARPVAGAPPAPAEAKRGTKVARVLELANFMRAVGRAPTKRSFF

SEQ ID NO: 118518 - protein, 184 aa, Triticum aestivum
  Clone ID: PAT_TA_12936.pep
FFFFFFFFFFGNNSLDESVSNICQTCGCFVSFCTTRGLVPGVPPRALHLRPGPACSYCYLLAHVPNSPLSRLNVLPPRRVLRAPRRPSAPWGRYGHLKFQTEPTLKVILPHQYSWHKVFVEPDEVKEASDHSLQGCVAHITVSLNDLLVQSSKLVKPLCILIQRSQPFQNLLSVRLCLIKKSRN

SEQ ID NO: 118519 - protein, 58 aa, Triticum aestivum
  unsure (1)..(58): unsure at all Xaa locations
  Clone ID: PAT_TA_12937.pep
TLLQELVIERCPFVKSXLPKDGLTSSLWKLEVFSGISEELKRKCRKLKGIIPIIKGYT

SEQ ID NO: 118520 - protein, 79 aa, Triticum aestivum
  Clone ID: PAT_TA_12938.pep
PELVELVVEFCFSTTTAPSRARFLLWYCCPCTLQLSLRQSTSSLKSRCSYFGSNKTEGSLTRQINPSKHQAKGSRSEVP

SEQ ID NO: 118521 - protein, 84 aa, Triticum aestivum
  Clone ID: PAT_TA_12939.pep
RTMNTRAQMAMKSLKQHRRNQNGGRHKFNLNRSWTMAKIAASYAGPSPCPLAPDLHLDELHPGSEVGQPRRVVPGSGCTTGFSS

SEQ ID NO: 118522 - protein, 132 aa, Triticum aestivum
  Clone ID: PAT_TA_12940.pep
SHQRTRRRSFPHRSIPPTPFDPCVCQLMVLRFFHSQIMIKLLLNFVKNKVCYGLIRIYCLTELWMFSFPWMLFILLQYMLSDSGHILLYVSKWQLQKLFNELTFIFLNYINLMCKSWRMTQNLKLTVLCLAS

SEQ ID NO: 118523 - protein, 132 aa, Triticum aestivum
  Clone ID: PAT_TA_12941.pep
CWLVNMAAYEMCVSSKWPSDGLAISSYISLLTMLMDKEEDVHKLRAKHLVRSLLSNHELLVFFKSLACHLRLGYRYFVITEKIDKFKRERPVRIALHRFVYNNFKTIVVMLSITGVLAGIFRTLMSLKQHQP

SEQ ID NO: 118524 - protein, 58 aa, Triticum aestivum
  Clone ID: PAT_TA_12942.pep
RTEVECLMGWIRYARMRVDGWTLRGPRELGHRGGLVVCKLSVFHRRATGKWLQATSTV

SEQ ID NO: 118525 - protein, 55 aa, Triticum aestivum
  Clone ID: PAT_TA_12943.pep
YSKVASKDRESMWRRYADDLVRKLKQPDTEKPDTNARQQQQRQQQRRSSDPPRRR

SEQ ID NO: 118526 - protein, 322 aa, Triticum aestivum
  Clone ID: PAT_TA_12944.pep
RKKNTENFDWDKFRRQAFADGHMKERKSERRDSVDWEAVRCADVQRISQAIRERGMNNVLSERIQEFLNRLVRDHGSIDLEWLRDIPPDSAKDYLLSIRGLGLKSVECVRLLTLHHLAFPVDTNVGRICVRLGWVPIQPLPESLQLHLLELYPVLETIQKYLWPRLCKLDQKTLYELHYHMITFGKVFCTKNKPNCNACPMRSECRHFASAFASARLALPAPQEKSLVMSSNQFSFQSGGMPTPYSTVLPQLEGSAQGQDFCTNNSEPIIEEPARPAREECPETLENDIEDYDPDTGEIPLIKLNLQAFAQNLENCIKESNM

SEQ ID NO: 118527 - protein, 364 aa, Triticum aestivum
  Clone ID: PAT_TA_12945.pep
MTPHAYVAPASRLLASVIRAELYLRFDWSLWDVALPPFSRFRGPLFRPVVSGVCIYLSPSSSLVSCSMLGAMDERIPPPPFFQYSPSGVHSSPHHHNPIRSSASERERYIAELLAERQKLVPFLQVLPFCNRLLNQEILRASSLPPNPNFVEPERFDYGSPLRLAGHPMNGQPMDMEGWTGMHAEHMGIHHSPSMGWDGGPGVVGGPVVKKLVRMDVPAEKYPNFNFVGRLLGPRGNSLKRVEATTQCRVYIRGRGSVKDTVKENKLRAKPGYEHLNEPLHVLIEAEFPADIVDARLNQAVVILEDLLKPVDESMDYFKKQQLRELAILNGTLREEESPSPSPHLSPSVSPFNSTGMKRAKTGR

SEQ ID NO: 118528 - protein, 92 aa, Triticum aestivum
  unsure (1)..(92): unsure at all Xaa locations
  Clone ID: PAT_TA_12946.pep
IPMEPKLKLHKSKGXEMVHLTMXRSLVGSLRYLCNTRPYLAYSVGIVSRSMQEHTMSHMVAIKRILKYIKGTTSLCCHYKKKKKKKKKKKKK

SEQ ID NO: 118529 - protein, 160 aa, Triticum aestivum
  Clone ID: PAT_TA_12947.pep
IIIIECCVSLDSVPGGGRATMAQHHIGVKEIQQRTLADGVVLLYRSYLLLLSQVEHHLPPELFLVTEVHLNLLSRLGAMARTSTPLASPLSLGMWGFLRWWLARSMAAREGIGAALAAQDSRQVREGEEGIQQREIHVDLGREEEGFRERCEDRGLVRVP

SEQ ID NO: 118530 - protein, 74 aa, Triticum aestivum
  Clone ID: PAT_TA_12948.pep
NKHVHQVTALLALQITLNRLAKSNKGKKEGKLHNRTTPTQLDHGVQSNTHSRKDVSFCFFTGTRTRAPVYYLKL

SEQ ID NO: 118531 - protein, 112 aa, Triticum aestivum
  Clone ID: PAT_TA_12949.pep
NSSSCGGGGGPDPSTKSWASTTNGGVFQWGSTSELIRSERSRSDDSWPLCRRPPGYAEQIRARRLLSSALLCARHWSLPPHPRFQERWVRRFLLHLVGCKQQCSSLADTNWD

SEQ ID NO: 118532 - protein, 317 aa, Triticum aestivum
  Clone ID: PAT_TA_12950.pep
MMAKVNAEDETAWAIAVDMECAAVEAMAPITLGQDHYHIAMFCPCDLPKYLNMTPGADMDNPADKCSKRMPVARWSAKQCVVQVLWTLDWLRELDQCLEIERSTYYACRLLLQFSPVSSLRSSIRPMVKYASYNGQDEAASKAVDFCLRALEDFDLALHGSPSDPSASVEAMRSKISDVIQALDNVMQIVPSTLIQKERLLGDASGQKRSKATFETCEKPIETKNTAHGWLQVRFKPIHQERYQCRRGWGKASHEQRAVVDAKDTPGKWEQGKFKPSNSRRGKAVVLGVWLLPLCLLISMVVVMSSSRHYVTEPVSY

SEQ ID NO: 118533 - protein, 71 aa, Triticum aestivum
  Clone ID: PAT_TA_12951.pep
SIKIQGLIEKLAGEGGGEEEERGEELPAPDVEPGDQTAASSHVTCTVVCAPFSWVCLWLPRWLSSLLRRVG

SEQ ID NO: 118534 - protein, 303 aa, Triticum aestivum
  Clone ID: PAT_TA_12952.pep
MKPGTLARAATQQQQQKGGGAVRVGGGGPAPFLTKTHQMVEERGTDEVISWGEQGRSFVVWKPVELARDLLPLHFKHCNFSSFVRQLNTYGFRKVVPDRWEFANENFRRGEQGLLSGIRRRKATATTTTPQSSKTSGTGVNVAFPPPLPALRPASASTSGTGNDHSSSSASSPTRPDLSSENEQLRKDNHALAAELALARRHCEELLGFLSRFLDVRQLDLRLLMDGDMQGAAGAGGARSADQEHCCEKKVKLFGVILKDASARKRGRCDEAAASERSMKMTRIGEPWVGVPSSCPARCGGGN

SEQ ID NO: 118535 - protein, 152 aa, Triticum aestivum
  Clone ID: PAT_TA_12953.pep
CCCLHGHRAAPSPARLSYSCPARLTSAAGRKGAAKHGSTPVHDGGASAVPGGPDSTATQSSARRHMALRNHRSLIRRRRPQRRRTPPARAPAPAPPFPSRTTWTLRRSPWRGRRKRAGERRGATTLHGASPILLLLLDWALLSWLVQAEAAQ

SEQ ID NO: 118536 - protein, 216 aa, Triticum aestivum
  unsure (1)..(216): unsure at all Xaa locations
  Clone ID: PAT_TA_12954.pep
EPGSREWNAVLLACSRAAESSAAVDTFKRMIDRGLKPDVVSYGALLSALEKGRLYDEALRVWEHMRKVGVDPNLHAYTILASIYAGKGDHDKADAVLXTWCPRKIEPTVVTFNAIITACTRSGAAFEWFHRMKMHKVEPSEVTYQVLIEALVQDGKPKLAYEMYIRASNQGLKLSAKSYDTVXVEACQDYGSPVDLTRLGLRPIMEVDPSKINGEF

SEQ ID NO: 118537 - protein, 116 aa, Triticum aestivum
  Clone ID: PAT_TA_12955.pep
GGLGFIVVSDDFVAQLWVRTTDFDGVAGWMPAQAVELNKLLPLRPGEWTNLQTVLGVAGDENVIFVSTSGGVFMVHLESLQFKKIFESNPFAECTTSTIHPFTSFFTAGNNMNVQG

SEQ ID NO: 118538 - protein, 189 aa, Triticum aestivum
  Clone ID: PAT_TA_12956.pep
VRPGFGTVGARCVVKANHFLAEIPDKDLTQYDVKITPEVTSRCVNRAIIAELVRLYRESDLGMRLPAYDGRKSLYTAGALPFDAREFVVRLTDHDSGTGVPPREREYRVAIKFAARADLHHLRQFIAGRQADAPQEAVQVLDIVLRELASQRHVAIGRSFYSPDIRKPQRLGDGLQSWCGFYQSLRPTQ

SEQ ID NO: 118539 - protein, 134 aa, Triticum aestivum
  Clone ID: PAT_TA_12957.pep
QSLIRPKLCLSVKKKNDQIRDRQTITMTWLPATNLHGIVRSCNPARVRCNRAAPPARTRAMAPTVAKSHHTSRSSVPPPTVAKSHHTSRSSVPPRDHKGHQTAPCTKIQEMPDEPPCIHVSIHHVPPPRPRSCK

SEQ ID NO: 118540 - protein, 195 aa, Triticum aestivum
  unsure (1)..(195): unsure at all Xaa locations
  Clone ID: PAT_TA_12958.pep
GAKATRPATRAARLAGPEYTFVKQLRHRVIVKTKTTEDKNAGGILAATSSRCSVPVRVPKLFTHKYAGTDMEFNDTTHLFMKEAEIFGILXTDDVKDLKPLXDRILLKVAGSEXETAGGLLLDTGRRERNLVLGTVVAVGPXGPLXDDGSMTPLSITPGKHRAVLQRMQVARARGRQGEYIVLEVIPDVRAVLSS

SEQ ID NO: 118541 - protein, 177 aa, Triticum aestivum
  unsure (1)..(177): unsure at all Xaa locations
  Clone ID: PAT_TA_12959.pep
YAFHGHGNVAMSLFRRMELDKXRPDGIMFLGVLKACGHAGRADEALKYFDVLTKTHGVEARGDRPRGRVDVLGRAGRLHQAYDVIRTMPVRVTAKAWGALLAACRKYGEVGLAEVAARALFEIEPENAGNFISLANIYSGLGMHEEAQRVRRDMEQRGLQSSPGSSWTIHRKSSELV

SEQ ID NO: 118542 - protein, 130 aa, Triticum aestivum
  Clone ID: PAT_TA_12960.pep
ASDKIVENSKGLLEPTEESLAREIFNLSPSAPDMVSNACKLAKALMELGGDERWTLIQGVWVEMLCYSASRCRGYLHAKSLGDGGECLTYIYLLWSFMGMETLADRHHMSEPLPFDSQGRHGQSAEGDMP

SEQ ID NO: 118543 - protein, 187 aa, Triticum aestivum
  Clone ID: PAT_TA_12961.pep
PVRPTRPGDDRHCTCATAMARSCSTSASASGTVSGNGEPRPADDLEKRQRTQPGVVSLEHLLQGPDAAPPEYLTLSLTPAGEVQPREQPGEVTLKHIDAPRDYLKPSLAPSDEDELCAGPNADRASSGGSVVQEDSSAASSDVVETALVIVDAIAPPAANANSILPPKKRKFAACVYQGTPGNQRRQ

SEQ ID NO: 118544 - protein, 88 aa, Triticum aestivum
  Clone ID: PAT_TA_12962.pep
SVSPTSSFSSGSSSSSSTSSFRRAGGSSSRLHSSSSSSFSDDEETAMATCFRVRQESFRALKGCRVAVTVRSALASVGGGHGAAVQRV

SEQ ID NO: 118545 - protein, 171 aa, Triticum aestivum
  Clone ID: PAT_TA_12963.pep
RWRVGGAEPPPLLASTPTPSFPDRRGGPPPLPRLSRHGMNQNNQNQKRYKIPNLVDVISPVEVRLKLVPDDIVDQRRVEQHRSLCASHRKPSAPSSSSAAETQPTSLPHNFSCQLSTPSSSRPSCSFPFPSTTTPPPPPPESPGSSRRAGEGRLWRRRSTMRAQGRRSEER

SEQ ID NO: 118546 - protein, 117 aa, Triticum aestivum
  Clone ID: PAT_TA_12964.pep
MKDRFERWIVVHGKTYRDEEEKAMRFELFKASLESVESQLPSVEESGVLPGVSCFADFTDEEIRNLLAFPDGIDESEYDEMVKSAWAKQQKGMKTGEPLKWRPGMTQGDMRATQGSA

SEQ ID NO: 118547 - protein, 198 aa, Triticum aestivum
  unsure (1)..(198): unsure at all Xaa locations
  Clone ID: PAT_TA_12965.pep
TRPVSTXLXGKYGTEMEKXLXGDGQAHYDELFSLACPKFIAAWPPVLKEPFTNYNQDVYRLQLKLFLDEVKQQLFLGDIRSFLKVFSVITIGRLAQHMRLDENALRAILLAYTRKTHAVDNYGKITSSADFDFYIDEETIHATESKSSKHHHDYFLTHISKLEEVMGELSEVQLAEPAISPGEEACMFPSYDGAHWHC

SEQ ID NO: 118548 - protein, 136 aa, Triticum aestivum; identical to SEQ ID NO: 116005
  Clone ID: PAT_TA_12966.pep

SEQ ID NO: 118549 - protein, 136 aa, Triticum aestivum; identical to SEQ ID NO: 116005
  Clone ID: PAT_TA_12967.pep

SEQ ID NO: 118550 - protein, 136 aa, Triticum aestivum; identical to SEQ ID NO: 116005
  Clone ID: PAT_TA_12968.pep

SEQ ID NO: 118551 - protein, 183 aa, Triticum aestivum
  unsure (1)..(183): unsure at all Xaa locations
  Clone ID: PAT_TA_12969.pep
MARTKQTARKSTGGKAPRKQLATKGPXARKSAPTTGGVKKPHRYRAGXPLALRAIRKYXKSTELLIRKLPFQRLGAARGPARDFNDRTSASKFPTPVPGPPRTAGPHGATSGGHSFARTPNLSAPMHAPSRRHHHARRTLQPARPHPRGARLSAARPIQPHAPVAGALGIRGRIPTFASICSR

SEQ ID NO: 118552 - protein, 508 aa, Triticum aestivum
  Clone ID: PAT_TA_12970.pep
RPRTRGRERALHRLPRLRWPHRRLRCPRSPPTPRRRLRSHRSRPHPSPSPRPLPVPSRRRSLPPPPRPAGVAAVGASAEDSSHVITVPSYSGWFSYDSISDTERRLLPEFFEGEVAAVSGSRGPEAYKYYRNTLVKRFRARPARRLTLTEARRGLIGDVGSVRRVFDFLEEWGLINHGAPPLGAKQGKDKREEATTSQSSALPAGPTTPKKLCVGCRSVCGSAYFTCDKADISICCRCFVRGNYRPGLTPADFKKVEISEDAKSDWTDKETLHLLEAVLHYGEDWKKVSEHVGSRSEKDCIARLIRLYFGEQFMGSKEQKMEFEIDDVTNESRAEIPNRLRLTPLADASNPIMAQVAFLSAIVGAGVAAAAAQAAISAQSQVDMNDSQTDSPISSTKEEESSYTNGLTANDLLKEASTNAQVQLQKEQKDIEQSLSAIVDVQMKEIQDKISRFEQKELLMEKEREQLHHLRELLFVDQLAVVQHQRRPHAVAAENKEEEKPKPIITMS

SEQ ID NO: 118553 - protein, 214 aa, Triticum aestivum
  Clone ID: PAT_TA_12971.pep
FIQRTQEDTRTQEYNTGALERERRPGPRNDVCVFAGNCKGQGSRTVKRVVLIQGPERRTVSRVGRLPGAEGPSVSRGGGLGEGLGLGSSGAKHSASSARHRRHSQPPAGPWRTMAKRAEQKGPRGGKPGHAGAQRRAYGRRLAECWRLKGRRRPLRPPAQALASPFNQGKSAKAGIDTGWIRTALDNSGQFKPNLDKRGKEGKGSKEEQKKKKK

SEQ ID NO: 118554 - protein, 199 aa, Triticum aestivum
  Clone ID: PAT_TA_12972.pep
HASAHASASPRPRELAELPRESSKFLPPRWSHPVQVQVQEQQNRSRRTASTNPTPTPPPMAMGPRALLRRHLPARRPSTSSRPEAAPMGRAPPRWWTSGRARGSPPVPFRHLFPQAPRAASPTPRPPSKPGGQAPRRGGGVRFRGTRRCRSTTRGCSSRWYERGSRLSSRRARRSRWNRRTPMTHSRERKRRRNYHKSR

SEQ ID NO: 118555 - protein, 187 aa, Triticum aestivum
  Clone ID: PAT_TA_12973.pep
SARPEPMTRSAPSRHLSLSFLWFLPSAYISPLSVFSSQQRRHGDLAGALRGMPPRPPSSPSSRDRIRSPQRPTPSCPRRTSFLHAKSHRRHVPPSPPTSYPPARLQMTRGVSTSLRWPSLGLNALKPYVTTREASLVPPLLAGFASPSGSNRWSSSLSGDPSSTSIVPSFSPFVLRRRAGDPRRRCS

SEQ ID NO: 118556 - protein, 133 aa, Triticum aestivum
  unsure (1)..(133): unsure at all Xaa locations
  Clone ID: PAT_TA_12974.pep
MGRKGVSYGTAAPPVSMVSDPRVAIIDVRDEERICDAHIAGSHHYASDGFADRLPEIAEATRAKDTLVFHCALXSQVRGPSCARMFLDYLSEAKEESAVKSITVLXERGFNGWELSGKAVCRCKDAPCWSVCS

SEQ ID NO: 118557 - protein, 129 aa, Triticum aestivum
  Clone ID: PAT_TA_12975.pep
STYPPIQQKSYSVTILQRSNTGGSFLLIMSFVQCRKDRRPGHHNRRDMEAAIDRSDSRRRRPLIHLLNHPVPEMNIKENAACWMIQDHKLGIVPDKINSNKIIKGHPITIHKTCACLMDTKCVYQPPVG

SEQ ID NO: 118558 - protein, 117 aa, Triticum aestivum
  Clone ID: PAT_TA_12976.pep
VSSRYLVDLGSPQFVGVPPDPQWAIETEMNLKSIVHLDRAQEVVNIVGSNGETSPRDKRGRSRDIALSSAFIPLFHFSVELPNIEDAEGTLQFLMALIEKGKARRWDKNILHRSNIS

SEQ ID NO: 118559 - protein, 185 aa, Triticum aestivum
  unsure (1)..(185): unsure at all Xaa locations
  Clone ID: PAT_TA_12977.pep
PLLWGCGDGIRERAALTEGHGLGVAVARGIAEGRGTGDGRRTVALFPQFVLMGVADAFPGVAKIEFFYEQAPDGGKSLGTSYSMTSLGIGNFXSSFLLSTVSRVTRRHGQGGWIQNNLNASRLDHYYAFFAVLNCANLFVFFAVCRMYVYNAEVTHVVDGGGGEKQRPEVAMQQPATVGAVEVHP

SEQ ID NO: 118560 - protein, 61 aa, Triticum aestivum
  Clone ID: PAT_TA_12978.pep
FKLKLNATGIWVGMLIGTVLQTVILFVILFRTKWQKEAMLAEERVRNWGGNVELPTVQEAR

SEQ ID NO: 118561 - protein, 61 aa, Triticum aestivum
  Clone ID: PAT_TA_12979.pep
MHEYGYLGSPVFNRRGHLIGISYLDRGHLQAWGVYRLQKDEVSKLDGICYVLDGAVARSPK

SEQ ID NO: 118562 - protein, 415 aa, Triticum aestivum
  Clone ID: PAT_TA_12980.pep
RPRTRGGHAPWHGCNLADFVMPCFLFIVGMAIPLSLKRIPDRSRAIRRVVIRTLKLLFWGILLQGGYSHAPDELTYGVDMKHIRWCGILQRIALAYLVVAVMEIATKDARVQDQSSSGFFSVFRLYLSQWIVACCILLIYLSLVYGIYVPDWEFTVRNVDSPNYGKVLTVTCGTRGNLSPPCNAVGYIDRKVLGINHLYQKPAWRRHRDCTDDSPHEGPFKRDAPAWCASPFEPEGLLSSFSAVLSTIIGVHYGHVLVHMKSHMDRLKQWVTMGIALLLLGIILHFSHAIPLNKQLYTLSYICVTAGAAGIVFSMLYFLVDVVSLRYVFAPLRWVGMNAMLVYVMAAAGIFEGFLNGWYYDGTNNTLVYWVRKHVFVRVWHSERVGILLYVLVSQILLWALLAGLLHRAGVYWKL

SEQ ID NO: 118563 - protein, 123 aa, Triticum aestivum
  Clone ID: PAT_TA_12981.pep
CSFDGCECSFSTKSNLNKHMKACHDQVRPFECRVAGCGKTFPYKHVRDNHEKSSCHVYVEGDYEEMDEQLRSRRGGGRKRSAVTVETLTRKRVTIPSEVSLLDDGAEYMRWMLSDGDGSNHAE

SEQ ID NO: 118564 - protein, 216 aa, Triticum aestivum
  Clone ID: PAT_TA_12982.pep
MYGSRLDGDGSSLPRMPNDGDTWSVMQSWVLPTRSVREFVMFSRMFVDALDAQMYDKHHQTGHCILSLHRDKHCYSGVLELIVNVWAFHSARRMVYVNPETGAMQEQHPLEGRRGQMSIQWFSYATLKSMDEDLAEEADADHPDRRWLWPQTGEVVWQGLYERERTMRQQEKERRKQQTKDKIQRMKKRARQKTIGRYIKPPSDDAGRLNDTRTDS

SEQ ID NO: 118565 - protein, 54 aa, Triticum aestivum
  Clone ID: PAT_TA_12983.pep
ERAICQPGQFASWPITGPAAVLPFRFFRLALTGPTTCNTWNLCICFLELYGYFR

SEQ ID NO: 118566 - protein, 185 aa, Triticum aestivum
  Clone ID: PAT_TA_12984.pep
TRPPTRPDKSIKAWSLEDYSLRCTMTGHKSTVSCLAVASGILYSGSWDGSIRSWWLTDHSPLSVLEDDAPGSIAPVLSISTEANFVVSSYENGCLKIWKDDVLVKSEKLQSASIYAVKLNGKWLYTGGLNKAVNIQELLEDESELEIRDVASISCDSIVTSILYWDEKLIVGLSNREIKVYDKGS

SEQ ID NO: 118567 - protein, 104 aa, Triticum aestivum
  Clone ID: PAT_TA_12985.pep
MAGTAAVYRRVMKAVQKHVGGSADKKHFREFVAAEFRSPAGTEADARARLRLAGDYAYHLTSIQHQKELLFSYNIAVDRSDEMKKILNKSAASVGLQLPDVYQP

SEQ ID NO: 118568 - protein, 90 aa, Triticum aestivum
  Clone ID: PAT_TA_12986.pep
HIVAYRRHTLSSTLFSRVQDRWRPPYRVRIYQRRRAIHVQGQPRHLHGLKMNGEQTTAAAQEHHTSSHPDDIALWSLVQRIRKNIASIAP

SEQ ID NO: 118569 - protein, 476 aa, Triticum aestivum
  Clone ID: PAT_TA_12987.pep
MGCFPCFDSGSDGELLYPKQGGGGGGNGTGGRTAAAASSSGVGAREERPMVPPRVEKLPAGAEKARAKGNAGMKELSDLRDANGNVLSAQTFTFRQLTAATRNFREECFIGGGGFGRVYKGRLDGGQVVAIKQLNRDGNQGNKEFLVEVLMLSLLHHQNLVNLVGYCADGEQRLLVYEYMPLGSLEDHLHDLPPDKEPLDWNTRMKIAAGAAKGLEYLHDKAQPPVIYRDFKSSNILLGDDFHPKLSDFGLAKLGPVGDKSHVSTRVMGTYGYCAPEYAMTGQLTVKSDVYSFGVVLLELITGRKAIDSTRPHGEQNLVSWARPLFNDRRKLPKMADPGLQGRYPMRGLYQALAVASMCIQSEAASRPLIADVVTALSYLASQIYDPNAIHASKKAGGDQRSRVSDSGRTLLKNDEAGSSGHKSDRDDSPREPPPGILNDRERMVAEAKMWGANLREKTRAAANAQGSLDSPTETG

SEQ ID NO: 118570 - protein, 139 aa, Triticum aestivum
  unsure (1)..(139): unsure at all Xaa locations
  Clone ID: PAT_TA_12988.pep
GGAGAGGAGVHYXQMAGSATSATGXPTFGLGLSCLRHEQMMSLARTAXSQGRSGEEGGASGGANDGMTRDFLGLRAFSHRDILGLAGFDSSCMGAAVNTAGNNTNMAPCYEPQQQGQPQPQPPQQQISNEPWHGMGSHS

SEQ ID NO: 118571 - protein, 263 aa, Triticum aestivum
  Clone ID: PAT_TA_12989.pep
MAAALAVTDELALPLRAVGDLAAAAGVSREEVVVITQCASLGGKLPFDDASVGAVLSVIKNVESFGDKLVAEISRVLKAGGIVLVQSFTPSTDQKPNNYIERQLLMGGFVEVQASATSSQDSVQSVTIKAKKPSWSMGSSFPLKKAVKALPKIEIDDDDELIDEDSLLTEEDLKKPQLPVVGDCEVGATKKACKNCSCGRAEAEQKVEKLGLTAEQIDNPVSACGSCGLGDAFRCSTCPYRGLAPFKLGEKVTLSDNFLSADI

SEQ ID NO: 118572 - protein, 119 aa, Triticum aestivum
  unsure (1)..(119): unsure at all Xaa locations
  Clone ID: PAT_TA_12990.pep
YQSAAGPNGSQSMAEFIGSAVPNGVASFINVGHSAALGSVGGVTGFGQDHQFAAVQMLSRXYEAAEPIARLGLNGGYEFGYSAAGMAGAGSVPGLGMLGGSPFLKPGIAGSDERGGAGQ

SEQ ID NO: 118573 - protein, 211 aa, Triticum aestivum
  Clone ID: PAT_TA_12991.pep
MQEERLPFCATWTSKVGSLVQPTARGNTTKWSICYLGDFGIANLVCNSNSTSVGHSSSASTSDSPIGLKGTIGYIAPEYAQTGQASTNGDVFSFGIVLLEMLIGKRPTDPMFDNELNIVNFAERNSPDQILEIIDAHLQEECKGFIGASAEAGDLVYQCLVSLVQVALSCTRLSPRERMNMREVAIARSQNIIYMLEQPSESKLCPARVIW

SEQ ID NO: 118574 - protein, 485 aa, Triticum aestivum
  unsure (1)..(485): unsure at all Xaa locations
  Clone ID: PAT_TA_12992.pep
PRVRPPPPPPPPREISRLQCRPPPPAPPKPSPNPAPLQTPAPVAREREGARGAARGRPVYPLPPPRPRAPPPRRPPPRARAAPPPLPPLRPSPPRPAPLLPPFLPPPPRAPPQAPRHCVAVRPFRASAQSPQVRTIVHHRISELGRPAALPRSDSXLPACCGPRFVELLWQLSVHALREVHRRTFAADVASNPLPAALTDVSYLHAAALLPVTKARIALERRKFLKNANIAVQRQTTWSNLAHEMTAEFRSLCAEEAYLQQELEKLQDMRNKAKLEGELWDERISSSSGQNSHLVSKATRLWESILARKGQHEVLASGPIEDLIAHREHRYRISGSQLLVAMDTSSSIPHSELLSARAGETSQILDKQEQISLFQGKEEALPRLDDRXGRVQQTVDVAEIXRRWTHALQRIHKQSLHLAKANDGXRGQNYSRXASDSETSSHADSLTATLAEHRQHLXSIQGLINQLKEAIPAWQQSITKTSGKK

SEQ ID NO: 118575 - protein, 104 aa, Triticum aestivum
  Clone ID: PAT_TA_12993.pep
RKSGSLSAMLSAALSGTAAAVPPQGEPMEGKVEVNSAVFPKGPPVPLPVQKMAKYIDTTEVTRGPDDLPGYWVVTGAKLCVEGGKVALKAKYSLLISAPEDDEV

SEQ ID NO: 118576 - protein, 124 aa, Triticum aestivum
  Clone ID: PAT_TA_12994.pep
AAARPGALPCTAAPRRRRLGLTRATSRPPCSTVVPVPLECSLMVTRISRTSCHTISTIDRSSCGLGGSTDRLDAYIYANNGRSSRLRVVGLVCTFLFCIVSLRSCIFATHPSVPCVRGKRKPKS

SEQ ID NO: 118577 - protein, 125 aa, Triticum aestivum
  Clone ID: PAT_TA_12995.pep
VRANLEVEKAKAFTKAKNKNFSLPAALQCLKRKRLYEQQVEQLGNFQLRIHDQMIMLEGAKATTETVDALRTGASAMKAMHKSTNIDDVDKTMDEINDNMENMRQIQDLLSAPMGAASDFDEDEL

SEQ ID NO: 118578 - protein, 152 aa, Triticum aestivum
  unsure (1)..(152): unsure at all Xaa locations
  Clone ID: PAT_TA_12996.pep
MSGVLGRVFGKSKEQSQASAPASIDKLSGTLEMLEKKGNLLMRRANXQDKKRKEYAEVKNLKTAILCLQKKRLFGQLVXRIRDHMLRLQGAKATMEAVDASTNSADAMKTMHKTNDINEDIKNIQDILAKPMNATNDYDEDALETELANLLR

SEQ ID NO: 118579 - protein, 111 aa, Triticum aestivum
  unsure (1)..(111): unsure at all Xaa locations
  Clone ID: PAT_TA_12997.pep
FFFFFFFEPGPPAPAVRCTLPGSPTWLWASAPGPGPGAPPHVPHWAPCRGSAPSPDCVPPTGYGLLLPVRFLAPRAPSSFYSAPPNRVPLGCPSQLFGCIRXSNVNSAHHL

SEQ ID NO: 118580 - protein, 99 aa, Triticum aestivum
  Clone ID: PAT_TA_12998.pep
WIRYQRKEVTIQEWENCQKSKFEAKMNAELSIHELAEKAGVKNNFTKRLPTLRHKVEGKQVRVEVRRDQQAVWLARQVERIWKTGHVPSRFQCCNWFLC

SEQ ID NO: 118581 - protein, 149 aa, Triticum aestivum
  Clone ID: PAT_TA_12999.pep
ASRNLSRPIEDKKGQSPEYTNLLRMGLVDSVDGLQYTRMSMVPDPDYTPLPSGWRPDHEKFLLEYIKLTDQQTLEEQRSCIREEGLITPQDHISMLVWSYKKNAVLLPSSKESDVQESIEDLGSDTDELNNKELGHGGHQGFPQPTEMS

SEQ ID NO: 118582 - protein, 118 aa, Triticum aestivum
  Clone ID: PAT_TA_13000.pep
QNRLCAFDLSSSAMAECAPSPLHDWEYLDLLPDELLPVGRALVNLGSGKFCIATHCRKDRSALQEEDELENIRSLGGNGGVQTLLTGVEVVRCADGLQLIHHKSQRYNIENLSIHCVL

SEQ ID NO: 118583 - protein, 122 aa, Triticum aestivum
  Clone ID: PAT_TA_13001.pep
ALPAQLLTPPGCRIFWGKRRGSFFFCGILTVMMGGRRWVLSTNRGGACRLHASFFFSEGVYTKGKKIHKLLFRFHFWFLGRKMDAGDEPASMPCMYHGGEDANFPLILNFDRYLRPKKKKKK

SEQ ID NO: 118584 - protein, 77 aa, Triticum aestivum
  Clone ID: PAT_TA_13002.pep
STSLPRYKSPDMASIDLNSTQEDDMAMAGVPLLSASPRAPFPAVLMEQPPHGHGHGHHCSPLELELGMSLSPPSIGT

SEQ ID NO: 118585 - protein, 127 aa, Triticum aestivum
  Clone ID: PAT_TA_13003.pep
MTFDKVEELRPGTYGHNLQLRVLSAKPVVLHRPQGGRAGGNMRIAECIVGDDTGVVVFTARNEQVDIMKPGAVVEARKARVDMYKGSMRLAVDKWGTLKAAESPADFKVKEDNNVSLVEFELITVMQ

SEQ ID NO: 118586 - protein, 127 aa, Triticum aestivum
  Clone ID: PAT_TA_13004.pep
MTFDKVEELRPGTYGHNLQLRVLSSKPVVLHRPQGGRAGGNMRIAECIVGDDTGVVVFTARNEQVDVMKPGAVVEARKARVDMYKGSMRLAVDKWGTLKAAESPADFKVKEDNNVSLVEFELITVMQ

SEQ ID NO: 118587 - protein, 221 aa, Triticum aestivum
  Clone ID: PAT_TA_13005.pep
GRFPPLSSSRTQPQRPLPLSSVLQRLRTNLSSSPASWFPSLSHPTPRRQTSPPPPSSSSSSSWVDLIFRSHPSSASKRGDSAPPSATKPGKGRPMTFDKAEELRPGTYGHNLQLRVLSAKPVVLHRPQGGRAGGNMRIAECIVGDDTGVVVFTARNEQVDIMKPGAVVEARKARVDMYKGSMRLAVDKWGTLKAAESPADFKVKEDNNVSLVEFELITVMQ

SEQ ID NO: 118588 - protein, 108 aa, Triticum aestivum
  Clone ID: PAT_TA_13006.pep
MNTRPVVLVCLLIVLIITSQFEWKQQIEDAADADPVTARRRQQVLAKEDAVKEKILLSQEKNIQQLNELIESLQRQLLHCRGSNKTIHTTTIAATEASEVDGHEIIDD

SEQ ID NO: 118589 - protein, 172 aa, Triticum aestivum
  Clone ID: PAT_TA_13007.pep
VRSFHGSPSSKLAGLIDYPRRILSPGRVSPIDPDAHPPPTPTPTPTDHPHHPEQQQPPALAPFVAVREEEEEGQGDGLDLRLCLRGRDGATGCVMDLDSAVLCGSSAFFAAMAPEPNASGAGARRIEVDGVDNVAAFRDAIELMFHADAPRWLARAGVSRAIAVLEVASSIM

SEQ ID NO: 118590 - protein, 109 aa, Triticum aestivum
  Clone ID: PAT_TA_13008.pep
VTNTVISSKSPPEFYVTRIPLHPATETFPALASSLYWGLLWLLLLVICISRMACVTKNVRILGTATITWTRALRVSMVHTIPLILLLRSRTSPVNCYADAWVDPKIPDR

SEQ ID NO: 118591 - protein, 95 aa, Triticum aestivum
  Clone ID: PAT_TA_13009.pep
CRELKFSTCKITKAGIGGPLFDLNGNFVGMNFYDSDGTPYLPSDIIQNLLRSFYAERTAAAGITEKPNYRWPVPKPYWYYPSRHPKREPKPTLFD

SEQ ID NO: 118592 - protein, 121 aa, Triticum aestivum
  unsure (1)..(121): unsure at all Xaa locations
  Clone ID: PAT_TA_13010.pep
KSHSCHTSVSLCTHIIIGSGPGTLGPAPCTNLQRRLPSSACKQKPGKTTIHRDRGVSHARTGWGNRGGXPLAPWNTSYNTVLVTRARVTDRIGEASLELCPLSSRRRHIRARQPYPAGPKV

SEQ ID NO: 118593 - protein, 158 aa, Triticum aestivum
  unsure (1)..(158): unsure at all Xaa locations
  Clone ID: PAT_TA_13011.pep
VRMLKYFLVTTQNVXENNSSQIPTENMNTLPDPPPMKKARTSKGNDEGKAKRGKETAIEDLVAVRKEELKTCVDVRTKQIESYREVKKAQMKKKDPDKDPYCIANCIVKLKTIPDLSASDHLKMIEYLKGQRIDREIFMIVEHDVVLEILKQVLGHQI

SEQ ID NO: 118594 - protein, 198 aa, Triticum aestivum
  Clone ID: PAT_TA_13012.pep
ENPLENDNNQGTLAVINLDQSVTNDDLRHIFGGYGEIKAIHGTSQNGHHKYVEFFDTRAAEAALYALNMRDIAGKKIRLERCCLGDGKRLTRHRPPELEHEEYGACKLGNANSLPSTYYGSVNMASMTSAGPEHGISRVLRPRVQPPIHQFREGAFLDVPSNTMQSISSPVRIATAVTHNNRSTVGENGHSLGKMGGQ

SEQ ID NO: 118595 - protein, 143 aa, Triticum aestivum
  Clone ID: PAT_TA_13013.pep
GFFRPGTRRRGGGISPLPAEDEDKEEERPGGGGSASVFPLQEAERRKEAGMEHYTMRLSAGGGATPTQQQQLCPWGEPLMAVAPDRRSRFWQMDVAVAAHRPASRSYARCRAAPPGLPTPLSPLAGAPSSLLNGTPPGFRTHS

SEQ ID NO: 118596 - protein, 334 aa, Triticum aestivum
  Clone ID: PAT_TA_13014.pep
MADASSRTDTSIVVDTDDKNQRMENGQNGAIVPSNSSEPSDRSDRPMDQKVLRRLAQNREAARKSRLRKKAYVQQLESSKLKLASLEQELQKARQQGIFISSSGDQTHAMSGNGAMTFDLEYTRWLEEQNKQINELRTAVNAHASDSDLRLIVDGIMAHYDEIFKLKGAAAKADVFHILSGMWKTPAERCFLWLGGFRSSELLKLLVNQLEPLTEQQLMGLSSLEQSSHQAEDALSQGMEALQQSLAETLAGSLGPSGSSGNVANYMGQMAMAMGKLGTLENFLRQADNLRQQTLHQMQRILTIRQAARALLAIHDYFSRLRALSSLWLARPRE

SEQ ID NO: 118597 - protein, 120 aa, Triticum aestivum
  Clone ID: PAT_TA_13015.pep
SALLSSSETHRAEHIDQEDIQDGSTVGRPGRAAGPGPAAARPPDGGEVRGRGKAALPAGAAAGAAQQQGQGRVPVQAQLLQRGGGRRVVRHAAARLRRLRPLTLMLITIPTGDLDRGNDR

SEQ ID NO: 118598 - protein, 163 aa, Triticum aestivum
  unsure (1)..(163): unsure at all Xaa locations
  Clone ID: PAT_TA_13016.pep
RRGRGVLQXHGVGFVADIRRXNVALTRARRALWVVGNASALMQSEDWAALVADAKARKCFMDLDSIPKDFLAMKISSNTPGRNSSNNPRNLRTGGPRPRHLDMLPDPRIGMRADEDERPNSVPRNASYRNLDDLGRSGDRSRESLQFGVAKRPNSSNGSRREV

SEQ ID NO: 118599 - protein, 222 aa, Triticum aestivum
  unsure (1)..(222): unsure at all Xaa locations
  Clone ID: PAT_TA_13017.pep
QWGERPRTRDGAEPPGRGPALGRSYLHEGLDPXRAHRDVTSSNSLIDTQWNAKVSDFGLAKLLCSEESYVTTRVMGTFGYVAPEYASTGMLTERSDVYSFGVLLMEIITGRSPVDYTRSAGEVNLIEWLKNMVAERKAEDVVDPKLPERPSPKALKRALLVALRCVDPDGHKRPKMGHVIHMLEMEDLNPRDDRKPRRDAATDRSSSMEDGSLSKRENQRYR

SEQ ID NO: 118600 - protein, 344 aa, Triticum aestivum
  unsure (1)..(344): unsure at all Xaa locations
  Clone ID: PAT_TA_13018.pep
PTRPHLIGDSNELTQDLASQGMSIVYELGDASMKGQLVHALVNTLTGAAGKKKAIKLMEDSEVFQEGTIGSNPAGGKLSTYKELCSLAXEMGQPDLIYKFMDLANYQAALNSKRGAAXFGFSKIAKQAGEASAHASADAWARLVRYQYDPDKNIQDSMGHIWKLIVSDPKKAIDEHYDVIVEDLLVQSGSRLWRSREASCLALADIIQGRRYSQVSKHLIKIWTTTFRAMDDIKETVRNAGDSLCRAVSSLTVRLCDVSLTTASDAKETMSIVLPFLLSEGILSKVASVQKASINLVMKLAKGAGIALRPHLPELVSCMLDCPTSLEDQRLNYVGMHAGNAGLQ

SEQ ID NO: 118601 - protein, 117 aa, Triticum aestivum
  Clone ID: PAT_TA_13019.pep
CLLQLPKCYCVTNTTITSKVLLPYSVNKGTSQVTITSILSLAFPIVGVVTANSFTRITITGVVIKCLGSNMRCPCGWDLAPWRSSSGSSLPISLKRTKKSRSCISTLFCRYPGRDHA

SEQ ID NO: 118602 - protein, 333 aa, Triticum aestivum
  unsure (1)..(333): unsure at all Xaa locations
  Clone ID: PAT_TA_13020.pep
VAMSACELSEPPPGKLADIGIAMGITGTEVAKEASDMVLSDYNFSSFAXLLVNEGSHPSACXAFMRYMRSSNIGGVESSFITSALGCLEVLIPVGLRRVDLTTDFSSATALSFNSSARDIMKKPPRRSDDSLITPWILFRYMVIGLYVGIATVGIFIIWYTHGSFLGIDLASDGHTLVSYSQLSNWGQCPSWEGFNVSSFTAGARTFNFDENPCDYFQGGKIKATTLSLSVLVSIEMFNSLNALSEDGSLLSMPPWVNPWLLLAMSVSFGLHFLILYVPFLTQIFGIVPLSFNEWLLVVAVAFPVVLIDEVLKFVGRCLTARARKQLGKRKEE

SEQ ID NO: 118603 - protein, 177 aa, Triticum aestivum
  Clone ID: PAT_TA_13021.pep
PPLPSGLLSGRAAGSGTRRSDWMGHNGGQEKGWTARGGLGSRRAARLVGARRRPMSLGPGRLGRDAHATSPSPPPVVRKLFHRSDAGRQRARHPRSLAGGFRPAVLARRSPISSRTQTDFFFLFCKLSFTECYKQNTRVICKLCCSAHSLYKPCVRRPSAYIDPHVALPLMSDFRYI

SEQ ID NO: 118604 - protein, 198 aa, Triticum aestivum
  unsure (1)..(198): unsure at all Xaa locations
  Clone ID: PAT_TA_13022.pep
MTPAERVKAKMKLQLAETASKDSTLGTATVSWGRFEFNKDAPLDEDDNDVEVANDDATLVKHMGRGFRLSTVESKNENIVRDAHDEAMFGVPMSSNVDTETSEDELKTNGEGKKAEDVEAQPSSSLIGDEVXGNAKDVMERKDGEAAAEFKYMKLVLAKMLDTVYFHICCSTHTHVVFMSCNIRQHCVQVDVLRTNSV

SEQ ID NO: 118605 - protein, 223 aa, Triticum aestivum
  unsure (1)..(223): unsure at all Xaa locations
  Clone ID: PAT_TA_13023.pep
HXXXQMFSTFVEQGMTMEKDVWTFGQGAGTTRSREPXLRLSRIQFERATMXAVVRKLTGTAEGMPSPRGIGIGLCFSMLSMVSAALVESNRLQIAQSEGLVHSKGAVPMSILWQGPQYFLLGVAEVFSNIGLTEFFYDESPDAMRSLGMAFSLLNISAGNYLSSFILSLVPVFTARGGSPGWIPDNLNEGHLDRFYLMMAGLSLLNIFVFVFYARRHKCKEAS

SEQ ID NO: 118606 - protein, 98 aa, Triticum aestivum
  Clone ID: PAT_TA_13024.pep
SPTAILKQFVTSDLTKLLGVVGQPTFVKHIHWRNAFPLYGHDYDSALEAIGKMESDLPGFFYAGNNKDGLAVGNVIASGSNTADLVISYLESGIKQVS

SEQ ID NO: 118607 - protein, 215 aa, Triticum aestivum
  unsure (1)..(215): unsure at all Xaa locations
  Clone ID: PAT_TA_13025.pep
MEPAEAEAGGGIAAARSSPAAVQATNDDAAASKLSCVTKGYMKDDYVHHFVRRTTKRAPIINRGYYARWSVLRKLMLQFLNAGSGSDDQKRKQILSLGAGFDTTFFQLQDEGLAPYLYVELDFQEVTSKKAAIINHYNDMKEKLGPDASISIEKGEVTSTNYKLFSADIRDIPKLDAVIRMPXMDPSLPTFIIAECVLIYLDPTSTDAMXSWASE

SEQ ID NO: 118608 - protein, 67 aa, Triticum aestivum
  Clone ID: PAT_TA_13026.pep
VPKVSLVFAGGATLELDPASIMLDGCLAFAPTPGEESVGFIGNVQQQTYEVLYDVGGGSVGFRPAAC

SEQ ID NO: 118609 - protein, 72 aa, Triticum aestivum
  Clone ID: PAT_TA_13027.pep
NQRISSKLKKKKNKSSGNVDRSPPISIFNLKIKPRCRNPQENKLISFAASPPPPLRLCEQQKRKPKPSLAVG

SEQ ID NO: 118610 - protein, 274 aa, Triticum aestivum
  Clone ID: PAT_TA_13028.pep
MSHNYGDTIPLHPSSAQSDMDEIESLMYDAPSATVLPARPPSPPRASIPISTSPPPPSSKPPLPASSVPIFVPQGPTPAPPASVSVAIGSEGFGPPPNTLTEPVWDTVKRDLARIVSNLKLVVFPNPNREDPGKALRDWDLWGPFFFIVFLGLTLSWSASVKKSEVFAVAFAVLAAGAIILTLNVLLLGGHIIFFQSLSLLGYCLFPLDVGALICLLKDNVILKIIVVTVTLAWSSWAAYPFMSAAVNPRRKALAIYPVFLMYISVGFLIIAID

SEQ ID NO: 118611 - protein, 147 aa, Triticum aestivum
  Clone ID: PAT_TA_13029.pep
SMEPEAKLKLKAGYSLLQQMRSFIMFVCVLLSHFSAAGASATGRPARQPEVPDPALAPGHEPFSRCFQGVAAAGVEQPETRAVVEDRAQHSVVEVASRHHELLQKGQLPHRRRAKFAPAHVKHARQSSRGGSSATARCRRGRRGSRR

SEQ ID NO: 118612 - protein, 107 aa, Triticum aestivum
  Clone ID: PAT_TA_13030.pep
IGRDAAYWEEPLEFRPERFMPGGAGEAVDPKGQHMQLMPFGSGRRACPGMGLAMQAVPAFLAALVQCFDWEVPNPPLDMEEEAGLVTARKQPLVLLPTQRLHPLPLP

SEQ ID NO: 118613 - protein, 238 aa, Triticum aestivum
  Clone ID: PAT_TA_13031.pep
PRVRFRGTAPMNLTDRLHHVLRGTTASVEIFFSRNNALFATRRMKLLQRVAYFNVGMYPFTSMFLIVYCVLPAVSLFTGKFIVQHLSATFLVFLLIITITLCLLALLEIKWSGITLHEWWRNEQFWVIGGTSAHPAAVLQGLLKVIAGVDISFTLTSKPGGADDGEEDTFAELYEVRWSFLMVPPVTIMMLNAVALAVGTARTLYSEFPQWSKLLGGAFFSFWVLCHLPPFAKGLMGR

SEQ ID NO: 118614 - protein, 313 aa, Triticum aestivum
  unsure (1)..(313): unsure at all Xaa locations
  Clone ID: PAT_TA_13032.pep
TRPGAWRXXSPMRAARSRPVLGVFEMSASRSIVHARAEKHVRRANAGGKFGPGGTSAVYEDPHRLSLRRLRLRDVLNEDTDSTVPAHGHGKASRQQKQPAQARQALIAVGGRGPWDEPLVSGEIYDPVTDKWVEIAGFPTDVGLACSGAVCGDMFYVYCESDTVVAYHLDACSWSVVQTSRPPPRLRDYTPALVCCASRLFMLCVSWCDPANRRDKGVRKVFELNLGSTPLLHWTEGSAHPDAPMDSNAVFAAGQDRIYAVEMFRIFGKVLDFATACRVSGGEQSWSRIARENAAAEADAMSCRLKSMAVLLL

SEQ ID NO: 118615 - protein, 82 aa, Triticum aestivum
  Clone ID: PAT_TA_13033.pep
NWTVFGGNSMVQVNDNTACLAFVEMKQGEVDKQGGSPAAVIGGFQMENNLLVFDEENQRLGFSSLLWGRQTTCSNFNFTMAA

SEQ ID NO: 118616 - protein, 315 aa, Triticum aestivum
  unsure (1)..(315): unsure at all Xaa locations
  Clone ID: PAT_TA_13034.pep
GKFTQQEEYLRELDEAFALVXGFSPVDLFPSWRLVRWLSNDERRMRRCHGHIQRIIANVIEGRKAAGVGASSTDEEDLLDVLLRLQQEDSLEFPLTTEIIGAVLFDIFAGATSTIGTTLTWAMSELVRSPETMAKAQQEVREVLGQDRAVITNSDLAKPDYMQMIIKETLRFHPPASLVLRACRGGCTIMGYDIPKGTNVNINVFAISRDPAYWNNPEEFRPERFENNNTNYNGTYFEFTPFGAGRRQCPAIQFSSSVLEMTLTNILYHFNWKLPGGASPISLDMSEKFGLAVSKKYDLKLEATPHLWFKAMRSK

SEQ ID NO: 118617 - protein, 136 aa, Triticum aestivum
  Clone ID: PAT_TA_13035.pep
EDASTSQRQFTTFSPVHGQKEGVGRRVALTMTYPHAHFVPVVIWMAHIARVESQLVGAGGLLLPLLFFFLLAGTLHRRRQQPNSFSSYSSCLSMGHQHHGFPDAICHAAFWIRTASALSDALAYALLGGRPDDEQG

SEQ ID NO: 118618 - protein, 113 aa, Triticum aestivum
  Clone ID: PAT_TA_13036.pep
RIYKRSYTHRPATSLGQLIPLTYGWTIRPYPTPGITPTTSTTQPYLKTNSASRRGLLLHAPTNSPAHAQLHVARTLATAERPARTRRVRRARPHQCIPHVPRAPDVPDEPDRT

SEQ ID NO: 118619 - protein, 57 aa, Triticum aestivum
  Clone ID: PAT_TA_13037.pep
CPVFSALQYLFRLVVFRLVLWEKYVYVFQDPVGHLLIVVYICTKHWLLLANYSCHCD

SEQ ID NO: 118620 - protein, 187 aa, Triticum aestivum
  Clone ID: PAT_TA_13038.pep
ALVLTGANGSGKTTFLRMLAGFSRPSAGEILWNGHDVTSPGVFQQYKLQLNWMSLKDAVKEKLTVLENVQWFELLEGKHGRSAPAIELMGLGRLMNDKARMLSMGQRKRLQLARLLAIDRPIWLLDEPSVALDSEGVKVLEYIIAEHRKKGGIVIVATHLPIEIEDSMNLRLPQRFPRRKTLVDLVR

SEQ ID NO: 118621 - protein, 96 aa, Triticum aestivum
  Clone ID: PAT_TA_13039.pep
STKNKLMQQSTSSISLQREKNSSLIHRVHSLEQFTDHPLKIMYRCPAFILHREQSEDVPRRPPLRPAPHRPPLPAGRRWPPAAAEHASTLSGSLPT

SEQ ID NO: 118622 - protein, 153 aa, Triticum aestivum
  unsure (1)..(153): unsure at all Xaa locations
  Clone ID: PAT_TA_13040.pep
RFRPLRQFNPGTAPTGPRRGPAGGPGAKAPGTPNYAAGRGRRVLYIRRXYGNRPMYIAANGTDEADNGTIPNQEALKEDTRISFHVNHLKLVHKAIPGGVNVKGYITWTFLDGFEFGDGFKDRFGLIYVDYATLARYRKKSXSYWIQDFLQRH

SEQ ID NO: 118623 - protein, 225 aa, Triticum aestivum
  unsure (1)..(225): unsure at all Xaa locations
  Clone ID: PAT_TA_13041.pep
LHRLFPNVRYSLXIDGKLKLVKDPYQLLKRFLWRKNVRFTISRYYRRFDVFEEAEANKAGXYDNASIDNQMKFYKTEGLTHYSSAKLLITSGKWFFLLNSDIEIFLLRTXRDTFILXDVPEGCVIIGEHIPITNLFTCLWFNEVDRVTSRDQLSFSTTRDKIRSRVLVDNXIRSGVDWTADMFLDCGRREFVVQVFFEEMLGAAPRSRSEEGEIWKFRNQPGRPH

SEQ ID NO: 118624 - protein, 95 aa, Triticum aestivum
  Clone ID: PAT_TA_13042.pep
KILFKGESTRPVYVLVMVEPEGVVAKPNVPERELALFNIVCDELLLGIPLFAWWVGTAALICIVLASIAPYFLPLHKLLNYEAAELSSVDAAKLS

SEQ ID NO: 118625 - protein, 109 aa, Triticum aestivum
  Clone ID: PAT_TA_13043.pep
RHEARSEKQAQQLNRSIWKASSAISSNSSMLDSTHTAIMPSSLDDLLLNSNTSFLYTGKPPKHGGAQDSIVDGWDMVEREILPPPPSQIEDIAQWERAHTYARSGSKKK

SEQ ID NO: 118626 - protein, 188 aa, Triticum aestivum
  Clone ID: PAT_TA_13044.pep
GDLRAIIDDTLTHYDELFRLKSAAARADVFHLITGMWATPAERCFLWMGGFRPSDLLKTLAPQLDPLTEQQMVGICSLEQSLQQAEEALTQGLEQLHQSLAITVAGSGSLSDDTNLGSFMGDMAVALGKLASLEGFVIQADNLRQQTLHQMHRILTVRQAARCFLAIGEYHNRLRALSSLWALALERY

SEQ ID NO: 118627 - protein, 248 aa, Triticum aestivum
  unsure (1)..(248): unsure at all Xaa locations
  Clone ID: PAT_TA_13045.pep
PKFAPEVFAMGFKNPWRCSFDSTKPSYFFCADVGQSLYEEVDLVVNGGNYGWRVFEGPQSYPALSTPGGNTSVDSINAIMPVMGYAHNTVNNNVGSASIIGGYVYRSMTNPCLNGRYIYADLYAQSMWSGIETPENSGVYNVTPLTFGCSKTSPIXCDVAAKSPLPSLGYIFSFGEDNAKDLYLLTSKGVYRVVDPSSCNYACPIKSSTQEGVPPPTSSPSSGFNAQAFTLPTTMLTGVLVVLLSLGF

SEQ ID NO: 118628 - protein, 178 aa, Triticum aestivum
  unsure (1)..(178): unsure at all Xaa locations
  Clone ID: PAT_TA_13046.pep
ASMQEQISSSFMESPPPPPPAHLDGPFFGADLLPSARLRRMRGYRPSPGGLKEEIMMFQTRVLLGGMNMYDRYQDWRLDVDNMTYEELLELGERIXHVNTGLREDEIVRNLRKVKPDSSFRLPTEAEKKCSICQEEFEANDEXGGRLGCGHSYHVYCIKQWLSQKNVCPVCKTAVTKT

SEQ ID NO: 118629 - protein, 117 aa, Triticum aestivum
  Clone ID: PAT_TA_13047.pep
QPIQTNLVCSTVQTHCSLASFRMCIITALVRAPIVFSSLLCVQRPRLKLMPSEIETGNGSGGSPEQYQPVCVTGATNSSTPCSGRASCPRHGEGLRMCHLLVLCRLVLNINQYGTSS

SEQ ID NO: 118630 - protein, 93 aa, Triticum aestivum
  Clone ID: PAT_TA_13048.pep
RPNTMSFISFFVTSVTKGVACMFGPENTRKRRILNVGRGSATCEDKEGQPVLFLLTSDATSHEKAVSFFFLFFQVCSSSKFVSSLKYSVYRVI

SEQ ID NO: 118631 - protein, 94 aa, Triticum aestivum
  unsure (1)..(94): unsure at all Xaa locations
  Clone ID: PAT_TA_13049.pep
INYYRNLDRNCELAAAWADAKVQVPTKYVVGEGEITYHFEGVREYIHGGGFKEDVPLLEEVVVXPGAGHFIQLERAQEVSDHIYDFIIKFSPPT

SEQ ID NO: 118632 - protein, 110 aa, Triticum aestivum
  Clone ID: PAT_TA_13050.pep
RLSKVVNQFSPASAKWQKRIAMAVPRAASIPAPSSSHAAADLSPHNVSGSLRRLKLRMTRHRSSTMAMQKSHVGGWVIDLDSNGISELFYLVFIMLGVSLFASTLVNCVE

SEQ ID NO: 118633 - protein, 122 aa, Triticum aestivum
  Clone ID: PAT_TA_13051.pep
YSRCNAALELLRLCTDALERAAESMLSHAGNVRETSISCFRPVQSEAQYTYLWQELALLKASVLETRAKLMLRGGQYGIGDDLIRKAIFIRTSICGEHHPDTVSARETLSKLTRLLTNVHLS

SEQ ID NO: 118634 - protein, 51 aa, Triticum aestivum
  Clone ID: PAT_TA_13052.pep
ARREDTARGLRRVLAQLGDDRSVADCEAMIRAYDVDGDGGLDFHEFQRMMS

SEQ ID NO: 118635 - protein, 186 aa, Triticum aestivum
  unsure (1)..(186): unsure at all Xaa locations
  Clone ID: PAT_TA_13053.pep
PLGLLDSRAPAPRENVEQLPGPDFNATQLIESFQSRGFDITDVVALSGAHTIGRSSCGSFKNRFGENADFVRWLQGTCARNPNHLQDLXDVTTPEKFDNVYYNNLKEGKGVLNSDMALTHDASTSWLVDGFAQDQGWFFSQFGTSMRKMAHLPSEFGNNGEIRKYSCFWANLHGPKGPTADLAASA

SEQ ID NO: 118636 - protein, 139 aa, Triticum aestivum
  Clone ID: PAT_TA_13054.pep
STKYNNDSIRRCHQGTLRTGIPSTVNGWLGVEGREYMSIRFLRTWNLRQQASGRGPDRAGQPRNILHTRDRNHRWVASLGSARSGRRTRHSSRPRSVVFTERGRLAWRAGYTQPCRCISSKPGTQEPSRTHTRGTPSTT

SEQ ID NO: 118637 - protein, 329 aa, Triticum aestivum
  Clone ID: PAT_TA_13055.pep
RPGVSAVLCPKDSVESHMQDTIVAGAYLCDEETVRIVCTEGPERVKELIAMGASFDHGEDGRLHLAREGGHSHNRIVHSADMTGKEIERALLQAVENDENISVFGHHFAIDLLTCQNNGEIFCYGVDSLDTKAQKVVRFISKVTLLASGGAGHIYPTTTNPPVATGDGIAMCHRAQAVISNMEFVQFHPTALSDEGLPIKPAKIRDNAFLVTEAVRGDGGILYNQSMERFMPLYDDRAELAPRDVVARSIDDQLKKRGEKYVLLDISHKPREKILAHFPNIAAECLRHGLDITQQPIPVVPAAHYMCGGVRAGLQGETSVKGLYVAGEV

SEQ ID NO: 118638 - protein, 72 aa, Triticum aestivum
  Clone ID: PAT_TA_13056.pep
HLMPRLLRLLIHLPVMLVADYRSTLCCVLRIMYSSTLCCVLRIMYSSTLCCVLRIMYSSTLEKESTGKQKSQ

SEQ ID NO: 118639 - protein, 103 aa, Triticum aestivum
  Clone ID: PAT_TA_13057.pep
MLLVAGLGAARGAGECGRVPADRMALKLAPCAAATQNPGAKVAPGCCAQIRSIGRSPKCLCAVMLSATARQAGVKPAVAMTIPKRCAIANRPIGYKCGPYTLP

SEQ ID NO: 118640 - protein, 115 aa, Triticum aestivum
  unsure (1)..(115): unsure at all Xaa locations
  Clone ID: PAT_TA_13058.pep
XHGSQGLEWRRIYRLGYPVMMLLAFAFLMLGVMHLWWHXNPMHKGSXXDTTILSNVQTGWHLLGVHFGRTLHAPWRQHPSWVLDCGRTWECGSWLVLVQEKKIISQLLFQTSVEI

SEQ ID NO: 118641 - protein, 153 aa, Triticum aestivum
  Clone ID: PAT_TA_13059.pep
YNSGQDGESAVCIRSNKGNFTAGYSKGRRLFHPRVAQFAGFLSYDGLGKLVYLHACVTETLRLYPAVPQDPKGIAEDDVLPDGTNVRAGGMVTYVPYSMGRMEYNWGPDAASFRPERWIGDDGAFRNASPFKFTAFQAVPRICLGKGSAYLQM

SEQ ID NO: 118642 - protein, 260 aa, Triticum aestivum
  Clone ID: PAT_TA_13060.pep
MPQGDYIELHQKRHGRRMDYEERKRKKEARAVKKNSKDARKLLGAKGKRFAKKRYAEKAQMKKTLKMHDESSSRQKVDDDVEEGAIPSYLLDRDPTQRAKVLSNTIKQKRKEKAGKWDVPLPKVRPVAEEEMFKVLRTGKRKTKQWKRMVTKATFVGPGFTRKPPKYERFIRPTGLRFTKAHVTHPELKCTFNLDIISVKKNPNGPMYTSLGVMTRGTIIEVNVSELGLVTPAGKVVWGKYAQVTNNPENDGCINAVLLV

SEQ ID NO: 118643 - protein, 82 aa, Triticum aestivum
  Clone ID: PAT_TA_13061.pep
TERLRRALASVSPRRTDPVISIHQVQPGGVGADASPPPCVWQKGILMGGKCQLPDFSGVINYDPAGNMVAPGRPRALPALGW

SEQ ID NO: 118644 - protein, 103 aa, Triticum aestivum
  Clone ID: PAT_TA_13062.pep
LFFFFFFTKLLMIISLNIELHGNLYHLNIHNQIGVALFMSTIFTFRYLSYKSATTIQVSLQSYPTTTILASPLVITTAGSPLPGRAPPIAAVDVVVVDEARPL

SEQ ID NO: 118645 - protein, 490 aa, Triticum aestivum
  unsure (1)..(490): unsure at all Xaa locations
  Clone ID: PAT_TA_13063.pep
MDYLLKVVALVVTASVIGIHLLTRARKWGPANLPPGSLGLPVIXGQTLSVFRAARASAGNQWIQDRIKRYGPVSKASVFCTPTVFLTGPAANKFMFFSSGLRMRTHRSFQRTSGXKSIVDMHGQDHRRIRGALMEFLKPDMLRRYTGRIDAKVRRHLEEHWYGHPTVTVLPLMRALTFDITSSLLFGLETGAXAGTPSPVTFGRMIEGVFAIPXNLPFTTFSRSLKAGRRARRLLEVITSDKKAKLGQGKASPNSDLITRLLSMTDEHGEQLLTNEEILDNGMFALVASHDTTSILMTCMVGHLANDPATLAAMVQEHEEIARNKAEGEALTWEDLSKMKFTWQVAQETLRIDPPIFGNFRTALEDIEFDGYHIPKGWQVIWTAIATHMDPSIFHEPAKFDPSRFQSQSSVTPPCSFVPFGRRPQNIPLGWSFPKMETLVMMHXHLVRHFRWKLCCKEKTFVRVSFPSPLQGLPIELEHINPGDRPGFAK

SEQ ID NO: 118646 - protein, 207 aa, Triticum aestivum
  Clone ID: PAT_TA_13064.pep
MAPKNALPVAVAAAADAGMEPRFRGVRKRPWGRYAAEIRDPARKARVWLGTFDTAEAAARAYDAAALHYRGPKAKTNFPVGTVAAFAHVPLPPPKALAVSPSSSTVESSSRDTPAAAPAAPAAAAPAPPPALDLSLAMPAMVAAQPFLFLDPRVAVTVAVAAPAPAPCRSAAISGMNKVAVREEEQSDTGLSSSVGDASTVVGVGFN

SEQ ID NO: 118647 - protein, 124 aa, Triticum aestivum
  Clone ID: PAT_TA_13065.pep
TCESMVDRRRRPGRQVKPELLAAGLNIQRSREPITERRNDQTNNHGCDATVSLWSGRRLAAGDAALEHLGVVEDGLEALLPEVLLEPLDELLRLGVHLGPGRLLLRRRRPLPPRQGERVRLVHA

SEQ ID NO: 118648 - protein, 194 aa, Triticum aestivum
  unsure (1)..(194): unsure at all Xaa locations
  Clone ID: PAT_TA_13066.pep
YERDGPFFFHDIALFTDSNPSSLPSSRIIGSLVVPQISESECARAPPHCSSSTRPSSETRLRKTITRAQQQRPPTLAATSEAECARAPLHCSLDRSKFRNTLRQAGDHHSRSTTTATDSATSPDSLRPARLLWRPSRLPPPLLPWPRRPTAPRGPPRRASSTPRAPARALAAPALGAPRGGLSRPRRGPLRRPX

SEQ ID NO: 118649 - protein, 59 aa, Triticum aestivum
  Clone ID: PAT_TA_13067.pep
MAATLKLRILAAAVVASSVVGMAMAAEAPAPSPATGAAATTPAFAFGTLVAAAVGYLFC

SEQ ID NO: 118650 - protein, 135 aa, Triticum aestivum
  Clone ID: PAT_TA_13068.pep
LGFPLPDTILRSIHHELYGASQMGSEPTEPSPRQSPLISLAHASPSMRPNRSDTTPRSHTYESGYHSSSGSQHDDGYEVDRRTGERQLRSMRRSGPLDYGASRKAKFVEGSSSGSHGAGSLQRFAVSRSGPLSYK

SEQ ID NO: 118651 - protein, 109 aa, Triticum aestivum
  Clone ID: PAT_TA_13069.pep
TAALSAPTTSTPKRHPGLIAPPPDPVARRRTQAACRPASPRPSPGARTLGATGSAPPATFPVSSAAKPSTCSSGCARTTARPAARGTASPPDPPANYPLHPVRLFLTLH

SEQ ID NO: 118652 - protein, 111 aa, Triticum aestivum
  Clone ID: PAT_TA_13070.pep
SDPLLITWPMMALHARDGFAHTFLIVLFINIMCDGSISLLGFRCTYCIVSFFYILRWPLDPWHCHVNALSFQLHRFIIHASGHLLTGIGNKWRRVDYRHFHRVVSFTEIIY

SEQ ID NO: 118653 - protein, 261 aa, Triticum aestivum
  unsure (1)..(261): unsure at all Xaa locations
  Clone ID: PAT_TA_13071.pep
MLLKSNEGSIQLMEYGHEKPEVTAVSIEPNFASYLFSEYLXSTSGTKLPEGVYLGRNKRKHSNDGEPSDSLKAMDGIKVANGLECKISCKTSKVSYVLDTEDFLFRLGKRRRLSRGGNVADRSPTSKKYAAKVQRFHRFXTQPKGGHGQQKKRNLVLLGSQLLRLNNDXSTIRRRVPFRNNRWEXTYRVNTAKRSEHVGHSSQALLSRQEGIYVLAACCLFXDYPFTGXFDGRAIXLQYLTNHHXCCCWYRSSVLFAVVLH

SEQ ID NO: 118654 - protein, 267 aa, Triticum aestivum
  Clone ID: PAT_TA_13072.pep
EHRYAVARRDALCGLVADLREQCTSKPDGLVLAAESIRTAMVGLLTTMCFGEGVDAGLTRAMADAQHDLVQFFPELRVFAKLPAVARLIHRQRWSKLVALRRKQEEMYLPLDPAGRRRQRKSGETPAYVDTLIDLRVPDDHNKRRRPRRLTDGELVGMCSEFLGAGTETVAAALQWIMANLVKRPHMQEAVRREINAAVDADAEEVGEEVLGKLEYLNAVLMEVLRLYPTATLVFRQAPKRRTGCRHGRETRQRGPARTRTRQTEKY

SEQ ID NO: 118655 - protein, 89 aa, Triticum aestivum
  Clone ID: PAT_TA_13073.pep
MEMNAATSLEPRAKATLVLGGESFTVSSESGALSEQLAAMREKSMVILKEYITKHNVPNDVPDESIEGPSDEEGEVLAKNPPKKSKKQK

SEQ ID NO: 118656 - protein, 245 aa, Triticum aestivum
  Clone ID: PAT_TA_13074.pep
MPKIKNLSDACKVSFSPDGPISEETLERVRALLDEIRPLDLGLDNEAQIARTWNSSTRQQNGRRGRGGPNQYAPTIKYLHIHECESFSMGIFCMPPSSVIPLHNHPGMTVLSKLLYGKLHAESYDWIDVADPTDPLKPRPARCVRDREMTAPETTILYPDRGGNIHTFRAITPCALFDVLSPPYSAENGRDCSYFQKSSVKEPSVVLPSEIDSSEVVWLEELEDHQPPEGFVVARGLYKGPVIRR

SEQ ID NO: 118657 - protein, 103 aa, Triticum aestivum
  Clone ID: PAT_TA_13075.pep
EQKNITVCIIGEQNKTWVKAGAGHDQINSHVATQNLQPQSKIKREYLFAEHFRANEHQLLAPIYLYWLCCLNLAISAAVIASSAQRIGAGATVEDRSRKSVPC

SEQ ID NO: 118658 - protein, 50 aa, Triticum aestivum
  Clone ID: PAT_TA_13076.pep
SGGGRTLNHEHSFHYSACLLAIVFLRPFRILENQSTFITKIMQGAISTKK

SEQ ID NO: 118659 - protein, 157 aa, Triticum aestivum
  Clone ID: PAT_TA_13077.pep
MRFWRDGGASGSGRDLNGGMPYGQVRVLVVGDSGVGKSSLARLILQGSAIARPTQTIGCTVDVKHITYGSPGSSSNSIVGDAERNFFVELWDVSGHDRYRDCRSLFYSQINGVIFVYDLSQRKTKTNLSKWAVEVAESGTFSAPLGSGGPGGLPVPY

SEQ ID NO: 118660 - protein, 112 aa, Triticum aestivum
  Clone ID: PAT_TA_13078.pep
ISKEYSSDSVLRNLVSYELQLLGGTATTPRGSWRMPVPTADSPWPGGVTAVLAGALGCRRERRRGNPTAARHDRHQSERAQHEFQWSAWGQHHRRTSSGAASNGHQTEHEAH

SEQ ID NO: 118661 - protein, 88 aa, Triticum aestivum
  Clone ID: PAT_TA_13079.pep
LTTCPVPPTACPMAPQTDYISRSTVRPPSGNDLPVDDDEKGDAFCVCVVPVLMVHAAPVDVPARGAACSCHLYTYVIYSVYTKKKKKK

SEQ ID NO: 118662 - protein, 98 aa, Triticum aestivum
  Clone ID: PAT_TA_13080.pep
CALARSLCDDHHTSFYCWTLMCLSPLQALCAKLVKDLFFPKFKCGTNLGLGVRFREYIVVIYIRREYQCYDVLVSHLQIVSIIQQFILDNMSVGTIAI

SEQ ID NO: 118663 - protein, 60 aa, Triticum aestivum
  Clone ID: PAT_TA_13081.pep
WQRRYAAMLRRKGKAVRLVEFPDAFHAFYGFPELPDAGRVVEEIKAFIESNSSIHCDPAA

SEQ ID NO: 118664 - protein, 60 aa, Triticum aestivum
  Clone ID: PAT_TA_13082.pep
HPSRFTRMEVTMGLLRWLRGGTTCEYNGRTTTVCFLFARKFLPNSLTRFLRFAPKVMGFG

SEQ ID NO: 118665 - protein, 131 aa, Triticum aestivum
  unsure (1)..(131): unsure at all Xaa locations
  Clone ID: PAT_TA_13083.pep
ELCAQIYSSSSTPITCKTSTTVANDVPSSYTTPTSAAAFHFHRFTMQNWSPTSSSSTSLSISTRRDCRSACRFEFCREERFADPYPSLGATSPSTTIFGRINEGVQASCEAADGGVQARRASASARAXGTA

SEQ ID NO: 118666 - protein, 106 aa, Triticum aestivum
  Clone ID: PAT_TA_13084.pep
MVVNLFRMAPPTRTTPNPNPPPPPPPPEAWQAVMAATNANTQLIMQILQERNQGSQGNQGNNQHHFATLNQFLANGPKTFSGCVEATDADDWLVDLGKHFECSIVR

SEQ ID NO: 118667 - protein, 112 aa, Triticum aestivum
  Clone ID: PAT_TA_13085.pep
NFVSIKRQVWYECVRDLMDDAVSPSKQQNDEGAVALTYLLSLDIDLVDTGTESQRVMRAKAVGALFKAKARGVFGQSGPDGAQLKGMVSKALEAERSLEVQRVLRDILVEME

SEQ ID NO: 118668 - protein, 120 aa, Triticum aestivum
  Clone ID: PAT_TA_13086.pep
DSYSRFKWWYAAVEQQTDAYDTMAAATSESKTPGPRCSGGCRWRQTRHWRPWRLESACLFPHDFHMTSIISADGCSHLDEQGRPRSEAAEQGTLLGPKNSRRIAIDLCSRPSPATFFLNT

SEQ ID NO: 118669 - protein, 103 aa, Triticum aestivum
  unsure (1)..(103): unsure at all Xaa locations
  Clone ID: PAT_TA_13087.pep
GTINKGQTLGFHXWKSRLGTQKSTTNKEVIQCYRPHSQRLLLQVTYHHAHRNSCPVHILQANSKQLSVKQSLHRVQDPASTTCRSSNHTMAFSTCVDPLEILK

SEQ ID NO: 118670 - protein, 112 aa, Triticum aestivum
  Clone ID: PAT_TA_13088.pep
LRSVEEFYRAREIAGVPSKYTHEIRSLKCSYVDDFGEKYCDFPRQERWQYELLRSSVHDMMDKFETFRDDYQDSDSIRKAVQEWHLSCLQSSSKAGSEISRAWAKQEPGASK

SEQ ID NO: 118671 - protein, 85 aa, Triticum aestivum
  Clone ID: PAT_TA_13089.pep
SGYLSASYCTHEYKEYMGLYYYFMSTSVLVYRSNMNIILHGSLNIFLQSWLQNRSRQCKNTSEYTADMLQLNEYTRTVQMSTPAA

SEQ ID NO: 118672 - protein, 62 aa, Triticum aestivum
  Clone ID: PAT_TA_13090.pep
MDRALTNNDTSEYTASDLLREHVTRAKNIRAKLRKERQVRIERYKQRLALLLPPPPPPPSEP

SEQ ID NO: 118673 - protein, 89 aa, Triticum aestivum
  Clone ID: PAT_TA_13091.pep
SPRGAGSFRSRGLLAGGRRVGASTSADLHPPSVRRWWPNHLALLICCVAQWTGFGFRLRTIFCFIIRNCISFPLFSEEQILCRYFQVLI

SEQ ID NO: 118674 - protein, 113 aa, Triticum aestivum
  Clone ID: PAT_TA_13092.pep
NYLHNKFTWYTHLHFTTQRMTTRLSHDMLTSYRSRPPNRDTECYVSRTAEIIWNQKKGFCRVQTFPLLCICDRGLELHAVFRVSRTGRFDFVGELPGQTACPEANHGKGMPEG

SEQ ID NO: 118675 - protein, 95 aa, Triticum aestivum
  Clone ID: PAT_TA_13093.pep
LATVLAILVGGRREGEVDEGEDELKKRRLCMIGGRVAWELERAPIAIGRSRRGSFGTRPGRSTEFCWAPKPFLLAREENHACMISSYLVNIEAQS

SEQ ID NO: 118676 - protein, 387 aa, Triticum aestivum
  unsure (1)..(387): unsure at all Xaa locations
  Clone ID: PAT_TA_13094.pep
RFAVVRQLCADHPDLDAAKVSLGVLGVVSQVTLALEPMFKRSVTFVTRNDSDMAEQAVVWGGLHEFGDMAWLPQQRNVIYRKDNRVAITSVGNDLNDYLALRSSPTADLISGRVMHELLEKKNNTVARCKEAPTSASLFEKAAYGFTNNDSLFMGYPVVGFQHRIQASGSCLENPEDALLTTCPWDPRIRGIFFYNNAYSIALSRVPAFIADMKQLRNSNPKAFCGIDASLGILLRYIKASSAYLGKPEDSVDFDITYYRSYTKGEPNPHSDVLDELQQMALHKYGAIPHWGKNRNFAFEGAISKYPEAGKFLEVKGRYDPDGIFSXSEWSDQVLGINGSPIIVEKGCAIEGLCVCSEDSHCAPEQGYYCRPGKVYREARVCSFQPN

SEQ ID NO: 118677 - protein, 151 aa, Triticum aestivum
  Clone ID: PAT_TA_13095.pep
SLLPHTNPQTRSRTTTLKSWKTSHLVHYLFGKHQQILFRFHNYVSLFVYYLYISSELLFATCITALLKSLQLHQELPLSRLPLLRNLRLTRLLLQPQHRRRGPRGATMAPKQGDTHHLLRLDGHMSVRCWRLSSSDSACSLFLPMKLPYVM

SEQ ID NO: 118678 - protein, 71 aa, Triticum aestivum
  Clone ID: PAT_TA_13096.pep
PGLRDARRAGGGDGGRRLVVGNCRGVRHHDLEPHNLQNGGQMLAFHVSSRASRQRSWKKLVGASSGSNETL

SEQ ID NO: 118679 - protein, 175 aa, Triticum aestivum
  Clone ID: PAT_TA_13097.pep
MRGSLMLPCTTSPNSRSLTLTKNWEAVLPKTPMPPAISDLIAQQDDDITIGSNDLKFVKGLRKIRPGYGRGKLEDDNGDKHVHIASEVEYGLKELSESEHEGDPKRLTMSYEPELEEGPDKLTMSYGSQHEEDPEKLTMSYGSQYEEDPDKLTMSYGSEHEDDREKVTMSYGSEH

SEQ ID NO: 118680 - protein, 93 aa, Triticum aestivum
  Clone ID: PAT_TA_13098.pep
AYLGGTGGNKATACIVSSGMSFPVREINFGTGLPAFASYHFPWPAGAAYVMPMPSARGDGEWVVYVHAAPELVKVIEEEPTVFKVLENSYVFG

SEQ ID NO: 118681 - protein, 98 aa, Triticum aestivum
  unsure (1)..(98): unsure at all Xaa locations
  Clone ID: PAT_TA_13099.pep
YSMKSAVRIASLANKCLVRHARYRPKMSEVLEMVQKIVDSSDLGTPEHPLISHSKELARGGKKRKGLDLKRRIAGIKAXGDGRWLTWHKWTPKLVRTQ

SEQ ID NO: 118682 - protein, 97 aa, Triticum aestivum
  Clone ID: PAT_TA_13100.pep
KLGWQSTMSATYIRSGVNGHFPELFLLGFEPIEVYYHHVRSNFTSRDTRALAQNCTVVGPTRRTAIFALRKLKQMQKHTSGRRDDSREQTKKKKKKK

SEQ ID NO: 118683 - protein, 90 aa, Triticum aestivum
  Clone ID: PAT_TA_13101.pep
GDFYTSYIDHALARSSLGATLLPAGSQRHRIKIRPEKSKFLRWYSSHDFRSQVLFQISLKICVLNPSSHLLCAITNLTAANSSIGNYTKT

SEQ ID NO: 118684 - protein, 109 aa, Triticum aestivum
  unsure (1)..(109): unsure at all Xaa locations
  Clone ID: PAT_TA_13102.pep
NTKYYELYRRXSLGGSLTDTLDNLITERRIEPQLAMKILLNFDKAVADVLSEKVKSRLTFKGHLDTYRFCDDVWTFIIKDINFKLDNTHQVHADRVKIVSCNAKRPGEA

SEQ ID NO: 118685 - protein, 283 aa, Triticum aestivum
  Clone ID: PAT_TA_13103.pep
MALNERLSKFKQQQERCQTTLSSIAATQASTTKSHNAPRSRPANAPSAPAKQIQAIKFSNDTERLQHINSVRKSPVGAQIKLVIELLYKTRLAYTAEQINEATYVAINSNKAVFDSLTNNPKVQFDGKRFSYKSKHDLKGKDQLLHLIRRFPEGLPVVEVKDSYPTVLDDLQALKASGDVWWLSSMDSQEDIVYPNDPKSKIKVDADLKQLYREIELPRDMIDIEKELLKNGHKPATDTTKRRAAAQIHGQRPKPKAKKKQKEITKRTKLTNAHLPELFDLPR

SEQ ID NO: 118686 - protein, 153 aa, Triticum aestivum
  Clone ID: PAT_TA_13104.pep
PRAASPLASACWPAGRASEEAQLPRWLLDTATAAGSATEFTGEFAMDDDGHLLHAWRRRVRARIRAQGEPLAPSPLARAAAYASFRKVVTALVGGQEEQCELAGMEASGPPFLWSLLGRAHGVRAFFNDQRMNAQKVLDGMLHRKNVVKEMTV

SEQ ID NO: 118687 - protein, 314 aa, Triticum aestivum
  Clone ID: PAT_TA_13105.pep
SVYHYALFSDNVLAASVVVNSTIVNAKEPEKHVFHLVTDKLNFGAMNMWFLLNPPGDATIHVENVDDFKWLNSSYCPVLKQLESAAMKEYYFKADRQKTLSAGSSNLKYRNPKYLSMLNHLRFYLPQVYPKLNKILFLDDDIVVQKDLTGLRDVDLTRPVNGAVETCGESFHRFDKYLNFSNPNISQNFDPNACGWAYGMNIFDLEEWKKKDITGIYHKWQNMNENRLLWKLGTLPPGLMTFYKLTHPLDKSWHVLGLGYNPTVEHAEIDTAAVIHYNGNMKPWLEIAMTKYRPYWTQYINYEHSYVRGCKISQ

SEQ ID NO: 118688 - protein, 320 aa, Triticum aestivum
  Clone ID: PAT_TA_13106.pep
VRPRVRFSAWSNKSYFKPLVFSSIVLFLGNVCYAMAYDTKSLTVLIVGRLLCGLGSARAVNRRYISDCVPARIRMQASAGFVSASALGMACGPALAGLLQWRFKIYMVTFSQSTLPGWLMAVAWLVYLVWLCISFKEPNRATEADDTQHNRASGQSVDIGQVENGLAQPLLGDSESKQNEDDDDDEEDESEESAQDSRKPATSIGSAYRLLTPSVKVQLLIYFMLKYAMEILLSESSVITSHYFNWNTSSVAIFLAILGLTVLPINAVVGTYISNMFEDRQLLMASQITLLVGIIFSFKVTSTYSVIQYVVSALITFVSA

SEQ ID NO: 118689 - protein, 113 aa, Triticum aestivum
  Clone ID: PAT_TA_13107.pep
VGRRYSTQKPVNCARASVHCLQLIWFKFHVCVAMDVQYGSAHRAARPLRSPHKKGSGTNLCGWLTHRYERPVHFFLMGWEAHFTYIFCAARPRATCGSIGGGLQFRPRAHAVR

SEQ ID NO: 118690 - protein, 192 aa, Triticum aestivum
  Clone ID: PAT_TA_13108.pep
AGQVPWKEEMGVSIVQCYSSARVPLLLCSLLVHPSQAFKLHEEKVPLSFIVPDPSPVLSPFSAPPPVTGADDDDGLRPRLPTERWKRGRGEERRARGGAHAPAHAPWSAGPARAPAPSYAPAPDSGSGAPVIESSPAVPVPRGVRDTATILPMPAPGVKRQDVGGAALARPGMVPLVVGLVMMASLAALLCY

SEQ ID NO: 118691 - protein, 75 aa, Triticum aestivum
  unsure (1)..(75): unsure at all Xaa locations
  Clone ID: PAT_TA_13109.pep
GAREVQFIISRQSVVYLVNLPCRFTNWLPCVRQPKNLCMIYXLFQXELTAKICAXLSLISVCFAXTDXKDSWXXA

SEQ ID NO: 118692 - protein, 153 aa, Triticum aestivum
  unsure (1)..(153): unsure at all Xaa locations
  Clone ID: PAT_TA_13110.pep
RQRLAAQVFSCLDLSSRRRERPPSPRAFPRLVAVDLRRDPPWPPLSSRCVARTRFRRSQHAHALDLDAHRRRPPSRAWRRAPPSPAPPSLPRRQTPASRRSWRPLVLLGNEHAPPLLRTRGPTPPAPALTPRVGREKAQSARPSXCXSGPWPK

SEQ ID NO: 118693 - protein, 165 aa, Triticum aestivum
  Clone ID: PAT_TA_13111.pep
RPFKLNDNFEKDISPYFYESIKRLVSDEVEKVKGFPLDSTVPYRERLKILTGLVNPDDMNLSSAERKLVQAYNEKPVLSRPQHNFYVGSNYLEIDLDVHRFSFISRKGLEAFRERLKHGVIDLGLTIQAQKQEELPENVLCSVRLNRLDFVDHGQIPTLLPCDDD

SEQ ID NO: 118694 - protein, 82 aa, Triticum aestivum
  Clone ID: PAT_TA_13112.pep
MKWLLQAYNEWILKTMEESSNLLHHKLLELWNKQKDVNGEAYLPAIYTNPKLLSVVQKKYLTGLLHDSVGFCSVRIIRKALR

SEQ ID NO: 118695 - protein, 89 aa, Triticum aestivum
  Clone ID: PAT_TA_13113.pep
MSAPNANTPNEGIVGQAVNSVKNAANYVAETVQGQTAEANKEANKQQAKGNVPGQDSLTDRASGALNAASDKMNQEKHEGSAEANKRSI

SEQ ID NO: 118696 - protein, 68 aa, Triticum aestivum
  Clone ID: PAT_TA_13114.pep
YAPVLLFQSETCSTFSLMQSRNRKVEGACTTWHRCLWLRITFLLYVKKMRSSSPPTLLVDVQRAPCNQ

SEQ ID NO: 118697 - protein, 160 aa, Triticum aestivum
  Clone ID: PAT_TA_13115.pep
RCLAQNPQTALKHQLRRMQSLRRRFHETNTTSVGLGIRCLPSDDHASATGRRAAVPSLPGPQPAPPPPSLHLQGALLPAPLLQDLAARVAGDELALHPDAAEAAAVAARHEGARGRHVPPGHRHLCHVRRRARRGRRWSGGRSAGFVSASLCSMARLPFT

SEQ ID NO: 118698 - protein, 203 aa, Triticum aestivum
  Clone ID: PAT_TA_13116.pep
MSTVISCSLLSGRPAAAPSLSSGNRFPPTTGKATAVALPCFQRQSRPSSVCCASNPKGDQHVPKTDLPPFGISPVALLHPGSPQGERWGIQERADTVSMWFEVPGLSKEDLVVELDEDVLVIRKMKTKAEIEAARADAIASGISKDAAGAAAHDGDMYARLLVPAGYNKETIKAELASGVLKVHIRKVMECARRRINVNIDVK

SEQ ID NO: 118699 - protein, 281 aa, Triticum aestivum
  Clone ID: PAT_TA_13117.pep
SDWAATARKIHQNMNAKDLNLTIQHIASHLQKHRLRAQKLSHSEEVYQRYASMKELSDMIASAYRPPTRPPNNYPATTQTQFTHGVASSIWDKYPGMVWPHVEGSSAASAMWYNYPGKPWGQLGESSARAEVSQINAGPPSVLIHGTKSIWDRYEESLQYYNGSLANKREVLPVKSKTADVYGRKIFINLEREETSRTEAAGKIVIGLESDDMHEGTMDNVHAAVTPQKDTMEKVHGAVTPQKDAMDEVHAAAIPHGVNEVPAAAMGAGDLMDLGSEALLD

SEQ ID NO: 118700 - protein, 150 aa, Triticum aestivum
  Clone ID: PAT_TA_13118.pep
TSSTAVQALHLPGVSCRRGASSPFRLVASVTGATPHARSAWVSGARRPLSSPFSSLPRQRTERYSRTRRWGKRGWSSPTAGRAATEVSSLGYSGGRSAMSHGDGAWGLQQLVQRGHKLITKTFLRPPRRTIFSCSVAPPLLLRRAALPPQ

SEQ ID NO: 118701 - protein, 329 aa, Triticum aestivum
  Clone ID: PAT_TA_13119.pep
MPHLSWEPPHMWSEVHGASTTPDMKNVKCIDCLSCCEVEIRTQDFFNGYYYGRVYQNEWPEMLKLKDWPTSNHFEELLPSHGVEYINSLPFQPYTNLKSGLLSVSALLPDDTSAIAWGCGDHALKLRQMFPKDWLNKLESDALQLSKQLEPSDIVSGYTNECPCCTKHENARHAATRDNSTDNCLYCPKSDNEKTDDLTHFQSHWVKGEPVIVQGVLQKMPHLSWEPPHMWSEVHGASTTPDMKNVKCIDCLSCCEVEIRTQDFFNGYYYGRVYQNEWPEMLKLKDWPTSNHFEELLPSHGVEYINSLPFQPYTNLKSGLLSVSALLPD

SEQ ID NO: 118702 - protein, 223 aa, Triticum aestivum
  Clone ID: PAT_TA_13120.pep
MKLAAACASMEVKAKPARGGKRTRASSGTAGVPTAKVLMEKKESEKERRQHMKRLCEKLSSLIPKEDNPHADTMTQLGSLDVAASYIKKLKERVDELQRKKTSAQAMATLRRVSDISMPTTTITTSSGAGSLEGDKYLDASPTVVEVRQPDDSSMDVRRSWRLAEPGRGQEQSRRQAERGADLVNAHHSVAGHKVFYTIHSRAFSIRIGIDVSRITERLRALV

SEQ ID NO: 118703 - protein, 115 aa, Triticum aestivum
  Clone ID: PAT_TA_13121.pep
GTVITRLPPAAYAALRSAFRGAIAPYGYPSAPANGILDTCYDFSRYGVVTLPTVALTFSGGATLALEAPGILSSGCLAFAPNGGDGDAAILGNVQQRSFAVRFDGGTVGFMPGAC

SEQ ID NO: 118704 - protein, 244 aa, Triticum aestivum
  unsure (1)..(244): unsure at all Xaa locations
  Clone ID: PAT_TA_13122.pep
IFSFKLITFAIAIVVSFTFVYLLSYVHISGAKKTLLSVLCXLWSCLVLVSSGIVPAFTEFXCGKNMTTDFVTFTVKYGCRSYKGSSTGWSKSEVPLLHVESDSATDDARRTVVSVDTKSSTRWSLAINMQEIDDFTVQVESDKLVEEGGKREEAGKLVQLGGESEVAGRQTQQTAGGTSAATQAPPTEAKVEDPPLLVKLRTDVNRATPMVETVLEKLPRWCAALGKSTSPYTLAFLTALPVNI

SEQ ID NO: 118705 - protein, 170 aa, Triticum aestivum
  Clone ID: PAT_TA_13123.pep
FASLMERLGANFNRDQNGMHAQLLGLSKLVELLDPSLHNYFRQNDCLNYFFCFRWVLIQFKREFSFDQIMLLWEVLWTHYFSEHFHLYLCVGILKRYRLRIIGEGMDFDTLLKFINELSGQINIDRAIQDAEALCTIAGEAGADCIPPGTPPSMPIETDGGLYLQEDDVL

SEQ ID NO: 118706 - protein, 65 aa, Triticum aestivum
  unsure (1)..(65): unsure at all Xaa locations
  Clone ID: PAT_TA_13124.pep
XXAGXXXVXXXXSXXVTLLASSGYXXSQXXLSLSVAVTLSLLLEAYTTQLDNAFIPLVFYSLLCL

SEQ ID NO: 118707 - protein, 347 aa, Triticum aestivum
  unsure (1)..(347): unsure at all Xaa locations
  Clone ID: PAT_TA_13125.pep
MAGKKRKSTEKQPKGSRLPLGADADAVADAGKRRRSGAAKRHQAEEEESVPSSISAKILREALRQQQEEGLADSRHAAAAATPAAPAVSAAPSTSFPVPAADGGDDDDEDVDEFDGFDALSEYDGGVPEIDEEDEKALAAFMSKDTSSKQSLGDIILQKIREKDATVSTESTACXKLDSRIIELYKEVGQLLSRYTSGKIPKAFKRIPSLECWADVLQLTEPQNWSPNAVYQATRLFSSNMNAKNAVRFYEAILLPRLRHDIKTNKRLHFALYQSMKKSLYKPAAFFKGILLPLCQEGNCTLREAVIIGSIIQKVTIPPLHASAALMKLADLEYCGTTSYFIKLFLD

SEQ ID NO: 118708 - protein, 105 aa, Triticum aestivum
  Clone ID: PAT_TA_13126.pep
RRRCEWCSLAGSRLASPSSATSGCISRSWRWWCLQRAPPSPSGTHPRQRPPSHSLPDPFSSLGGRAAGARPLRRSSYQLLQIVPIILATVMQQQTLRERASLIKQ

SEQ ID NO: 118709 - protein, 109 aa, Triticum aestivum
  Clone ID: PAT_TA_13127.pep
DNVYCTLLAHSALHGAMAGYSGFTVAPVNGRHAYIPFYRITEKQNKVVITDRMWARVLCSTNQPCFLSHEDVENMKHDDDERHHLHNTQLLDGSPAKCSPNCNGSAGAE

SEQ ID NO: 118710 - protein, 288 aa, Triticum aestivum
  Clone ID: PAT_TA_13128.pep
AWFIAIGGPLAPQLSAPLIAQASPFYPDGKGALSAIVAARLKAGGPVIGVGAVGAGQRLSAQSTIFADTQDAAGNRRLLPVAPCFPQGIGGLLKIVANCPMTIGHMVRAAAEGAGQDLIAQSMNFVDTQDASGNKLLLDVGLWLSQKIKDHFKKKTNFPITLKYIDPTYMIRAVRSNASDNVYCTLLAHSALHGAMAGYSGFTVAPVNGRHAYIPFYRITEKQNKVVITDRMWARVLCSTNQPCFLSHEDVENMKHDDDERHHLHNTQLLDGSPAKCSPNCNGSAGAE

SEQ ID NO: 118711 - protein, 159 aa, Triticum aestivum
  unsure (1)..(159): unsure at all Xaa locations
  Clone ID: PAT_TA_13129.pep
AVPSPVVSDGDHINLFSGGXGAAVRAALASASGGRGAAREREPATDTKPNPKKRKKEEEVRTAGPDDEKYKLGYGLAGKGVATPWYMSKPLASSSKERRDYAEGNGEKRSGGKKSIEELREERRKREAKEKERERALLATTARKERQPDRGYSSRYMRR

SEQ ID NO: 118712 - protein, 103 aa, Triticum aestivum
  Clone ID: PAT_TA_13130.pep
TLEVKCCGCSDREMLGLTLASHLINIWYWVLLIVSALIFVFLPMPCDIYWTIIHMLASRRRRRRVSLSNCPPPIILACRSPPCLPPVHDIACNLGCCQVNLGW

SEQ ID NO: 118713 - protein, 72 aa, Triticum aestivum
  Clone ID: PAT_TA_13131.pep
PAVSNQGEQQMLFAGSDGDKLSFHDHDVLLIIVAYGVHLCWTQFSNCSVFLGATVSSQIIPSQCLFLICWKC

SEQ ID NO: 118714 - protein, 209 aa, Triticum aestivum
  Clone ID: PAT_TA_13132.pep
MMSFGNDKTLLIHLSTDQVYEGVKSFYKEEDETLPVKMYGKSKVAAEKFITEKCSSYAILRSSIIYGPQTISPVEKSLPVQWMNSVLSQGQQVDFFYDEYRCPVYVKDMVDVILSLTKSWLSDGKKIQVLLNVGGPDRVSRLQMAEAVAEVRGYSKSIIKSVPASSVNRGVASPPDISMDITKLTQTLGIQPITFLDGVRATLDAEAST

SEQ ID NO: 118715 - protein, 92 aa, Triticum aestivum
  Clone ID: PAT_TA_13133.pep
NTSLSRWYAYQEQASSSIPSPLSYNTQEHKTSYKDEAFPSFNFNLELSSSKALIRFTHHLFLPLEVSELVKHTLCLQDLISSAFFCVTKYAS

SEQ ID NO: 118716 - protein, 131 aa, Triticum aestivum
  Clone ID: PAT_TA_13134.pep
MGSFLSSLWTPPPLAGDDPDSAVVAVHSKPAWDKHWEEHRNASKLMVIDFSASWCGPCRFIEPAFKEMASRFADALFVKIDVDELAEVAKTFRVEAMPTFVLVKGGQEVSRVVGAKKDELDRKIKTFISST

SEQ ID NO: 118717 - protein, 123 aa, Triticum aestivum
  unsure (1)..(123): unsure at all Xaa locations
  Clone ID: PAT_TA_13135.pep
MGSFLSSLWTPPPLPGDDPDSAVVAVHSKPAWDKHWEEHRNASKLMVIEFSASWCGPCRFIEPAFKEMASRFADALFVKIEVDELXEVAKTFRGEAMPTFGLGEGRAXVSRVVGAEVRDDGLD

SEQ ID NO: 118718 - protein, 471 aa, Triticum aestivum
  unsure (1)..(471): unsure at all Xaa locations
  Clone ID: PAT_TA_13136.pep
MATAAAAAVASLRYFPSSVRNRSYPGTIGGGAVVTFSPRRGRCGTAAMAAPSREAEPASSLGDLTRVDFPILDQEFDGNKLVYFDNGATSQKPSHVMKALDDYYRFYNSNVHRGIHALSAKATDAYESARRKVANFINAADSREIIFTRNATEAINLVAYSWGLSNLKQGDEIILTVAEHHSAIVPWPFVDYKTGAVLKYVGLTPEVGPAVERXDARLAAVTRAAVVHHVACGRPSWLPRPEVVSCANKVGAKVLVDACQSVPHMPVDVQKLGADFLVASSHKMCGPTGVGFLHGRTRGLSSMEPFLGGGEMIADVFEDKSTYAEPPSRFEAGTPAIGEAIGLGVAIDYLSHFGMQRIHEYEKVLGSYLYESLLSVPNVRIYGPAPSASDHRAPLCSFNVENVHPTDIAEILDLQHGIAIRSGHHCAQILHRTLGINASARASLHFYNTKEEVDAFIHGLKATIDFLTSHH

SEQ ID NO: 118719 - protein, 269 aa, Triticum aestivum
  Clone ID: PAT_TA_13137.pep
MDVWTMHQLKDNKLQSDGPPGMKGSLLENLLNGEGPFVAFTLRELYSVSAAIVKLKGLISFSGDVCRKACNPFQHLSLNPMVGTACIALQKIADMSDWPDMFSLVWIDGILRYLEVLGTFPELNLSKELYAQIVNAHVSAIGKCILLQGKSATLPTHEIGSSTKTLQLQNTSGYVVTKNIIDRQNRLNSLISRLRLSMRNFVSVASNMHLSATLQVIERALVGVNQYSHSIYEVETGTSDGGTVSSDVAAGIDCLYLVLGSVPGNKRVF

SEQ ID NO: 118720 - protein, 415 aa, Triticum aestivum
  Clone ID: PAT_TA_13138.pep
GLATSSASSRVYHVTDYGADPTGAADATAAIKKAIADAFSPPSNATMAAGIPDLGGAEIHLDGGTYLVNGPLTLPASGGGNFKIHSGSLRASAEFPTDRHLIELSAVPTGSSSSGYHYEYVTLRDLMLDCGYRGGGVAVVDSLRVAVDNCYITGFETEGIAVRGGHETYIRNTFLGQHMTAGTDPGERSFGGTAIRLDGNDNSVSDVVVFSAATGIMVTGGANTISGVHCYNKATGFGGTGIHLKVPGLTQTWLSNCYMDYTSIVAEDPVLLHVSGSFFLGDANVVLKAVNGVARGVQITGNMFNGRGKGVDIVQLDGAFGTVEQVYVQQNSAMGMNLKATTARGSAEGNGSSWTVDFAPVLLFPDRIGHVQYSLVAGDAFPGHTLRNISGNQVVVATDKAVSATVHVLVDQNSN

SEQ ID NO: 118721 - protein, 201 aa, Triticum aestivum
  Clone ID: PAT_TA_13139.pep
VRPPGLVLVSSLVRRPPRSLTLVPCLHSLGARHRGLKPSPCHLPPLSQLPFSGNDSLGSRDCGAEPSTCHLGSFGLLSWCVHGRLLSSGRVAALQSCLSGPLRLLLRWWLRRRLSPCRFLSARPFLAGRLPARPFALRPPSLVAQMDKMGALSYEATSGSPHSSDNCFPTAAASSLGYPKTEFCQLPLHSLLSELHHQLLL

SEQ ID NO: 118722 - protein, 132 aa, Triticum aestivum
  Clone ID: PAT_TA_13140.pep
YKGGEGCEVSTSFYRKRKNATWRLSGLVLNLLGLVVILREPPVTCALYEAFYVGLYHHINLVDVVHGDLEAHQVEILEPIVVVYIIQPAAEIAVDSWQLKVRQVWYFSIVCGICLFITSSGSKGATVLALVV

SEQ ID NO: 118723 - protein, 134 aa, Triticum aestivum
  unsure (1)..(134): unsure at all Xaa locations
  Clone ID: PAT_TA_13141.pep
NHDEEALERPQPGADPKPQPGADEPAXQSSCIRNRKKDKRKKRQGGXDIQQTMEAYLDFRMKQARTKEQTKKDGEQFSISRCIKALHSMTDVSDQVRVLAADVFKDAVNREIFLSYEPRLRPLWLKREVNRLLC

SEQ ID NO: 118724 - protein, 95 aa, Triticum aestivum
  Clone ID: PAT_TA_13142.pep
AKVGLKPDGFFVLKENIAKNGFVLDKEDNSVTRSDAYFRELFNKCGLYIHSIKNQKELPEELFAVRMYALVTSQPKVTKNGKRGRPKNSPRIIRS

SEQ ID NO: 118725 - protein, 517 aa, Triticum aestivum
  Clone ID: PAT_TA_13143.pep
HGPAGLKAIADRVHGLAGTFAHGLKKLGTVTVQELPYFDTVKITCADANAIAEEARKSEMNLRVVDANTITVAFDETTTLEDVDKLFKVFSGGKPVDFTAESIAPEVSSSIPPSPHASAHALAHPIFSMYHTEHELLRYLHKLQSKDLSLCHSMIPLGSCTMKLNATVEMMPVTDPKFANMHPFAPIDQAAGYHEMFDNLGDLLNTITGFDSFSLQPNAGASGEYAGLMVIRAYHKARGDHHRNVCIIPVSAHGTNPASARDPGTGPARVKKHLALFAPSHRVTRVGGTPPRVISDPLGSLSAAPWGSALILPISHTYIAMMVSQGLTEASKIAILNANYMAKRLEKHYPVLFRGVNGTVAHEFIIDLRGFKATAGIEPEDVAKRLMDYGFHGPTMSWPVPGTLMIEPTESESKAELDRFCDALISIRAEIAEVENGKADTHNNVLKGAPHPTQLLMGDAWTKPYSREYAAFPAAWLRGAKFWPTTCRVDNVYGDRNLICTLQQASQVAEEAAAATA

SEQ ID NO: 118726 - protein, 149 aa, Triticum aestivum
  Clone ID: PAT_TA_13144.pep
HCTFLRYEHTSTYHISAYIYLNCLRIHLKMQYMSIVFHLQGGRCLCCKMPQQLNRDNSTKRSCRAARRVNEYFITLVEDLLVQELWDASLILLHRHYVTCNLLAEVLDLLLVHIRSQVKASELQYVVQDIHHTVFPGAWLVLRNQRVHK

SEQ ID NO: 118727 - protein, 117 aa, Triticum aestivum
  Clone ID: PAT_TA_13145.pep
GKDHSAEFYKLKKHVHREYLQVCRECRKCYKLLMLYPTFEVIRVFCTLWITRVRSALKFLSHLSQDKAGSTNRPACPESTLGMILSTLHVEERNNAAEGHRTLQCHVAISRAAGAKC

SEQ ID NO: 118728 - protein, 222 aa, Triticum aestivum
  Clone ID: PAT_TA_13146.pep
MDAADAASPCDGHRTVWSEPPKRPAGRTKFKETRHPLYRGVRRRGPAGRWVCEVRVLGMRGSRLWLGTFTTAEMAARAHDAAVLALSGRAACLNFADSAWRMLPVLAGPFSTAKEIKDAVAVAVLAFQRQHPVASMAPLSPARTTDDEKEIDGSPAPSALSMSSELLNEHWFGGMDAGSCYSEGLSRGTPARRARRAGGARRGVETRPRRDKVDTGSAVNRK

SEQ ID NO: 118729 - protein, 98 aa, Triticum aestivum
  Clone ID: PAT_TA_13147.pep
MNPSQIMYLCEYISTPRALLPLLSYSTLSPPRLSTDGETPRDLGSRAKLNKHPSSIHHKRKNILANCALNLHPSFNVLLHQGVNFPTSTDFPTLATLS

SEQ ID NO: 118730 - protein, 62 aa, Triticum aestivum
  Clone ID: PAT_TA_13148.pep
ECGYIAANLYAKSVFGEDALVNISIEKQVDGKLSGHIRIRSKTQGIALSLGDKITLKQKGGS

SEQ ID NO: 118731 - protein, 370 aa, Triticum aestivum
  Clone ID: PAT_TA_13149.pep
SAPSCSSSTGETLPTPDNANLRHRLLPPGPHHPDAYAPIVLCVRQLGNTGDDVRKIWLQSCRQSFAKMLAEKQFRETEEMKAKSQISHAQPDDLIDFYHLKSRRGMSQLELEDEVQDDLKAATGGFSKETDDANRLNRILQLTGFSDPVYAEAFVTVHHYDIVLDVTVINRTKETLQNLCLELATMGDLKLVDRPQNYPFVPDTSMLIRATFMVISTEKRVICQALVDATSIGRERSGVVLNDIHIDIMDYISPATCADVTFRNMWAEFEWENKVAVNTVIQDEKEFLNHVIKSTNMKCLTPPSALDGECGFLAANLYAKSVFGEDALVNISIEKQVDGKLSGYIRIRSKTQGIALSLGDKITLKQKGGS

SEQ ID NO: 118732 - protein, 176 aa, Triticum aestivum
  Clone ID: PAT_TA_13150.pep
LSLLNTWTGSGCEMWNPSTSTMLQVLVSIQALVLNAKPYFNEPGHSMYANTPLGEKQSLAYNEETFLLSCRTMLYSLRNPPKHFEHFIGGHFRKYGRDILVGCKAYMGGAQVGCLAGDGVQDVDEGDKSCSQNFKCSLEILFKGLINEFTDLGVGCHEFQAQVVNSGAAADTTLRL

SEQ ID NO: 118733 - protein, 135 aa, Triticum aestivum
  unsure (1)..(135): unsure at all Xaa locations
  Clone ID: PAT_TA_13151.pep
EIWRTGRPSKFCKGLQGHLSCSASQKVLEIAKKFPSKIRLEQLPRRNIFPPQFHGNGLSYDSIGLFFFAQDIQSYERHYSKLVEWMLKGDLALKXGNIETAELLIFPSNILPKSFQRWNMSYYLWGVFRVKKKRL

SEQ ID NO: 118734 - protein, 221 aa, Triticum aestivum
  Clone ID: PAT_TA_13152.pep
MPILYAVVARGATVLAEHSAAATNAGAVARQVLERHPGGGADSHVSYTQDRYVIHAKRTDGITALCMPADGDRRRIPFAFLEDIHGKFVKTYGRAALTALAYAMNDEFSRVLSQQMDYYSNDPSADQINRMRGEISQVRSVMIDNIDKVLERGDRLDLLVDKTTTMQGNTVRFKRQARRYRSTTWWRNVKLTAALILLLLVIVYIALFFVCHGFTLPTCIR

SEQ ID NO: 118735 - protein, 178 aa, Triticum aestivum
  unsure (1)..(178): unsure at all Xaa locations
  Clone ID: PAT_TA_13153.pep
PSSPSVGRSVRTIRPREGIQPKIQEVTDEDEAGNAPDSSHGSEEPYGYREYQAVPRFQYERRSSDPILGIVAVSSDETESSDDDEDGVGAYSTRTNSPRESPPTPEXVDENEGDKERREGVHPQRVSEEARFRLQEGFAVHQRKSARDPRRPQSNGKVSSLATGSSACSSVSGRRWFC

SEQ ID NO: 118736 - protein, 92 aa, Triticum aestivum
  Clone ID: PAT_TA_13154.pep
TDIFCQQRFTDLAFTDQPRNQFRTSCGGSIHGGADRGARVASFSRGQSQNWRNTISPSQSVVKNASLDLPMRQLRTHCQTIPNNANHPLRLE

SEQ ID NO: 118737 - protein, 185 aa, Triticum aestivum
  Clone ID: PAT_TA_13155.pep
FFFFFFFFLFCAHCSFRRTLNSAASSSGSALHSSSTWALPALPVLACSGLPNHSVPPRSLILPHSVPLLFRLPPRPAPRWLSLSGSPPPRSSLLRLLVFCGNCLLTLHCPSVGSPMRHVAPRRISCSVSWPGALNSPPLVSSPVGLSAWPSAEPFSSPGGGNIPQVPRLSTILFSLLPSYIPHLS

SEQ ID NO: 118738 - protein, 191 aa, Triticum aestivum
  unsure (1)..(191): unsure at all Xaa locations
  Clone ID: PAT_TA_13156.pep
LQCGGSILNENXVLTAAHCLYYVQSDWHVRVRAGSSSXRTSGGQYPHAKKVMYDSRFTMKNLRYDVGLIKLETPLVLGPAVQPVQLVAVGAEPGVGSTITLSGWGVVQEGNKTPPLGLRTTKVQTVRRWTCSLSYVLMAKITDAMFCAAAQGKDTCQGDSGGPAVDENGRQVGIVSFGNGCANWLFTGGLY

SEQ ID NO: 118739 - protein, 157 aa, Triticum aestivum
  unsure (1)..(157): unsure at all Xaa locations
  Clone ID: PAT_TA_13157.pep
RRRGRVVGARPGHGRLRPRPRRYPRRRLGCXLHRTCSEVPRRGQRRLGPTRTRAPSSPPMPMPTPTPTAAGRHPAPPQHLYGGVGGPASVLDQTVFVREEEMEERGEARRRLTWPMPTQTSTAAARTTTTLLVQLSSIDQPVLCSFSKPVIVVPLPP

SEQ ID NO: 118740 - protein, 98 aa, Triticum aestivum
  unsure (1)..(98): unsure at all Xaa locations
  Clone ID: PAT_TA_13158.pep
VVXGXKPACLPLLRGARRAWWPCPCAACRASSRAPAARRGLPPASAASDGAVALLSLNWFLLGVLTYPMLPGVARAVVPRAARLAGPAIAWLAAAVPV

SEQ ID NO: 118741 - protein, 325 aa, Triticum aestivum
  Clone ID: PAT_TA_13159.pep
FRFESGYEQKRKVMNKKYEVYEKQMKAARKTGSKAAQDKVKDQAMSKAHKEVAKGKGKGKNVANDDDNVKPADLPQKWHDYKVEFHFPEPTLLTPPLLQLIDVGFGYPNRPDFKLSDVDVGIDMGTRVAIVGPNGAGKSTILNLLAGDLNPSEGEARRSQKLRIGRYSQHFVDLLTMEENAVQYLLRLHPDQGGMSKAEAVRGKLGKFGLPGHNHLTPIVKLSGGQKARVVFTSISMSNPHILLLDEPTNHLDMQSIDALADALDEFTGGVVLVSHDSRLISRVCDDEEKSQIWVVEDGTVTKYDGSFEDYKDELMAEIKKEVEE

SEQ ID NO: 118742 - protein, 106 aa, Triticum aestivum
  Clone ID: PAT_TA_13160.pep
LKTRRASHDTVQRLRRGHASLCWVWVAGFLFLSLHAWHILFSNILYLSNCLASQAQEHEVFAPIAFFTPRPWLCTYSNSGKYPVIYDARRPGEVPCKQPCDLPLLL

SEQ ID NO: 118743 - protein, 131 aa, Triticum aestivum
  Clone ID: PAT_TA_13161.pep
AMTVFSICMYASPLSIMRMVIKTKSVEYMPFLLSLAVFLCGTSWFIYGLLGHDLFVTIPNGCGSVLGAAQLILYAIYRNTGGPGAAGGGKGPGGDAAAGGDGRNGGAADGERPAVRRGRRSPARWPRPGLA

SEQ ID NO: 118744 - protein, 218 aa, Triticum aestivum
  Clone ID: PAT_TA_13162.pep
CWWRSGSRSLGSAGGAGPRLRGFGGFAAVTAVRGFRDGAARHLVGVEMRNITDENPVRFWPAGVDGTRGCRSPLWRRRRVCRHLPRAWCWQLSPGESLGPLGRHDGGVCDVVSLLGASCEETEFPVGAPPVFVVALTAHLRRYVWSSRMNPKEAGVAVLWRCSASIKTRRGVSVLGRFFRIVVVLLCVVVLRISGCGVVLCSLFAASDRCYVLISLLL

SEQ ID NO: 118745 - protein, 139 aa, Triticum aestivum
  Clone ID: PAT_TA_13163.pep
RCSSSVFLCEIPSPNPLARMPHPLPPRSPPLSLVGCHNTKPGILPLLLPCMCVPVVAFPPLPHRCPNASMGYNRSMADGRVRGREGRVVGPSLRLVKHRSGLGATTGACGQGRPWREARRPEKQEQGDCYSLSGRTIFI

SEQ ID NO: 118746 - protein, 110 aa, Triticum aestivum
  Clone ID: PAT_TA_13164.pep
VETTAVCDFPRKFIALFARRLARCVCGLSDPPTYHHRPSHTTVFNRSQPILRIRPRRDASLRCKPQRLGRGCTTSRIGANEGLRLCSVWLLQVPSSAKPESVRCRARAVL

SEQ ID NO: 118747 - protein, 58 aa, Triticum aestivum
  Clone ID: PAT_TA_13165.pep
GLFVRRDSAKVGHNVKVLFKRIAQALPGMEGEGQQAANQTIDVNVNQPKPESEGGCQC

SEQ ID NO: 118748 - protein, 279 aa, Triticum aestivum
  unsure (1)..(279): unsure at all Xaa locations
  Clone ID: PAT_TA_13166.pep
MMMGFMGKRKELEQVVDGLCDFSLSGPAAKCRRLDPGLPPILEEEPPCPSIPYQHQMLGEEINSGVNMPIVEDMIEGAMPSHLSSEDKALVIYKPVNKPTLFGLSIANPSIIVSSDLIRGLKNQPFNQGNCHGLEDNSPERSNCLALVPWTPQRIAMTSDWSAAPPESTHNVEEPMDADETEVISMDFEEAPQATPRGIDVDNIHQWXPALHGPAIAAEPVSASHVVVVTNLEMSAPLTAGYLHTKDEEIPIAGLHRKCVSTFDGLRNDCYVHNSPSLA

SEQ ID NO: 118749 - protein, 76 aa, Triticum aestivum
  Clone ID: PAT_TA_13167.pep
KCHTCISRSLPLCYTVDCFISFKHAVGSLNLPVEFDGQVLILNLIAYAILQFDKRRNVQKIHRHSRCNYLLHHILG

SEQ ID NO: 118750 - protein, 80 aa, Triticum aestivum
  unsure (1)..(80): unsure at all Xaa locations
  Clone ID: PAT_TA_13168.pep
TMSFFFLLSXLLNDRGGGGLHPHWVLXQINQXPTLMKGLQWHDHXEXIPNHLSTXSFPQXXRNAFTNLPLGTXVXDGGNS

SEQ ID NO: 118751 - protein, 239 aa, Triticum aestivum
  unsure (1)..(239): unsure at all Xaa locations
  Clone ID: PAT_TA_13169.pep
IMTALLMHRGISPSIVGAFSGLYSXMGLVATFISSSLVKRVGILKAGAAGXXFQASLLSXALTVYWAGPISQRTPLXIFLASIALXRLGHMSXDVVGTQIIQTGVPASKANLIGGMEVSIASLAELVMLAMAIIANDVSHFGFLAILSVSSVAGAAWMFCRWLRNPTGEQRALFILDRGIRPPAAGAWGGRSGGTGAEAACSRSSPETSGGTPTAGAAGEEAPTRRMLGPGVEMGLALQ

SEQ ID NO: 118752 - protein, 103 aa, Triticum aestivum
  Clone ID: PAT_TA_13170.pep
RSYVIALLSCILGFPKHVIILATLLLTALLMVADAQPAPKIDCPSACNARCSQNWRNKICNKDCNICCDKCNCVPSGTGQETRSECPCYANLVDSKTGKLKCP

SEQ ID NO: 118753 - protein, 188 aa, Triticum aestivum
  Clone ID: PAT_TA_13171.pep
MRPLDEKETTMVFEKLFKFTGPNLKHLLERPSVEGPDPEPGRYCLRLHKNRVFYASESLVRRATAVSRTRLAGVGTPIGKFTHGGAFHLTVHALDLLAAHARRRIWLKPDTERSFLFGNSVPKSALARITENTKSGDGVVVMSMADVPLGFGVAARGAQDCRKADTNAVVVLHQSDAGEYLRKEEELM

SEQ ID NO: 118754 - protein, 92 aa, Triticum aestivum
  Clone ID: PAT_TA_13172.pep
FFFFFFFAPTASISATITTKHPQRTAYTLQGRNDRRSYTQALILRTCPVHTQVFTIQCLLDLAQGTSPDIRLRTCHQSVITSGNTYTAAMLP

SEQ ID NO: 118755 - protein, 177 aa, Triticum aestivum
  Clone ID: PAT_TA_13173.pep
QIALLLLLLAAAHGLSVAISPTPIINTTCAALAHSPNVTVHVDYEFCVRALSADTASSSATDARGLAAAAASLTVANLTSTEHIIADLVDNLGRCLTDYREINGMVRHALDDIRGGRAADASVKLLEVAKANAPAWCDLILIEGDAKRNPIDQENHNADFLSVIASGIAELMLHSHG

SEQ ID NO: 118756 - protein, 221 aa, Triticum aestivum
  unsure (1)..(221): unsure at all Xaa locations
  Clone ID: PAT_TA_13174.pep
MHWVKESVSMILIDLGYSWICYLTLLQGDGSWERKDMXLLEMXRIMLGXEYKILVVSWIEAIDTACXHIINRVYLHXLQKVAYELLTDKKPNVSYFKVFSAKCWIRDPHHNSKFALKAHEGFMLGYGKDSHTYRVFNNVLHKVVETVDVRFDETNGSQRKHLPSVIDEPAPEETIKFKATEDVIPTEESAEEFIPEREERRANAPEENAEENGAQENADQI

SEQ ID NO: 118757 - protein, 51 aa, Triticum aestivum
  Clone ID: PAT_TA_13175.pep
RPVVKLARNEQCIALYPLAAHYSIGPFPAHVIFQPSQGPFILGLISAFGLL

SEQ ID NO: 118758 - protein, 113 aa, Triticum aestivum
  Clone ID: PAT_TA_13176.pep
PSVSCLLIYFLIVLFICFLVVSAGRVPRPPTGHRNPGPSTCCRYPGPPTGRRNSGPSTGSRNNGPSTGRRHNGPSTGRIINGPSTGRLTGGPPMGQSRALFRTVNGLELESSL

SEQ ID NO: 118759 - protein, 401 aa, Triticum aestivum
  Clone ID: PAT_TA_13177.pep
VLAPQAAALAGPHPGAQAWAEALSQATRECIWRDSSAPSGTVPIYQALEKVNGIAEDLSWEVFRDTLIEQAEQGVDYFTIHAGVLLRYIPLTAKRMTGIVSRGGSIHAKWCLTYHKENFAYEHWDDILDICNQYDVALSIGDGLRPGSIYDANDSAQFAELLTQGELTRRAWENDVQVMNEGPGHIPMHKIPENMEKQLEWCNEAPFYTLGPLTTDIAPGYDHITSAIGAANIGALGTALLCYVTPKEHLGLPNRDDVKTGVISYKIAAHAADLAKRHPYAQAWDDALSKARFEFRWLDQFALSLDPVTAMSFHDETLPSDGAKVAHFCSMCGPKFCSMKITEDIRKYADEHGYGTVEEAVRQGMSEMSAEFLAARKTISGEQHGEAGGEIYVPESYVVQK

SEQ ID NO: 118760 - protein, 235 aa, Triticum aestivum
  unsure (1)..(235): unsure at all Xaa locations
  Clone ID: PAT_TA_13178.pep
MMRAPPRLLSPPSSATAPHLLLYASSAVCRLPPSAAAVARSVSVSTTVVDAPAAAAEPGSSATPRRRLILLRHGDSAXGSASPRDHDRPLSKAGRADAISVSDKFHQMGWIPELILCSDATRTKETLQIMQEHVQGLSQALVHFIPSFYSIAAMDGQTAEHLQKAICEYSTDEILTXMCMGHNKGWEEAASMFSGDSVVLKTCNAALLEAAGKSWIEAFSQAGLGGWKLHGIVKP

SEQ ID NO: 118761 - protein, 111 aa, Triticum aestivum
  Clone ID: PAT_TA_13179.pep
GGNQAASISHLRPATVAVQLGGMRDAVQCWCRCTGLPYFFSPPTNIQPRQCLSSLACVAALRYGSKAADGGAARRVVDAVAGVSLMLPLTTGCLRPMTKCCFPPVVLFFCF

SEQ ID NO: 118762 - protein, 95 aa, Triticum aestivum
  Clone ID: PAT_TA_13180.pep
EEFRSLFITFSRGYPIDKDDIREFFNSLHGRPCVEDVMVERAAPGQMPVYGRVVLQSADMIPALLGGEPTAKFIIKGRHLWARVYVPCSRNTFQA

SEQ ID NO: 118763 - protein, 172 aa, Triticum aestivum
  Clone ID: PAT_TA_13181.pep
GAFLGASALHMAAVARNLSLSPAILCVDDFRGWPAFRGRFRRDVPQQRHGDALLLPQFMANVLAAGPEAAAAVLPLPFSTASTLGALCRWGVYADHIEVDAGHDFHSAWADINLAWAVLRPGGVMFGHDYFTAADDRGVRRAVTLFARVKGLTVRPHGQHWILSPKPRGEGR

SEQ ID NO: 118764 - protein, 117 aa, Triticum aestivum
  Clone ID: PAT_TA_13182.pep
MGNCWGTRIKDGSTHPGASRMFSRGSGKDGSRLSACSSRARSASMPPSAKTECEILQSANVEKSQPNDLRWATRNVGPDSMLGEGGFGSVYKGWIDEHTLSACKPGTGIPVAVKRLN

SEQ ID NO: 118765 - protein, 195 aa, Triticum aestivum
  Clone ID: PAT_TA_13183.pep
MYHHHSSFSSSSYTCQGSNGFLPSQPSASSYGDLLQAEQHCYYNYSQQQQGQAPPFRHVLSAGDLGAPPPAAAAAGRCRTDERRERIEKYRSKRNQRNFQKKITYACRKTLADSRPRVKGRFARNVDDDAVADQPEFTAAEVSSMMSEANVVVGAVDAAASSSSSNMPEWWPAMQGALAMEDDELYIAVSSINLY

SEQ ID NO: 118766 - protein, 188 aa, Triticum aestivum
  Clone ID: PAT_TA_13184.pep
THHVFRLRFEPPGGRRRHFVSGRCHASTRRRTAPAAAVHHVVGGDPGWAVASDVLAWSAGRLFTVGDTLWFAYEAAEVAGEAEFEPCEAGGTPIRTYTDGLSRVRVGLDDEGTRYFLSADPAKCKGGLKLRVDVRATVSVSPRSVDRAAAAAPAPPAPPASSGTQAVVPLVRRALCLVSVWCFLFLGA

SEQ ID NO: 118767 - protein, 292 aa, Triticum aestivum
  Clone ID: PAT_TA_13185.pep
MAAAALAPALAPVPLPAAFAGWWEHVNGSPAWQDGIFWALAALYGLSAASSFIQVARIQHRVPEYGWTTQKVFQFLNFLVNGARCSIFAFRRQVQLVNPQIFQHVILDLPGLAFFTTYAMLALFWAEISYQARGLDTDGLRSGFYTINGVVYAMQVLVWVLLWLNPNSSMLVLSKLFIAGLSFSAALGFLLYGGRLFLMLKRFPIESKGRQQKLSEVGRVAAICSCCFLARCVMMCFAAFNKDADLDVLDHPILNFIYYLLVEIVPSALVLYILRRIPSKLKLAHYHPLSSG

SEQ ID NO: 118768 - protein, 185 aa, Triticum aestivum
  Clone ID: PAT_TA_13186.pep
RRRERHGRRKGGRMEPEHFVRIPDAEPTKARPLQGLWKGVCENKTLEFYIISYDDIGGVTCRRVSENRGQNSGYSPVFWTTDATFLEPPFSERELDRYSCLEHIGVVTCGHTETWNKAVSRILCINSSFDLVHPHLLAPFDDTRNVEGRIWLYEDGTFGFGFTGSNSIIDLKHVSMDGCIIDTSS

SEQ ID NO: 118769 - protein, 134 aa, Triticum aestivum
  Clone ID: PAT_TA_13187.pep
MASKAQGSYSMKVLVVEDNTVQWMVLSQKLRNYQCEITLAANGKEAVDLFLKGKKFDIIFCDKDMPIMTGPEAVVKIRAMGESDVKIVGMSADDDAMEVFISAGADIFVPKPIKVQDLESVIKEVVNKKKNTMV

SEQ ID NO: 118770 - protein, 232 aa, Triticum aestivum
  Clone ID: PAT_TA_13188.pep
LHRPPFDEPRRNGKVPKILTHRLFPQAWYSIWIDGKMELMVDPLLILERYLWRGKYTFAVAVHKHHRSIYEEGDAIKRRKRYARPLVDLQMKIYYHEGMEPWDEKKRMPSDIPEGAVLIREHTTITDLFSCLWFNEVNLFTPRDQLSFGYVAHRLGDALKFFMFPNCEYNSLFILHRHTREHSSKVEWAKTIDEILKKGLKESRGGLGLWTPYPADLSSVELPAVKRTSQAS

SEQ ID NO: 118771 - protein, 92 aa, Triticum aestivum
  Clone ID: PAT_TA_13189.pep
NVDTELMSELIPIVSSILLRCQHCPVQNHPADSTYQVMQPHLCVTCRSFYEKDKLCRRTLSTHWMNIKLHVYCQKKKEVIKLEKRVSAACMD

SEQ ID NO: 118772 - protein, 129 aa, Triticum aestivum
  Clone ID: PAT_TA_13190.pep
ARLGTTPSVLALLLAAATLSSAALPTAGGAPRRVLWTKGVPADPFCPWEAVKFDACAAVLGLADAQAGAQLGSECCQLVGGLAAAEAAACLCVAAKEGVLGLVSAEWSVGVELLASACKTDIPDGFKCV

SEQ ID NO: 118773 - protein, 317 aa, Triticum aestivum
  unsure (1)..(317): unsure at all Xaa locations
  Clone ID: PAT_TA_13191.pep
VPANSPAADALQLYKRMRAAGVAPDCYTYPIVLPACAAARAPRLGRAAHRDAVRFALAGDGFVHSALIAMYCQEGEVADAEQVFLAAAAGARTVVSWTAMVAGYAQNCLFGQAAAVFGSMVDQGVLPNEITLISFLPCLQGQECLAAGEMVHGFVIKLGFDANLPLVNALXAMYGKCGSIASAKELFDGMAARTVVSWNTMVAMYEQNGDGVRAIKFFHXMLSEKVGFDAVTLVSVLSACTRQGALETGKWVHELARSHGLETDASIGNVLVDMYAKCGEIVYARQAFEGLREPGVVSWSAMISAYANHGEQVRCKF

SEQ ID NO: 118774 - protein, 257 aa, Triticum aestivum
  Clone ID: PAT_TA_13192.pep
MRFLGGFICLCGSLFVLSLSSQPDLTPIEEDGITPIEQGEKRVNPGCAAPVSPRHINTGCGCCFAIVAVQNLESVVLIETGKYSRLSVQEVIDCLGKCKKGLLYGYIDYPINLIRRQGPCQAADKPRAIQPADKPKPGAIQVIEWDQFLGHDDYVKRLRTDPPVPVEDQFKIALFTSPLSVRFNVNKYFVRYDGKTIIEHHQCPPPRKGKGHNHALLLVGFGTDSRGNKFWLVRNTWGAGWGRNGYALLRRGGDPQG

SEQ ID NO: 118775 - protein, 238 aa, Triticum aestivum
  Clone ID: PAT_TA_13193.pep
SARGPLGFVDVMASVVRRHSEWQWQTIVMGVAFLAVLLGTRQISARNPRLFWVSAAAPLTSVIVSTVISYFCRGHGISIIGDLPRGVNPPSMNMLVFSGAYVALAVKTGIMTGILSLTEGIAVGRTFASINNYNVDGNKEMMAIGVMNMAGSCASCYVTTGSFSRSAVNYSAGCRTAVSNIVMAAAVLVTLLFLMPLFHYTPNVILSAIIITAVAGLIDVRGAAKLWKVDKLDFCACV

SEQ ID NO: 118776 - protein, 106 aa, Triticum aestivum
  Clone ID: PAT_TA_13194.pep
SPVLLHHRACGHVALASYLLRPCAACYASHSLTQSFQSANTGSGCPLGTPATGRAPPGIQFPPPLLPSPASYFMACAYWGPCSRCPPRWPSEASELLSDAPASGRS

SEQ ID NO: 118777 - protein, 81 aa, Triticum aestivum
  unsure (1)..(81): unsure at all Xaa locations
  Clone ID: PAT_TA_13195.pep
TSSSLASLLARLASLANQDEPCHPPXXDSDVXCRDQSTCNDAVXXXLCERXGRETYSTRINSITSSXKXXEQDTXATIXSX

SEQ ID NO: 118778 - protein, 175 aa, Triticum aestivum
  Clone ID: PAT_TA_13196.pep
FFVFLFSPKILNRWTGLQTRARWARTCPTKHTPIWVPLYILAQRLKKKKRTRPKTRRLPRLAFRPPSPNAPPSSPPGQTPPPGRTSLPPTRPHRPLPLPPAPPPPLSSPLRRRAGRFAAVQPAVALALAGGRPACPSLGSPPWGFVSSSISFPAPPPRPPAFLMEQNIPYQHSLI

SEQ ID NO: 118779 - protein, 294 aa, Triticum aestivum
  Clone ID: PAT_TA_13197.pep
MDIMQTSDSSHHGIVENSPYTTPYDRRVEGDQLGASWYFSRKEIEENSLSRRDGIDLKKESYLRKSYCTFLQDFGMRLKVPQVTIATAIVFWSGFFLRQSHAKNDRQTIATVCMFLAGKVEETPRPLKDVVLISYEIIHKKDPAAVARIKQKEVYEQQKELLLIGERLVLVTLGFDMNVHHPYKPLVEAIKKFKVAQNALAQVAWNFVNDGLRTSLCLQFKPHHIAAGAIFLAAKFLKVKLPADGEKVWWQEFDVTPRQLEEVSNQMLELYEQNRVGPPPSQGNDTEGRSASVV

SEQ ID NO: 118780 - protein, 182 aa, Triticum aestivum
  unsure (1)..(182): unsure at all Xaa locations
  Clone ID: PAT_TA_13198.pep
ALLKLKIAQKELAQVAWSFXNDGLCTSLCLQFKPQHIAAGAIFLAAGCSTHTTPIKVTLPTEGVQVWCVDFDVTPWQLEEVSNQMMELYEQNRVGPPPSQGNNTKSSSASLADQHAAEKAPGVPRSLLPMKLIKHLDSRAYQAVTGMTTLSLKSRTQTRGYPRVKQGMALPTAMKAPICPHQ

SEQ ID NO: 118781 - protein, 100 aa, Triticum aestivum
  Clone ID: PAT_TA_13199.pep
SNHLTNSQKKETEPNRVPGPTPCLSSPPPQTKLSSHCRLPARRPGSLHRIVASLDGSLAVLHRIEASLPASLAALHRTVEWAAAPPSPSFLISVRQIASA

SEQ ID NO: 118782 - protein, 302 aa, Triticum aestivum
  unsure (1)..(302): unsure at all Xaa locations
  Clone ID: PAT_TA_13200.pep
GSPRRVFALRDAGHLAENATAYVSLEPCNHYGRTPPCTEALIKAKVKEVVVGMTDPNPIVASKGIENLRNAXAIDVGVGVEEALCLRXLNEAYIHRMLTGKAFATLRTTLSMNGTVINQIGSGADQPGGYYSQLAKEYDGVIISSDMAQGTTLPISREAGAKQPLYIIIAQGEGSEVHIPFLDEESASNAIVLADSPVTVEPSGVSVSVLDQMNLESILRLLADRGLCSVLVDFRDAGGVLVPLLSKFQEDKLVQKVVVELSPVWVVSPGPSDLAFGGSQSFALKNVEHKEVNGTLLLEGYL

SEQ ID NO: 118783 - protein, 191 aa, Triticum aestivum
  Clone ID: PAT_TA_13201.pep
SVRGEARSHESLTESGRSSRKAEGLRMADLYANLPAAPKTKDSREESGRFSGVFSSSGSPRHGISRSSRGPATQGARDDAYRALAVDEVAAPGARPGGRGGRGDGGGRSSHKSQDAAVGYLVHLLRSARPLRDPSNSSVTSRAESTEAGNTSSFMSRRTSDAFEELESFKDIKENLLSRSRSRMQDSFDRS

SEQ ID NO: 118784 - protein, 128 aa, Triticum aestivum
  Clone ID: PAT_TA_13202.pep
MRSPVNKDAQESVTIAVADEHMGSVIGRGGRIVNEISKVSGAWIDISGKGEFMPGARDREVIMRGTSEAIRAAEAMIMHRVSVASGNLMGRRVEGTSVKGLLTRLDEEEEDDDAVVQMHRLKLSDRTE

SEQ ID NO: 118785 - protein, 123 aa, Triticum aestivum
  Clone ID: PAT_TA_13203.pep
IVTSPPPATVGTPPATCSLRSGAGRVSCTSWCPRASAYAPSAAAPASSTSEPLTPELPACYHLFPRESLLARRGAISWLSWTTEDSVLCEEVPKSLPLIPGSCASVPMYGTREGKRPMSLLSL

SEQ ID NO: 118786 - protein, 175 aa, Triticum aestivum
  unsure (1)..(175): unsure at all Xaa locations
  Clone ID: PAT_TA_13204.pep
MEEERKGFQPHLMGLGGGSRLRGAAGAMGLQKQNSWSPDIERDEAWERRRRGILGRGRRSPLQRAQSVTDDQLDELRGSLDLGFRFDPPSQRCAACDAGRSRLVETLPALDLLYAVXRQRQRRGLRRRGPSPEASEPSPIGSPLSILSPDDPPETVKIRLEQWAQVVALSIRGPA

SEQ ID NO: 118787 - protein, 336 aa, Triticum aestivum
  unsure (1)..(336): unsure at all Xaa locations
  Clone ID: PAT_TA_13205.pep
HASDAAAADAVVSASASSGKKAKAAVVLRVPAVCSRRQALARREAAMRRAREAGRDYELVPTARGETLFTQSWWPHASSSVKPRALVLVMHGLNEHSGRYDHLAKRLNDMDVKVYGMDWTGHGGSDGLHGYVQSLDLAVQDMKMYLKKISAENPGVPCFCFGHSTGGGIILKAVLDPEVDALVNGIILTSPAVRVQPAHPXVAALAPVFALIAPRYQFTGSSKNGPAVSRGXRGREKPPSVPDSDDAVGPVRTGYEILRLTAYLQQHLRRGTVPRVGMCGADDMVTDPEGSRRLHREASTPDKDIRLYDGLLHDLLIEPEKEVVLGDIVDWLTPRI

SEQ ID NO: 118788 - protein, 154 aa, Triticum aestivum
  Clone ID: PAT_TA_13206.pep
IWVLYILQEAFQRRLEEAGDTELDPHVVWSEEVGGRNRRRYYGLPGIIDKGRIGNLSKSIPGSLGRKRRQLFTQDQVQEMINHATRQMNETWENRFQSLEKSMRGMASSDISQHASAAGPGAEDDEASHEHTSDSTDDGTYQSAEDDSGGHSGD

SEQ ID NO: 118789 - protein, 170 aa, Triticum aestivum
  unsure (1)..(170): unsure at all Xaa locations
  Clone ID: PAT_TA_13207.pep
AQAIGAAQEMLIYHVGSSTANPLIWRDMXQFFFEHFTRYPXNLAAGQAIKVAPMRIFGNMHQFNNNVERDMLLWGAGETLSPRARMLFSKYADKIIHLARMYQPYGFYGCRFDNANTKALFAEMSSEEKAQFHFDVRSIEWKEYFTNVHIPGFMKHVMKGRGTSPIVGNN

SEQ ID NO: 118790 - protein, 147 aa, Triticum aestivum
  unsure (1)..(147): unsure at all Xaa locations
  Clone ID: PAT_TA_13208.pep
RXMRELFPNFYTKEMLAGDDLKPFLPFSSRLAAVDFIVCDESDVFVTNNNGNMAKVLAGRRRYMGHKRTIRPNTRKLNVLFQTRNQTGWDTFSRKVKKIQRGLMGEPDDPRHGRDDFHEMPSSCICQRVPVNRSATIQTRNLLSQVR

SEQ ID NO: 118791 - protein, 110 aa, Triticum aestivum
  Clone ID: PAT_TA_13209.pep
GGQLAKPGAIIIRQRGTRVYPGNNVGMGKDHTLFSLIDGLVKFEKYGPDKKKVSVYPYEKEPENPNSYRARKREYFRMRRERKKARAEGAAEPQLVLAAVDENSEVSADC

SEQ ID NO: 118792 - protein, 185 aa, Triticum aestivum
  Clone ID: PAT_TA_13210.pep
MAFTLVGAFKGLSLASSSSFLRGDRAALPGGTTGGVGVATLPARGLTIQMAHKKGAGSTKNGRDSKGQRLGVKIYGDQLAKPGAIIIRQRGTKVYPGNNVGMGKDHTLFSLIDGLVKFEKYGPDRKKVSVYPYEKQPENPNSYRARKRENFRLQRERLKARAEGTYEPELVLAAADASVEVNADC

SEQ ID NO: 118793 - protein, 257 aa, Triticum aestivum
  Clone ID: PAT_TA_13211.pep
SAHASAKSGVKIETDAQATNQESASVDRAGVIEDLLTKLEACAKKLPSGFQMKPIQFEKDDDTNFHMDLIAGLANMRARNYGIQEVDKLKAKFIAGRIIPAIATTTAMATGLVCLELYKVLAGDHPVEDYRNTFANLALPMFSMAEPVPPKEMKHQDMRWTVWDRWSIKGNITVAELLKWLSDKGLTAYSVSCGTSLLYNTMFPRHKDRLKRKMVDVAQEVAKVDVPAYRKHFDVVVACEDDDGNDIDIPLISIYFR

SEQ ID NO: 118794 - protein, 111 aa, Triticum aestivum
  Clone ID: PAT_TA_13212.pep
VRIKHDILSRFIELGEAGGDDGGSLFGDDKGLRDVVLNFVIAGRDTTATTLSWFTYMAMTHPAVAEKLRRELAAFESERAREDGVALVPCSDGEGSDEAFFDRVGQFRGTP

SEQ ID NO: 118795 - protein, 349 aa, Triticum aestivum
  unsure (1)..(349): unsure at all Xaa locations
  Clone ID: PAT_TA_13213.pep
YPEKNEGLRQFDVNSVRAEVEITFDPEVVGLRSVVDIIDMESSGRLKAHVQNPYVRSSSNDAQEASKMLHLLRSSLFLSIQVFFMRMVCPHISFINSFLLMHCGPFRIGDLLKWMLVSVVQFVVGKRFYVAAYRALRHGSTNMDVLVVLGTTATYVYSVCALLYGAFTGFHPPMYFETGAMRVGGVLLGKYLEVLAKGRTSDAIKKLVELVPATAILLLKYKDGKYAGEKEIDALLIQPGDVLKVLPGSKIPADGIVTWGTSHVDESMVTGESAFICKEVSSSVIGGTMNLNGILHIQAAXVGSGTVLSPIISLVETAQMSKAPIQKFADYVCXIFVPIVITLSLLTFC

SEQ ID NO: 118796 - protein, 89 aa, Triticum aestivum
  Clone ID: PAT_TA_13214.pep
LYNKQVSCCCASWPPNCSVLAGNHFSLFSFLELTRCHHGPRRCTRYIINTASRFSEKISLRGSKFTLFAASNSHKCRLCSVCYISCHCC

SEQ ID NO: 118797 - protein, 140 aa, Triticum aestivum
  Clone ID: PAT_TA_13215.pep
GGSGQLILEPHGGAMGRIAADKIPFPHRSGVLYNIQYVELWNGKEAGGDVTPTPNWIGGLYDLMTPYVSKSPRGAYVNYRDLDMGVNKVVGGVTCYETAKVWGKRYFGPANFRRLAKIKRKVDRTDYFRNEQSIPPLPLN

SEQ ID NO: 118798 - protein, 113 aa, Triticum aestivum
  Clone ID: PAT_TA_13216.pep
AQARRMGEEGSGFTRAARGMDYVYEYMLNVLRQYSALLRYTPTVPERAVEVSLESMACPRRGREREFMMESREKCVAVDEPCTLPPPFTVDQVREMAVRDEQVRSKLLQMVRH

SEQ ID NO: 118799 - protein, 225 aa, Triticum aestivum
  Clone ID: PAT_TA_13217.pep
YSYIANKPHNAQAQSSSVSSASKAPISYLSSVSSASKAPASSASSVPQGRFTRKTNDDLPNFAVLDSQKAKDAVKSAVLDSQYEYEDEYDDSFDDLGFSVAESSYEEAEGANDAEGSSSGPRWSSQKKPQFYVKDGKNYSYKVAGSVAVSNAREAAVLNNTQKDTIHGLGRGGNLPIGGNLPMGVPNRQHRVVEEEEGGHANSFSRGGFESPLSVQGQKRWLGSW

SEQ ID NO: 118800 - protein, 281 aa, Triticum aestivum
  Clone ID: PAT_TA_13218.pep
PSHLPDDINSAPALAVEATYINQNFSQQVLVRDGEKVTFDEPNPFASENEEAAPVCYRYRRWKLDDDISIIARCEVHAAGVDPSGARQFLTLNALNEFDPKITGVDWKQKLESQRGAVLATELKNNANKLARWTAQALLSGADMMKLGYVSRVHPRDHFNHSILTVMGYKPRDFATQINLNTANMWGIVKSIVDICMKFEEGKYVLVKDPAKPQMRIYQVPNDAFENDYVEEPLPEEEQIRPATDDVDATAQEMDAAAEAEANKATTQGGDGEKSADAAAA

SEQ ID NO: 118801 - protein, 91 aa, Triticum aestivum
  unsure (1)..(91): unsure at all Xaa locations
  Clone ID: PAT_TA_13219.pep
GARGXQCXRRCPGQCDCXLPAGVPHPPGRRSTKWPPTPARRRRSEAGVRTQISRPNRSARQGTYVDGCNAAHAVAARDRHCMHACAALFFN

SEQ ID NO: 118802 - protein, 97 aa, Triticum aestivum
  Clone ID: PAT_TA_13220.pep
LHTRTRISKFKTMNSCTPASFKWLFFVLLGILNSGWEISSDQQCMLIVSHSKMCTMLILHQCICTTNGTYQCVFSYTLSTSIQSIRSVVIFGCQGCF

SEQ ID NO: 118803 - protein, 158 aa, Triticum aestivum
  Clone ID: PAT_TA_13221.pep
MAERLAPEKRHAFVHNGQKVFEWDQSLEEVNMYIELPKNVPTKLIQCVIQAGHVEVGIRGHPPYLNHDLMHPVKTDSSFWTIEDGELHITLQKREKGKAWASPIKGQGSLDPYAADQEQKRLMLQRFQEENPGFDFSQAQFSGTCPDPRTFMGGIHTD

SEQ ID NO: 118804 - protein, 94 aa, Triticum aestivum
  Clone ID: PAT_TA_13222.pep
QQQEPPLTGSQWLFLNSKNEQWFLHASSNSWPFSQLARRTHKFRGIGFVEPAWHDNRVVDIITRATKSRALVLFLISSMRNGFLFLYFYVCASP

SEQ ID NO: 118805 - protein, 223 aa, Triticum aestivum
  Clone ID: PAT_TA_13223.pep
PIPTQEQLLSAACRRRALSLVLVVLLLSATGAARVDGDTASSNAAALTSAAGGNSSAPTSAVDETIETYLCHICLGRDLLNRRVCPTYWPDCHALCDPHPPPAAGAVPAATPASPAVPNRDDPCYVVKIYNNGTHAVVQYLDCRLTRWCSLTCGGGDDVRALGAAATSPAPAAPSFLGHAAAARRRKAGVQLAGHGSGSTCPRWRARTLSARMNAHIWLCCDA

SEQ ID NO: 118806 - protein, 82 aa, Triticum aestivum
  Clone ID: PAT_TA_13224.pep
CLSPLAKEPSRHAKLFFYRCRDYRQPACQSAHDTTSSTHIRKMYFTHFSRFACSVFSTLGPTICQMKDTCMCDHLLLTHKYL

SEQ ID NO: 118807 - protein, 124 aa, Triticum aestivum
  unsure (1)..(124): unsure at all Xaa locations
  Clone ID: PAT_TA_13225.pep
NVESLYPSELGPXVMSTTDFFESGLANLDEXIEEKVKAASLRGNVLRLCLCXLERQGAQVGLQEVPKDSALGRLRGSDNVVEIYSRCYESSPLVIQGAGAGNDTTAAGVLADIIDLQDLFQARP

SEQ ID NO: 118808 - protein, 81 aa, Triticum aestivum
  Clone ID: PAT_TA_13226.pep
DYSLLGANQGIIMEGEGRIDYMYRSHNTTVQFDAHRIDTRSRSPPRYHSWGTDRQGMHLQPYRSRRTGTGGGTASPGRVGR

SEQ ID NO: 118809 - protein, 160 aa, Triticum aestivum
  Clone ID: PAT_TA_13227.pep
MPWPRGIHLLLCILTYNIEKTVSCVLSLGHKKEMGSGSTTVRLMAFASALVLLTHCTHAAAAPSFQQKQAAAKTWCVAKPSTGEAALRANLEFACSESDCSAIQGTGGCSAQNGGVLLSRASVAMNAYYQARGRNTWNCFFNATGIISITDPSLGTCKYA

SEQ ID NO: 118810 - protein, 75 aa, Triticum aestivum
  Clone ID: PAT_TA_13228.pep
RVCWSSPAPAIISTPGEHRKAPAYFSFCKGLSGEKLAVAKVEKLELFRKPRLSIRQVQIFPYFGCCGLPSIVHGP

SEQ ID NO: 118811 - protein, 148 aa, Triticum aestivum
  Clone ID: PAT_TA_13229.pep
FPVQEAPDLLHNLNQQALGGQHSSRSPSPPKQNADAGMRIKATFGSEKVRFRLKPECSFQELKQEMARRLSIVDTSFLIVKYLDDDLEWVLMTCDADLQECLHVYKLANLQTVKISVHLAPIPEARVTIGHTGLSMKDIIGLISLWGF

SEQ ID NO: 118812 - protein, 66 aa, Triticum aestivum
  Clone ID: PAT_TA_13230.pep
AWLQTVIHPNIGSLDSRVTLFFLAALEVIRRGLWNYDRLENEHLNNAGKFRAVKVVPLPFHEVEED

SEQ ID NO: 118813 - protein, 134 aa, Triticum aestivum
  Clone ID: PAT_TA_13231.pep
DEFLHQRLSFVRYVSAQKACIEALDGWLSKFILTDTICYSRGISLIAPDRDGTPPMVVITSGTPCCRRLDRSSRTSESGIGLGDGERSFSAAESWCQELTVDVESDLLNNYQFDLFACIQTVVHFCLSTVFSCS

SEQ ID NO: 118814 - protein, 113 aa, Triticum aestivum
  Clone ID: PAT_TA_13232.pep
YYRTASIGAPVQGFTDSRGRRRIRDDEAGRRKLGRCRGSRPAGEDESELLLFLVFAAVSVSQIYKSLAANRMQDAHLFSSFDLIYPCAGRNNGSSLCRRHLACSFIKSWPSQF

SEQ ID NO: 118815 - protein, 146 aa, Triticum aestivum
  Clone ID: PAT_TA_13233.pep
DSAPPKKLGASPIPFFPLAPLPVVSSGGAIPQVWRPWGLRGPGGGIPWPGRGQVGVAPHQQMCSQRMPVRSMLGKTAELGLQPPHGVGPLGLKPFFSGFVCGGNVDSVVGRGTTVRASVKHPLKKILPNHSPHLSPFVLKYSYSGG

SEQ ID NO: 118816 - protein, 86 aa, Triticum aestivum
  unsure (1)..(86): unsure at all Xaa locations
  Clone ID: PAT_TA_13234.pep
SSVIFAGSCLASCGCAHVDGAGAGDGAGARVPWRGEGEAAVGFGGATKRVLRGGPNGFYGEEERGGVVGXDXLLXAXGGALRXXLL

SEQ ID NO: 118817 - protein, 190 aa, Triticum aestivum
  unsure (1)..(190): unsure at all Xaa locations
  Clone ID: PAT_TA_13235.pep
MASASSAAASLRLLRRPIGLTPLRPGRRLLCVASPTAALATDGDSSPASSASMAQPTVVDVNPPRGTRDFPPEEMRLRSWLFDNFREVSRSMAFEEVDFPVLESEALFIRKAGEEITQQLYNFEDKGGRRVVLXPEITPSLARLVIKQGKSVSLPLKWFTXXQCWRYERMTRXXXREHYQWNMDIXXMPK

SEQ ID NO: 118818 - protein, 83 aa, Triticum aestivum
  Clone ID: PAT_TA_13236.pep
RPDNFAKLSEALYVAEQKAREAVQMRSKVQRELMLKEKERKEQELRALAQKARMERSGAPPPSTGMPVGGGRERERERVDDGD

SEQ ID NO: 118819 - protein, 361 aa, Triticum aestivum
  Clone ID: PAT_TA_13237.pep
MASPSGSAGDLAEPCGGASSTISPIRPMLSAAPPPTVLPSAWRWADAWAIAGAFGEGMMHPVDTLKTRLQSQAIMSGAKAQKNIFQMVRTVWASDGLRGFYRGISPGVTGSLATGATYFGVIESTKTWLENNNPNLSGHWSHFIAGGIGDTLGSFIYVPCEVMKQRMQVQGSSKSWALNATKGNVSQSPGTQMYGYYNGMFHAGSSIWRDHGVKGLYAGYGSTLARDVPFAGLMVTFYEGLKELTVYGKRKYLPDSDLQVSNSFEGLVLGGLSGGFSAYLTTPLDVIKTRLQVQGSTTRYDGWLDAVKKTWNAEGVNGLFKGSVPRIIWYIPASAFTFMAVEFLREHFNEKIDMDAETALN

SEQ ID NO: 118820 - protein, 130 aa, Triticum aestivum
  Clone ID: PAT_TA_13238.pep
PRRAAAREGLVRYVLEHPGAMWFVGPTFAALTGLVFKEGLCYGKLEAGILTFVIPILLLGHLSGLMDDGTKMSLLGVWMALFTVFAARKFQQPIKDDIGDKSVFIFNALPEEEKKALLQRLEAPTEQKFD

SEQ ID NO: 118821 - protein, 179 aa, Triticum aestivum
  Clone ID: PAT_TA_13239.pep
MATLVFDAAVLSRKDDIPPQFVWPADEAPSVDGVEEIAVPVVDIAGFLAGDGAATGGLRDLAAACEKHGFFQVVNHGVDPALLAKAYRCCDAFYALPLAEKQRAQRRLGENHGYAGSFVGRVGSKLPWKETVSFNCSAAPEGARKVVDYFVAVLGEEYRDIGKRCGKSTCERDDAPWRW

SEQ ID NO: 118822 - protein, 78 aa, Triticum aestivum
  Clone ID: PAT_TA_13240.pep
DPRRVSLRRRQDPVPLYRSPSLFFAHPPRSKTVAPWSLLVLEGRRGRLLPAIPRASINPARYESLFFFLCCNLIHMRV

SEQ ID NO: 118823 - protein, 244 aa, Triticum aestivum
  unsure (1)..(244): unsure at all Xaa locations
  Clone ID: PAT_TA_13241.pep
MDHQRRFNASRSKADIGAVHHARDVASRGSSASDPWNPQTTPPLRCTVCFTRHLLHDFCSQRQHPLISLLYSKTKQQNGRRSPHRRTPXPDSSQNRLPAEKAPTHRRRSVQVPGSAQNAGETEVSDEAAVKPPGQHFDSATPARRCQSGRASSDCVAVTSQSWSPPAHYPRLGRTKPNRTTSSGATARAASDRRTPPPSPPNRGFRVGPSLRSDSAPPPRHVQPPDVILDASPPHPCIADRSRL

SEQ ID NO: 118824 - protein, 94 aa, Triticum aestivum
  Clone ID: PAT_TA_13242.pep
MHACMQRTYCMHRDLCHGHGWMQPPPSPPAPPPSPPPPSPPPPPPSPPRPPPPPPTPPRPPPPPPSPPSPPEPPPRPPSPPEPPPRPPRPPAPP

SEQ ID NO: 118825 - protein, 207 aa, Triticum aestivum
  Clone ID: PAT_TA_13243.pep
FDSDEVEEEEEGADLGDLDVPGNGLLGGSSSVLRSARKHFDDDDELFEDSMSLKNFGISDACLATLSSQDIDFSASPKMPDRKLGSVDDDQKILEEAEEPTPPQIETYEQDDNAFQGMIRASKEEYDKLPPYMKTLASWEELHDAVSKLNAYFGGDKAQGSLNQDDVASIGLGRKGRSYLLILLRLNQLAMETIDGSIFYNLRKNDS

SEQ ID NO: 118826 - protein, 215 aa, Triticum aestivum
  unsure (1)..(215): unsure at all Xaa locations
  Clone ID: PAT_TA_13244.pep
MVLTRPPPGRDGVIDLPWLRRLAQKNVSSGRNASLPAARLEELCSDLDASEDVGDSRPARTVSDIGEVIRREKEWVRSNVSHQALPPRLHRSSSHRLPRAPSYTAQCGMPNVHDKFEAPESVADDVPPRSSRRSSPEIISEEDDVISSSTRRGDCNDPKPSDERTDGAIADLGAGIDEIKSACRPSRPSSQNEGNSXSXGTRRCXCWPNXRXLNA

SEQ ID NO: 118827 - protein, 644 aa, Triticum aestivum
  unsure (1)..(644): unsure at all Xaa locations
  Clone ID: PAT_TA_13245.pep
MWVQLSHLQGYPRVRGPKGYRGRVMLAFEENGSSKIGVRFDKQIPDGNDLGGLCEEDHGFFCSAELLRPDFSGSEEVERLAMTELIEVISEESKIGSLIVLLKDVEKSFTGITESFSSLRNKLELLPPGVLIIGSHTQMDSRKEKAHPGGFLFTKFASSSQTLFDLFPDSFGSRLHERNKESPKAMKHLNKLFPNKISIQLPQDEALLTSWKQQLDRDVETLKAKSNIGSIRTFLNRSAIECNDLEELFIKDQSLTNENVDKIVGYAVSYHLKHNKVETSKDGKLIITSGSLKHGLDMLQSIHSDNKSSKKSLKDVATENEFEKRLLADVIPPNDIGVTFDDIGALENVKETLKELVMLPLQRPELFCKGQLTKPCKGILLFGPPGTGKTMLAKAVATEAGANFINISMSSITSKWFGEGEKYVKAVFSXLASKISPSVIFIDEVDSMLGRRENPGEHEAMRKMKNEFMVNWDGLRTKDKERVLVLGATNRPFDLDEAVIRRFPRRLMVNLPDASNREKILKVILAKEELGQDTDLESLANMTDGYSGSDLKNLCVTAAHYPIREILEKEKKEKNVAKSEGRPEPALHGSEDVRPLSLDDFKSAHEQVCASVSSDSANMNELVQWNDLYGEGGSRKKKALSYFM

SEQ ID NO: 118828 - protein, 501 aa, Triticum aestivum
  Clone ID: PAT_TA_13246.pep
VPGFRFSRCSYLLSLLRPALIRELELERHGLGLLPRCPSSLAPCRDGRHRRRRRGPTRKRSHSGKFSNKDAEAYPRYEEQLEKFCKLMDFVIDSPPPELRQLYHASMVDRMKDKVDKSVFWSKLLGLVMQQGQQDMVNFFGLPLPPASSVSARWFEGDVLKATLATDAVIGTMAGVNTPGSGYVLLHHIMGETGGQRGVWAYVEGGMGSVSSAISKAALEAGVQIVTNAEVSQVMVDENTGKVQGVALADGTELHSSVVLSNATPYKTFVDLVPANTLLEEFLCAIKTADYSSATTKINVAVNALPQFRCCKNINPKGGPEHMGTIHIGSESMEEIDIAYKEAAGGFSSTRPVIEMTIPSVLDKTISPPGQHVINLFVQYTPYKLSEGSWQDPAVRKSFAERCFSLIDEYAPHFSSSVIGYDMLTPPDLEREFGLTGGNIFHGAMGLDSLFLMRPAKGWSDYRTPVKGLYLCGSGAHPGGGVMGAPGRNAAAVVLDDLKAR

SEQ ID NO: 118829 - protein, 126 aa, Triticum aestivum
  unsure (1)..(126): unsure at all Xaa locations
  Clone ID: PAT_TA_13247.pep
GPAPPLSLLARLALAQYKEAGLAVVRTVAEGLGLRECPSQNTKXGPCNGYLXERCLAVMGCSIARPLKRWXGAGEQEALAQCCRQLRPIAKQCRCEALWXAVQGNLRGIFGFQQGQTARQINRAKT

SEQ ID NO: 118830 - protein, 353 aa, Triticum aestivum
  Clone ID: PAT_TA_13248.pep
MSPAAAAARATSFAANFTTSTAPSSGGRLLRPFCGNPRPRRAVASMAVSAPKSPAAASFLERRESERALHFVKYQGLGNDFIMVDNRDSAVPKVTPEEAAKLCDRNFGIGADGVIFVLPGVNGADYTMRIFNSDGSEPEMCGNGVRCFARFIAEVENLQGTHSFKIHTGAGLIIPEIQDDGKVKVDMGEPILYGPDVPTKLPSTKNEAVVKAELAIDGLAWHVTCVSMGNPHCITFGSKELKVLHVDDLKLSDIGPKFEHHEMFPARTNTEFVEVLSRSHLKMRVWERGAGATLACGTGACAVVVAAVLEGRAERKCVVDLPGGPLEIEWREDNNHVYMTGPAEAVFYGSVVH

SEQ ID NO: 118831 - protein, 197 aa, Triticum aestivum
  Clone ID: PAT_TA_13249.pep
MESSKKNRGEIHRGDGRGRRVLAASLLAAAVVAAVIALALFLVYRPAKPQATVARAGVYRLVSAAAAPGANNSAPTPYALSATVQFTLLLHNPSDRTAVVYDRLLAYVTYRGEMVAPAGAAARWVLLWTPGGRRGRVSPPAGAAAGAAPHPYCVAARVPLRPVGMGRRGHLRGPVKGPCRVLVRAVRRRPPPHRPAS

SEQ ID NO: 118832 - protein, 255 aa, Triticum aestivum
  unsure (1)..(255): unsure at all Xaa locations
  Clone ID: PAT_TA_13250.pep
MEEHKPLAAMVVVQCIYAAMALWAKAMFSRGMNPMVFVVYRQAIATLVLVPITVLANRKRLKEILCIGTTGFALVFLASLVGATANQYMYYQGIYLGSSSMATAMTNLIPAITFVLATSVGRVPRRDLQAASRRHGTXAPPSCVRGASARSFLWGPKLLPGPLRVRGAGLGRLAPLPPDAPPGRYWGMGPLGLVGSCSCCSLWLFVRVPLCISYADPPTLSAWLGFLSPPLLALLNSFVLPDLDAWKINSLFELM

SEQ ID NO: 118833 - protein, 80 aa, Triticum aestivum
  Clone ID: PAT_TA_13251.pep
VASMSILMLLVSFDEVQGKCREERIKLSCDNWVKCFEWCRLFGGTKGYCDKGSCVCVNCFVQSSGHHSTEVPPPNSAHLE

SEQ ID NO: 118834 - protein, 153 aa, Triticum aestivum
  Clone ID: PAT_TA_13252.pep
RFGRANIAQVFLGGSYLGVETSERLEMSLLSPPPPPPPLLVTPYGSTGGGDSSVSIDPYVPLIVTLIIIAALMVASLVFANLCVKRWAFFNSSYATQSFVKQECGMCTREGTIDVAYPVMKGNVENVASEELVESDPPQNEEDDEDGSSEEGF

SEQ ID NO: 118835 - protein, 97 aa, Triticum aestivum
  Clone ID: PAT_TA_13253.pep
DSDETHLKTVVFKIFIGYEKQVNFARFFLVNAKALNKIEFEVYGACDAISVAYYHSLLQVEKRASQDAQVEFRSEYQRTGYDNHVHDLSVADPFGQP

SEQ ID NO: 118836 - protein, 253 aa, Triticum aestivum
  Clone ID: PAT_TA_13254.pep
RIRHETHPIPPRHPGSHRTRGVRVRQRPAREGRRSNRSSAMDRSLRKKEKMREREVRRGRRKREERGEGGAALTDGSRHGAADGHFDEIHHLSRFSSAPGCDEAAGGGENSMRGRYGGGSQPACLQPEEGSSGCELGGGSARPSHGAAAADSPPASFVVMWICMASDVALPMTHLELPFVTPVAGPVSSCACGRGRPGNRHQRRDAGRRLSPFRLRQLLIGRFLELISAKSLIFRCPPLSLPSLGCFSYIIIL

SEQ ID NO: 118837 - protein, 350 aa, Triticum aestivum
  Clone ID: PAT_TA_13255.pep
ILQYLGLRGNSLTGTLSPDMCQLTGLWYFDVRGNNLTGTIPQSIGNCTSFARPDISSNKISGEIPYNIGFLQVATLALQGNRLTGKIPEVIGLMQALAVLDLSENELVGAIPPILGNLSYTGKLYLHGNKLTGEVPPELGNMTKLSYLQLNDNELVGTIPAELGKLEELFELNLANNNLEGPIPTNIISCTALNKFNVYGNRLNGSIPAGFQNLESLTNLNLSSNNFKGHIPSELGHIINLDTLDLSYNEFSGPVPATIGDLEHLLQLNLSKNHLSGSVPAEFGNLRSIQVIDLSNNAMSGYLPEELGQLQNLDSLILNNNILVGEIPAQLANCFSLNILNLSHNNFSGH

SEQ ID NO: 118838 - protein, 76 aa, Triticum aestivum
  Clone ID: PAT_TA_13256.pep
ANKYSCLKYMVIRGTLYIDTTGYCTSISSRYSHCRYTCYILGTLLFISHTDTDNANTHELAETLQCVRPTVASRNN

SEQ ID NO: 118839 - protein, 125 aa, Triticum aestivum
  Clone ID: PAT_TA_13257.pep
DSARGSILIGCYFAPRVLTPIQCCRYERNTLIRHCFILFRQKGKKAISFNSLQAQSGLQTIEMQVVSRRLRTSIRYRHIHHIPCPPYIYRCTVRCMKLCLDMPWRRCTGHSEQRCLNRAPKGQGI

SEQ ID NO: 118840 - protein, 134 aa, Triticum aestivum
  Clone ID: PAT_TA_13258.pep
MGSAMDHVGAAGGRAKKASGGSQLWKKALLHSSLCFVMGFFTGFAPSSVSDWRSVAPAGVGSSHVVKTPQVIASGAAMDRSLLARDAAARIGGVPRPLLVVGTTTESTPTAAGERAAMLTRMAHTLRLVPPPLL

SEQ ID NO: 118841 - protein, 110 aa, Triticum aestivum
  Clone ID: PAT_TA_13259.pep
ELKSFHGGVHQGTSDVSSWLPQRRKSPMIINRYNRRIVYHGTYHPCTLVPHIFYKHFDNCRCHNHNLSRTYHDSKDESCTCTAGQLQQYRGRGRMLTPIETRLLPSCWPL

SEQ ID NO: 118842 - protein, 136 aa, Triticum aestivum
  Clone ID: PAT_TA_13260.pep
AAAFGTSYYFSYGESRLICLQDVDGEKSQSCKERGLLSLQRNTDVDSLSRPRFRSRCLRAWTPLATRFVETLRLRCRRFAHPAHRCRFVALVPPPVAVKSPITGSNPITPTVSESTRPRIAISATAINGRSPTRPN

SEQ ID NO: 118843 - protein, 87 aa, Triticum aestivum
  Clone ID: PAT_TA_13261.pep
CCNKSSDGCPVGGSMSKNFATINYRIVFLSNKEVLVRRTTAEPLMQAASSGRHAHWWQAILSPPLISSPWSVLLSHPAPRIRRPSAS

SEQ ID NO: 118844 - protein, 86 aa, Triticum aestivum
  Clone ID: PAT_TA_13262.pep
ATQIFRERLGHGTEGKLILASPQNLPMVACARNLAHATMQRKRHGKGGEGGRQRRAGPPPWPAGSAASTRAGLLPSPYRRPPPSSL

SEQ ID NO: 118845 - protein, 159 aa, Triticum aestivum
  Clone ID: PAT_TA_13263.pep
MDEPPVSTNARNRDPPRGHNPAGGAGDAQQVVNRARARREAELAAQHEARQLTPVRPTTSVEPGVTSRSLGVPCLVPALCNVRLPKDFKGLRELPYYSANLSPETWVESYEMAMEMLDVDDAACAKYFTMMLEGTTRTWLKSLPANSIRSWAELRARFF

SEQ ID NO: 118846 - protein, 122 aa, Triticum aestivum
  Clone ID: PAT_TA_13264.pep
FFFLTFCSKPATNPRIWRQRGRIWWMRGRTRRIRASTTTRWGLRRLDTFEVLPRAGEYRCSTLRRCQAPGAGGRETLSCRPPRGAATGRRSCCRTPLSDATGRRRCDHDDVPRQGTCSLSNF

SEQ ID NO: 118847 - protein, 173 aa, Triticum aestivum
  Clone ID: PAT_TA_13265.pep
MSSKQGTVKKLGDGHTVTILSGESKSSSSHMCSQNCGDKEILSTPSQDNMESDSCHACERHIYHPILPWINGDGSINSTVYEGLTRRIIGYVMQYPGTVEDDVIHKMDVWNPQTCRTLLEKLTLDKHLYVRVFEEPVPTAPTILQSLFSRDTCTQPCKRRRRCFSNSTSTFML

SEQ ID NO: 118848 - protein, 235 aa, Triticum aestivum
  unsure (1)..(235): unsure at all Xaa locations
  Clone ID: PAT_TA_13266.pep
MTVMPPARHRPAAKRPMWIIVLLCLVCVVLIGAYVYPPRHYSQCYLSASSVCTPFKDWLPSIGRREKTDDEIISAAVIRDILGMPMSTSKNPKIAFMFLTPGSLPFEKLWEKFLQGHEGRYSIYVHASRQKPVHTXSSLFVGRDIHSDAVVWGKDSMIDAEKRLLTNALEDADNQFLSCFPDXCVPLNQSXNVLXYLKGTNTISIDGPRSWPQWWKPLEMLPERRKGAMGCNHKA

SEQ ID NO: 118849 - protein, 193 aa, Triticum aestivum
  Clone ID: PAT_TA_13267.pep
MSTSTSGGGSLSPQAAAALQEGIGLVFGRWTALQMAVENKWGGPDSRAKADQLAASILSWFTNSKGPYYYEDLEDMMFDNIYKSLNSNFADGSIGEVAEQFLIMHEECLENNFSSIEKLRNTRPQGNAVSQSRQMVPEDDDDDSSDDGDEPSMGKDEAARSDDMVIDQPKPSKPTPDADGWTVVPPRRGRGKN

SEQ ID NO: 118850 - protein, 144 aa, Triticum aestivum
  Clone ID: PAT_TA_13268.pep
FFTFQVPGQDPGRHGPPADRWVEVPAVPGALIVNIGDLFQILTNGRFRSVYHRAVVNRDRERISLAYFLGPATDAKVGPLKEVVGGGRPAYRALTWPEYIIVRKEAFANGGADLEFTKGGTALEMVSINPDDHDGMDDQGDISS

SEQ ID NO: 118851 - protein, 312 aa, Triticum aestivum
  unsure (1)..(312): unsure at all Xaa locations
  Clone ID: PAT_TA_13269.pep
TGKRQNEAIALAWATKFATRDSIFDKNFSLLGTGDGKDTPLLLKEGQDVFKSYAHAXQARGFCQGVLATMEMRARHDLLSKLLELVFPRKDTITFEVVMNEDAMDHVMVAVARKKAAKAMQKEERDLQKFASVLAPAPAGKKWVADELAVVAESKEVAGDMITEAVLDQVLGEKAFEKMXKXFILLHFSDQLAGSXQEVLSFKFVLPDXKHMGDMTXLVALVPFYIDLVGRYKLSSHARSKTDAARTKAAQEAFRELQGVRQETLLRKKAEKKKLMEEAEAKLSAEVLRKKEEKERNRQMKKGAPKVKMLRS

SEQ ID NO: 118852 - protein, 417 aa, Triticum aestivum
  Clone ID: PAT_TA_13270.pep
MASAMELSLLNPAMHHHGIAAKTASHLPVLPARRGAVRFRVRAAAAAPPAPAAKPGSPKKRGKTEVNESLLTPRFYTTDFDEMEQLFNAEINKQLNQDEFDALLQEFKTDYNQTHFIRNPEFKEAADKMQGPLRQIFVEFLERSCTAEFSGFLLYKELGRRLKKTNPVVAEIFSLMSRDEARHAGFLNKGLSDFNLALDLGFLTKARKYTFFKPKFIFYATYLSEKIGYWRYITIFRHLKANPEYQVYPIFKYFENWCQDENRHGDFFSALLKAQPQFLNDWKAKLWSRFFCLSVYITMYLNDCQRSAFYEGIGLNTKEFDMHVIYETNRTTARIFPAVPDVENPEFKRKLDRMVDINLKIISIGESNDMPLVKNLKRVPLIAQLVSEIIAAYLMPSIESGSVDFAEFDAQACLLNL

SEQ ID NO: 118853 - protein, 144 aa, Triticum aestivum
  Clone ID: PAT_TA_13271.pep
ARGTYLENEYYFQGYWAEIVDKLDGVAARYRAAERRFGPALRRRHAEGDHALYAAARNAALRKKGGGVPGPDGGGQKASAWRRPFVTHFTGCNPCGGRPNEIYSNESCAEGMRRALNLADDQVLRAYGFRHAGPLKDDVRPLVA

SEQ ID NO: 118854 - protein, 114 aa, Triticum aestivum
  unsure (1)..(114): unsure at all Xaa locations
  Clone ID: PAT_TA_13272.pep
MSPSGPVRLLYSEIAIGVGQVHKYYQPSKSHRLVSAVIHGEKVPLYGAGGGLSLSGNDVTVPLTVDFELVSRGYVIGKLXVRVTHRVXVSCRIAVDAKRARTRIPKKACAVYKA

SEQ ID NO: 118855 - protein, 149 aa, Triticum aestivum
  unsure (1)..(149): unsure at all Xaa locations
  Clone ID: PAT_TA_13273.pep
IRHEGKPRGIRTARKHVNHXRREQRWADNDXXKANLGTRWKANPFXGASHAKGIXVLEKVGVEAKQPNSAIRKCVRVQLIKNGKKITAFVPNDGCLNYIEENDEVLVAGFGRKGHAVGDIPGVRFKVVKVARCFSLXALYKEKKERPRS

SEQ ID NO: 118856 - protein, 154 aa, Triticum aestivum
  Clone ID: PAT_TA_13274.pep
FLARTVGGTWSCMSHGEDRAPARGFTSAAITILWAGGCDFYRWQEAYAAHFGCCSAGSRARGSNPSGCRPTSGADQPTSSSSTTTEPRTGVEDIAAVMNQVVASLMGIIDGARQNGRSPGHAASINIGMSVAIFIIGVCTLVLLVAVILMRAQE

SEQ ID NO: 118857 - protein, 235 aa, Triticum aestivum
  unsure (1)..(235): unsure at all Xaa locations
  Clone ID: PAT_TA_13275.pep
ATRARVTIPLLFLLGTSLLFAAAVSASHDEEDDRRGGHSLQQCVQRCQQDRPRYSHARCVQECRDDQQQHGRHEQEEQGRGHGRHGEGGREEEQGRGRGRHGQGEREEEQGRGHGRHGQGEREEEQGRGRGRHGQEEREEHGRREQEEHGDSRRPYVFGPRSFRSIIRSDHGFVKALRPFDEVSRLLRGIRNYRVAIWEVNPRAFVVPGLTDADGVGYVAXGEGVLTVIENARSG

SEQ ID NO: 118858 - protein, 99 aa, Triticum aestivum
  unsure (1)..(99): unsure at all Xaa locations
  Clone ID: PAT_TA_13276.pep
WRGAYYFXFILCCCFCCLSLREDLSNVMCTVIDQRGECPSFVAVDVVVSFLCQLRAGLDGALSAHSRPIRACEKYAYLIYLSCVVIYASSPVQTSSSLG

SEQ ID NO: 118859 - protein, 157 aa, Triticum aestivum
  unsure (1)..(157): unsure at all Xaa locations
  Clone ID: PAT_TA_13277.pep
MATRGRATIPLLFLLGTSLLFAAAVSASHDEEEDRRGGRSLQRCVQRCQQDRPRYSHARCVQECRDDQQQHGRHEQXEEQGRGHGRHGEGEREEEQGRGRGRRGQGERDEEHGDGRRPYVFGPRSFRRIIRSDHGVXSRALRPFDEVSRLLRGIRNY

SEQ ID NO: 118860 - protein, 164 aa, Triticum aestivum
  Clone ID: PAT_TA_13278.pep
MTPLPHRQSATSAPVAAAAEMVVAVANGAKREATAAANTTAAAAADADSPISVLEEEKMSGSKDGKAGELKANGGEAHPIAEALKAEEELLNSVKDETSVEPLDATSPLPIDLAAKNGDTSLITEVMTKEEEEMYQARIKLEEEEDVRKREEAARQAFDPNAKF

SEQ ID NO: 118861 - protein, 155 aa, Triticum aestivum
  Clone ID: PAT_TA_13279.pep
VLEGEGEVEIVCPHLGRDSERREQEHGKGRWRSEEDEDDRRQQRRRGSGSESEEEQDQQRYETVRARVSRGSAFVVPPGHPVVEIASSRGSSNLQVVCFEINAERNERVWLAGRNNVIAKLDDPAQELAFGRPAREVQEVFRAKDQQDEGFVAAL

SEQ ID NO: 118862 - protein, 103 aa, Triticum aestivum
  unsure (1)..(103): unsure at all Xaa locations
  Clone ID: PAT_TA_13280.pep
RYETVRARVSHGSAFVVPPGXPVVEIASSRGSSNLQVVCFEINAXRNERVWLAGRNNVIGKLDNPAQELTFGRPAREVQEVFRAKDQQDEAVEGFLRMATAAL

SEQ ID NO: 118863 - protein, 100 aa, Triticum aestivum
  unsure (1)..(100): unsure at all Xaa locations
  Clone ID: PAT_TA_13281.pep
ARATTYLCYSRVLTNLHTHTSSALKWHGLQLTHSLNNSGLAASERGGCHPQERLHGFVLLILGAEHLLHLPRGPAEGEXPGRGRPACHHVVLPGATPGCS

SEQ ID NO: 118864 - protein, 121 aa, Triticum aestivum
  Clone ID: PAT_TA_13282.pep
DVVCNPLGKSGGALIQQFMILSFGSLANSTPYLGGILLVIVIAWLGAVRSLDSQFSPLAKQDLEREQKLKAEAVETTAQVVGTGNGSLQENVASQNSTNGTVIKQSQEPEITAPEKSGKQS

SEQ ID NO: 118865 - protein, 275 aa, Triticum aestivum
  Clone ID: PAT_TA_13283.pep
RAEFGTRLRSASLLPLRRSPLHSSGFQPRAAMASDAASQFQKIQIQREDTTFDVYVVGKENAPGVVVLQEWWGVDYEVKNHAIHISQIGDGYRALIPDLYRGKVALEVAEAQHLMEGLDWQGAIKDIQASVKWLKENGSPKVGVTGYCMGGALAIASGVLVPEVDAVVAFYGTPSSELADASKAQAPIQAHFGELDSFVGFADVTAAKSLEEKLKASGVAHEVHIYSGCSHAFMNASPEALKRRKGMGLTDENQGAIDLAWSRFSTWMGRFLGSA

SEQ ID NO: 118866 - protein, 214 aa, Triticum aestivum
  Clone ID: PAT_TA_13284.pep
MAIRATIPLLFLLGTSLLFAAAVSASRDDEEDRRGGHSLQQCVQRCQQDRPRYSHARCVQECREDQQQHGRHEQEEQGHSHGRHGEGGREEEQGRGRGRHGEGEREEEEGRGRGRHGEGEREEHGRHEQGRGRRGEGERDEEHGDSRRPYVFGPRSFRSIIRSDHGFVKALRPFDEVSRLLRGIRNYRVAIMEVNPRSFVVPGLTDADGVGYVA

SEQ ID NO: 118867 - protein, 357 aa, Triticum aestivum
  Clone ID: PAT_TA_13285.pep
SARGTDGRRKLVIAKILHTISVPGKFQYFSAKPLLASLSKRVLRAALKTSDEQLDRLLFGRRQGQEEEESISIVRASEEQLRELRREASEGGQGHHWPLPPFRGDSRDTYNLLEQRPKIANRHGRLYEADARSFHALAQHDVRVAVANITPGSMTAPYLNTQSFKLAVVLEGEGEVQIVCPHLARDSERHKQGKQGRWSEEEDDAQRQQRRRGSGSESESSEEEQDQQRYETVRARVSRGSAFVVPPGHPVVEIASSRGSSNLQVVCFEINAERNERVWLAGRNNVIGKLDNPAQELTFGRPAREVQEVFRAKDQQDEGFVAGPEQQEQERGDRRRGDRGRGDEAVEAFLRMATAAL

SEQ ID NO: 118868 - protein, 194 aa, Triticum aestivum
  unsure (1)..(194): unsure at all Xaa locations
  Clone ID: PAT_TA_13286.pep
RYPCAYDDGWTALKWAQAQPFLRSGEDAQLRVFLAGDSSGGNIAHHVXAVRAAEEGIKIHGNILLNAMFGGNERTESERRLDGKYFVTLQDRDWYWKAYLPEDADRDHPACNPFGPNGRRLKGLPFAKSLIIVSGLDLTCDRQLGYAEGLREDGHDVKLVHREKATIGFYLLSNTDHYHEVMEEIAEFVRANLL

SEQ ID NO: 118869 - protein, 726 aa, Triticum aestivum
  Clone ID: PAT_TA_13287.pep
MAVGDPGALLQEKTGGSMSIVRASEEQLHELSRQASEGSQGHHWPLPPFRGDSRDTYNLLEQRPRIANRHGRLYEADARSFHALAQHDVRVAVANITAGNSPTFSAPMESGLVASHRLRLPALPSAAHAHLLRHRRLVATPLRLPTTPTPLRQPAALPLRPCLRPPRAASVASPAPVPGDAPDNSRKFLGVDALTLKKIVPLGLMFFCILFNYTILRDTKDVLVVTAKGSSAEIIPFLKTWVNLPMAIGFMLLYSKLADVLSKEALFYTVIFPFIAFFGVFGYVLYPMRDAIHPTALADRLLASLGPSFLGPVAILRVWSFCLFYVMAELWGSVVISVLFWGFANQITTVEEAKEFYPLFGLGANVALIFSGRTVKYFSNMRQNLGPGVDGWAISLKGMMSIVVVLGFVIAGIYWGVNKYVIDKTSLPVERKKKNKPKLSMGESLKVLVSSQYVRDLATLVVAYGISINLVEVTWKSKLKAQFPSPNEYSSFMGDFSTATGIATFTMMLLGRLILRKFGWGVAATITPAVLLVTGVGFFSLLLFGEPLTPLLATFGMTPLLAAVFVGALQNIFSKSAKYSLFDPCKEMAYIPLDEDMKVKGKAAIDVVCNPLGKSGGALIQQFMILSFGSLANSTPYLGGILLVIVIAWLGAVRSLDSQFSPLAKQDLEREQQLKAEVVETTAQVVGTGNGSLQENVASQSSTNGTVIKQSQEPEITAPEKSGKQS

SEQ ID NO: 118870 - protein, 455 aa, Triticum aestivum
  unsure (1)..(455): unsure at all Xaa locations
  Clone ID: PAT_TA_13288.pep
MTRRRTGAVGARTTVRDCLPGFSCPLGREGGGIRSRRRSPAAGLLPEDSAGGIHLALLGGPHAVSEAASAILCSPGRSCSCLQQLRAEGRHREEAPPADMAGSDEVNRNECKTVVPLHTWVLISNFKVSYHMLRRPDGTFERDLAEYMDRRVPANPRPVEGVSSFDHFIDLSVGLEARIYRAVAGNAAGAAEGAAALTLPILEFLGGAPSPDPLPVIIFFHGGSFAHSASSTTIYDNLCRQLVKLSKGVVVSVNYRRAPEHRYPCAYDDGWTALKWAQAQPFLRSXSDAQLRVFLAXGDSSGGNIAHHVAVRAAEEGIKIHGNILLNAMFGGVERTESERRLDGKYFVTLQDRDWYWKAYLPEDADRDHPACNPFGPNGRRLRGLPFAKSLIIVSGLDLTCDRQLGYAEGLREDGHDVKLVHREKATIGFYLLSNTNHYHEVMEEIAEFVRANLL

SEQ ID NO: 118871 - protein, 613 aa, Triticum aestivum
  unsure (1)..(613): unsure at all Xaa locations
  Clone ID: PAT_TA_13289.pep
MATRARVTIPLLFLLGTSLLFAAAVSASHDEEEDRRGGRSLQQCVQRCHQDRPRYSHARCVQECRDEQQQHGRHEQEEQGHSHGRHGEGGREEEQGRGXVGRHGQGEPEEEEGRGRGRHGEGEREEHGRHEQGRGRRGEGERDEEHGDSRRPYVFGPRSFRSIIRSDHGFVKALRPFDEVSRLLRGIRNYRVAIMEVNPRSFVVPGLTDADGVGYVAQGEGVLTVIENGERRSYTVRQGDVIVAPAGSIMHLANTDGRRKLVIAKILHTISVPGKFQYFSAKPLLASLSKRVLTAALMTSDEQLGRLLFGRRQGQEEEESISIVRASEEQLRELRRQASEGGQGHHWPLPPFRGDSRDTFNLLEQRPKIANRHGRLFEADGRSFHALAQHDVRVAVANITPGSMTAPYLNTQSFKFAVVLEGEGXEVHIVCPHLARDSEXREHEHGKGRRSEEEDDDQRQQRRRRGSGSESESESEEEQDQQRYETVRARVSRGSAFVVPPGHPVVEIASSRGSSNLQVVCFEINAERNERVWLAGRNNVIGKLDSPAQELTFGRPAREVQEVFRAKDQQDEGFVAGPEQQSRHEQEQERRRGDRGRGDDAVGAFLRMATGAF

SEQ ID NO: 118872 - protein, 275 aa, Triticum aestivum
  Clone ID: PAT_TA_13290.pep
MATARLLLRSASLLPLRRSPLHSSRFQPRAAMASDAASQFQKIQIQREDTTFDAYVVGKENAPGVVVLQEWWGVDYEVKNHAIHISQIGDGYRALIPDLYRGKVALEVAEAQHLMEGLDWQGAIKDIQASVKWLKENGSPKVGVTGYCMGGALAIASGVLVPEVDAVVAFYGTPSSELADASKAQAPIQAHFGELDSFVGFADVTAAKSLEEKLKASGVAHEVHIYPGCSHAFMNASPEAVKRRKGMGLTDENQGAIDLAWSRFSTWMGRFLGSA

SEQ ID NO: 118873 - protein, 603 aa, Triticum aestivum
  Clone ID: PAT_TA_13291.pep
MATRARVTIPLLFLLGTSLLFAAAVSASHDEEEDRRGGRSLQQCVQRCHQDRPRYSHARCVQECRDEQQQHGRHEQEEQGRGHGRHGEGGREEEQGRGRGRHGQGEREEEEGRGRGRHGEGEREEHGKHEQGRGRRGEGERDEEHGDSRRPYVFGPRNFRSIIRSDHGFVKALRPFDEVSRLLRGIRNYRVAIMEVNPRSFVVPGLTDADGVGYVAQGEGVLTVIENGERRSYSVRQGDVIVAPAGSIMHLANTDGRRKLVIAKILHTISVPGKFQYFSAKPLLASLSKRVLRAALKTSDEQLDRLLFGRRQGQEEEESISIVRASEEQLRELRREASEGGQGHHWPLPPFRGDSRDTFNLLEQRPKIANRHGRLFEADARSFHALAQHDVRVAVANITPGSMTAPYLNTQSFKLAVVLEGEGEVQIVCPHLGQDSEREHEHGKGRRSEEEEDDQRQQRRRGSGSESEEEQDQQRYETVRARVSRGSAFVVPPGHPVVEIASSRGSSNLQVVCFEINAERNERVWLAGRNNVIGKLDNPAQELTFGRPAREVQEVFRAKDQQDEGFVAGPEQQEQERGDRRRGDRGRGDEAVEAFLRMATAAL

SEQ ID NO: 118874 - protein, 608 aa, Triticum aestivum
  Clone ID: PAT_TA_13292.pep
MATRARVTIPLLFLLGTSLLFAAAVSASHDEEEDRRGGHSLQQCVQRCQQDRPRYSHARCVQECRGDQQQHGRHEQEEQGRGRGRHGEGEREEEQGGGRGRHGEGEREEEEGRGRGRHGEGEREEHGRHEQGRGRRGEGERDEEQGGSRRPYVFGPRNFRSIIRSDHGFVKALRPFDEVSRLLRGIRNYRVAIMEVNPRAFVVPGFTDADGVGYVAQGEGVLTVIENGEKRSYTVRQGDVIVAPAGSIMHLANTDGRRKLVIAKILHTISVPGRFQYFSAKPLLASLSKRVLRAALKTSDEQLGRLLGRRQGKEEESRSISIIRASEEQLRELSRQASEGGQGHHWPLPPFRGDSRDTFNLLEQRPKIANRHGRLYQADARSFHALAQHDVRVAVANITPGSMTAPYLNTQSFKLAVVLEGEGEVEIVCPHLGRDSERREHGKGRWSEEEEDDRRQQRRHGSGSESESEEEQDQQRYETVRARVSRGSAFVVPPGHPVVEISSSQGSSNLQVVCFEINAERNERVWLAGRNNVIAKLDSPAQELTFGRPAREVQEVFRAKDQQDEGFVAGPEQQSHEQEQERGDRRRGDRGRGDDAVGAFLRMATGAF

SEQ ID NO: 118875 - protein, 495 aa, Triticum aestivum
  unsure (1)..(495): unsure at all Xaa locations
  Clone ID: PAT_TA_13293.pep
MATRARVTIPLLFLLGTSLLFAAAVSASHDEEEDRRGGRSLQQCVQRCHQDRPRYSHARCVQECRDEQQQHGRHEQEEQGRGHGRHGEGGREEEQGRGRGRHGQGEREEEEGRGRGRHGEGEREEEEGRGRGRHGEGEREEHGKHEQGRGRRGEGERDEEHGDSRRPYVFGPRNFRSIIRSDHGFVKALRPFDEVSRLLRGIRNYRVAIMEVNPRSFVVPGLTDADGVGYVAQGEGVLTVIENGERRSYTVRQGDVIVAPAGSIMHLANTDGRRKLVIAKILHTISVPGKFQYFSAKPLLASLSKRVLTAALKTSDEQLGRLLFGRRQGQEEESSISIVRASEEQLRELRRQASEGGQGHHWPLPPFRGDSRDTFNLLEQRPKIANRHGRLFEADARSFHALAQHDVRVAVANITPGSMTAPYLNTQSFKLAVVLEGEGEVQIVCPHLGQDSEREHEHGKGRRSEEEEDDQRQQRRRGSGSEXSGEEQDQQRYET

SEQ ID NO: 118876 - protein, 627 aa, Triticum aestivum
  Clone ID: PAT_TA_13294.pep
MATRARVTIPLLFLLGTSLLFAAAVSASHDEEDDRRGGHSLQQCVQRCQQDRPRYSHARCVQECRDDQQQHGRHEQEEQGRGHGRHGEGGREEEQGRGRGRHGQGEREEEQGRGHGRHGQGEREEEQGRGRGRHGQEEREEHGRREQEEQGQGRGRRGEGERDEEHGDSRRPYVFGPRSFRSIIRSDHGFVKALRPFDEVSRLLRGIRNYRVAIMEVNPRAFVVPGLTDADGVGYVAQGEGVLTVIENGEKRSYTVREGDVIVAPAGSIMHLANTDGRRKLIIAKILHTISVPGMFQYFSAKPLLASLSKRVLRAALKTSDERLERLLDPRQGQEKTGGSMSIVRASEEQLHELSRQASEGSQGHHWPLPPFRGDSRDTYNLLEQRPRIANRHGRLYEADARSFHALAQHDVRVAVANITPGSMTAPYLNTQSFKLAVVLEGEGEVQIVCPHLGRDSERREQGKGRWSEEEDDDQRQQRRRGSGSESESESEEQQDQQRYQTIRARVSRGSAFVVPPGHPVVEIASSQGSSNLQVVCFEINAERNERVWLAGRNNVIGKLDNPAQELTFGRPAREVQEVFRAKDQQDEGFVAGPEQQEQERGDRRRGDRGRGDEAVEAFLRMATAAL

SEQ ID NO: 118877 - protein, 588 aa, Triticum aestivum
  Clone ID: PAT_TA_13295.pep
MATRGRATIPLLFLLGTSLLFAAAVSASHDEEEDRRGGRSLQRCVQRCQQDRPRYSHARCVQECRDDQQQHGRHEQEEQGRGHGRHGEGEREEEQGRGRGRRGQGEREEEQGRGRGRRGEGERDEEHGDGRRPYVFGPRSFRRIIRSDHGFVKALRPFDEVSRLLRGIRNYRVAIMEVNPRAFVVPGLTDADGVGYVAQGEGVLTVIENGEKRSYTVRQGDVIVAPAGSIMHLANTDGRRKLVIAKILHTISVPGKFQYFSAKPLLASLSKRVLTAALKTSDERLGSLLGSRQGKEEEEKSISIVRASEEQLRELRRQASEGDQGHHWPLPPFRGDSRDTFNLLEQRPKIANRHGRLYEADARSFHALAQHDVRVAVANITPGSMTAPYLNTQSFKLAVVLEGEGEVEIVCPHLGRDSERREQEHGKGRWRSEEEEDDRRQQRRRGSGSESEEEQDQQRYETVRARVSRGSAFVVPPGHPVVEIASSRGSSNLQVVCFEINAERNERVWLAGRNNVIAKLDDPAQELAFGRPAREVQEVFRAKDQQDEGFVAGPEQQQEHERGDRRRGDRGRGDEAVEAFLRMATAAL

SEQ ID NO: 118878 - protein, 217 aa, Triticum aestivum
  unsure (1)..(217): unsure at all Xaa locations
  Clone ID: PAT_TA_13296.pep
ITVMMMAPAAFRRHRKQGGESPPSSSSSFCSLTFSLDGRRVSPMVHGLHGVGGXEPLRDWICLSVFLCFCIFXSALSPFLIYSEIRNSDWIETFAHIFLRKXLSCGQRRAATALQGSHEGQGCTCPPPPQXRAPGAGRAQGGPGAPRGEGAAPLSRGHLGHRFALILPPENPKYSKXFSVRLYPVWTPFDMGFLRNIKHATDRNWHWALDQYVSPKK

SEQ ID NO: 118879 - protein, 241 aa, Triticum aestivum
  Clone ID: PAT_TA_13297.pep
MMEHTAVGEDQAMSDLRDKHRLDLESLTLTSQPFKTLALFVLAIGQSIRSTCSCVLKEGSRLKFLVPLLGATCVLLLVTDGPHEKHMQELLWYARFGLWWVVLGVASSIGLGSGLHTFVLYLGPHIALFTMKAVQCGRVDLKSAPYDTILLKRRPSWLEKDCLEFGPPIYQETIPFSKILHEVHLEAVLWGIGTALGELPPYFISRALACRPHGACGRAGPLWLSGGWGSSTHPRLLMHIF

SEQ ID NO: 118880 - protein, 84 aa, Triticum aestivum
  Clone ID: PAT_TA_13298.pep
RLAPLPAAPLRRDELRRPDSSVAAAASLSCLACPRPPRPEALQTHKVADLQWQRDGSCKLVWPRLVTLRLYMEEVGTDANYGVK

SEQ ID NO: 118881 - protein, 227 aa, Triticum aestivum
  Clone ID: PAT_TA_13299.pep
RHLLRLPPVRSHPCYTIPFGFGGCRRHKRKKNIGRMSASLLARRFLHKERRHSSPWTQGSSCEPMGFEEIIDETMLAGKLEVIEHSDSCSEGDPGSPVGLSIGKSFGTAPANAVTKRLSQECSAESSNGAKLKPTTGQFCPDVVDARSGWTVDANHVLNKIEALGDISTAMAMLVNKTCTYGGPDHTMFMEKIFEHEKMIFELRLDCQKAKTKRLNFSIGNLSTRQN

SEQ ID NO: 118882 - protein, 50 aa, Triticum aestivum
  Clone ID: PAT_TA_13300.pep
TVHEVTSHAFIVSYKAVSFSIDCSTVFTWKRSKSFSTAVAVERIRPIGSS

SEQ ID NO: 118883 - protein, 230 aa, Triticum aestivum
  Clone ID: PAT_TA_13301.pep
PANSRLLAGLAAMATSHMTTTVFSAIVIILLSSAMAAQSSGDVGGKKPKPTDFMLEACKNASNWSKSYNEGYNYVTAEFCISTLLSDNRSADAKDRRDLALIPVDILKERVVIAGGNVKKMLHSTKNSTSTTARHLRTCELDYTATAGILNFCDALMRDYQGDRRSEDEDNDGPLNFELPECVDEANEAWGYCGLALLHIPGAEALVKEGDELQMLMNLSIALLSPYRLD

SEQ ID NO: 118884 - protein, 215 aa, Triticum aestivum
  Clone ID: PAT_TA_13302.pep
IRHEKYFTAREQFRRHQEFDRYLASGELDDDVYKFSSSQDKSVLQFVEKNNVKSRFGNLDDKLIKLSLEDRAQIVDTIRQVDIYSENLKNITADDKLKVCLQNLVHELKEEGFFNVDNDSIDWEKTCFVSLIDEFKELVFKGHGCPRYVAIQGIMEYWIISQRSDINGQVAFEKVIEGVCHTWKKNIAELWMDTRYYEESCYDLLRNPLKKILPK

SEQ ID NO: 118885 - protein, 207 aa, Triticum aestivum
  Clone ID: PAT_TA_13303.pep
MAKKGAGGEESVVVPGQTEEAKQGPPRKRNPCPGIRCVGGRIYDPENGKTCHQCRQKTMDFSVACTQPRKKGLCPIHFCHKCLLNRYGENAEDMTKEAGWTCPKRCGRGNCSFSRKKKGETPTGLLAHAAKASGHSSVHDLLIKGSDMVVAAQTLSSLPKKIKKERKEGSLKRALGIDDANGGLFAEGDENIKTDLNALPSVPIQKK

SEQ ID NO: 118886 - protein, 145 aa, Triticum aestivum
  unsure (1)..(145): unsure at all Xaa locations
  Clone ID: PAT_TA_13304.pep
LADLFTEAGLQKGRVARPYAAPAEWGHWPRPSVDGGTLGGPTRDPPPSPRPRTPPPPFAPPAPPAAVVRRRPSAARRRGAGGPGSRPASCRPSPRRPPRASPGGPPASAAPPPRLPPSXSRPPGAPAPCLPPRARCCLPLFYPGL

SEQ ID NO: 118887 - protein, 97 aa, Triticum aestivum
  Clone ID: PAT_TA_13305.pep
FGTRGRKKIVPTLLMALTKNNTNALCLVILMMSTTLLPCEATGRNKGTPALIDVCKRDRLCENPIGYNVTLCKVSCEWSGYSFDNSYCEEGKCCCAS

SEQ ID NO: 118888 - protein, 152 aa, Triticum aestivum
  Clone ID: PAT_TA_13306.pep
MLPVCRPSAVYPVAVVAPPPQVGLADAPPPEVWTRIPQGTPGTLGGVGLRLLQALFAAASIAVMASTDIFPFCSAFSYLIAATSLQCLWSIALAFVYIYALLVKCSLLNLRAVRIFFVGDWITGTVTLSAACASAGITILIDNDVKYCEALP

SEQ ID NO: 118889 - protein, 105 aa, Triticum aestivum
  Clone ID: PAT_TA_13307.pep
MLQQPPFHIAKTNYESLTLYGASKAKVKCDRHAHRKVFIQQLFRLHSKKAQPTVDERFVHSLHTGRQLRRQQPIIGSALAGAVHPYHCVTYVEYAHHSDRSPPCQ

SEQ ID NO: 118890 - protein, 118 aa, Triticum aestivum
  Clone ID: PAT_TA_13308.pep
MYVVGTIINVVGRDVPLPQAGFLPQLGGGRYIRLYPGSVSEDLYPHTETMLSNTSQVDLDNIDMNEFPKVENLDFMDCILEEGDMLYIPPKWWHYVRSLSISFSISFWWRTTVISPSA

SEQ ID NO: 118891 - protein, 93 aa, Triticum aestivum
  Clone ID: PAT_TA_13309.pep
RQLQAPNQAEGAPPSSPLSRQSRAKVVVVDSREVVVLRPHRTSTAEQKPPPMRSTIDRKDPTQRNTNIDELQSDPSKFIKDRLVGDTTSHVHR

SEQ ID NO: 118892 - protein, 100 aa, Triticum aestivum
  Clone ID: PAT_TA_13310.pep
HASAHASAVGERAGQRRGQVHQRRWPAMSPPTSHPPSSPYWSFARSTRPPPSAPPRSPARPTRPPPSAPSGSSARATRRPPWAGPPISAPTTQSTWHTIE

SEQ ID NO: 118893 - protein, 81 aa, Triticum aestivum
  Clone ID: PAT_TA_13311.pep
MRSLSLASCSIHGQCKSRLLPQTVKFDDRSTEVDCRQVFSHCMMRAFSFAIQIRTWVSNDRVRLSLQGTLSDSAELVAGDV

SEQ ID NO: 118894 - protein, 117 aa, Triticum aestivum
  Clone ID: PAT_TA_13312.pep
VPAPKPPAASPAPKQTPSPSASPVPKPPAPRAPAQAPKPSSPAAPAASPVPKPPTPRAPAQAPKPPSPPPPASSAPKPSPVAPAPAQKPSPPTTPPPPPPQKPSAPPTPPPAPTQPP

SEQ ID NO: 118895 - protein, 175 aa, Triticum aestivum
  unsure (1)..(175): unsure at all Xaa locations
  Clone ID: PAT_TA_13313.pep
MATAEGKNKIIKLKSSDGKEFEVEQAVAMESQMIRHMIEDEYTDNGLLLRSVNSKILSKVIEYCNKHVQAKAADTSDFGGGARPLGATSAXCAPAKDLKNWDANFVKVDTATIFDLALAANHLNIRGLLDLTCQTVADMITGKTPEEIRKIFNINEKLRPEEEEKIRRENQWAFE

SEQ ID NO: 118896 - protein, 315 aa, Triticum aestivum
  Clone ID: PAT_TA_13314.pep
AGEFLQSSQFFVGGRCWRIYYYPNGKDSETVDYISFYLKLDEIVTEDVKTMFTINFAKVLGKRLSWPSASTTGYVFGGKQMWGYPNFIKRENLEKSEHLKDDSFTIRCDVVVVHDICTKQTSTPKFVFVPPPELNQHLGDLLKTEKGADVVFEVGGEMIPAHRCVLASRSPVFSAELFGVMKEGDTASVIHIDDLEAQVFKELLYVAYTDSLREAKEEEEDIMCQHLLIAADRYNMERLKLICEEKLCKYIDAGSVPTILALAEQYHCNGLKKACFDFLSCPAHRRAVVATDGFKNLCKSFHSLVMELIAMPSPP

SEQ ID NO: 118897 - protein, 141 aa, Triticum aestivum
  Clone ID: PAT_TA_13315.pep
VGRHPARPRAAPTRSADVPRRASLAASVSHSRSPSIAMQHRGHSSSSHEIRKEQPAAIARACFLHYCMAVPPSIDRQKPGGLDFHTACINQSAGNQENLPHLKNAKGGHTNTPRQGDLLAALLLKSAGILPRFPLLLRPIG

SEQ ID NO: 118898 - protein, 140 aa, Triticum aestivum
  unsure (1)..(140): unsure at all Xaa locations
  Clone ID: PAT_TA_13316.pep
PMNVHKIEDSADDWGQRPMWLSWWTMGSTGRGVRIFVFFSPRRGRAEVXSPGPAAPATSGDAPTTRTDQGDEPRPSVQDAGFEGGRDESTIDHGRRPMTVKMELGLWCSSDEAKGWGGSACSGGSTGGERRRGGGSERVN

SEQ ID NO: 118899 - protein, 98 aa, Triticum aestivum
  Clone ID: PAT_TA_13317.pep
LVPNSARAPLARSPCDRWRRPPPPASTSVRCISVRRPDSAAPRALPQENRLHSPSLRQQRRRRTGRHPSPLCLKASITSGDDDGQEVTLLSPRCCIMS

SEQ ID NO: 118900 - protein, 57 aa, Triticum aestivum
  Clone ID: PAT_TA_13318.pep
EIAHLFPNLRGCLGTLIHNTETLERFQHGLSCHTVHMSIIFLSKSGQNAYFEAGSWM

SEQ ID NO: 118901 - protein, 125 aa, Triticum aestivum
  Clone ID: PAT_TA_13319.pep
RREERAIEKAQHEEEMALLARERARAEFQDWEKKEEEFHFDQSKFRSEIRLREGRTKPIDVLLKNLNFADEFDVELNEPYLVFKGLTVKEMEELHDDIKMHLDLDRESQVNVKYWEALMVVCDWE

SEQ ID NO: 118902 - protein, 338 aa, Triticum aestivum
  Clone ID: PAT_TA_13320.pep
VHDILQRYPELMTGFSEFLEHCENIDGFLDAARDKRQTSRTVKALEKERDKGRAGEDRERDAEKLSEKEREKLDKVSALNSKEATTHKAAAFSSTKEKYLCKPISELDLSNCQRCTPSYRLLPKNYPVPASSCRTDLGISVLNDHWVSVTSGSEDYSFKHMRKNQYEESLFRCEDDRFELDMLLESVNVAIKRVEELIEKMQENSIKPDSPIRIDEHLTSLNLRCIERLYGDHGLDVMDVLRKNASVALPVILTRLKQKQEEWSRCRSDFNKVWAEIYAKNYHKSLDHRSFYFKQQDSKNLSTRALLSEPRAVNEKKRKEDDVLLAIAAGNRRPIVPN

SEQ ID NO: 118903 - protein, 122 aa, Triticum aestivum
  unsure (1)..(122): unsure at all Xaa locations
  Clone ID: PAT_TA_13321.pep
KTNLTCTVCDITATSEVALQEHLKGKSHGRKXTKLALPARGTGQPEEDAFSLKVNGSPALPAKGKNPSVAVASMALAEKKVRQLGLELHGLRHHSKQSEEHARSPQRENSYEEDCHDRAAIS

SEQ ID NO: 118904 - protein, 154 aa, Triticum aestivum
  Clone ID: PAT_TA_13322.pep
MGPLQGLWAWRTGEQCMPNIWRSLDAMDDQEGGLIFSAQLDPMRAGFDPTLISFPVPALISRLLGWSNNSGQGRPQGSVMVAAAAVALYVAALFVSGQQPRRRRLAASAAARPTSARPRALPLPAPDGGLLRILSGNNHEYLENVVHSASIGAR

SEQ ID NO: 118905 - protein, 141 aa, Triticum aestivum
  Clone ID: PAT_TA_13323.pep
MTGNHGGRRRKAPQQGRPARDDAVDISQSNSDGQDGAEGSQPKRRLQRLTPQQTQVLEGFFGICAHPDENQRMGMSESTGLTMQQVKFWFQNKRTHMKHVTGKEETYRMKAQNEMLREENKRLASAANTSFCPSCVALPGL

SEQ ID NO: 118906 - protein, 155 aa, Triticum aestivum
  unsure (1)..(155): unsure at all Xaa locations
  Clone ID: PAT_TA_13324.pep
MVKIEDCDGDGAADPPQPNPAPAPTAVKAEEAIDDGQPGTSSSYLRSHFIGMGFSPLLVDKMLQKHGDHDSNTILESLLSHHNSGSESSSSTGVSSDSDGEENSSEQEVKPFXSDTEEGXSYLLRTMNFSQTEGRLSIRPIRCGRPYLISLLSSL

SEQ ID NO: 118907 - protein, 102 aa, Triticum aestivum
  Clone ID: PAT_TA_13325.pep
SDLGAPVVSDRSWVAGQLRKTSGKFLVALDWQKGGRRRRIALGLSSGRASRSWGGWPLLRGELYGGSLMSRECSEGLGDPLYSVTRLAPRWQQISSPATAFL

SEQ ID NO: 118908 - protein, 189 aa, Triticum aestivum
  Clone ID: PAT_TA_13326.pep
SAHASAHASAHASAHASADAWVAMAIGAGLVEIWCYKWYVLGGLGVYITLRTVKRFVRTNSPDVSSALAATKFATESADAAAVLGGYVKEVLKRKDLDDLDVCTVTTDFGSLIETKGAAVGCYCVEHLHLKVINHLNDSDMKHLLDRLNSAFESLRKMLVLNARMGYRLTEQTDKSRYCILSKDGQAIG

SEQ ID NO: 118909 - protein, 116 aa, Triticum aestivum
  unsure (1)..(116): unsure at all Xaa locations
  Clone ID: PAT_TA_13327.pep
MWRLKILQGVQVQPKAKTKKPKTEKPKKPKKVQVITYFGLVWRKHKNDIGGEDFRANDVILKSKDGIGSSIKPACXLCNKPYSPDFMYVRCERCQKWFHGDALQLEEERITEVVQY

SEQ ID NO: 118910 - protein, 189 aa, Triticum aestivum
  Clone ID: PAT_TA_13328.pep
GAPLSSAPTVRAVRSRALGRWRPPPQLLPRLLSSAGASSARPAELIELSEVEKVLHDVRAGDVRVFPVGEGGLHGGACADYMVVATGRSDWHVRNIAQAILYKIKQKQKGSNRILMPSVEGQQAGKWVVIDSGSIIIHALEERAREYYDLESIWTKAVSPNISVQELETSLVKTRRKGPVAETHEEHLS

SEQ ID NO: 118911 - protein, 150 aa, Triticum aestivum
  unsure (1)..(150): unsure at all Xaa locations
  Clone ID: PAT_TA_13329.pep
MGFNRAQSVPACALPSPCPSPAAPAVRPRPRPGPAPALPHPGSCIARASAGVARRGHFTGGYCSRKGIVKRLHCECTIKCGHHSPPPPSEVPPPPASVRPPPPPRXPVPPPSLGPPPPLAVPAGFASPGMYPCRKGPFSCLHGNLQFIRN

SEQ ID NO: 118912 - protein, 137 aa, Triticum aestivum
  unsure (1)..(137): unsure at all Xaa locations
  Clone ID: PAT_TA_13330.pep
MAYQYHHQDHALGMDAAAAAAGNPGGGFAPGLGAGAGGGGWEREKAAIEAHPLYERLLEAHVACLRVATPVDQLPRIDAQIAARAPPAMPPAGAPAGGXEELDLFMTHYVLLLCSFKEQLQPLVRVHAMEANMGFWK

SEQ ID NO: 118913 - protein, 49 aa, Triticum aestivum
  Clone ID: PAT_TA_13331.pep
SRFIPLRLRLSSRQAHSGGFLPSKNTARAVFPAQAGFNRAYLMLLGPGT

SEQ ID NO: 118914 - protein, 61 aa, Triticum aestivum
  unsure (1)..(61): unsure at all Xaa locations
  Clone ID: PAT_TA_13332.pep
WAAVWGRARRRKRTSGLRRLAALLLGIAFCALRVAFQXGAAFLEGLRKPGGGRKLARIFLH

SEQ ID NO: 118915 - protein, 254 aa, Triticum aestivum
  Clone ID: PAT_TA_13333.pep
APALSLSLSLSLSLTPHSQPVITNGANGAIPATPKTTVSTKSGPTVAPSKVKPALNLKIDRATSVTPRPLPVDKAATLPSSLSLANKAIPVPPQSSAPWVAKAAKGIPAPPKPSAQANKVTKAAPVPMKSPTPQVEKVAKAIPALSKSPAPQVNKVAPPNAAPRQLPSVSYSEARKSAVPKKIVGTSVPRTSTAVSRPSSAPLFQAPRSTLPPIPGAQVPPSQSRSLTASRRSSNEPSAPVPSYVPQSYRNAII

SEQ ID NO: 118916 - protein, 120 aa, Triticum aestivum
  Clone ID: PAT_TA_13334.pep
IRTSANHVSMGNTNNVLMGSTENLRNGIRLLIFALSDTLNLPNLDSKNILLRNNENSKSSRVTHSCDDSPDLSITGSLVKLELSSGSTATVDNPSNNGFPSTPPPLLPSIKLVPILQPGG

SEQ ID NO: 118917 - protein, 70 aa, Triticum aestivum
  Clone ID: PAT_TA_13335.pep
EEDNKEIYGMISNAKRKYADSNNLIVNLYNKRSWNNTISQNVQPLVQAIKKYNLYMFSYSRGSTILQLPD

SEQ ID NO: 118918 - protein, 259 aa, Triticum aestivum
  Clone ID: PAT_TA_13336.pep
DSAEASIGVRDDEPVPVARVQSMPPDVAGATSALETKHGQLVKEDEVERFKELWLSLVEREQRLELRLMHLDGLREQLEHRLSVAALETWILKLDALLLHEENERLKAQAAELEAVRAQLGRAKEKLRALKERVQIEREESQREAATLRDKVMQLEKTGENRERVLAAEAATLRKAKAGLEEENMELARRLQHVEQVSSSVTISLVDGVTAFLILDFNSTFSAISSKFVKITTPPARSIICILDTCRERQVLWNRGTAY

SEQ ID NO: 118919 - protein, 85 aa, Triticum aestivum
  Clone ID: PAT_TA_13337.pep
KIMMKNMMQTRRLVLLLLVLGCFTSHANCQAKKETMDEEKIVIPPCRFCLKDKQLIPPTPLPWCCILEGGLCYKTKVECQINCGC

SEQ ID NO: 118920 - protein, 480 aa, Triticum aestivum
  unsure (1)..(480): unsure at all Xaa locations
  Clone ID: PAT_TA_13338.pep
MGSEGPGHGFGSGAAERDIDDLPPNDANYTALTPLWFLERPALAQPDRASVVHGPVRYTWAETYRRCRRLASALARRSVGHGSTVAVIAPNVPAVYEAHFGVPMSGAVVNCVNIRLNAETIAFLLDHSVAEAAMTHQQLFTLAEESLKIXQEKKKQNFRPPTLIVIGDPTWEPKSLQYALGQGAIEYEEFLKTGDPEFNWXPPKDEWQSIALGYTSGTTSSPKGVVLHHRGAYLMALSVAMVWGMPEGAVYLWTLPMFHCNGWCYTWALAAFCGTSICLRQVSTKAIYTGIAKQGVTHFCAAPVVMNNLINAPASETFLPLPRVVNVMLAGAAPTPSLLAALSIRGFRVTHTYGLSETYGPSTLCVWKPEWDDLPLEERSRLHCRQGIRYTALEGLDVVDPKTMVPVPADGKSYGEFGLRGNAVMKGYLKNPKANAEAFAHGWYHSGDLGVKHPDGYIEVKDRMKDIIISGGENISTLEV

SEQ ID NO: 118921 - protein, 291 aa, Triticum aestivum
  Clone ID: PAT_TA_13339.pep
PRVRWAIGPTCTSGILDKDADAMAGRGNRADVDVGHVVSWLDAMPPASVLYVSFGSIAQLPAKQLAELARGLEASGRPFVWAIKRAKADAAVKALLDDEGFESRVEDRGLVVRGWAPQVTILSHRAVGGFLTHCGWNATLEAISHGVPTLTWPCFADQFCSERLLVDVLRVGVRSGVKLPVMNVPAEAEGVQVTSGDMEKVIAELMDDGSEGMVRRSRAKKLAAEASAAMEEGGSSYTDLEDMICYASELSRKRSPECGWTSSTSLPSAVAELRSNDSAKIEAGAALSLQS

SEQ ID NO: 118922 - protein, 113 aa, Triticum aestivum
  Clone ID: PAT_TA_13340.pep
FGRENMLDACHIIQNFRQGNKLRQEKNKELGATSSVIYYLCKAKHCGGSFHTFSFDNKRLGKQLCLATSDVSILAHTFFLLIQDYFFLLYRLGCTCLGNSAKPRRHMKAPLAS

SEQ ID NO: 118923 - protein, 72 aa, Triticum aestivum
  unsure (1)..(72): unsure at all Xaa locations
  Clone ID: PAT_TA_13341.pep
RPPTRPPTRPPTRPQSXPAAAAAPDFPPTRTSLPARPSPPRIPHPXEPPPPPLSLQSPAPAPSSPPSSRCQN

SEQ ID NO: 118924 - protein, 97 aa, Triticum aestivum
  Clone ID: PAT_TA_13342.pep
GTRCVSPFGVATPMLVNAWRHGEDEEGGALPAPVSAEEVEKTEEMVRGMATLKGPTLRARDIAEAALFLASDESRYISGHNLVVDGGVTTSRNVIGL

SEQ ID NO: 118925 - protein, 150 aa, Triticum aestivum
  unsure (1)..(150): unsure at all Xaa locations
  Clone ID: PAT_TA_13343.pep
MAAAALRARLNNLVTSMFATGMLDENFHQLQSMEEDGTAARGYVADMINLFIKDTKRILNDIAGLLSQPVVXDYDMVDVLVRQLKGSSYSVGAKKVNLSCMQFRRFNEPRSKERCLMXALALAWSEFCEVRSKFEAMMQLEEQIATYGPK

SEQ ID NO: 118926 - protein, 99 aa, Triticum aestivum
  Clone ID: PAT_TA_13344.pep
QEYNPMHKWVIQGHKVINFLLITLIVLSVSIKFIHPSKYCSCRCHGAFDCTRIREPSCLGPKTNIHACMLDGCRSRAEIEPPHISLHDLVLRNKHKHHQ

SEQ ID NO: 118927 - protein, 137 aa, Triticum aestivum
  Clone ID: PAT_TA_13345.pep
VRKAAPLSNRERLVLRKQALQTKKRPVLAIGRNNVITGVAKTIRTHFKKHPLAIVNIKNRADGTPVQQLISELEEATGSVLVSREPNKVILYRGWGADVTQTSSREDGTNEGEKEVISPQLLEAIRLECGLHPGESQ

SEQ ID NO: 118928 - protein, 218 aa, Triticum aestivum
  unsure (1)..(218): unsure at all Xaa locations
  Clone ID: PAT_TA_13346.pep
ATATQARPPRQSRPADDAPLPPPAAPRVPVPARHPPPSHLLSFPATTSPLASSRTPMADAASRPRVRRIHPRRRRAPWLHPRRAPLGRGAALPRAARHLLCGLRRPPYRRAGRPSQAIRCSSEWEDVRLAVRSPGWGRWRSGCWSGGSNGSDFAGWARAAAHRPRGVDLVGKVXXWRRXAGCVGXRCXAVKXWRNSAXVKVLRGRDXSTVDXTLAKES

SEQ ID NO: 118929 - protein, 225 aa, Triticum aestivum
  Clone ID: PAT_TA_13347.pep
RSGFPGRPRVRIFAQHKAFLDIIEKDLFQSARRSVTYLRLDGSVQTDKRFEIVKTFNSDPTIDVLLLTTHVGGLGLNLTSADTLVFMEHDWNPMKDLQAMDRAHRLGQRKVVNVHRLIMRGTLEEKVMSLQRFKVSVANAVINSENASLKTMNTDQLLDLFTSTPASRKASVLPSSSSATEEESNKGKPGRKGLKSILSGLDELWDQSQYADEYDMNQFLAKLNG

SEQ ID NO: 118930 - protein, 87 aa, Triticum aestivum
  Clone ID: PAT_TA_13348.pep
IRTRESFPRSCGDPLFLPGAIDPTPARDRRPRGQCLHRRRPRCLGLRQARRRLGFRQARRRLGPGQARHPQDMLYKSRESIFLMDWG

SEQ ID NO: 118931 - protein, 90 aa, Triticum aestivum
  Clone ID: PAT_TA_13349.pep
DTPFLPMRRQHKTHMCSLLIALLVFASTWKPTMQLPPCWHHPEKFSICFATWREEICNKLCIAENYEYGACAMIYPVPRCVCHKRHCHDT

SEQ ID NO: 118932 - protein, 88 aa, Triticum aestivum
  Clone ID: PAT_TA_13350.pep
EIKYGPNQYTGCHISNDRPMDDKFMHAHTHYICYLGYLIISTFTCHPYSCSLTRSCHLLLRRRCPGSCCSARSRHPPVTPLTMDHTQA

SEQ ID NO: 118933 - protein, 274 aa, Triticum aestivum
  unsure (1)..(274): unsure at all Xaa locations
  Clone ID: PAT_TA_13351.pep
MSAQGIESMEAKRRRGEKSATSAAPGPLEVLDCAFCFDPLKPPVFQCRVGHVICSSCHHKLRKKDNCHVCAITGGYNRCIAFDHILESIKVSCSNSIYGCTIKTHYYQQEEHEKSCPHAPCFCPEPGCGFAGSTAQLQRHLTVDHMLPATAFAYGYSFTLHMQEGMRVLHRKEXGGPLFLAKFTLVPPFGNAISILCIHPHVVTENHRFECDVDFYSRTMGWHQHSNFQIISTNLSNGFPGEEASYTFVVPKISSDPHTTTTRLLIRPPKITCP

SEQ ID NO: 118934 - protein, 173 aa, Triticum aestivum
  Clone ID: PAT_TA_13352.pep
MAAEVVALSPASRLPSLSSRPNALTASSSRSRPPRGARAPRSPPTLAISTPHRRRALLLLRPRATEQQGQVQQQEEEVVDGNVLPYCSIDGKKKKTIGEMEQEFLRALQSFYYDQKAIMSNEEFDNLKEELMWEGSSVVMLSADEQRLLEAFIVYIAGNPIMSDAEFDELKLR

SEQ ID NO: 118935 - protein, 212 aa, Triticum aestivum
  unsure (1)..(212): unsure at all Xaa locations
  Clone ID: PAT_TA_13353.pep
LKARYEPAGLLEASMAYIAGNPIMSDAEFDELKLRLKQDGSDIVTEGPRCSLRSRKVYSDLTVDYLKMFLLNVPATIVALGLFFFIDELTGFVVNVFQFXLEPFGFIFTXMPLWPRILVTAQVVTKAIINDVLIMKGPCPICGTENLSDYEXDTVRSSISGGNETMVKCANCKTVMVYDSKXRLITLPGIHEQDNWKVGATKMQSWPFMFGN

SEQ ID NO: 118936 - protein, 331 aa, Triticum aestivum
  Clone ID: PAT_TA_13354.pep
MGMEYEPAPAQKKPAAGGRAALKLLLALLLVGLAMRLLADRCASRLLPPPAPKEEAAELAVTAPPAQEADGGDGRPVTPNGAGRCDLFHGEWVHDSTGPAYTNATCRFIETPQNCMSNGRPDDGYLYWKWKPYGCDVPRFESKTFLEDMRGKHWALVGDSILRNHVQSLLCLLSKVEDPTEVYHDKTYQSRRWHFPSHNFTLSLVWAPFLVKAEIFEDENGVSSAEPRLTFDVLDATWVSQWASFDYVIISTGQWFFKKAVYLEHGAVIGCHFCQDKSLKEVSIDYSFRRPLREAFRFITASPHRPVVFYRTWSPSHFEGGEWFSGGRCDR

SEQ ID NO: 118937 - protein, 84 aa, Triticum aestivum
  Clone ID: PAT_TA_13355.pep
IRHEEMRGLKVPSLLCLLLLIPLLLPGSEADTCSRFSRTYIVKPPECNHDPCAKACQKEGFTEGVCEIIRATPIFMRCLCKKEC

SEQ ID NO: 118938 - protein, 296 aa, Triticum aestivum
  Clone ID: PAT_TA_13356.pep
MKVLCSACEAAEARVVCCADEAALCARCDRDVHDANRLAGKHHRLPLLSAASNPPAVSAPNRDICQEGHAYFFCVEDRALLCRSCDVAVHTANAFVSAHRRFLLTGVQVGLEPDEQEEPVPEPEPEPQPPNNASSAPLPPPMCPGKRSPTPWDSDGDIDWAAGPDVGITGNLPDWSVIDEQFGSGTPALRPAEPEVIKAPPRKSPRVAVTAASAALFGGSMPDWPLDEFFGFTEFNSGFGFAENGTSKADSGKLSSPNRGSMSSSSSGNAAQNAQDFFGQVPEGHWVESTMPELPS

SEQ ID NO: 118939 - protein, 174 aa, Triticum aestivum
  Clone ID: PAT_TA_13357.pep
MASAATSLVMVLVVLAALSYGLPAARSDIDFIARTCKKTTNPALCVAVLSADPKSGQASTEHDLASVALQIATSTAKKNAAVICDLGGKHQGKPEGPRVGMYVSRHMSICGKPNSWGLPAPPPAVGRVPRLCPAGPWRRAQAARAGARYRGSPNDLRCPAWIAFQQKLGGTLPK

SEQ ID NO: 118940 - protein, 248 aa, Triticum aestivum
  unsure (1)..(248): unsure at all Xaa locations
  Clone ID: PAT_TA_13358.pep
MHGSYAAPPASSAGYAKIPTYPPPPSSSYPSPSPSPVPPAASASAPAPIQDPTAPPSSLAKAAELVTRFREQGQALIAARRXWGEVFRSPAFSKPPNVGEAVSRMRRNTAYFRANYALAVLAVVAASLLWHPGTLFALLALCAAWVLXLYFARPAEGAQPLRVFGTEFDDGTVLALLSGVTVIAMLFTDVGWNVVGSVMIGLALAGAHAALRSTDDLFLTEQEAAGNGLVAAGFSAAGPILPTYVRIG

SEQ ID NO: 118941 - protein, 176 aa, Triticum aestivum
  unsure (1)..(176): unsure at all Xaa locations
  Clone ID: PAT_TA_13359.pep
MPTGRMSGNITQDWEPVVLRRAKPKAADLKSAKAVNQALRTGAPVETVRKAAAGTNQEXSAAAVAAPARKLDEXTEPAGLGRVGGXVRAAIQKARVAKGWSQAELAKRVNERAQVVQEYESGKAVPVQAVLXKMERALEVKLRGKAVGSARADQSDGSWGHILPVKFVMNGSKSDL

SEQ ID NO: 118942 - protein, 124 aa, Triticum aestivum
  Clone ID: PAT_TA_13360.pep
SAAPRPPSALSTRTKASSSATMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 118943 - protein, 103 aa, Triticum aestivum; identical to SEQ ID NO: 107316
  Clone ID: PAT_TA_13361.pep

SEQ ID NO: 118944 - protein, 138 aa, Triticum aestivum
  Clone ID: PAT_TA_13362.pep
RRPLGGRGPLPRPASAPPRPSSALSARTKASSSATMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 118945 - protein, 101 aa, Triticum aestivum
  Clone ID: PAT_TA_13363.pep
LYYTVHRELRITTWASAYSSTSTSMKNPSEGVAASSDFKAYEVTKDHLARTYTVRVACRSLGVIDPHPLSWSRVRAVQRPHALNLYTEAAQIHSIGARPNR

SEQ ID NO: 118946 - protein, 178 aa, Triticum aestivum
  unsure (1)..(178): unsure at all Xaa locations
  Clone ID: PAT_TA_13364.pep
DSARHFLHDQLSTLRGMRPFCLVVGVFLLLRWPAFSLAWAPVARTITVDQRGGGDYWTVQSAVDAVPYGNSQWVRIYVKQGSYREKVTIPSQKGFILLQGDGSFNTDINFDGHGYRHRRARHRPDQRARQPPATSTGXSPAGTTAPLTVHADNFVARNIAFKNTFNGGHPGGGRADRR

SEQ ID NO: 118947 - protein, 116 aa, Triticum aestivum
  Clone ID: PAT_TA_13365.pep
LLQTCLQTRFQSKQGPLFITMDTKSPAAGFSVLRSAPLVPVDTTLPDIGFSSAPFIPVDTVSPASVSANIAAAGFFSFLGLPRPLLIPADPASAGIAAAAVLSFLGLPLPLLIAVG

SEQ ID NO: 118948 - protein, 80 aa, Triticum aestivum
  Clone ID: PAT_TA_13366.pep
LITLLQQCLPVAVAIRLPVVGRAPRHGILTLVICYLWRASFLTHGWQPITSGGWPIHTCMWHTSGGTFPHPPPVKKKKKK

SEQ ID NO: 118949 - protein, 97 aa, Triticum aestivum
  Clone ID: PAT_TA_13367.pep
MTQEHTVGEQKKKKKKKKKKKKKKKKKKKKKKKKKKKKKKKKKKKKKKKKKKKKKKKKGGGVLGEQSLGGGVGKKKFFFWGKKNKKKGGGFKKGGRG

SEQ ID NO: 118950 - protein, 136 aa, Triticum aestivum
  unsure (1)..(136): unsure at all Xaa locations
  Clone ID: PAT_TA_13368.pep
MEAEVQAREEQEEEEVACECCGFTEECTAPYIAGVRARYGGRWICGLCGDAVAEEMCRASPPVSPAEALDRHACVCGEGRRASAPPSPGDELIAALRLLLRRRLGSPSPPRLXRSTPSRPWRDLGNPTRRSLKHKA

SEQ ID NO: 118951 - protein, 131 aa, Triticum aestivum
  Clone ID: PAT_TA_13369.pep
DRADQAARGNPRGAKRARAQAWPRGPRRARPRMAPAPPPWRTSEGAPAASTAAEAPQPMDTAEGKQPSSSSAALSSINRKIKKGVQTKRTKNMRKMKAVARAISKTEKSEEKVLKAKSKKSRIQSAKSLYD

SEQ ID NO: 118952 - protein, 152 aa, Triticum aestivum
  unsure (1)..(152): unsure at all Xaa locations
  Clone ID: PAT_TA_13370.pep
PIGCVPAELAMHSLDGSCDPXLQRASEAYNPQMEAMLNQLNAEVGSGNGNGAVFVAVNTRRAHDDFIADPKAYGFVTATEACCGQGRFNGIGICTMVSSLCANRDEYVFWDAFHPTERANRLIAQNYLTGSTDYISPMNLSTIIHLDRHLHD

SEQ ID NO: 118953 - protein, 255 aa, Triticum aestivum
  Clone ID: PAT_TA_13371.pep
RPRTRGRTRGLLSLPGENGNDHMDDVEIRALMQDMIAAATDTSSVTNEWVMAEVIKNPRVLRKIQEELDAVVGTSRMVVESDLPHLTYLRCVVRESFRMHPAGPFLIPHESLKATTIMGYDIPAQTRIFINTHALGRNPRIWDDVDEFRPERHLPADGGRVEISHLPDFKILPFSAGKRKCPGAPLGVILVLMALARLFHCFDWSPPDGLRPEDIDTDEVYGMTMPKAKPLIAAAHPRLPPQMYGSCPSHGMQMQ

SEQ ID NO: 118954 - protein, 105 aa, Triticum aestivum
  Clone ID: PAT_TA_13372.pep
GITTLQVTWDPGGSAQYQFVDQAEDWVLDVLRVPWDPDGTLQHRLEGKSNLMGEGLLATWASLGLRHYPAHEGDALHIQGKASTSNLAWTGTDRRLRPRLSLSLG

SEQ ID NO: 118955 - protein, 94 aa, Triticum aestivum
  Clone ID: PAT_TA_13373.pep
ECQHFVKSGFCKFKAKCKYHHPRSLAPPPTAGALSPLGLPLRPDQPVCTYYERYGVCKFGPACMYNHPFNFGHPVSAAGPPLSAQYLTSGNYTV

SEQ ID NO: 118956 - protein, 56 aa, Triticum aestivum
  Clone ID: PAT_TA_13374.pep
PTRPPTRPVSVTPHGSPLQGHCPTAGCDTGNHCFEHSVPGGNCHGVTEIKIVYYNP

SEQ ID NO: 118957 - protein, 159 aa, Triticum aestivum
  Clone ID: PAT_TA_13375.pep
MAASKPLALLLLVTLSATAMSAAGQGCGGHKVTVQNLCGHDLNLGIAAVADSKVLFPNGWLLPNGKHESFDVCSWSGSVSAHGAAVAKFHIGHDGGAYYEVSTDQANMPIRVSVTPHGSPLQGHCPTAGCNSGNHCFEHSVPGGNCHGVTEIKIVYYNP

SEQ ID NO: 118958 - protein, 205 aa, Triticum aestivum
  Clone ID: PAT_TA_13376.pep
HHTDSYSMAASKPLALLLLVTLSATANACRRSRVRRPRGEGAHPAPPRAALGYRDCGGQVRSAAPTGGWCRTGTPETFDVGTGAGADGKVRCPHGRRLPYGTARSRSTCARGPGASRRPAPPSPSPPWATTAGAYYQLRTHQPNMPIRVSATPHAKARSTGTAPPPDATATTIASCAPSPAATASVSPISRSSTTTDRSIHPSPV

SEQ ID NO: 118959 - protein, 103 aa, Triticum aestivum
  Clone ID: PAT_TA_13377.pep
PGRQLRLFDIRLGQTEVHAIGWKQTSSESQSALINQSWSPDGWYLSSGSADPVIHIFDIRYQGQKPCQSVQAHQKRVFKGVWHQTFPVLTSISSDLNVAIHKY

SEQ ID NO: 118960 - protein, 175 aa, Triticum aestivum
  Clone ID: PAT_TA_13378.pep
FFFFFFFLGGRNCILLLFFGINVMYSSSQLYAPTQYYVFFYSSIPCRPELAGRLACHVFELTAIRPTPYYVFFYSSIPCRPELAGRLARRVNPFTHHVSTVLASSHTDENGHARALMFTAGVASQLGIQTLGFTILTVLRIRPLGKSSIYTAEEQEQACPFQHKQSFWTLPNSPP

SEQ ID NO: 118961 - protein, 166 aa, Triticum aestivum
  Clone ID: PAT_TA_13379.pep
TLSSTQERASLCFRAASSSGDRDRSISYAISTGGGRFRSNPTPTAGEASRTYDDDPVSLCSSSRYATLFMTLIASDRRGAGSGVATATSHRAPVVQELGACCAAHHGRHRQAQVEQPCGAAGASAAGAAGTATGVFPGHTTSTVLSAGAHGQRPWSAGAGCACRRR

SEQ ID NO: 118962 - protein, 150 aa, Triticum aestivum
  Clone ID: PAT_TA_13380.pep
LAIVASNHGGLVHTRRKHQLQAKARRTMLPQAGKSCVPPICNDVLPVLQAGCGCCNEGLVSAESSGPPVLRCNIAGVAALPVLLCRIAGVAVFLCSAAEATMQRRRGGRCFYAAPTGPSRLRCSVARAALEHRRVVEAAMRMERTPPGLQ

SEQ ID NO: 118963 - protein, 130 aa, Triticum aestivum
  Clone ID: PAT_TA_13381.pep
KEDDQEGMGARSRKGRGADGREAGVGREGGRGVDCWLADCGVLPAMRSRRRWRRTGRRGRDELPIKMQSCCFYHVVLILLTVIFVENICTVVWLRYRATIFVLHYLVGLIIWIKYKASVVQKFLVTFVYL

SEQ ID NO: 118964 - protein, 180 aa, Triticum aestivum
  Clone ID: PAT_TA_13382.pep
KWETLAVCCGKWNTLVCEGEFPLVKDNNAGLNYLPRNCDRISFLPFSGSFLSLRIFPDSIPFSSNFIWSGWQDLRTIWSGWNELRNVKRLPFLIMTRGHLLSNNATELLSSFSSTEVYSSSSSTKVHSSFSSTEVHSSFSSTDLLSSFSSSFLSLCIFPDSIPFSSNFIWSGWRDLRAIC

SEQ ID NO: 118965 - protein, 72 aa, Triticum aestivum
  Clone ID: PAT_TA_13383.pep
PYITKKNAPYLFLMLYHGMFLLVQVGLSGSFRQWLDVRTGNLLLEGFGMPLFERWDMKKWRSATFIQVIGPL

SEQ ID NO: 118966 - protein, 89 aa, Triticum aestivum
  unsure (1)..(89): unsure at all Xaa locations
  Clone ID: PAT_TA_13384.pep
RCYRWQQSTCGDCGRQEPRREGXLAEPGQRRRWDGGGGREGGDVHQEVQGGDEAAEPEVGRGTPGHACKRPMTSIILVIITHLLMDVLN

SEQ ID NO: 118967 - protein, 105 aa, Triticum aestivum
  Clone ID: PAT_TA_13385.pep
PKGYDQGRVKRECQPSYSHLDSRDKTGSPAGRTSTAWTPIQSRKLIVNSCHLAEARSCNHVFTYGKPFTSDVLGFKNLEVEFLASRNMIICITLRLMKRSIDRFV

SEQ ID NO: 118968 - protein, 143 aa, Triticum aestivum
  unsure (1)..(143): unsure at all Xaa locations
  Clone ID: PAT_TA_13386.pep
LLVANMQGGVLLFASSYFEYIRLSSFLKSXDASFCRIGEVTLQQDISRARLWFFEGQKKILLYSERSHFFHGYKIRGGHHLVVYSLRGRKYFYPKLVNMLGESANPRCNVFFSRLNLLKLEQIVGMSSARRLISSDKDMFVFC

SEQ ID NO: 118969 - protein, 300 aa, Triticum aestivum
  unsure (1)..(300): unsure at all Xaa locations
  Clone ID: PAT_TA_13387.pep
MEEAVAPPQDVVQPAKGGRDLLRIFKELKQSMVTDWGGVRPPLVEEDKEFLEKKQKMQDWEQQLSSASQQAEALVKSQQDMGDTMGALGLAFVKLTKFETEEALYESQRIRAVDSKRIATAAVKASRTCRDLNTQTVKYLDTLHEHLGIMLSVHTAFSDRASALLTVQTLMSDLASLQSRIEKLEAASSKVFGGDRTRLRKVHELRETIRATEDAKCCALREYERIKXENNKIELSRLDRERREDSWRCWKGYVTSQASYAEKIVDGWEXMAEETSGMREDSSVDTTFSLCFVGVHVCTM

SEQ ID NO: 118970 - protein, 112 aa, Triticum aestivum
  Clone ID: PAT_TA_13388.pep
WNTANGNMLNSIDTGSQVCNLAWCKNVNELVSTHGYSQNQIMVWKYPNFGQVVTLTGHTLRVLYLATSPDGQTIVTGAGDETLRFWNIFPSMKAQAPARDAGLFSFSRSHIR

SEQ ID NO: 118971 - protein, 286 aa, Triticum aestivum
  unsure (1)..(286): unsure at all Xaa locations
  Clone ID: PAT_TA_13389.pep
TSERKEEADPEAEVAREELNRPPPPRAEERIAQIEIDQEFIGDIVQGELKSDMIRRDIADYSSDSDHGRDSRQSSPDYTHETNYPVSPSARPLRLHKVIEHRLEERIKELETALAQSQKQAQLHMMARERVFSEQTCLNSDSGSSSNQDSPLFIQETSSSAEPFCLNLSGDALEAYDEAYEEFMRIADSPCTTSTNGRPQVNEDYSVDRSLIWGLEDESATELKEDSTWEQAEERXPNRAQESDGDESGDEDDHDSEMLIQQIVERTKQGSPVLIHAQRMLFSVDD

SEQ ID NO: 118972 - protein, 142 aa, Triticum aestivum
  unsure (1)..(142): unsure at all Xaa locations
  Clone ID: PAT_TA_13390.pep
VRFKCIDLDGNGILTHIELQYFFEEQLHRMECMAQEPVLFEDILCQLVDMIGPAAGGFFTIKDFRRCKLSGHFFNVLFNLNKFMAFESRDPFLIRQXREEPSLTDWDRFARREYIRLAMEEDGEDASNASGDVWDESLESPF

SEQ ID NO: 118973 - protein, 158 aa, Triticum aestivum
  unsure (1)..(158): unsure at all Xaa locations
  Clone ID: PAT_TA_13391.pep
LRPQQVEVWFHNRRARTKLKQTXVDCEYMKRXCEQHAAQHNRLEQEVAALRALQAAPPAQKGASAGPRTPLSMCLSRKRVASTSSASACTVPSFSANAGTGMPLPSPVAHARTPAVLLRVRRHRSGVRRPCGAREGGQGGQIEGAMSVTPPCSACQAS

SEQ ID NO: 118974 - protein, 75 aa, Triticum aestivum
  Clone ID: PAT_TA_13392.pep
IAKKEEHIPFRNSKLTYLLQPCLGGDSKTLMFVNLSPEVFSTSESICSLRFAARVNSCEIGVPRRQTQMRSLSQG

SEQ ID NO: 118975 - protein, 502 aa, Triticum aestivum
  unsure (1)..(502): unsure at all Xaa locations
  Clone ID: PAT_TA_13393.pep
PAVSGRPTALFQSHPSPKSQFQYLIISLLLPSRRSPCPPPRGAAGFTFTPPPFITSFTELLSGSGAGDAEGSPRGFNRGGRAGVPKFKSAQPPSLPISSPRRPFSCFSIPAGLSPAELLHSPVLLNYSHILASPTTGAIPARRYDWQASADLNTFQQDEVGRGDSGLFGFSFHAVKPNATVNAQTNYLPLFKEHQQQQQQQVVEVSNKSSSGGNNKQVEDGYNWRKYGQKQVKGSENPRSYYKCTYNNCSMKKKVERSLADGRITQIVYHGAQDHPQPPPTRRCGSSYQRLXRSGPTPEHSSVALGDDEPDKPAATRRKEQADNEGSSGGTGGCGTPVREPRLVVQTMSDIDILDGGFRWRKYGQKVVXGNPNPTSYYKCTTVGCPVRKNVERASHANRAAITTYEHKHSHDMPIRPTPALRASPTRXKLSHHLPVRRGRALPATSSADSSGGIWPAAVPAPYTLEMLTNPAAGHRGYAAGGAFQRTKDEPRDDMFVESLLC

SEQ ID NO: 118976 - protein, 320 aa, Triticum aestivum
  unsure (1)..(320): unsure at all Xaa locations
  Clone ID: PAT_TA_13394.pep
GDRDLYGYSWFPATVAKVIDRLSYLVEYSDLEEEVGGGKAMEYLHCLFIRPDVEHSPRESEFRLGPGAAVEVYCDGAWSPGVVQRAVGEGEYEVSIDGKEGELLLKKVPSGIGYISICMTHSRNFLHIQRQGNRRQSVSGKRPSSAVEVASNDDGNSHHTQSPATKRSRKELPRKKLEELTEGSEHVLESEMDTSLSALRKSLASNFSPKTCSPRSRKNNFQAISRRIVDSCTVPMKGLGVYHASSENPTPQNESRADGIVEVVVQEAPLDMMLSNGQLNSPVCGTIADEAHDMXLTAGLRKQKMDSSCINNAGQKPQES

SEQ ID NO: 118977 - protein, 93 aa, Triticum aestivum
  Clone ID: PAT_TA_13395.pep
MENVQQGLIMPPDAPTTQDIGGMMKIVPSELDTDADYWLLSEPGESARDMWRTARDVEWEGIDINAEDFLEVGTPRQQEQPPSEMVDQPSCIS

SEQ ID NO: 118978 - protein, 100 aa, Triticum aestivum
  Clone ID: PAT_TA_13396.pep
MSEQQDQVSKSSCSSISTSTQGSEDDGTVGALLTEAKTNGRSLGKRLSHLDSLPHTPRVNGKIPDFSNATIDHESLLERLGTYGLAEYQIEGDGNCQFRA

SEQ ID NO: 118979 - protein, 185 aa, Triticum aestivum
  unsure (1)..(185): unsure at all Xaa locations
  Clone ID: PAT_TA_13397.pep
SWDARTTGSSWYQHHLQVDGQLTNAYRGRFGLGTLLGRLETLAQPQEAIGPVCDCQFPALADQXFRNPEYHKQERKAVMKRLKKFRLGYXGFVPMEYMVYLEMMERYWGXWGDHLTLQAAXADRFGAKICLLTSFRDTCKIEIVPRDLTPTRELWLSFWCEVHYNSLYATDDLLTRKTKKKHWLF

SEQ ID NO: 118980 - protein, 209 aa, Triticum aestivum
  Clone ID: PAT_TA_13398.pep
EDHHARCRSFDADPAACRPAPPVRRRESPDPPVSDLPRHPSPVPDVSSAPESQASDTTRPCLLCPGGPHGGQPVSLWISRQPPPCWRPLGTPRPGPSPSRRDRSAPPSTAEQPRSVACSATPPPASPPARPGPPPRHPFGLARLRAALPLPGPAPWPRGFGGSAGGSGCDRGLWPEGREARTVGSSGACCAAPEVAGNGRRWWWRRWRR

SEQ ID NO: 118981 - protein, 122 aa, Triticum aestivum
  unsure (1)..(122): unsure at all Xaa locations
  Clone ID: PAT_TA_13399.pep
EPRARAQGARPGRKVRGPLRGRRPRGGTSPXHLLTYPVSVTGDGAXDAAARDGVLPGHGGGGSSAASPTTSRPSLPRRGTSVCTTLHRSNSFLLFGFSSEDLVFLLKTQNKNSPRLWFSSFF

SEQ ID NO: 118982 - protein, 127 aa, Triticum aestivum
  Clone ID: PAT_TA_13400.pep
ASGPPPPPPCCFSFKRVEAEEKLTHGDSAAVSYLLPLISGCSSFCCGVLRALCLPSSHKEVASLLLLTLQRKHQMIRQLAKSAGVLFVFYGVDNSNNLVKYFFLQFFRNLKIFYVNFMSFFLLDSCD

SEQ ID NO: 118983 - protein, 75 aa, Triticum aestivum
  Clone ID: PAT_TA_13401.pep
NLPSSSDFPGSAAVYCSWIDEEESLEMKRWWCVVQQGTLQLDADDFRAPLSARGRVRVIVSLTSIIHTKNRVGLN

SEQ ID NO: 118984 - protein, 165 aa, Triticum aestivum
  Clone ID: PAT_TA_13402.pep
RRPRKRGRKPANGREEPLNHVEAERQRREKLNQRFYALRAVVPKISKMDKASLLSDAIAYIQELEERLRGGAPARAEAGPSVEVKAMQDEVVLRVSTPLDAHPISGPLSAMRDSQLNVVASSMAVADDTVTHTLVVRSAGPERLTAEAVLAAISRGVMMSATPSP

SEQ ID NO: 118985 - protein, 213 aa, Triticum aestivum
  unsure (1)..(213): unsure at all Xaa locations
  Clone ID: PAT_TA_13403.pep
TLFVSPRICQSAPPALQNPSRQPCSSPPPRSLHRPPCRRPSSPRSPRPPPXPLPCRRPPPPSYLLLPPPSPVPAAXPNLSPRFPRSPQXPHPQPPAPSHSRRTIPPFRPLLLPGSPPRRRPAGKGRQRVADEDNEGEKEGERKGGRRRGARPSDSRLPAAGPGGAPTGPPSRPLLRPRRPGGGPRPARAGAPGAAPVARRTWRRQVPDRTQVR

SEQ ID NO: 118986 - protein, 55 aa, Triticum aestivum
  Clone ID: PAT_TA_13404.pep
IRTLDGLSLESEPSDQPDDSKTNSDSAHQSYAFQSDSAPPPAANKKSAKPKWFKR

SEQ ID NO: 118987 - protein, 275 aa, Triticum aestivum
  Clone ID: PAT_TA_13405.pep
PPINPLRLWTRGRDEGGLELLLSMDLDEEETRPEQQAPPRVPDKLKAVSQELGHEIRIFTSTTFELMTSKLAKADQEEDDDFYELQPSDYYKLISNRLAEQSKVLKTRKIREAELAAQRARLTKAVARVRFPDGYILEAEFHPSEMVHSLVDLLMKVIARPDLPFYLYTVPPKKRIMDTSQDFYTIGFVPGANVFFSYDLPEGSELNTDAVKSGPYLREEIRTLDGLSLQSEPSDQPDDSKTNSDSAHQSYAFQSDSAPPAAANKKSAKPKWFKR

SEQ ID NO: 118988 - protein, 120 aa, Triticum aestivum
  Clone ID: PAT_TA_13406.pep
SNICLMFITGMFVNGPYALITTAVSADLGTHSSLNGNSRALATVPGIPEGTGPVGAASGPGATGYPAAGGWRGECTMLMAAALLAGLLLTHLVCAELRGKLSSNVSKVVANAQTTCSDQV

SEQ ID NO: 118989 - protein, 320 aa, Triticum aestivum
  Clone ID: PAT_TA_13407.pep
VRLCVSRGAISKFHALREDRAVLGNFCGRTPLLFATYHNGGTAEYLLDHGANQDKADHDGSSLLHYAAELGNCEMVELLLAKGAYVEPVSACGTPLHVAAGKGHYGAMKILLDHNADYNKMVNGVTPLIVATDAKSMKCIKLLVKAGANLKEAAAYTTLHAEKVVSDYFLNCIMEDVDANRDVPFYGPMLKRKIMTSGLISRGSNSLKNKDYVVAAKLYSKAMVLDPDDAVLFSDRSLCWLQLGDGKKALLDANKCRKMRPHWPKACHRQGEALMLLKDYEGASERFLDGLKLDPVDTDIEDALREAMKSLKTSRSTKAK

SEQ ID NO: 118990 - protein, 346 aa, Triticum aestivum
  unsure (1)..(346): unsure at all Xaa locations
  Clone ID: PAT_TA_13408.pep
MATTKLSPLSPVRPDDRRRAPAASVVLKVQDSTAAEAYEQYLRLPELSRVWKTACCPGWPDEGLVKPALQALEITFRFVSVALSDPRGYASRRELARRLESPRVAPEPKTGYRNRENGALFTIHQILESWLCAASQLLTRLNSRIEPNDWDAAANDCWILERIWKLLADIEDLHLLMDPDDFLRLKSQLRIRSAPDGTDASFCFRSRALLHAANATRYIKKLVPWVIXXEVDPNGGPRVQEAAMRLYHGRRRGEGEDAGKIELLQAFQAVEAAAXRVFFAYRQVVAAXVCGTAXASGNRAXLFAPAEGXDPLSQNVLEPPYFPSLDAAKTFLADYWVQHMAAASVP

SEQ ID NO: 118991 - protein, 243 aa, Triticum aestivum
  Clone ID: PAT_TA_13409.pep
AASAGGDGRDEGARQPVRPGVRAVPAGAGAAEDVQGQPDARGGPDERRVKPAPQAPEITFRFVSPRARPARGAPPAAASRRGGSGRPPPRGRTSGSPTCGATARRRAPPRTRETPASRRGVAAAEPGRGRGATPLGASIRPDHGRRRGEGEEAGKIELLQAFQAVEAAVRRFFFAYRQVVAAVCGTAEASGNRALFVPAEGTDPLSQMFLEPPYFPSLDAAKTFLADYWVQHMAAASVPSGRS

SEQ ID NO: 118992 - protein, 93 aa, Triticum aestivum
  unsure (1)..(93): unsure at all Xaa locations
  Clone ID: PAT_TA_13410.pep
RRPGALIIFFQVELALGEECTPAGCPRLVPGAADGGFSVRVSNXSSDEVDTDQLGLGEAVDDEAEEFIARFYAQLRRQNHIGLLPYYLQEAAA

SEQ ID NO: 118993 - protein, 115 aa, Triticum aestivum
  Clone ID: PAT_TA_13411.pep
AWSRPRCGILSGIRVLYPVKVTLWFDIFKNIDKIKQVECPVLVIHGTADDIVDFSHGKRLWELAKEKYEPLWVKGGGHCNLETYPEYIRHLRKFVNAMEKLAKERATKAPQTLMI

SEQ ID NO: 118994 - protein, 45 aa, Triticum aestivum
  unsure (1)..(45): unsure at all Xaa locations
  Clone ID: PAT_TA_13412.pep
IRQLXIPLTKGNKSWSSTAVAAALELVDPPGCRNSARGIFFYLSR

SEQ ID NO: 118995 - protein, 108 aa, Triticum aestivum
  Clone ID: PAT_TA_13413.pep
SKDSHHDKTTTTQKSLTKTEEPCHVSTYAGHLRRTVAPAKLPLSTLHPPFMPKGGGKCMVGLDQTGERRSLGITSDDRTLCRRRSIMDSGEHRRSTMKDLQTVSPDLV

SEQ ID NO: 118996 - protein, 84 aa, Triticum aestivum
  unsure (1)..(84): unsure at all Xaa locations
  Clone ID: PAT_TA_13414.pep
TYPEIEELIKEVMVTPAEVAEVLMRNEETDVAPPGLIQFLKRKKDGAGKPENVXQVAKEEEQEKEMMTKSDVPDNEDQQDGSKE

SEQ ID NO: 118997 - protein, 77 aa, Triticum aestivum
  Clone ID: PAT_TA_13415.pep
ILRPVPPRTPGRGPGAAPPSPRPPARRPPASSRPRSCAAPRAGDERPRSRRHHRRRLPLSPPSPTRRPRPGRPRRGR

SEQ ID NO: 118998 - protein, 173 aa, Triticum aestivum
  Clone ID: PAT_TA_13416.pep
MPNKVDVKSIISSAFLFKINCSTVKVAHWNYAQRNYLIRPVILTNLLPYNELLAYFDLPLADFARMSNPAWRSTYTEVFAYGGYRLFVQCQTTIDAVSNAPSAFGMFLCAQKSTQPEVLSVAFSVRQKPGGGYVDKFSFDSPFLPDNKFGVADLLLTPWAELLDENNLFLING

SEQ ID NO: 118999 - protein, 135 aa, Triticum aestivum
  Clone ID: PAT_TA_13417.pep
HYIHHDNTDTLPILPELKPICAHITESSRSRDLEFVRVPRQALGRRYKLPARTGASSRGSRPEDRTKRSWSKPEPPLALLTEPPTPPELSPRPADHHKLRFPTSLPCRAHLTAVATEHHAVVPQWSTVYPHDDQP

SEQ ID NO: 119000 - protein, 255 aa, Triticum aestivum
  Clone ID: PAT_TA_13418.pep
PPNPPSSCFFSSLPLPSHAKKENPKSPNPPPTPRQLRPQSPIPHAAGLPTSSPQLGSPPPAAPPWSASPRSCSSWAPSASTGSRWPSCARTARSTPASPPPSSSRSPRSSSPTSPSPTPSSPPSTPTTPPSSPPPPGPPPSSGSSSGSAPTGPPSSSSRPPTSSRSSSSRSSPPPPPSSPSPPSTPPSTTRSPSRGCSPSCPASGAASRPPSSPPSRCSSPTTSSSPSSSSRSSSPSTMAPPSPGSSPSSSSSPN

SEQ ID NO: 119001 - protein, 143 aa, Triticum aestivum
  Clone ID: PAT_TA_13419.pep
KQRRMFTPMQARACHQCDAAPSSPSSPSSQQQQPRTNEQRHTTPRQSVVEVVGEEGDDERDGGGHGGGGRGAAGGGARGAAGGAGGRLGGEHRGRRGGDNESGEQHLLHLHRLGTYGRRGGGRAGEQGSGRFIPLRSSSERDR

SEQ ID NO: 119002 - protein, 103 aa, Triticum aestivum
  Clone ID: PAT_TA_13420.pep
KEYYSLQLSFSTSNPPSKSRPCRVFSQIPKRARDSNILIHKKEQTGCLQTGAMSPAALSLAAETRPVPARAPGKNRNNKGQAHSHRLKYIQGKAHPNRRQVDL

SEQ ID NO: 119003 - protein, 85 aa, Triticum aestivum
  Clone ID: PAT_TA_13421.pep
PKSIHNPDILENFSKEYMYLACVMYVKKVKKGPFAEHSPMLDDISAVPNWKKVNSGLLKMYKAEVLEKVPIMQHFLFGSLIKWED

SEQ ID NO: 119004 - protein, 110 aa, Triticum aestivum
  Clone ID: PAT_TA_13422.pep
DVSGYGDASELPRKVEYDDDNRSEFLQDYLEVLYLSIRNGSNARGYFVWSFLDVFEFLFGYRMRFGLRGVDMNSEGRTRYVRNSARWYSGFLKGGELRPASSSGKAYVAA

SEQ ID NO: 119005 - protein, 176 aa, Triticum aestivum
  Clone ID: PAT_TA_13423.pep
MACIPCTIQLARVRASSSSGWRSPRAARVGLRAAQVGGAAAWLGPSLLSKVAPARESGRVGFFKFGNKDAEGAGIYGSQARDDFDRDDVEQYFNYMGMLAVEGTYDKMEALLNQSIHPVDILLILAASEGDLPKIEELLKAGAKYDVKDADGRTALDRASGEVREFITGFAVAKKA

SEQ ID NO: 119006 - protein, 130 aa, Triticum aestivum
  unsure (1)..(130): unsure at all Xaa locations
  Clone ID: PAT_TA_13424.pep
TTRSIISFCAAPIRRFFRFGNISPIHPGIYGSQAREALCQXDVERYFNYMGMLAVEGPYDMVEALLNQGIHPVDILLILAASEGDLPKIEELLKAGAKYDVKDADGRTALDRASGEVREFITGFAVAKKA

SEQ ID NO: 119007 - protein, 95 aa, Triticum aestivum
  Clone ID: PAT_TA_13425.pep
HNKNIDRTKPREGRESVLNTEAECESRHPARMGVRELSLRRLEPFGGAIFSGRHHGLGGAERLVHLSAPFDAREKHLVELDQVIPRAPAAATEEP

SEQ ID NO: 119008 - protein, 90 aa, Triticum aestivum
  unsure (1)..(90): unsure at all Xaa locations
  Clone ID: PAT_TA_13426.pep
PQLVESFPHLHVLKLWNCSXDALPGNMEHLTSLRELVVSSCPNVRSLPTLPQSLEGLRLAYLEDEVMESCQTVGHPNWQKIEHVCKKIFT

SEQ ID NO: 119009 - protein, 110 aa, Triticum aestivum
  Clone ID: PAT_TA_13427.pep
VCLKAPGFHRGEIEAGTLKFDRVESEVALLRELKKEEFIEYFDEYIKVDAPQRRTVSVQVFSGNHSAEFKKAIAEADPPKTCRITDIFGFKRSRPLHRSLKGGPGLITMD

SEQ ID NO: 119010 - protein, 116 aa, Triticum aestivum
  Clone ID: PAT_TA_13428.pep
YERRTTAKAFAKDVFINQGRPLGGRSGSGADPVSVITPATTITEQPSTVSSTSGQKLPTSTEKAADSESTMDTTLELGGKKPPESAQTPRSMKINPDGLKNPLLKDTSAAVPVQNN

SEQ ID NO: 119011 - protein, 117 aa, Triticum aestivum
  Clone ID: PAT_TA_13429.pep
PPRSYLRVQLAPKINSQLSHCDKKPHTLCTPIHTRGGYNTEIATWLTAGLGSIGPNSLDSFPFFPHCTRTGEKARLHLRGGSGCSLAAERLSLYLGGTGAPSASWWPDSLEAQRLAG

SEQ ID NO: 119012 - protein, 131 aa, Triticum aestivum
  Clone ID: PAT_TA_13430.pep
NEYWSIDIKLHNRWWHLQEKVVADMLDISFLLSSTHSLVTERITHLWWCRRSRPRGGPTGPLCLKIPDTPCYQPGIFFLSHVRNQSSRGTLSEYSRHVVRLAGYNQASCRVCPRFIQSRCSLISQDEPERA

SEQ ID NO: 119013 - protein, 102 aa, Triticum aestivum
  Clone ID: PAT_TA_13431.pep
ANLLARGPREGDADQHCNNEVLSLTDKAATSVEDEKETILGKRPRDDDAEQQCNDEVFSLTVKASPPIEDEKQRVLGKRHRGDDDEQDCDGEVGVDLDVSKP

SEQ ID NO: 119014 - protein, 111 aa, Triticum aestivum
  unsure (1)..(111): unsure at all Xaa locations
  Clone ID: PAT_TA_13432.pep
SIGDKVVNLISRAGMLGHASFLRSXGHVHTYLPELTRHGMSQSHVLHHRSRREHNFVXQLPGKDPTSSGTPPCAAPHCCSTDSQRTVLLLACTXPTPCCGYPVLNLREMST

SEQ ID NO: 119015 - protein, 114 aa, Triticum aestivum
  Clone ID: PAT_TA_13433.pep
FFFFFFGWPPSVGVFSPYVNVFHAQDFLLQVQLPIYCTPRVSASDNLISFTDPNICTGHYATSHSTRATFLMSGDAAAESLNHMHSTSTLTHVLLLSVSGIRKLTKSIARIYAS

SEQ ID NO: 119016 - protein, 206 aa, Triticum aestivum
  Clone ID: PAT_TA_13434.pep
AAADDEQQFTMHAVVDTHRRFTSSRWWTPTTRYGWSTPSTSWSCCLLRRSTRWSGLTLSTPALMSVSSQGRRRPDVHAQSRPRLPLLPGHKALQAFHQVFQQLPLHVRYGGHHRRCKCAQEFGHRLPESCRHPEPIQDLGQQRSMRRTHWFTSPRPSSILLQRHEGFLQQGQACLALGLDGETRQSSCRVHDQEGIHELRDVQADR

SEQ ID NO: 119017 - protein, 107 aa, Triticum aestivum
  unsure (1)..(107): unsure at all Xaa locations
  Clone ID: PAT_TA_13435.pep
TTTLITDQLWLNLVIIWLSPYLTSRLLNGLMGLFTWAPSSTARSSSAARRCCAASGTPRPRTATPSASRRWTRCTPCRATRSSPPSGRHCXXXXXXXXXXXXXXXXX

SEQ ID NO: 119018 - protein, 229 aa, Triticum aestivum
  Clone ID: PAT_TA_13436.pep
MALDSVPSYPSDLGSSGRATRTQQRIRKEERTWTADTYAPYDDGHQWRKYGEKKLSNSNFPRFYYRCTYKTDLKCPATKQVQQKDMSDPPLFTVTYFNHHSCNTTSRPIGSAPDTTEQSSSRRAVSICFGSHATGEQPTFLTSPGTLQSPASTTNQQNDRGAYGHQFQWTDTSPSAGDAPVKMETDSLAGTGASSGAASGHALSRTLLPIGPVEMHRLGSSLVLVAGRV

SEQ ID NO: 119019 - protein, 88 aa, Triticum aestivum
  Clone ID: PAT_TA_13437.pep
YHSHKHEVKSLRLGYLKERAPSGAHPNRRRDRRGRLRVLTPTDGEIAEGAFGCSPQQTERSQRSPSGAHPNRRRDRRGRLRVLTPTDG

SEQ ID NO: 119020 - protein, 270 aa, Triticum aestivum
  unsure (1)..(270): unsure at all Xaa locations
  Clone ID: PAT_TA_13438.pep
MEMIHKGSLDLVLVPCGLAIMLGYHLLLLYRILRHPHTTVIGYENHNKLAWCWFFWLIAAVHACPQTTAPEEAALALSVISDSISASTTLASLCIALGSLIGAWVSSNASPSAPLTAGGDGGASQXRRRGWASAKFTSLLVCFLASFACFIQSAGHYVHASFLMSALGXDAPASHVQRAVILGGNFWALGLRALYFATALLMWVFGPVAMLACSVLTVAVLHLLDTSSMPLHHHQFVDRTSVAGGARAASAPNPGLHSAVAVFSPAPYLR

SEQ ID NO: 119021 - protein, 206 aa, Triticum aestivum
  Clone ID: PAT_TA_13439.pep
TALLMVSSHASSPQSTSPISNLPMCCSMSQKETNMRYCVLPGTSTFRQAKTTSPTLDCSLLDFTRAPRLRHLLLPFSCAPILDAPNRLSPRPFLFPRHSCSDEEVTFPCAHSHALTKIEHLQFLLGCSLSFCLLTFFLFTHFICYPPIKSTASQPALLLQFAFNTPKGKLEATHGFKDEVVTARSMSSESAPDTAAPAPPRRHRGD

SEQ ID NO: 119022 - protein, 73 aa, Triticum aestivum
  Clone ID: PAT_TA_13440.pep
LDTSKLCKVLLGRLYMPSYDICMVLYTTHTTILFLPRFLFSSLHCPTFAIDKEEPLGSFPPEQQWPCTLSPRG

SEQ ID NO: 119023 - protein, 131 aa, Triticum aestivum
  Clone ID: PAT_TA_13441.pep
FFFWEEGSLLAGTSPAIARFPSFPGCHTFIRKEAPNLAFPKYWSPIIYYYINFVKQTNPFQSLDNRFMVSPLDSPFSKKKKGDNNRSKTGPGGTTTSFYSSLMPGALILHNALIFNIALAKQLFILSLFFV

SEQ ID NO: 119024 - protein, 105 aa, Triticum aestivum
  Clone ID: PAT_TA_13442.pep
WLVNVDARSIHYDPTIYDSPTVFDPSRFNDDMKPYSFLAFGAGSRTCLGMNLAKIMMLIFLHRLVTNFRWEMADHDTSLEKWAMFPRLKNGCPIQLTPIRKDKMH

SEQ ID NO: 119025 - protein, 116 aa, Triticum aestivum
  unsure (1)..(116): unsure at all Xaa locations
  Clone ID: PAT_TA_13443.pep
FCSGDTIFVAWGSXQGREQGGRQTQEARPLREGMSKGRFCSILQNSRPPNGTTCPARGGDVXQKFRRKGAKLQQVWCHWPSEEHHATGQREKLFQGVLLYLAIRTKSGCRMHMSCV

SEQ ID NO: 119026 - protein, 181 aa, Triticum aestivum
  Clone ID: PAT_TA_13444.pep
MAGSKPAFASPLEKIHPMGANPEGGLEQTGGQVFKGLDALRVSKAMGQGNASSSPSVSWGDMLTTPGSRFGLSAREAGIAETASGNSRIMAAGVCGQSADTLSFICEGDEALGSMKEVEAQTIGDLLPTDDDLISGVIDGFELSGLSINQDDADEDIFGTGGGLELENDDSISIKGARNLG

SEQ ID NO: 119027 - protein, 199 aa, Triticum aestivum
  Clone ID: PAT_TA_13445.pep
AWSRPRYTVPVEERFVMKRIGPKNFHMFRCVTRYGYKDIQKKHDDFEKMLLDRLLIFVRLESMMDGYSDSEDFTMTEHKVERPANALLMSEKAGSDLSYSSHDSSIVLAKSPLTGNNSVTRYSSQTYGDELEFLNSCKDAGVVHILGNTIVCARRDSGIIKRIVVDHLYAFLRKVCREHSVIFNVPHESLLNVGQIYYI

SEQ ID NO: 119028 - protein, 99 aa, Triticum aestivum
  Clone ID: PAT_TA_13446.pep
LGVTRKEIVSTSSFSASFNTQMCNKIGIPSYIDELEPLKLVRYERISRKPSTPSEKALESSDIVHYQTWSSVSIILFQNPFSIAINMVVPLFFLNSSFF

SEQ ID NO: 119029 - protein, 98 aa, Triticum aestivum
  Clone ID: PAT_TA_13447.pep
MGGGVVRCCVKILALLSLVPLALRAGSFLGHVVAPPPSSARPAAAARRASVVAGSAHVKTSEGAALAAARNRNGAGVGGFGDDKRMAPSGSNPLHNLR

SEQ ID NO: 119030 - protein, 99 aa, Triticum aestivum
  Clone ID: PAT_TA_13448.pep
YPPSSDSISSTHCSLPFAFLLLRVASFVIHVSVCALRSHHVVETDPFIAWHNPCVFEVLPYIHAETASLALIVAMVQTNSTSHLFCSILFQIFSAKDPN

SEQ ID NO: 119031 - protein, 199 aa, Triticum aestivum
  Clone ID: PAT_TA_13449.pep
RPRTRGRTRGRTRGRTRGRTRGHWTELLKKPTKRGHTLLCKKLSKLSLENLEQLYLPTLFDNHWILVVINFTQNTIEIYDSNKKVKEGEDPHKVILDNMCTNLQEALTAILNQSAINFIHFPRKYCYAGKQTNNDDCGFWVIKVLLCHNGKGLVGNYKWEMDVFRKEICYILVYHRFNDLNPRRPAIQKIASSVQTIVE

SEQ ID NO: 119032 - protein, 296 aa, Triticum aestivum
  Clone ID: PAT_TA_13450.pep
MPDLSPSKGVLSCLYSRCDSASQSKGTHKLLFDLILDYYDKAVDRLPVKEMPPDVDLLRLVEGSGFCFGLLDPVSNIIFNTISVLPHDIGATPKPSSPCRKKSKRTLPKITRKPKWDEIASKSYKGLIDFMLSYFGCLSKDQAARYLFWSSADVSLAVMLVEYEFGTDNPLLPYPGSERTQAALKMAALGARHTAPDSFVRFVTSQYPRNILLNSARVLADSGRKLHIADVKGIVDLVHSLDTPCYDAKVALLPNGRTVCYVQKITFHGEVLAAEAVTSKISDLGDGYSSSSTTTT

SEQ ID NO: 119033 - protein, 130 aa, Triticum aestivum
  unsure (1)..(130): unsure at all Xaa locations
  Clone ID: PAT_TA_13451.pep
HSDAGFLTILLQDEVGGLQIFNEDRWVDVTPTPGAFIVNIGDLLQLISNDGFRSVEHRVLAKNAAPRALDRVLPXSTHFHPASTRMYGPIKELLTEENKPLYRETLVRDYMKHYFSIGLDAKTAISDFRL

SEQ ID NO: 119034 - protein, 214 aa, Triticum aestivum
  unsure (1)..(214): unsure at all Xaa locations
  Clone ID: PAT_TA_13452.pep
VRTPMLGRREADIRNKMVAPANANLEGLMPIDDLDTTGGSKLEKYARDTLDPSLSWKDVEWLKSITSLPILLKGIVTAEDGGGGKXARKAVEAGAAGIIVSNHGARQLDYAPATISALEEVVKAVVGAVPVLVDGGVRRGTDLLKALALGARAVMVGRPVLYGLAARGQAGAKHVIEMLNRELELAMALCGCRSVAEITRDRVQTEGDRFRSLL

SEQ ID NO: 119035 - protein, 194 aa, Triticum aestivum
  Clone ID: PAT_TA_13453.pep
SPSLFSCAAGLDAAAPVALDAPPHLRVPPPPPPIMQAEQPQVDAVRLPDLTSLNRLQRGEDFGVRTGGCGQSSSSSWPPEALMKSYRSTILHLVPEEKRLSIYKSDVRQSQTKFRTHDCRSSFRRSVLEEKKWSTMHACVEQIVGRSCARSFEESAPQTTIWPSMAYTANPAITFFGHTVIDGYTETMSNQVNQ

SEQ ID NO: 119036 - protein, 90 aa, Triticum aestivum
  Clone ID: PAT_TA_13454.pep
GIDPKRLCRGITPIYDNITRETKRTSSLYAVETSVAFTTVQAHMSTIVVLVIKQKDLACLLSGFRATNVNDVKPAHSPAARSLQFRHSTP

SEQ ID NO: 119037 - protein, 135 aa, Triticum aestivum
  Clone ID: PAT_TA_13455.pep
RREGASEGEVGVIQFKMRGLHREMSRYDENRAGREWSDRKRKGCVVRWIFFVLGPLFVGDNMMNSPDNHISPPYMICIWGRLNCLAGLILGCRLGTHLMSKHLRTWEGYMSFTVGDNLNYLFDSLVARSNARAFY

SEQ ID NO: 119038 - protein, 62 aa, Triticum aestivum
  Clone ID: PAT_TA_13456.pep
ISMVYKHSKMTTKDVTYKWHKENQIDPQMQVLLGVITKLFETWPYPLSRFSGRVAPDCLTVS

SEQ ID NO: 119039 - protein, 122 aa, Triticum aestivum
  unsure (1)..(122): unsure at all Xaa locations
  Clone ID: PAT_TA_13457.pep
RASGRRGSRWRRRRRRWRPPPCSSSPSPPRCPPTSCPSAPXAPRRCAPSRPCMSTPPPSSPFPLFLLWPSPRQQPWPSLPCRAASSSPPGSPDQPPPWPSRRWQPLPSALASPVSPWLLLAG

SEQ ID NO: 119040 - protein, 88 aa, Triticum aestivum
  Clone ID: PAT_TA_13458.pep
LTGSRPVFFFWGKYRKQAGKGSLAYRVRPGTETERPQLVVFGWAKLKQKPKENLTDLFLLSVDFVLLCRFDHICTNRLTSLLCQSIDL

SEQ ID NO: 119041 - protein, 186 aa, Triticum aestivum
  Clone ID: PAT_TA_13459.pep
AADRAASSSSIGARAIHPIFLPFGDSGRRLIGIQRCEECFGICQEVHYRTLCSTLATLPGVTTPQQLLDTALRVTAAKSAMAEMRLDEAMRAGLGNTIPMMSSLQSCRDSYASLTDSLGKSRTTLKKGGSRDDLMSELSAASTYSTDCRDIFGERPELKSPIRGAQRHIMRLVSNCLDLATAIRQP

SEQ ID NO: 119042 - protein, 181 aa, Triticum aestivum
  unsure (1)..(181): unsure at all Xaa locations
  Clone ID: PAT_TA_13460.pep
PRVRPRVRFDKMLSVMCPPTPTPTPPPLLPPLTPLVTRRRDTHPVPRRSWGVDVGELVLAGCSKVVPGNSVPDAQLRGKQTYEAGAVQGEEFAILTEAIHRLXEVYERVESSRRQHMAELKRMRKDMQRDLEVRRREILEKAQMEIASLEEEDAKEGAVNNRLEDHNGVEEQNNGALDASP

SEQ ID NO: 119043 - protein, 112 aa, Triticum aestivum
  Clone ID: PAT_TA_13461.pep
MYRMMLVPLIDFLLCSGSWAMGVRTLFGMHRPGKTPVLLCSLHKSNCVRMLGLPSFEDIGTLSSKTEVKTIELAQGPSRLLLTGDGAGELKVWTWAPQDEESPSTGAAINVS

SEQ ID NO: 119044 - protein, 56 aa, Triticum aestivum
  Clone ID: PAT_TA_13462.pep
YTILHRYISSIKYSQIVHTCKCKNRCYSSWKQCYRNINNGTAFVFVSQSTNMYGIL

SEQ ID NO: 119045 - protein, 123 aa, Triticum aestivum
  unsure (1)..(123): unsure at all Xaa locations
  Clone ID: PAT_TA_13463.pep
VAPQRNVLRHRAXGCFLTHAGWNSTLECALEGVPMVCWPFFSDQQINSRFVGAVWRTGLDMKGVCERGVVERTVREAMVSDKIRGVAQAMAQQLRLDVAQAGPSSSELERLVRFIRELSIRSC

SEQ ID NO: 119046 - protein, 85 aa, Triticum aestivum
  unsure (1)..(85): unsure at all Xaa locations
  Clone ID: PAT_TA_13464.pep
RQRDGDFPCGRTYSLIIVPPLQVGASPQRGRGAPLLTILINPREMNRERAEPGIQQRRSPGLPGLGGSCPPGQIVRALXXXPXXX

SEQ ID NO: 119047 - protein, 64 aa, Triticum aestivum
  Clone ID: PAT_TA_13465.pep
RQNQQGVPDYNKLCANLDRIDNKCCIHMACDRKITTRNDASRLTETCWIKTLGQITDNTQLSES

SEQ ID NO: 119048 - protein, 100 aa, Triticum aestivum
  unsure (1)..(100): unsure at all Xaa locations
  Clone ID: PAT_TA_13466.pep
GEFMGSVSPDLRFVIDDISGDDPSAVGVTWHLEWKGRPFPFSRGCSFYRCEPDPQRPQQIQIVYGRDCVEPATKPGELALGXIRGVTWILERFPSLADRL

SEQ ID NO: 119049 - protein, 89 aa, Triticum aestivum
  Clone ID: PAT_TA_13467.pep
IHGTSREECDYWRGGHMEGRRGQASMATGAGDTQPGSGAGDGEPGRRRPVEEWLPGAGMEGTSQNPSCQELVAKDLHGTEWHFCGDFTI

SEQ ID NO: 119050 - protein, 294 aa, Triticum aestivum
  Clone ID: PAT_TA_13468.pep
VRPRVRPRVRGRVGGDGTVITFGATVRILEGRRASYSGERPEVSDYSSRGPNIENAQMQLADVLKPNVMAPGHHIWGAWSPTSGALPEVQGESYAILSGTSMSTPHVAGVVALIKQRHPKWSPAMIMSAIMTTADVTDRSGRPLMARRDVGAVVAATPFDMGAGAINAARALDPGLVFDATYREYLQFLCAVPGVDEAAVRRAVGASCPSSRARWCSDLNAPSVTVASLVGSRRVDRKVWSVGAENETYMAYVRAPDGVAVRVSPDEFTVAPGETVGLRIVLNTTVPGNAFSFG

SEQ ID NO: 119051 - protein, 181 aa, Triticum aestivum
  unsure (1)..(181): unsure at all Xaa locations
  Clone ID: PAT_TA_13469.pep
MQQVTMSPSICLAILLLALVSPSPASASITNNNGVAVAAPRVPVAFQFLQGHNDARREVGVAPLEWNWTLGQDAKRYAAQLVVRCKLEPPKYIPPIYARNRYWGSGKQDGAAATGSWVYERRWYDQXANACAPGKECGSYKLVVRNTTRELGCACRTCRGSNDXVAVCSYSPGGNFADPPY

SEQ ID NO: 119052 - protein, 204 aa, Triticum aestivum
  unsure (1)..(204): unsure at all Xaa locations
  Clone ID: PAT_TA_13470.pep
KDDCQXITEQDSYLTLTGPSRGVVMSHDNSHLEVKLKVKGTTESEDKDLNKFVDSYRLGCFLPIEYTSKLCTVEMQYYTAFSSVEATIFVRVFKGRWPHGFRGVLTASTSKKRDIQISLLELNCDKLPVDADGFVKLSRSVICVEKDGKLGLSILQRGAGGEEGRAIAGIWIAAEDAGKATHYMPVEALDCWMEVTVAWSLFSI

SEQ ID NO: 119053 - protein, 193 aa, Triticum aestivum
  unsure (1)..(193): unsure at all Xaa locations
  Clone ID: PAT_TA_13471.pep
SHPDWSAAAIKSAILTTSDITDSTGGPILDEQPHXAMGAGHVNPSKAIDPGLVYDLGITEYAGDICALLGDQGLEIIVRDPRLSCKMLPKIPEAFLNYPTITVPLKTRPFTVNRTVTNVGPANSVYILKMEIPSSLTVRVXPEMLVFSKAGEKKTFSMTVSTSSSDGNKFIEGSFSWVSVHHVVRSPIVALSF

SEQ ID NO: 119054 - protein, 256 aa, Triticum aestivum
  unsure (1)..(256): unsure at all Xaa locations
  Clone ID: PAT_TA_13472.pep
QRPRPRGLYAGQKERXVFQHSSFLAGGATIAAGRFTAEXGVIKSIWAYSGHYKPSAENLTNFMSFLEENGVDLKEVEVRSSTKEDYYEDPVPNIKENPAAAAMMASNTPQLILPSNMVEEDKASGPSSQTEADEDDNVRVEQARPTYQRTLSGGLQSPRDAVVSQDAILERVNSKSKSKSYQLGHRLSLKWSTGNGPRIGCVKDYPIELRMQALEMVQLSPRASTPPASWRMPSCLSPTLPMPPLVPLQASLPQPS

SEQ ID NO: 119055 - protein, 423 aa, Triticum aestivum
  unsure (1)..(423): unsure at all Xaa locations
  Clone ID: PAT_TA_13473.pep
LSLVVVEGLWWQALDFARLNHSTVYFYQHQEPETAASRWNLVSLKASKVGPGMFTDANALNSRXQHWIESIYPSHSYGQNLLFCYDVWCQTQAGQPFFGWRDIGDGKDVGLPECPRARLDXQWIRYLGRQEREFHEYIFKEGKIIHXICGGALDTSQGPQGTYWILVMSNAWKLYPGHKAXGLHQPSSCSGGGPAIPATRLDLKXGRLKXIWAYSGQFNPSAEIPPFSRKFLEKKGFHRMQVQVRSSTKEDYYEDPVLNSKQNPAAAAIMPSNPPQLILPSNMVEEDKASGPSSQTEADEVNDNLRVEKARSAYQRTLSGGLQSPRDVGVSQDAILERVNSKSKSKSYQLGHRLSLKWSTGNGPRIGCVRDYPIELRMQALEMVQLSPRASTPPASWRVPSCLSPTSPTSPLVAMQASLPQPS

SEQ ID NO: 119056 - protein, 86 aa, Triticum aestivum
  Clone ID: PAT_TA_13474.pep
VQGDMFLWVTVPLRWKWRLLSLGLFLLRNRRHLMMNGMDFDGIERSGQWDGSLNVVKMMAKERHYRSLFPLNLSVRSVEVPLYFCI

SEQ ID NO: 119057 - protein, 104 aa, Triticum aestivum
  Clone ID: PAT_TA_13475.pep
GPTEAAEHATISDFQAELVQLGAALNGDHAKDTYPHKLVEGMTVADAARYCNGAFKAFQDECERCKKCGKDGSHIPTMPPLPPSKKRSGFASKMLACFACGHSS

SEQ ID NO: 119058 - protein, 191 aa, Triticum aestivum
  Clone ID: PAT_TA_13476.pep
TRPCHRKGKEGDKVLGREVVLDKQPDGKEVLKITIKNPSLGGQPQVQEDTQVRFIKPKNSEVGKWEKSEAKRKRIRPTFDMLLSKYASQAAGSCSNRSSHSKRSRLPPEQEFRRYARPYGSWAPTWMSQPSYAPYYMRDFNGGWWQHPMAPYAFHMGWAAPRRPARNRLYYPTQGRLSYGANRPTKKTQKK

SEQ ID NO: 119059 - protein, 137 aa, Triticum aestivum
  unsure (1)..(137): unsure at all Xaa locations
  Clone ID: PAT_TA_13477.pep
QGQGYYDNTLDGWVGLHEDXYICACQVAPRSRGSTQQPEWKVVKGKLFHKVPERKRAASCATLTYMGNARFCLVECVVREEVEYEDALGDCDGCMLLMTKFGLKYSHNGELQTINRTTNSYVLSKHITGFSPVAFWM

SEQ ID NO: 119060 - protein, 601 aa, Triticum aestivum
  Clone ID: PAT_TA_13478.pep
YPWHKHVKSLEPILRRVVKEEVAGALAKLGPAAAPARIEGRTSPKRIEGPNGSNLQLQFRSRLALPLFTGGKVEGEQGASIHVVLLDANTGHVVTSGPESFAKLDVLVLEGDFNKEKDEDWTEEEFESHIVKEREGKRPLLNGDIHVTLKEGVGTIGELIFTDNSSWIRSRKFRLGMRVSSGFCEGIRIKEAKTEAFTVKDHRGELYKKHYPPALKDDVWRLEKIGKDGAFHGKLNSNGIYTVEHFLQLLVKDQQKLRSILGTGMSNKMWESLVEHAKTCVLSGKHYIYYSKDTASVGAIFNNIYEFTGLIADDQFISTENLTENQRVFADTLVKQAYDDWINVVEYDGKGLLKFKQKKKSVTTRSDAANVSTSYTSYDSAHSQKQLARGHANANIERSLMSSTSKAEETRIASNGNQVAIYAANPQDISPSITMQYGMSSLIPEGQFNGSSIQTQASRSSNMLAFGPPPQQQQNFEFSTLGLSMQSPALNPFDDWPGRSQENRGGVDDFLMEEIRVRSHDILENEEEMQHMLRILSGGAAANMNTYIPSPIPTYNFEDDRAPSSGKAVVGWLKIKAAMRWGIFVRKKAAERRAQLVELDD

SEQ ID NO: 119061 - protein, 254 aa, Triticum aestivum
  unsure (1)..(254): unsure at all Xaa locations
  Clone ID: PAT_TA_13479.pep
TTANIWDLYDFVDPDVVLTILVHQVILASLSDVVEARLWLHDWLAIFIAQYNKAYKNVRPADSGVSDIDVDFSNCSQLQPLARLVFAFLVSPLLQVQDEHIHPDYQTYLQCLFSALEPASGRRAICPTLSSYSSLDTEAEVHQSLSRSVFTSERPIFLLDAYTDLLVYYLPTASPSIPFPPPRDCLLRSTVDRLKQERTLTPRLAFIHGARDDTTTSEKYLIEDRALDGTLMDGSTGFRSXLEEVRSRVAEFGI

SEQ ID NO: 119062 - protein, 139 aa, Triticum aestivum
  Clone ID: PAT_TA_13480.pep
SWKHRCWLKSRDGLRFQDRQAAESNRNIIGSACVIIKVEGDMVDNANSLTASSNWDALTGLSAPSKKRCVERPCSSRENVPYEAMSKRTRFCSICKLPGHKKTTCPDKGDVSKQPRMPASSKNCGIGGQGIVAPRTSGR

SEQ ID NO: 119063 - protein, 90 aa, Triticum aestivum
  Clone ID: PAT_TA_13481.pep
IMAVRETVQQLHHEQFNIFTSTYSYMKFLSEAYCNALGVAQRPTILVAFRLLLSQRDHFLQVHIVSDENLVIAADLSNTMCRSLAAHHTC

SEQ ID NO: 119064 - protein, 60 aa, Triticum aestivum
  Clone ID: PAT_TA_13482.pep
TQPLDLVDSHNKRVTHAKLESVLHIEPFAHVSEYFMSSTISFFVVCVLIYIYGIGGLQVI

SEQ ID NO: 119065 - protein, 141 aa, Triticum aestivum
  Clone ID: PAT_TA_13483.pep
LFIAVSSSVNSYEIHQLSWRFKRKKRNKENKKLSPGQNYRILNQIEEQSEEARKSKKPKRAMMVFSVSRETVSKHRRRTRKAKPKEEEEEGGYARILPPNAPKGFVCHQPNRLPNLIQNSGLIIEGRSARGLVHRLHLELR

SEQ ID NO: 119066 - protein, 536 aa, Triticum aestivum
  unsure (1)..(536): unsure at all Xaa locations
  Clone ID: PAT_TA_13484.pep
MARRGWRRPLASLPALALALLLLAVAAAAAGSPDRAAPSRPPLVLPLTLSYPNASRVASSRSRRGLAEGGHPSARMRLHDDLLTNGYYTTRLYIGTPPQXFALIVDSGSTVTYVPCASCEQCGNHQDPRFQPDLSSTYSPVKCNVDCNCDSDKSQCTYERQYAEMSSSSGVLGEDIVSFGTESELKPQRAVFGCENSETGDLFSQHADGIMGLGRGQLSIMDQLVDKGVIGDSFSMCYGGMDIGGGAMVLGAMPGPPDMVYTHSNAVRSPYYNIELKEIHVAGKPLRVDPRIFDGKHGTVLDSGTTYAYLPEQAFVAFKDAVTSKVHPLKKIRGPDPNYKDICFAGAGRNVSQLSEVFPKVDMVFGNGQKLSLSPENYLFRHSKVEGAYCLGVFQNGKDPTTLLGGIVVRNTLVTYDRHNEKIGFWKTNCSXELWERLQSGGAPSPTPSNDQXSKADLSPAPAPNGLPEIMMLGPAPVKSPINVTXPNLETQLEEFGELLAKERGKIPSRLRKYEGQTGFQRSSQGGTRQSNETGY

SEQ ID NO: 119067 - protein, 68 aa, Triticum aestivum
  Clone ID: PAT_TA_13485.pep
HEKKCFSRLFPLLKQAASLVSQRLYYQDMIPTGLHLKQPHQKQNSYKAGLKHRHAAASGLARAELLRR

SEQ ID NO: 119068 - protein, 86 aa, Triticum aestivum
  Clone ID: PAT_TA_13486.pep
TFKTHFSAALSGLVQLFWRRPSITQFSHSPGFRGFLGTSPLSGLIGDSTLVPLVLTDAAKLMLTQALVWRLLPAICQTVDPSMFFP

SEQ ID NO: 119069 - protein, 207 aa, Triticum aestivum
  unsure (1)..(207): unsure at all Xaa locations
  Clone ID: PAT_TA_13487.pep
HEAPKSPSTTDRAGGPSRTRALPPASPTTAALPPASPPPHPHRQRPPPPXALPPPLATPPPQATLDPEFCSRQPASTQPRHRRQPSTLTVRSLPPLPPTTPXSANEHGAPPQTTTXHRATPPPNASPSRASPPPEQARIERDCLLDVLSDPPSSRVSLFSHDQLTTISTSYVCLLCPIKSICGGGDDPIHEDVDPGSIDPLLKEKEA

SEQ ID NO: 119070 - protein, 155 aa, Triticum aestivum
  Clone ID: PAT_TA_13488.pep
SLQRRSEFLISEAGLQPAYIAQRSVILGHSLEGRLRPRYYAVKFLKENGLLRRDPSYDTIVKLTDKVFREKFIYPHKEAAPHLEEDYDAACKGKCRLISDSHEPGTSYDIAMCCLSAAVCLLDAGLLLLMCDETDNLVPEYCYMMPSFSREETMD

SEQ ID NO: 119071 - protein, 167 aa, Triticum aestivum
  unsure (1)..(167): unsure at all Xaa locations
  Clone ID: PAT_TA_13489.pep
GISTLHLGTTVFQKMIDVTMTTKMRSMKILVLESSPNLDLVIDFLVCFPCLAKLYVILNAGKNMNIVRKYDQLDPIECLELHLKEVVSRXYCGGYRPXFDFANSFLLNAKVLNKMEIGGSYYRNDDCYLRLLQVGNRXSQDARIEVNRNIFTRQVHTQDLSMADPFD

SEQ ID NO: 119072 - protein, 109 aa, Triticum aestivum
  unsure (1)..(109): unsure at all Xaa locations
  Clone ID: PAT_TA_13490.pep
RAGFGEQNHQRVVWCFFLMFTTLIHITFLFFLDGNVQCTEVFFGVDCKARMKQHSTLGKIRLACSPLLRRHXPWIRDKVHMLCVCSSAHSECTSLLLDLLLLGMRLIIC

SEQ ID NO: 119073 - protein, 122 aa, Triticum aestivum
  Clone ID: PAT_TA_13491.pep
CTTANRRWPGCTAATATSGAAARRRIRGGRRTATPSCSPRSSPTRPSLSCSTAWALTTGGACRPWCRRRRTSWRPPPAAPTTCPQAMRAARPSWRTTAAVGSAPPTSADLIGPLVLSISIVT

SEQ ID NO: 119074 - protein, 261 aa, Triticum aestivum
  Clone ID: PAT_TA_13492.pep
MAGNGASAWRQLTPFPLYLAIFFLLGANGAEAATSFSFTNACAHPVWVGALSGATSPQLPRTGFYLAPGATSALAAPSSGAWSGNFWARTGCAVDEGTGRLACAMADCGTGDVACDGRGPAPPVTLAEITLAAPGSGGLDFYDVSLVDGFNLPVSIAPSHGGCQAAACAGDVNAVCPSDLRVVSGSSGEVVACKSACNAYGSARYCCSGDYGTPAACGPTNYSQVFKAACPAAYSYAYDDASSTFTCSGAATYHITFCPAT

SEQ ID NO: 119075 - protein, 204 aa, Triticum aestivum
  unsure (1)..(204): unsure at all Xaa locations
  Clone ID: PAT_TA_13493.pep
MSDRRRDKERPRERGGYDQPRERDHDADRHRDRDRDRDRDVDRHRDRDRGQDKERDRDRDRDYRRARKRSRSPSPSADRDRSRRRRSHSHSHPHRSRSPDAGRHKRRREVSPVADPKEDDRKAGPPFRXKAAEEPAPVGDGDVDAEELEMMKMMGIPVGFDSTKGKYVPGADVSGVRAVTKRQPRQYMNRRGGFNRPLPPEVNR

SEQ ID NO: 119076 - protein, 84 aa, Triticum aestivum
  Clone ID: PAT_TA_13494.pep
IELDKLLSLNGNGSQVILGFAEENNVVFVWTHGVLFMVNLESLQFKKLGETRTLSHYHPFESVYTAEIEIGGGHDGVDLSQHIR

SEQ ID NO: 119077 - protein, 189 aa, Triticum aestivum
  Clone ID: PAT_TA_13495.pep
RPFFGSIEVMYFSASLGKFHEGAWVPITLSFIFMVVMSVWHYGTIKKYEFDVQNKVSVNWLLNLGPSLGIVRVRGIGLIHTELMSGIPAIFSHFVTNLPAFHQVLVFLCVKSVPVPHVEPEERFLVGRIGPKEYRLYRVIVRYGYRDVQQDDLEFEKELINSIAEFIRSGGADQNGFVEGSEKLSSISS

SEQ ID NO: 119078 - protein, 63 aa, Triticum aestivum
  Clone ID: PAT_TA_13496.pep
IQPFLSILMTSIFGRRDYAKKYVALMTTAIIKRIYIQSAVFQYQDLTRKINYNRQLYYKVNGD

SEQ ID NO: 119079 - protein, 120 aa, Triticum aestivum
  unsure (1)..(120): unsure at all Xaa locations
  Clone ID: PAT_TA_13497.pep
ISTTVISRNDRNLVTRVQELIDPVTNVWDGQEIIKIPVHDQFDDQPAWHYDKRGLFAVKSAYKVARDRSKAHESFRGLATTSNPATDNQVFXERNYIWGLSLPNKVLHFLWRLTTTSSPM

SEQ ID NO: 119080 - protein, 76 aa, Triticum aestivum
  Clone ID: PAT_TA_13498.pep
FFFFFFPGQNSTSLVQDIKRYTGHEPAWVKRILVEFHSNTMFKDKPLITYSIFYIGVVLDTCVSPQAHISFRSRCD

SEQ ID NO: 119081 - protein, 238 aa, Triticum aestivum
  Clone ID: PAT_TA_13499.pep
ALKKIKHLEVLSMSGIQSVCDKFVNELIPIHGSNIRELAFAGCLKLTSSSIKTIGVNCPQLSSLDIRNLNRLRDSATRHLRDGCRLIKKLKLQKNTFSDVALSQFLEESGGSLTELSLNNIEKVGNLTARAIALKCSVRLEVLDVSFCRGLSNEALGLIVDSCSSLRTLKLFGCTQITDIFLKGHSNSLVKIIGIEGSILEQVGSLLVCPRMMLHLSDEPAVQLGQGNSSRTYLADTS

SEQ ID NO: 119082 - protein, 94 aa, Triticum aestivum
  Clone ID: PAT_TA_13500.pep
RGRGRGACDTSDPQLPSLLLCPWAMAVLMHQIHYRSICCNIGWVVSSPLYQHTGVTSNCIRSSVKNHLRKICHSSLQGLHVEFEENLCTSIPTP

SEQ ID NO: 119083 - protein, 150 aa, Triticum aestivum
  Clone ID: PAT_TA_13501.pep
IRPRTLGRTWPHGYRGVFKAETSGIPEKSVMLLDCRDGKLPVDGDGHVKFSRRVVCVEVAPLDELCVTNLKVSIEAVRIKGKKEKVKEKIRKHTVKLEADFLPKKKGRSREIVEVLSCEMEVEVAWSLLSTFKASYKRAIADHLESLNLV

SEQ ID NO: 119084 - protein, 140 aa, Triticum aestivum
  unsure (1)..(140): unsure at all Xaa locations
  Clone ID: PAT_TA_13502.pep
FAPAVPVPAVXGCYTATAPKNGYALGRLGCLPWAVAGTAKPTPRPDDSGGPRGPQHAAAPRPGQRLGLWKVELVKQRPRGHWAKRGASEEVGDCTGVELEKESTVDTIIPSGEPAVEQRESRRMSPQHRGGGRPPNDXYP

SEQ ID NO: 119085 - protein, 72 aa, Triticum aestivum
  unsure (1)..(72): unsure at all Xaa locations
  Clone ID: PAT_TA_13503.pep
MQRTCFPTSIVTDPQVQMGSSTEGXSEAASKPYYYXNLFSDLIDLKSPSGGNKTGTSLGSXNGGQPMIGGKK

SEQ ID NO: 119086 - protein, 247 aa, Triticum aestivum
  Clone ID: PAT_TA_13504.pep
MAAAATTSSALSMKLLVDTKAQRVLFAEASKDVVDLLFSLLALPVGTAVKLLGKDSMVGCVGNLYGSVEKLDGTYVQPGTAKDALLHPVVFSPGAAGTNMFRLPEATSGGQFKALFKCSYCTGSYVSETSGTKCPSCSYPMATALRFASGGGGAAAAGGVSGKGFVQGIVTYTVMDDLRVTPMSSISSIALLNTFAVRDLGALQEKTVQLGYEEGLAILKASLQSKTVLTDVFLAPPRRAGRARSCA

SEQ ID NO: 119087 - protein, 117 aa, Triticum aestivum
  unsure (1)..(117): unsure at all Xaa locations
  Clone ID: PAT_TA_13505.pep
MAAATLRWVIQMHRDVPRAARFYAEGLDFRVNVCTLRFAELQSGPFKLALMHTXTVHLSSRAYSSMLSFTKPDITSTIRKLMSLGAELDGPIKYEIHGKVAALRCIDGHVLGLYEPA

SEQ ID NO: 119088 - protein, 51 aa, Triticum aestivum
  Clone ID: PAT_TA_13506.pep
IIDPVKVIRTALQDAASVSLLMTTTEAAVAELPSTKARIASRMPDMSGMGF

SEQ ID NO: 119089 - protein, 180 aa, Triticum aestivum
  Clone ID: PAT_TA_13507.pep
IGVARGLMHLHQHGVVHYNLKSSNVQAAGNGEPRVGDYGLASLLPMLDRYVLSSKIQSALGYMAPEFACKTVKITEKCDVYGFGVLALEILTGRRPVEYLEDDVVVLCDLVRSALEEGRLEDCMDPRLCGEFAMEEAIPIIKLGLVCTSQVPSNRPDMGEVLSILDVVRSPQDSPGDEMV

SEQ ID NO: 119090 - protein, 197 aa, Triticum aestivum
  unsure (1)..(197): unsure at all Xaa locations
  Clone ID: PAT_TA_13508.pep
SWGRRADVVAVHPESPELVMDDVLKMQFVLATVCESARLLPAGPLLQRCSMQHDLTLKSSLTMPAGAILVVPLHLRARWMLLYGEMDACQFNPSGFLQKDIDLGRNIXAAHKGSNGIKLFXTERDKSDSFLPFGSGNRACVGQKFAILGISMLVASLLHNYEVQPQPALTKEMGLAVDSSNLRHLPNPKIILTKRKI

SEQ ID NO: 119091 - protein, 97 aa, Triticum aestivum
  Clone ID: PAT_TA_13509.pep
QHSHCYHVDLSNKAIVVHIDHNSSLITVCLRNAVVKMLQVRYGIRSGGTNHRQLSRVVQNPLALVDRTPRVTQSDGELDFEAEGGVDVVGWGCDDGG

SEQ ID NO: 119092 - protein, 194 aa, Triticum aestivum
  Clone ID: PAT_TA_13510.pep
MDPFLLSIILCSCIFAAVSWKKLNGMRLRLPPGPPRWPIFGNLLQLSPLPHKDFARFCTKYGPLVYLRLGTIDAITTDDPEVIREILIRQDEVFASRPRTLAAVHLAYGCGDVALAPLGPNWKRMRRVCMEHLLTTRRLESFAAHRAEEAEHLCEFVWAKSQSGKPVNLREVLGAFSMNNVTRMLLGKQYFGLQ

SEQ ID NO: 119093 - protein, 276 aa, Triticum aestivum
  unsure (1)..(276): unsure at all Xaa locations
  Clone ID: PAT_TA_13511.pep
MEASAQQGNYVQVYVMLPLDIVSVNNRFEKGDELRGQLKRLVEAGVDGVMVDVWWGLVEGKGPRVYDWSAYKQLFELVHEAGLKLQAIMSFHQCGGNVGDVVNIPIPQWVRNVGVSDPDIFYTDQHGTRNIEYLTLGVDDQPLFHGRSAVQMYADYMASFRDNMKEVLDAGLIVDIEAGLGPTGEXRYPIQSQKHEWSFPGLGEFNCYXKALQADFKDTAAXVGHPNGEISRDARTNNXTFPRTRFFRDQGTNFHCAGRFSFGGTPKPRKRWGTHF

SEQ ID NO: 119094 - protein, 188 aa, Triticum aestivum
  unsure (1)..(188): unsure at all Xaa locations
  Clone ID: PAT_TA_13512.pep
RNIEYLTLGVDDQPLFHGRSAVQMYADYMASFRDNMKEFLDAGVIVDIEVGLGPAGELRYPSYPQSHGWSFPGIGEFICYDKYLQADFKAAAAMVGHPEWEFPHDSGTYNDTPERTRFFVDNGTYLTEQGRFFLAWDSNNLIKHGDKILDETHKXFLGHRVQLAIKIXGIHWGDKGSKACWPSSQLGN

SEQ ID NO: 119095 - protein, 117 aa, Triticum aestivum
  Clone ID: PAT_TA_13513.pep
MEASAQQGNYVQVYVMLPLDIVSVNNRFEKGDELRGQLKRLVEAGVDGVMVDVWWGLVEGMGPKVYDWCGYKQWIRLEHEAGLTIQAFMHCTQGGGKGMYALHTVLAGRIILDLSDL

SEQ ID NO: 119096 - protein, 94 aa, Triticum aestivum
  Clone ID: PAT_TA_13514.pep
FVDNGTYLTEQGRFFLAWYSNNLIKHGDKILDEANKVFLGHRVQLAIKVSTIILNISVSYNSTPSVPNYLFWICLDTDVSRLILVLNTSVSRQI

SEQ ID NO: 119097 - protein, 343 aa, Triticum aestivum
  unsure (1)..(343): unsure at all Xaa locations
  Clone ID: PAT_TA_13515.pep
EKLISGKGFALNPGQKYYLVPSSWLSEWRAYITATGKNVSSLPEPQSLEVAINSLKCEKHSRLLQRPLDIVYKRGGITQKTSNTDGLAIISESDWQSFSEEWNVEHADGACAEIVFSKSSEDKPHESSEAMVISDKDPDQSINGANDDLEDCRPYVRTDPEVCEECIGERESCALVEKLNYQNEDIHVYLVRGKEAPKSIREASAALPVPDRRTSKRSRRTTTGNSISLKVSXSTTVYQLKLMIWESLGIVKENQEAXHKALLEIERGFADPGWISAFPLGDVLWXVKDPECFEDXDIADEIQWMHYLLKKFSWTIDTMYNSTLSRHIPRFQVILQHTLAGTC

SEQ ID NO: 119098 - protein, 176 aa, Triticum aestivum
  Clone ID: PAT_TA_13516.pep
MATLTSLASNPNPNKSFEVLPNPGDSLSSLSFSPKSNLLVATSWDNQVRCWEIGNGNSQPKASISHDQPVLCSAWKDDGTTVFSGGCDKQVKMWPLLSGGQAQTVAMHDAPVKEVSWISQMNLLVSGSWDKTLRYWDTRQPNPAHVQQLPDRCYALAVNYPLMIGGTADRNIVIFN

SEQ ID NO: 119099 - protein, 306 aa, Triticum aestivum
  unsure (1)..(306): unsure at all Xaa locations
  Clone ID: PAT_TA_13517.pep
MAGNMLANYVQVYVMLPLDVVSVDNKFEKGDEIRAQLKKLTEAGVDGVMIDVWWGLVEGKGPKAYDWSAYKQVFDLVHEAGLKLQAIMSFHQCGGNVGDVVNIPIPQWVRDVGATDPDIFYTNRGGTRNIEYLTLGVDDQPLFHGRTAVQMYADYMTSFRENMKKFLDAGTIVDIEVGLGPAGEMRYPSYPQSQGWVFPGIGEFICYDKYLEADFKAAAAKAXGHPEWELPDDAGEXYNDTPEKTQIXQRTTGQXLXXEXGKFFLSMGXQQNWFKXXXQXFWAKPXXVFLWEAQGKPKIPKSGGEK

SEQ ID NO: 119100 - protein, 120 aa, Triticum aestivum
  Clone ID: PAT_TA_13518.pep
STYQLLQELCCQHLWQIPEQSQCQAIHNVVHAIILHQQQKQQQQPSSQVSFQQPVQQYPLGQGSFRPCQQNPQAQGSVQPQQLPQFEEIRNLALQTLPAMCNVYIPPYCTIAPFGIFGTN

SEQ ID NO: 119101 - protein, 241 aa, Triticum aestivum
  Clone ID: PAT_TA_13519.pep
MEASVQQGNYVQVYVMLPLDAVSVNNRFEKGDELRPQLKRLVDAGVDGVMVDVWWGLVEAKGPRVYDWSAYKQLFKLVHEAGLKLQAIMSLHQCGGNVGDVVNIPIPQWVRDVGASDPDIFYTDQHGTRNIEYLTLGVDDQPLFHGRSAVQMYADYMASFRDNMKEFLDAGVIVDIEVGLGPAGELRYPSYPQSHGWSFPGIGEFIVSVSKYVSFCFDQFTFACNIDDQMLFSIVQSDDLH

SEQ ID NO: 119102 - protein, 389 aa, Triticum aestivum
  Clone ID: PAT_TA_13520.pep
DNEKEGAAPKPNAFQSLLPAVREKIVDGFTQEARDMFEREFDFFDKVTSISGVLFPLPKEERRAGIKRELEKITIPGDDLYLPTATNKLVRGIQLDSGIPLQSAAKVPIMITFNVIDRDGNPNDVMPQACIFKVGDDCRQDVLALQVIALLRDIFEAVGLNLYLFPYGVLPTGPERGIIEVVPNTRSRNQMGETTDGGLLEIFQQDYGPVGSPSFEAARQMFIVSSAGYAVASLLLQPKDRHNGNLLFDSQGRLVHIDFGFILEISPGGNMGFESAHFKLSHEMTQLLDPSGTMKSDTWNQFLRLCVKGYLAGRRHMNGIVTTVQLMVDSGLPCFSRGEPIANLRKRFHPEMNEREAANFMVRTCVDAYNKWTTAGYDLIQYLQQGIEK

SEQ ID NO: 119103 - protein, 176 aa, Triticum aestivum
  Clone ID: PAT_TA_13521.pep
RMLTRHHASMNFTCAEMRDSEQSEEAKSAPEELVQQVLSAGWREGLHVACENALGRFDATAYNTILRNARPKGINKNGPPEHKLFGFTYLRLSNELLEGQNYATFQTFVEKMHANLGHDPSVDPVAPLERSKPEMPIEMILKAAQPKLEPFPFDKNTDLPVKDHTDVGDEVLLAPV

SEQ ID NO: 119104 - protein, 617 aa, Triticum aestivum
  unsure (1)..(617): unsure at all Xaa locations
  Clone ID: PAT_TA_13522.pep
PTRPVVFKEAIPIKNISVVSRIHQTYRIGYLKDVILPRILDDATLASLNTMIHXNAAVISLLKDDACFIQDLFSRMRSPNISMELKRELVLFLHEFCTLSKSLPLVQQLRLFRDLSGEGVFEIVSDVLQSQDRKIVSAGTDIVILFLNQDPNLLRSYIVQQEGNSLLGLLVKGMVTDFGEQMHCQFLEILRILMDSFTMSGAHRDVIIEIFYERYLDYLVDVIASSCPSRSATRTSPNSALVGGNTEVHRIKPEILLNVCELLCFCVVHHPYRIKCNFLMNNAIEKILTMTRRSEKFLVVAAVRFMRTIISRNDEHLIRHVVKFNLLKPIIDAFVENGDRYNMLQSGVLELLEHIRKENLKPLVIYVTESFSDQLMKFEHFGSIQAFKLKYQQYLESADMKLSASVPDMRKKAEGRGLEKEEEDYFNESDEEDSVRRTKHAHSEHNEESKDDVANGSETGDISSRPKSGGLVDYADDDDEDFNPPPKEPDRPVDDDELLTISTVKRKLVNPGDGKHADGEVRKRQKIETRITCAKISALTNLASKHKDTLASSSPSCEANGVLGEHATHSDEHQHSTDTAETSRQVGGDCIKAMGSLSSEKAVNTTKINDSEPYLVR

SEQ ID NO: 119105 - protein, 230 aa, Triticum aestivum
  unsure (1)..(230): unsure at all Xaa locations
  Clone ID: PAT_TA_13523.pep
MEASVQQGNYVQVYVMLPLDAVSVNNRFEKGDELRPQLKRLVDAGVDGVMVDVWWGLVEAKGPRVYDWSAYKQLFKLVHEAGLKLQAIMSLHQXCGGNVGDVVNIPIPQWGAXDVGASDPDIFYTDQHGTRNIEYLTLGVDDQPLFHGRSAVQMYADYMASFRDNMKEFLDAGVIVDIEVGLGPTGELKYPSYPQSHGWAFPAIGKIICFEKNLEADFKTTTTMGGPSEW

SEQ ID NO: 119106 - protein, 343 aa, Triticum aestivum
  Clone ID: PAT_TA_13524.pep
MATLTSLASNPNPNKSFEVLPNPGDSLSSLSFSPKSNLLVATSWDNQVRCWEIGNGNSQPKASISHDQPVLCSAWKDDGTTVFSGGCDKQVKMWPLLSGGQAQTVAMHDAPVKEVAWISQMNLLVSGSWDKTLRYWDTRQPNPAHVQQLPDRCYALAVNYPLMIVGTADRNIVIFNLQNPQTEFKRIQSPLKYQTRCVAAFPDQQGFLVGSIEGRVGVHHIDDSQQSKNFTFKCHREGNDIFSVNSLNFHPVHHTFATAGSDGAFNFWDKDSKQRLKAFSRCPQPIPCSSFNNDGSIFAYGVCYDWSRGAENHNPANAKTSIYLHSPQEAEVKGKPRIATGRK

SEQ ID NO: 119107 - protein, 262 aa, Triticum aestivum
  unsure (1)..(262): unsure at all Xaa locations
  Clone ID: PAT_TA_13525.pep
MEASAQQGNYVQVYVMLPLDIVSVNNRFEKGDELRGQLKRLVEAGVDGVMVDVWWGLVEGKGPRVYDWSAYKQLFELVHEAGLKLQAIMSFHQXCGGNVGDVVNIPIPQWVRNVGVSDPDIFYTDQHGTRNIEYLTLGVDDQPLFHGRSAVQMYADYMASFMDNMKEFLXDAGLIVDIEVGLGPAGELRYPSYPQSHGWSFPGIGKFICYDKYLQADFKTATAIVGPPEWGFPSDAGTYNDLPQKTRFFVDNGTYFTLTGEV

SEQ ID NO: 119108 - protein, 503 aa, Triticum aestivum
  Clone ID: PAT_TA_13526.pep
MAGNMLANYVQVYVMLPLDVVSVDNKFEKGDETRAQLKKLTEAGVDGVMIDVWWGLVEGKGPKAYDWSAYKQVFDLVHEAGLKLQAIMSFHQCGGNVGDIVNIPIPQWVRDVGATDPDIFYTNRGGTRNIEYLTLGVDDQPLFHGRTAVQMYADYMTSFRENMKKFLDAGTIVDIEVGLGPAGEMRYPSYPQSQGWVFPGVGEFICYDKYLEADFKAAAAKAGHPEWELPDDAGEYNDTPEKTQFFKDNGTYLTEKGKFFLSWYSNKLIKHGDKILDEANKVFLGCRVQLAIKISGIHWWYRVPNHAAELTAGYYNLDDRDGYRTIARMLTRHHASMNFTCAEMRDSEQSEEAKSAPEELVQQVLSAGWREGLHVACENALGRYDATAYNTILRNARPKGINKNGPPEHKLFGFTYLRLSNELLEGQNYATFQTFVEKMHANLGHDPSVDPVAPLERSKPEMPIEMILKAAQPKLEPFPFDKNTDLPVKDHTDVGDEVLVAPV

SEQ ID NO: 119109 - protein, 306 aa, Triticum aestivum
  unsure (1)..(306): unsure at all Xaa locations
  Clone ID: PAT_TA_13527.pep
MEASVQQGNYVQVYVMLPXLDAVSVNNRFEKGDELREQLKRLVEAGVDGVMVDVWWGLVEGKGPRAYDWSAYKQLLQLVHEAGLKLKAIMSFHQCGGNVGDVVNIPIPQWVRDVGASDPDIFYTDQHGTRNIEYLTLGXVDDQPLXHGRSAVQMYADYMASFRDNMKEFLDAGVIVDIEVXDLGPAGELRYPXSYPQSHGWSFPGIGEFICYDKYLQADFKAAAAMVGHPEWEFPRDAGQYNDTPQRTRFFVDNGTYLTEQGRFFLAWYSNNLIKHGDKILDEANKVFLGHRVQLAIKISGIHWWY

SEQ ID NO: 119110 - protein, 503 aa, Triticum aestivum
  Clone ID: PAT_TA_13528.pep
MAGNMLANYVQVYVMLPLDVVSVDNKFEKGDEIRAQLKKLTEAGVDGVMIDVWWGLVEGKGPKAYDWSAYKQVFDLVHEAGLKLQAIMSFHQCGGNVGDVVNIPIPQWVRDVGATDPDIFYTNRGGTRNIEYLTLGVDDQPLFHGRTAVQMYADYMASFRENMKKFLDAGTIVDIEVGLGPAGEMRYPSYPQSQGWVFPGIGEFICYDKYLEADFKAAAAKAGHPEWELPDDAGEYNDTPEKTQFFKDNGTYLTEKGKFFLSWYSNKLIKHGDKILDEANKVFLGCRVQLAIKISGIHWWYRVPNHAAELTAGYYNLDDRDGYRTIARMLTRHHASMNFTCAEMRDSEQSEEAKSAPEELVQQVLSAGWREGLHVACENALGRYDATAYNTILRNARPKGINKNGPPEHKLFGFTYLRLSNELLEGQNYATFQTFVEKMHANLGHDPSVDPVAPLERSKPEMPIEMILKAAQPKLEPFPFDKNTDLPVKDHTDVGDEVLVAPV

SEQ ID NO: 119111 - protein, 542 aa, Triticum aestivum
  Clone ID: PAT_TA_13529.pep
REQKLELHPRWRPALELVDPPGCRNSAPEVYVMLPLDAVSVNNRFEKGDELREQLKRLVEAGVDGVMVDVWWGLVEGKGPRAYDWSAYKQLLQLVHEAGLKLKAIMSFHQCGGNVGDVVNIPIPQWVRNVGASDPDIFYTDQHGTRNIEYLTLGVDDQPLFHGRSAVQMYTDYMASFRDNMKEFLDAGVIVDIEVGLGPAGELRYPSYPQSHGWSFPGIGEFICYDKYLQADFKAAAAMVGHPEWEFPRDAGQYNDAPQRTRFFVDNGTYLTEQGRFFLAWYSNNLIKHGDKILDEANKVFLGHRVQLAIKISGIHWWYKVPSHAAEITAGYYNLHDRDGYRPIARMLKRHRASLNFTCAEMRDSEQSSQAMSAPEELVQQVLSAGWREGLNMACENALPRYDPTAYNTILRNARPHGINKSGPPEHKLFGFTYLRLSNQLVEGQNYVNFKTFVDRMHANLPHDPCVDPVAPLQRSGPELTIEMILQAAQPKLDPFPFEEHTDLPVQGLGGIGGDVEGPTGGMGGEVQDPTGSMGGELPATV

SEQ ID NO: 119112 - protein, 540 aa, Triticum aestivum
  unsure (1)..(540): unsure at all Xaa locations
  Clone ID: PAT_TA_13530.pep
MEASAQQGNYVQVYVMLPLXDIVSVNNRFEKGDELRGQLKRLVEAGVDGVMVDVWWGLVEGKGPRVYDWSAYKQLFELVHEAGLKLQAIMSFHQCGGNVGDVVNIPIPQWVRNVGVSDPDIFYTDQHGTRNIEYLTLGVDDQPLFHGRSAVQMYADYMASFRDNMKEFLDAGLIVDIEVGLGPAGELRYPSYPQSHGWSFPGIGEFICYDKYLQADFKAAAAMVGHPEWEFPRDAGTYNDTPQRTRFFVDNGTYLTEQGRFFLAWYSNNLIKHGDKILDEANKVFLGHTVQLAIKISGIHWWYKVPSHAAXEVTAGYYNLHDXDGYRPIARMLKRHHASLNFTCAEMRDSEQSSQAMSAPEELVQQVLSAGWREGLNMACENALPRYDPTAYNTILRNARPHGINKSGPPEHKLFGFTYLRLSNQLVEGQNYVNFKTFVDRMHANLPHDPCVDPVAPLQRSGPELTIEMXLQAAQPKLEPFPFEEHTDLPVQGLGGIGGGEVEDPTGGMGGEVQQDPTGGMGGEVEDPTGGMGGELPPTV

SEQ ID NO: 119113 - protein, 537 aa, Triticum aestivum
  Clone ID: PAT_TA_13531.pep
MEASVQQGNYVQVYVMLPLDAVSVNNRFEKGDELRPQLKRLVDAGVDGVMVDVWWGLVEAKGPRVYDWSAYKQLFKLVHEAGLKLQAIMSLHQCGGNVGDVVNIPIPQWVRDVGASDPDIFYTDQHGTRNIEYLTLGVDDQPLFHGRSAVQMYADYMASFRDNMKEFLDAGVIVDIEVGLGPAGELRYPSYPQSHGWSFPGIGEFICYDKYLQADFKAAAAMVGHPEWEFPHDSGTYNDTPERTRFFVDNGTYLTEQGRFFLAWYSNNLIKHGDKILDEANKVFLGHRVQLAIKISGIHWWYKAPSHAAELTAGYYNLHDRDGYRPIARMLKRHHASLNFTCAEMRDSEQSSQARSAPEELVQQVLSAGWREGLNVACENALPRYDPTAYNTILRNARPHGINKSGPPEHKLFGFTYLRLSNQLVEGQNYVNFKTFVDRMHANLPHDPCVDPVAPLQRSGPELTIEMILQAAQPKLEPFPFEEHTDLPVQGLGGIGGGEVEGPTGGMGGEVQDPTGGMGGEVQDPTGGMGGELPATM

SEQ ID NO: 119114 - protein, 191 aa, Triticum aestivum
  Clone ID: PAT_TA_13532.pep
PLVCKHPPSADRGRPRGRPRGRARGFVNVTIQSLMRITPLRNFFLIPENYQHSKSPLVHRFGELTRKIWHARNFKGQVSPHEFLQAVMKASEKKFQIGVQSDPVEFMSWLLNTLHAKLRSSKKKNRSIIYDCFQGELEVVKEIHRKHLVDDEQNGEAGSQVETTSDGMVTQTSRVPFLMLGLDLPPPTLFK

SEQ ID NO: 119115 - protein, 342 aa, Triticum aestivum
  Clone ID: PAT_TA_13533.pep
MESCSFRTATSPSPFPSAPSSSSSPRAPCPSLRFARARNGRQMRMRRMASGFDAFPPLPGKVFVEETIGAEYGEGFETFRMDGPLNIDVDYLNEKLQECFLQRIRHAMKPDEAFGLIFSWDNVIADTDSLKLDAWRQLALEEGKDIPTAAHIQKSILHGAADHVLRKVLYWAKEDDQMERLKARLIELYYESLFKLDTPVEGLREWLDAVRTAGIPCAVASSLDRRCMVEALDRMSLSKYFKAIVTDEDDMESIAHRFLSAAVKLDRKPSNCIVFEDDPRGVTAAHHCTMMAVSLIGAHPAYELEQADLAVARYSELSVINLGRMFAQQGVKLQWTCTKQII

SEQ ID NO: 119116 - protein, 229 aa, Triticum aestivum
  Clone ID: PAT_TA_13534.pep
MATAISASALLSSAFAGDRRHRRAARPAPRRAVPAGLTVRCEQSDKQKRQPLSALVPREQRFMFEGDELCGPDIWNTTWYPKAADHVTTEKTWYVVDAEDKILGRLASAIAVHMRGKNEPTYTPSVDMGAFVIVVNAEKVAVSGKKRSQKLYKRHSGRPGGMKEETFDQLQKRIPERIIEHAVRGMLPKGRLGRRLFTHLKVYKGSEHPHVAQKPVPLPIRDKRIMKSG

SEQ ID NO: 119117 - protein, 67 aa, Triticum aestivum
  Clone ID: PAT_TA_13535.pep
QAEPTITIILWLITEPVHNSKCNGCSQKQWANWAKHLKVLWLEQVYPFTHSKYLGRHHASIFTQKDT

SEQ ID NO: 119118 - protein, 91 aa, Triticum aestivum
  Clone ID: PAT_TA_13536.pep
LTNNHGIVHDMLHLLDLLHGVPLHRVGVCGYKHQSEMAGWGSSAALMFGTLIMWCCWRRLELQTTPTRCIHSLVVARDKAVMELSSSPFRQ

SEQ ID NO: 119119 - protein, 149 aa, Triticum aestivum
  Clone ID: PAT_TA_13537.pep
MREPHRLALLVAGEMASAAYLETDENLEALISRIEQKSRKIETLLKQSKPVEALKTALEGSPLKTRDERCKSANWIVVHRAMMAIRDIDGMFNSLDTEYYDILMKYLYRGLSTGDRPTCDQCLKIHEKLTERAGLGCILRSLADTVNTV

SEQ ID NO: 119120 - protein, 162 aa, Triticum aestivum
  Clone ID: PAT_TA_13538.pep
MPEYCVTGGTGFIASHLIRALLAAGHTVRATVRDPSDEAKVGFLWDLEGADERLQLLRADLLVEGSFDAAVSGVDGVFHAASPVVVSYEDGKDAQEKLVDPIVNGAGNVLRSCARAAVPPRRVVFTSSCSCVRYRHHHVHGGAPPTLNESHWSDPDYCRTYG

SEQ ID NO: 119121 - protein, 91 aa, Triticum aestivum
  Clone ID: PAT_TA_13539.pep
LGFVYSTLAAVVASKYTSGQLNLLGCHLDPTSLFCELYVREHAKWHTSGNSYKAADVWMLTPHICHFSHINYQHYRGRVCQKKKKKKKKKK

SEQ ID NO: 119122 - protein, 254 aa, Triticum aestivum
  Clone ID: PAT_TA_13540.pep
RPPTRPLSSSSGVRSAPCPCASGSWARWRTRKGKADARYKPWQRRRQGAARTETEAVDDTAGTSSRTSGRTETAGDGGTQQELPPGVSYQFSGAPGGGGGSGLSNQARGSAPFGGQNQIANPQFGGCGGGSGAGYRGFSQFADGHGGFSQFHSSPPAAMVQPTLGSQVAATICEVATPRLWTMEGTQLPLCEDCERTIFFHARPLQHLEQYLASTAVGGGAGSIPVFLAAHGRVGWFSQWAGDNPSFFLMKTHS

SEQ ID NO: 119123 - protein, 80 aa, Triticum aestivum
  Clone ID: PAT_TA_13541.pep
IAGVEDKLSPRCCRGLADIRDMAPTFDRRRALCACIHKEMLAAGKVVTRRAATLSARCGVRISFLPTAHAFDCYRIPRTD

SEQ ID NO: 119124 - protein, 116 aa, Triticum aestivum
  Clone ID: PAT_TA_13542.pep
RAQVAPGSPSRLAAPPHPRCHHAGPPRLRATRLQGCRAKPPRPLRHHAGPPRPPRSPRPPCSSRARHHTAPPRTRHASPSPRARHAPQPMPPCRPRTPRPPRTPPRTTAAPRTLWL

SEQ ID NO: 119125 - protein, 125 aa, Triticum aestivum
  unsure (1)..(125): unsure at all Xaa locations
  Clone ID: PAT_TA_13543.pep
SWQSPLELKQGAPCALRQQNQGWAFGSPLVLQXLAKTIYXXVAFIKXRXHNXXHGXFXGLLGTNXXSTXXAPXKXRPYLXPFFLRISXLGXXWXGXKFLXXXXXXGVGXXFPKKXRXXFXXXXXF

SEQ ID NO: 119126 - protein, 735 aa, Triticum aestivum
  unsure (1)..(735): unsure at all Xaa locations
  Clone ID: PAT_TA_13544.pep
SARPSAHGRASGESLVIEAITFLRHLKTLIMGKGQLGETFFQALAECPLLNTLTVSDASLGSGIQEVTVNHDGLHELQIVKCRALRVSIRCHQLRILSLRRTGMAHVSLNCPQLLELDFQSCHKLSDTAIRQAATACPLLASLDMSSCSCVTDETLREIANACQNLSVLDASNCPNISFESVKLPMVVDLRLSSCEGITSASMGAVCFSRILEALQLDNCSLLTSVSLDLPHLKNISLVHLRKFADLNLRSPVLSYIKVSRCSALRCVTITSNALKKLVLQKQESLCNLSLQCHNLIDVDLSDCESLTNEICKVFSDGGGCPMLRSLILDNCESLSVVELNNSSLVNLSLAGCRSMTFLKLACPKLQVVILDGCDHLERASFCPVGLESLNLGICPKLSVLRIEAPNMSILELKGCGVLSEASINCPCLISLDASFCRQLMDDSLSQTAEACPLIEHLILSSCLSIDVRGLSSLHCLQKLALLDLSYTFLMNLKPVFDSCLQLKVLKLSACKYLSDSSLEPLYREGALPMLVELDLSYSSIGQTAIEELLACRSLXVNVNLNGCTNLHELVCGSDYCRSGDMPVDAFPPDSAPDKTKEIRESSNCQLEVLSCTGCPNIKKVVIPSTANYLNLSKINLNLSANLKEVDLKCSNLYNLNLSNCNSLEILKLDCPRLANLQLLACTMLQEDELKSALSFCGALEILNVHSCPQINTLDFGRLQAVCPTLKRIQSSPIA

SEQ ID NO: 119127 - protein, 144 aa, Triticum aestivum
  Clone ID: PAT_TA_13545.pep
QQHLVESSLYHMSTRVMAPAKKNAAARILVIVMVATALLPASRATVTKSGEELFKMALAGLMDVAIDDVIAASPPSKIPEVKAAGEKQQLLAMAKVDTAKGDKAKLEACMSAYKKAGEQVLAAPPAQKFSVMDTGFTEASRPAP

SEQ ID NO: 119128 - protein, 122 aa, Triticum aestivum
  Clone ID: PAT_TA_13546.pep
FTASQCLYYESHLQHVYQVKLRTFSGISKQGHVVPSRGHQNRQVERGEIYPCGVLHAGRTIPDDQHQHEEWPRASPSKIRPRSIADNNEYVRTTITDRKSTNQHPASTTNKKNAGNMSGQVE

SEQ ID NO: 119129 - protein, 88 aa, Triticum aestivum
  Clone ID: PAT_TA_13547.pep
AGGEVVACPLRADEGGGGERVVGRVGDGMPPPTPTRCASSLTWPRACWLGGGCGVVHAMETAGLATDFEQRHGSQQETIHQYPLILTL

SEQ ID NO: 119130 - protein, 317 aa, Triticum aestivum
  Clone ID: PAT_TA_13548.pep
MAAPATFVVVVALVAAALCGGVCRAQDMDNEWARYRGFFGGGGTLLPQSDVDLLEFPLNLEYLEAEFFCWSALGYGLDGIDVNLTGGGPHPIGGQTAALTPFVRDVATQFCYQEVGHLRAIKQNVRGFPRPQLDISATNIGKIVEQAMNTTLDPPFNPYENSLNFLIASYIIPYVGLTGYVGANPKLLTPQARRLVAGLLGVESAQDAVIRALLYERGLSRVASYGVGVAEVTAHISELRNELGRRGVKDEGLVVAPGEGPEGQTVGNIIAGDRYSLAYDRTPEEILGIVYGTGSPAQAGGFFPQGADGRIARGLLM

SEQ ID NO: 119131 - protein, 72 aa, Triticum aestivum
  Clone ID: PAT_TA_13549.pep
TCRQVKMQQYIDLLNSAINSEIDCFSFHSESVEKTGSSGYSPKPDIEVHTCAKLIYTISMKHLLPPSLNTER

SEQ ID NO: 119132 - protein, 376 aa, Triticum aestivum
  unsure (1)..(376): unsure at all Xaa locations
  Clone ID: PAT_TA_13550.pep
AAASTPNINIDQLGVPWSIALNLTYPETVTPYNIERLKELVEYGPHPPPGKTGAKYIIREDGQRLDLRYVKKSSDQHLEXGYKVERHLNDGDFVLFNRQPSLHKMSIMGHXFKIMPYSTFRLNLSVTSPYNADFDGDEMNMHVPQSFEIRAEVLELMMVPKCIVSPQANRPSVGIVQDTLLGCRKITKRDTLIEKDVFMNILMWWEDFDGKVPAPAILRPRPIWTGKQVFNLIIPKLINLIRFSAWHAETESGFITPGDTMVRIEKGELLSGTLCKKTLGTSTGSLIHVIWEEVGPDAARKFLGHTQWLVNYWLLQNGFSIGIGDTIADAATMEKINETIGTAKNEVKELIKQAQEKNLEPEPGRTMMESFENRVN

SEQ ID NO: 119133 - protein, 139 aa, Triticum aestivum
  Clone ID: PAT_TA_13551.pep
GNFYCRLHHINTARDRLRSEIGQVFTEWKFDLMGEQVSKMWSIEEQLKFAALEQLVPVFEDKSFWAVAAKHFAPKTRVDLVRYYLNVFLMRRVSNQCRLSLLEIDSDEDEAEEEEDEDQSDGSNSSQRPQDVQEVKKIF

SEQ ID NO: 119134 - protein, 142 aa, Triticum aestivum
  unsure (1)..(142): unsure at all Xaa locations
  Clone ID: PAT_TA_13552.pep
GSRGCLQLGTRVDGRDLKRANVTTAPRMNAELILPLIGLSSFFPVLVIGXSECERAKPSPDPYLKALDLIGASPDHTFIFEDSASGIRAGVAAGVAVVGLTTGNPEKVLRDAGASLLIEDFRDPKLMAVLQELDPAPADKQG

SEQ ID NO: 119135 - protein, 88 aa, Triticum aestivum
  Clone ID: PAT_TA_13553.pep
KGYLVDWAIKYLQQPEEIGKLVDPELTNVRTEDLAVICSVVSRCVDPDPSKRPSMQIIAGALETGIDLSAAGILKESSLAWAELALSL

SEQ ID NO: 119136 - protein, 81 aa, Triticum aestivum
  Clone ID: PAT_TA_13554.pep
RQFTRELGRAGVMHEVRRRRWHENARDKRKRKSRDAAWRFSRRRFKGPYPFDDEQGSKERTTDDDGRDNWELPGGEFPSFR

SEQ ID NO: 119137 - protein, 141 aa, Triticum aestivum
  unsure (1)..(141): unsure at all Xaa locations
  Clone ID: PAT_TA_13555.pep
GKNEKVGHCWLKLRRWSKAWLHMVLALLSHMVFGPLPPVLCGLSFRESNDGENKMMXALLACIALLALGXVHFYRRAMTYFKTLIYYLTIAASLSGISYVADVLITRLLKHFGTIDLGGALAPHASLGLLFSHLGNAHTSA

SEQ ID NO: 119138 - protein, 223 aa, Triticum aestivum
  Clone ID: PAT_TA_13556.pep
MTSAMGDEPKITAAAMADKLASLSSGQQVLSSIFSSLAAEQAASINGGSSSGELSAGPPGFDRPKRPRLEQQAGDTGAPPFFAQVPQVQQQIGAAPTSLGSTQSPAQANQVPGSFAPPPLQPMVPQLMQQFSQNTGGPGGMFGMIPFGMMAGSLPPPLPLLPAGFAMPNGPPPPPPLPPIQQQQQQSPQAPQQSPTSTGFFPTSSTGFFPPVQVQQSPSVQRQ

SEQ ID NO: 119139 - protein, 68 aa, Triticum aestivum
  Clone ID: PAT_TA_13557.pep
RATGVGFASSIARFGGILCPVAAGGLEHACHQTAAIAVFITVMLVSAVAVSYFPLETSGRKLSDHIAA

SEQ ID NO: 119140 - protein, 135 aa, Triticum aestivum
  unsure (1)..(135): unsure at all Xaa locations
  Clone ID: PAT_TA_13558.pep
AAPPSGACRGWCAGPVVSYSGVHRRAFGGFCALLVVLTPCRRRGFAPGLVALPVRGTTESRCGDVSPGAEVTNKGALALYGRLGFIRAKRLXRYYLNGVDAFRLKLLFPRPDLGLDPMMMLRDERDGQHMDSPYL

SEQ ID NO: 119141 - protein, 167 aa, Triticum aestivum
  unsure (1)..(167): unsure at all Xaa locations
  Clone ID: PAT_TA_13559.pep
MKPFFWAAALLFDTASLFFSSTTATTVLHRPTPGRSLDHRSMADDGAEAYEDLLPVMAGRLGTAGLLSELRAGFRLLADPARGAITAESLRRSAGAVLGVEGMTAEEAQVMVGEGDHDGDGALSEQEFCVLMVRXLSPGIMADAEGWLEEAIADELLPPPPPPAPAA

SEQ ID NO: 119142 - protein, 131 aa, Triticum aestivum
  unsure (1)..(131): unsure at all Xaa locations
  Clone ID: PAT_TA_13560.pep
MAKYNVVQKEQAASPAMTASAAPHGDPNSGKLKHHNAPIAISGKRKRKLLRRLNRDQXKEAVMVKALENNMGDVDMVSAEASSETAKDKSQMKFNVKKNSRIQIKRLKGKGRKKAKNVKPPTKEKADAMVE

SEQ ID NO: 119143 - protein, 94 aa, Triticum aestivum
  Clone ID: PAT_TA_13561.pep
MLRRDGVEDDIRGHHHAHGSAAIVIEFFGFTANRCATGRQPAAPSLSPTLDNSVANGPRAARLSVPVRSGRCGLRLRVGPPQLRAQGGVRTAWI

SEQ ID NO: 119144 - protein, 129 aa, Triticum aestivum
  unsure (1)..(129): unsure at all Xaa locations
  Clone ID: PAT_TA_13562.pep
RRISTHVLSPKNFISSSSQLPSSQITSCCPSLQCCNSSLVIPPLSFLPASWSARLLLGYVFKHFAFPFGCPTVSSIPIWSPRSWALAHGCSVPWIAWTLPSHGHRRQXISKATKTNXQQDKCAPXFXQI

SEQ ID NO: 119145 - protein, 84 aa, Triticum aestivum
  Clone ID: PAT_TA_13563.pep
LLRRRPAPARPPLVSGFWLPTLPVASSAPRLAPLRWGPPAPPPLSDAHLSWPPPRPPPASSPATPPPPPPPPGLPLRAARPPAS

SEQ ID NO: 119146 - protein, 102 aa, Triticum aestivum
  Clone ID: PAT_TA_13564.pep
MHQGLPIVICLFDGPKVPEKLDEVDKKCHFYTYDLIPSQNSFCFERRDWMTVQPDELPGGRQLIMGLNPPFGVKAALANRFIDKALSFKPKLVILIVPKETK

SEQ ID NO: 119147 - protein, 66 aa, Triticum aestivum
  Clone ID: PAT_TA_13565.pep
EMKEGAVVSLEILTLVNLEGMVEVPPGIEFLAHVKHISFREITSEFLTSLRQCPRTQGVQWRHTLR

SEQ ID NO: 119148 - protein, 162 aa, Triticum aestivum
  Clone ID: PAT_TA_13566.pep
SADAWAGSSVMVLDPVPTSALFPAQPDHPDWFAMDCRHGRALFSRMGDTSVLMVLDPVSAATASVSSPYIHPVSFNAAPGSFSRAPLCAPQGCDCHAGQGGCFGVLRRTTNRLQEPRLGWRALPSGRLCHQLCPRGHIGLALTNLASRVEPAHLSSSPQCQI

SEQ ID NO: 119149 - protein, 132 aa, Triticum aestivum
  Clone ID: PAT_TA_13567.pep
RPVTLWYRAPEVLLGATHYSTSVDIWSIGCIFAEMVRKQALFPGDSELQQLLHIFKLLGTPTEEDWPGVTALRDWHEFPQWKAQRLTRAVPTLEPEGIDLLSKMLQFDPANRISAKATLEHPYFNSLDKSQF

SEQ ID NO: 119150 - protein, 172 aa, Triticum aestivum
  Clone ID: PAT_TA_13568.pep
SCFFFFVLFRRNHSPPFISFHAHAQTFLTFRFMKNNDESPNIAALPAYCICWSSLRRFLCPAVTPRHGGSMSSSSCFISSSAWSGSPDGSTSSAWARGDSGPLYGDLVAFWRSVAGLGVARPSWWRRCPLLAVSSCSALFLWLLSAACSSCASCNLWLRVCLSGWPCWRNPI

SEQ ID NO: 119151 - protein, 167 aa, Triticum aestivum
  Clone ID: PAT_TA_13569.pep
YVYVATDAELARLLGARTPEKLVGPSLYCQHYGAVPEPEAKRAAAAIEAEAFACHLRVRLRRDLGLPQGAFRRLQNVLEGGLRLAPRVLQIPSGRKGGHGGTGGFVGAYFGSCRFHFRGVGLSSYGNLIAVILLVRWTLVHDFLRLWLVLLYAVYQGNAREKTKVCF

SEQ ID NO: 119152 - protein, 204 aa, Triticum aestivum
  Clone ID: PAT_TA_13570.pep
VPLAGISGTPCSYGELASIRDVTQEVANAMSKLANTLARVLAESLGHTAGQRFPKGCDERTCFLRLNRYPPCPFSPDAFGLVPHTDSDFLTVLCQDQVGGLQLMKGSRWVAVKPIPGALIVNIGDLFQAWSNNRYKSVEHKVVTNATTERYSVAYFLCPSYDSPIGACEEPSPYRTSTFGEYRRRVQEDVKKTGKKIGLPNFLL

SEQ ID NO: 119153 - protein, 142 aa, Triticum aestivum
  Clone ID: PAT_TA_13571.pep
VLSKSLVAAPILLKIVYGNYIVQYVLKQRNPSYLAIIASHFRSNYVTLSRQRYSSNVVETCLQVFNDRDRSNIVHELIRYHPFRDLVSDEFANYVISRALTTCKVPLRDRLATAILSLQNVNRRHPHCLKMFNTLSELGYRY

SEQ ID NO: 119154 - protein, 98 aa, Triticum aestivum
  Clone ID: PAT_TA_13572.pep
PGYAAYAASKAAVETMTRILARELRGTGITANAVAPGSTATPMFYGGKTDEEAERYIAEAPLGRLGMPEDIAPLVGFLASDAGGWVNAQVLRCNGGTI

SEQ ID NO: 119155 - protein, 141 aa, Triticum aestivum
  unsure (1)..(141): unsure at all Xaa locations
  Clone ID: PAT_TA_13573.pep
RHRSRGRRRQEARPRGPQPPASRSRTGAPAGEPRREGAIPRGPGRGGAQPPAPGARPRRPPGPRPRAARTAGPTTGPHFPFLYQPPPXNNPGXRPPAGGAPGSGWEPGPRFGRPSFGFGPSGFRRRTPPPTVGCVCVCVYT

SEQ ID NO: 119156 - protein, 174 aa, Triticum aestivum
  Clone ID: PAT_TA_13574.pep
ACTELSCLASGGWLCSALLALLVVLAARPAAVSGASAHLHFYMHDVLTGPAPTAVQVLDGPRGHFGDTIVIDDALTATSSAASPAVGRAQGRYIWASKGNPELLVTMEVLLTSGPYAGSSVTVVGRDDIGAAVRELSVVGGTGQFRMATGYVLWKTVRLDHPNAVLELDVFVNP

SEQ ID NO: 119157 - protein, 313 aa, Triticum aestivum
  unsure (1)..(313): unsure at all Xaa locations
  Clone ID: PAT_TA_13575.pep
TLERDPPGASFPPPSCFPSPSWLLLPRRYCGSRCAPRAASRSCAAAAPRRTRSSGSDRSATSGARPASXHARRHDLRPSNRLLXAEALFVGSPVDDLTADLIIRDLLLFAPNDXLLGYCGGRVTTWRPRCCSDGWSSCQANLXWLCSGWAGSTGGSTPPTPTKGHDIXTPNGRXRDHPPPVSPGRTSLHLLLQITEMLHEKIKNYKILSRITGKPEEQIDEDVLIHXFDRFMSPWEAKDYGIIDSIIDEGKLGLVAPVSGAVPPPKSRVWYLWNASGPTRKIMKNLPSEEKLIRNGNGSVSGADGMLKEASST

SEQ ID NO: 119158 - protein, 147 aa, Triticum aestivum
  unsure (1)..(147): unsure at all Xaa locations
  Clone ID: PAT_TA_13576.pep
KLIYMLGVCRKSMARHPEGPANGAAXQEMISAREVSQHAEAYVRRSVLFAASCVLIALHPSYVASVLIEGNQDISTGLEWIRTWALRIAEADPDTECTSMAMNCLRLHSEMVLQTSRALESAEHSKAGTRALPSKPDNIIIPFANMM

SEQ ID NO: 119159 - protein, 115 aa, Triticum aestivum
  Clone ID: PAT_TA_13577.pep
GVWGPGIQFEWHHNIKCISSPRIALFLSHHVFYLLFLTYFILLSVTEEVSLQSLITIYLGWGTLILHLKNDRAANREEEVPLAIATGQPEHKEGTGKRRSDDGSNAPGGPQQPYD

SEQ ID NO: 119160 - protein, 121 aa, Triticum aestivum
  Clone ID: PAT_TA_13578.pep
RVLRKEAEQSALVSSYFELCRTLGVLSAAEFPAVERVPDHDIRDLEKLIMADVEDGGCTVEQDNEAKALVVPMEGAGVASTTVATKEWMVFDDDAGTGVRQGHFGDYVNPFLTNLTGLGET

SEQ ID NO: 119161 - protein, 149 aa, Triticum aestivum
  Clone ID: PAT_TA_13579.pep
YDYVMKTDDDTYLRVAALVGELRRRRRDDVYLGYGYNMSGDPAHVYLGYGYNMSGDLASWVSTAEEILARNDTLGPEDLMLGKWLNLAGKGRNRYDLKPRMYDLSWDMDNLRPDSVAVHMLKDNRRWATTLRYFNVTAGIKPSELYHLP

SEQ ID NO: 119162 - protein, 86 aa, Triticum aestivum
  Clone ID: PAT_TA_13580.pep
MAMRCALTSLPARLRSPAVVASGTRRLLSDGKGRVLSEEERAKENVYIQKMERERREKLKKKLEQEKDAADKAKSGADGKKAEGTN

SEQ ID NO: 119163 - protein, 108 aa, Triticum aestivum
  Clone ID: PAT_TA_13581.pep
DKIERVNAMDAAVPQEIQNIENNRLEYHIISGPGRPHVSSRSNDASSGSRRPPTRRRGERRSVPRPRPRGEGKELRRVSGSPQSIGVAAAGAGWQLLQEICLQQRGRH

SEQ ID NO: 119164 - protein, 100 aa, Triticum aestivum
  Clone ID: PAT_TA_13582.pep
SSISLTNLSTCLSLSYFSDLFWWLQHHYSFTKTGACFLEHRIVLIFSLTMLCSCLLGSSQLISKVDSFSSLGPAELGRNPTTLYIPCSTNQQGSHLVMPT

SEQ ID NO: 119165 - protein, 170 aa, Triticum aestivum
  unsure (1)..(170): unsure at all Xaa locations
  Clone ID: PAT_TA_13583.pep
KDLTKYNMXVHRRXVQFKTAYYSXYLPVACALLLSGESLENYGAVENILVEMGTYFQVQDDYLDCYGDPEFIGKIGTDIEDYKCSWLVVQALERADESQKSILFENYGKKDPACVAKVKDLYKELNLEAVFHEYESESYKKLIADIEAQPSDAVQKVLKSFLHKIYKRQK

SEQ ID NO: 119166 - protein, 244 aa, Triticum aestivum
  unsure (1)..(244): unsure at all Xaa locations
  Clone ID: PAT_TA_13584.pep
MAAAANGGGGESKAAFARIYDALKAELLRDPAFEYTESSHQWIDRMLDYNVLGGKCNRGLSVVDSYKLLKGVDVLTEEEMFLASTLGWCIEWLQAFFLVLDDIMDDSHTRRGQPCWFRVSQVGLIAVNDGILLRNHISRMLRLHFKKKPYYADLLDLFNEVEFKTASGQMLDLITTHEGEKDLTKYNIGVHRRIVQFKTAYYSYLXVACALLLSGESWRTTVLAPLTLPSPPLLPLSSAVRPAP

SEQ ID NO: 119167 - protein, 358 aa, Triticum aestivum
  unsure (1)..(358): unsure at all Xaa locations
  Clone ID: PAT_TA_13585.pep
MAAAAVALSNGSGGDSKAEFAEIYSRLKEEMLEDPAFEFTDESLQWIDRMLDYNVLGGKCNRGLSVIDSYKTLKGVDVLXKEETFLACTLGWXCIEWLQAYFLVLDDIMDNSQTRRGQPCWFRVPQVGLIAVNDGIILRNHISRILQRHFSGKPXYVDLIHLFDEVYFTSAXGWLLERLTTYLGEKDLTKDNLXLHRRIVQYKTAYYSFYLPXVACALLLSGXNLDYFSSLLKNILVEMGXTTFIVQDDYLDCFGDPESIGKIGTDIEDYKCSWLVVQALEPADESQKGILLENYGKSDPESVAKVKDLYKELDLETAFHKYERESYNKLIADIEAQPSKAVQKVLMSFLEKIYKRQK

SEQ ID NO: 119168 - protein, 148 aa, Triticum aestivum
  Clone ID: PAT_TA_13586.pep
KGIKLLLVTLGSNGVFICCREHVNFMKDPKRCKVTPFSTQLLEKLEGCSLSSMPVNLSREGSSRTCVFHLPATSASVVSLPGGGDRVDGGVRSSLCGGLDIMQSVAVGIAVAKASVESEANIPANFSAASIADEARRTLLSARQIWCQ

SEQ ID NO: 119169 - protein, 117 aa, Triticum aestivum
  unsure (1)..(117): unsure at all Xaa locations
  Clone ID: PAT_TA_13587.pep
PYDPLWIKGGGHXCNLELYPDFIRHLSKFIREMESVTTKTRLKKIRQSLEPTKTAYRVNTATTTTFTANCCCRIRVRRPSCNLSCSCCDALRKCFAFGAFKCPACCSCFKCCCCCGG

SEQ ID NO: 119170 - protein, 252 aa, Triticum aestivum
  unsure (1)..(252): unsure at all Xaa locations
  Clone ID: PAT_TA_13588.pep
MKNHRGDGSPSAAGSACRSGRSTASTPVGRRGPRGGGELPRAARAGGWPESGTAGTAAWQRRPGRAQPSATSEAVRRRQPQQPLESDAAAARPRRFQPPEALLPPGQTTHPCAEHQNGGGGATSAGSMPPSASSLGAAGPAKSRAGTSGCTGXGSRAPRRAGGCDGGSDGAGSNLHAGSGGGRAHDAGSGGXRPTPWRRWRATKRWPRPLTRRRRRNRDIGTRGMVPFLTFLCFSWFSSESLSPESMPITVG

SEQ ID NO: 119171 - protein, 118 aa, Triticum aestivum
  unsure (1)..(118): unsure at all Xaa locations
  Clone ID: PAT_TA_13589.pep
PPRGIELXKRTRKGSLHXKVVSVYINRTGVVMLKMKSRHVAGTITKKKKSVVVDVCRDLAAWPGRHLLEGGEHRRYFGLRTAEHRVIEFECASQREHDMWTKGVARLLAIVDGRKRFA

SEQ ID NO: 119172 - protein, 153 aa, Triticum aestivum
  Clone ID: PAT_TA_13590.pep
PHPHRRYRALHHTTAAPPAPTTPRCCCRLRPPHPTAADCCRGRPHITAPSRTRTTPPAPAFHVAEPLHWRPPPFSASLVHTEQAFSKALSGAASSTSSPPSSGASSLPRAALSPQYPSPRQPRHVFPFTSVLFNSQLGHNITGVQKFSDGAAR

SEQ ID NO: 119173 - protein, 93 aa, Triticum aestivum
  Clone ID: PAT_TA_13591.pep
VFLCASHFVFLQFVQDADAFQFSGSRASSAGCSLLQLSWVVGAVCTDVRGQDDDVDSCENSNHITLRNPRFLTRYSSIAFWVLVRQCHVWLHL

SEQ ID NO: 119174 - protein, 77 aa, Triticum aestivum
  Clone ID: PAT_TA_13592.pep
RPEGKTREATECLKVHELNGIAHGVGSSGSGCFIQWGSLQSFTLGVRCSCRGKGCHVLYQVIYVCVLCTQIRMDDMH

SEQ ID NO: 119175 - protein, 128 aa, Triticum aestivum
  Clone ID: PAT_TA_13593.pep
LSTRMEYSQQSTCPLSSRYDHSPVNLLQDCSCTVLQFPYLLDTTVARASSSLDVALRMTATTQRTPGRTVVLLHHLHDAAVSATLEVKPCSSHNGAAPCSLPLLHNQAVSRAPPPILNSWRPASCRFL

SEQ ID NO: 119176 - protein, 304 aa, Triticum aestivum
  unsure (1)..(304): unsure at all Xaa locations
  Clone ID: PAT_TA_13594.pep
MGAGDKTAAGMPRIGMGTAVQGPKPDPIRRAVLRAIEVGYRHFDTAAHYETEAPIGEAAAEAVRSGAVASRDDLFITSKLWCSDAHRDRVVPALRQTLRNLQMEYLVLYLGHWPVSMKPGRFKAPFTAEDSVPFDMRAVWEGMEEWHRLGLAKAFPVTNFPXKKQETLLSFASIPPTVDNVGVNPVWPQRKLREFCRGKGIQLCAYSPLGAKGTHWGSDAVMDAGVLQEIAASRGKSVAQVCLRWVYEQGDCLIVKSFDEARMRENLDVDGWELTEEERRRIAEIPQRKINLGKRYVSEHGPYK

SEQ ID NO: 119177 - protein, 195 aa, Triticum aestivum
  unsure (1)..(195): unsure at all Xaa locations
  Clone ID: PAT_TA_13595.pep
ARGSFSPPAYIRPEAAGDAPLPLPSAHVRPQAHSPLPTQPPVCPRPPALPHSASSLDSPPLXPSPGTCLDLPPVTPXADVPACAFALAPCAAAAVSRRRRRSPAPPAPASTGCPRPPPPPPPSPPRPRPAAGPALAPCAVRPGAGPCAPPPSPLSSALRPAAPGPGPPPAPLCPAPRGAPSRQCPCSPGTRDHRC

SEQ ID NO: 119178 - protein, 98 aa, Triticum aestivum
  Clone ID: PAT_TA_13596.pep
TRKMFLCSLWFCPSWRWQPIGIKMLSRGLDIQTACFTALGHMLIQSYKMHTQHTSSSMPTKKHTLLCWERNGYSRLHYCYMSAACWASNLTVRCLLQT

SEQ ID NO: 119179 - protein, 192 aa, Triticum aestivum
  Clone ID: PAT_TA_13597.pep
MVRRVYLLPVLIIHVCRYGYKDVRKENPQTFEQLLIESLEKFIRREAQERSLESDENGNTDSEEEVASSSSRVLVGPNGSIYSLGVPLLAESAGVSNPNFGSSTSFDGSLDGTMDGRRSLDNELSFIHKAKECGVVYLLGHGDIRARKESFFVKKLVINYFYAFLRKNCRRGIATLSIPHTRLMQVAMQYMV

SEQ ID NO: 119180 - protein, 121 aa, Triticum aestivum
  Clone ID: PAT_TA_13598.pep
VQHELHFHMVHRLLREHIDQEVDYKVIVFCTAAMVTEFMYIMLRDLKLNVIEINLGKPQLYRTRVSEELRDSNRLILVTSDVSTRGVNYPDVTPPIGEKQSCIYEGDLSDYLGRKDLTSKS

SEQ ID NO: 119181 - protein, 328 aa, Triticum aestivum
  unsure (1)..(328): unsure at all Xaa locations
  Clone ID: PAT_TA_13599.pep
QKKKKKKGKRDRARIPAAREFHGMSSQLVKAMPSLIFTKVQEDNCTSSTCAICLEDYSVGEKIRVLPCRHKFHAACVDLWLTSWRTFCPVCKRDANAGMSNFPPSESTPLLSSAIPLPAESTALSSFRSMVAASPPRTISRHPSWQSMSRTNSNSSILHTRNPCRCFSNSPAISTSRSSVDLANMSSPXVESTPHLASAHSLGGGHFSPPISIGYTSPHVSPFGYRFSGQFIGSPHIPRSENGSPSYYPGSSGQQYPYLRHRTESGPSLFTMVPQSPQQILLQDGGDSATSLSASASTQSLRQAYLQHCXDSDVSLSAATSAQSLPGC

SEQ ID NO: 119182 - protein, 112 aa, Triticum aestivum
  Clone ID: PAT_TA_13600.pep
CCCLAWSRPRYHADKPGSRPLHHELVQFDLAQAGNSLMPSVSVTPYAPSTSPPGRPSVLLFLAASPNIAIKVLLGKKCVDKKKIAVTVVLVAISLYSRLHPHKKCYCSLLYV

SEQ ID NO: 119183 - protein, 181 aa, Triticum aestivum
  Clone ID: PAT_TA_13601.pep
PAKRGGVNKSLKRVRKLSEMTEKMSKTMLDTVISVTGSMAAPLLRSNQGKALLSTVPGEVVIASLDAINKVMDAVEAAERRSLAATSNVVSGAVSKRYGESAGEATGDAFATVGHTVGTAWNIFKIRKAVTPSSSLPGNMVKGAARDSNGGGRASAAPPPYQQVVALAVLPAEDHHEDQHT

SEQ ID NO: 119184 - protein, 126 aa, Triticum aestivum
  Clone ID: PAT_TA_13602.pep
TYREGYLRQVSFPSLVTLIYCIPHICFVPSVVCSNSLNSSIMFARGLFGSSFLDRGVYLDHKNLYLDSMLVSTENLGFGIWLLVSFNLQIYHPIGSKDRTLSSSNYGLTFLEETFKYADYIWAVHY

SEQ ID NO: 119185 - protein, 200 aa, Triticum aestivum
  Clone ID: PAT_TA_13603.pep
GVITTIGCDPAEGYTVAARFGDQNDLDAKVVMRSGPLYGLIILGSDLKAKPCLAPRFYDGETLSSGPVFAVGCQGFYKDIIIVSGLIGVNVCKKWVEGRKLSTLVHTCQIGDGLIGAPVLNRGGEEVGINVARTRQTSQINYAVKMEEFRNMLAELVGTEYKPETGLARLLTLFNEKISEFGSTTGKHGVKRKLEHTSRQ

SEQ ID NO: 119186 - protein, 232 aa, Triticum aestivum
  unsure (1)..(232): unsure at all Xaa locations
  Clone ID: PAT_TA_13604.pep
SPTRALWRQQQPPALISNVDTLIVIPNDTALTAVSTATPAFGVFQRXNDIQXSRSSFQSDIITVPRLXLNVDFADVRSXLWSDAGSSLMGIGTSNKXTRARDAALNAIQSPLLDIXCIERATGIVWNITGGSDLTLTEVNAAAEVIYDLVDPGANLIFGSVIDPSYTGQVSITLIATGFKRQEESEVRPAQAGGDVNRGRSSRFSSSSQDEGPKLQVPEFLQRKGRPGFSRG

SEQ ID NO: 119187 - protein, 223 aa, Triticum aestivum
  Clone ID: PAT_TA_13605.pep
VRSQTEVSSSLPLGVAKVEVEPVEVIEHEACTPQAGPVLAAMDIAKENIPAMDTAKENVQPGGYSSPLKENILAPHQNIQPEEHMTPVKGSILASHTNAQAIGEMTPMTLLSQKLSSISLGQANGEATPLAQKLSSISQGQANGEATPLTQKAPSISQGQSNGEATPLNQKLSSISQGQSNGDATPLTQKLSSISQGQSNGDATPLTLLAQKLSSISLGDATD

SEQ ID NO: 119188 - protein, 114 aa, Triticum aestivum
  Clone ID: PAT_TA_13606.pep
KRDIDRLSARELNFVRLLTIEAVASSKHAASTPKEYANETCFLSAQKGNLFTLTIGEDLIFFANICQNLSFCFPNIERRRCLWFVFSSQSILRDCYRPLITSSAPDPSRWEQQL

SEQ ID NO: 119189 - protein, 142 aa, Triticum aestivum
  Clone ID: PAT_TA_13607.pep
FFNGTEFADSIDAAFTSSVMHEAYLFKGDSYANINYSSKTCIAIRKITEGVYSLRNTIFESGVEAAFASHLSEEAYIFKGDQYALINVAHGATDDYIIGGVKPIAPNWPCLRRILARKNLGVDDHGHHNQEQADQDHVHDEL

SEQ ID NO: 119190 - protein, 71 aa, Triticum aestivum
  Clone ID: PAT_TA_13608.pep
PCIRFSHKNLFFLSFLIYGRVGLLGLNSFFTKVPIKPRFNIPSRMPAIISSIIKNSCQCPVIPSRDLIELS

SEQ ID NO: 119191 - protein, 78 aa, Triticum aestivum
  unsure (1)..(78): unsure at all Xaa locations
  Clone ID: PAT_TA_13609.pep
YFYXQREWQQGGPNFIHEPFRDACLCLFCSPARIHKIQQAVMCIRAGLQNISFDVNRNIVDRDKLLLELGAYMTVQPI

SEQ ID NO: 119192 - protein, 282 aa, Triticum aestivum
  Clone ID: PAT_TA_13610.pep
ARGLTVQASISPPFLSPSSLSSDSTISSKYSSDSPSLSPSTSSPPSLGLSPASSNLPHALASADAWALRQSSNAEHSKPVLGSIRSPSKVSSIAERRGGFSGLKLPSLPKELVLPPRAPSIHKAEEVTDKTNTNGVKQLTGVSCPEKCTGTSSTATDSNSEATVHGETILIEHTNSEACNYVQLLVYRWPCMEKLTAFARKDLDPKTVFIFVAPKASRSAEEVKTVCVWVGGEYECSKGVDSIDWQQVAGDFLNQKGFNNTLPVKVFKEHETENLLEVLDAR

SEQ ID NO: 119193 - protein, 172 aa, Triticum aestivum
  unsure (1)..(172): unsure at all Xaa locations
  Clone ID: PAT_TA_13611.pep
VVEHGLGHLPFTEKQIITPTGSVYTGVDFCKKLCGVSIVRSGESMENALRACCKGIKIGKILIHRVGDNGQQLIYHNLPMDIDERHVLLLDPVLGTGNSANQAIDLLXRKGVAEERIIFLTLISAPEGIQCVCTRFPKLKLVTSEIDTGLSEEFRVIPGLGEYGDRYFGTDN

SEQ ID NO: 119194 - protein, 223 aa, Triticum aestivum
  Clone ID: PAT_TA_13612.pep
RESLVQMQYLSKLSVNASDENEVLLLNVLPPNLQTLSLRGRLEQGSLEESPPFQSDGGQNVCALALSWSQLRKDPLPSLSLLSNLTLLHFTRAYKGEQLTFLTGWFPKLKILSLRDLPNLNRLEIQQGAMAGLERLSLANLSSMTEVPAGIEFLASLQYLGFHEISGDFLPSLRQCSAIRGKQWREGRPLRAGAAAGDREREAPDTTLPLQVLKLPVSGCIGF

SEQ ID NO: 119195 - protein, 83 aa, Triticum aestivum
  Clone ID: PAT_TA_13613.pep
SEFAPGDAVRPLTVCRHAFHAACIDSWLGAHTTCLVCRTDLDAPPNEEIAFAEEHGHSGLTAAAVHEATGHRTTSSPPATDHR

SEQ ID NO: 119196 - protein, 91 aa, Triticum aestivum
  Clone ID: PAT_TA_13614.pep
DFPSRDVAVDGNAAKDNKKSRIIPRHLLLAVRNDEELGKLLAGVTIAHGGVIPKINPVLLPKKTAEKEGQAPKSPKKAAKSPKKAATPKKA

SEQ ID NO: 119197 - protein, 80 aa, Triticum aestivum
  Clone ID: PAT_TA_13615.pep
SLFVILLDLLRDHVILLHIFNYCIIRTVWSTSSESTVSCSGKAPKGAIPGPSPGRHAATRSRRVSSSSNPPTADGFGAGK

SEQ ID NO: 119198 - protein, 90 aa, Triticum aestivum
  unsure (1)..(90): unsure at all Xaa locations
  Clone ID: PAT_TA_13616.pep
RGRGPRYPKXIPDAYERLLLDAIEGERRLFIRSDELDAAWELFTPLLKELEQKRMAPELYPYGSRGPVGAHYLXAAKYNVRWGDLGGSEH

SEQ ID NO: 119199 - protein, 102 aa, Triticum aestivum
  Clone ID: PAT_TA_13617.pep
RVCHRGPSRPMLVKERCCRELAAVPDYCRCEALRVLMDGVRVEEGHVVEGRLGDSRDCPREAQRAFAATLVTAAECNLPTVSGVGSTFGATGRLMKIELPKY

SEQ ID NO: 119200 - protein, 129 aa, Triticum aestivum
  Clone ID: PAT_TA_13618.pep
FFVCLSWLQYIGIKFMQHKMIQGLASSSVRTLYPTPQERTIQLAGISSANACLTTIQSYAIPVAHVEKSLSVIFSTAVQTSDMNYSSKEGFTLISSQHRRPSSPASSFRIGSSHPQKLASGSQAPCLDH

SEQ ID NO: 119201 - protein, 79 aa, Triticum aestivum
  Clone ID: PAT_TA_13619.pep
VPDYCRCEALRVLIDGVRVEEGHVVEGRLGDSRDCPREAQRAFAATLVTAAECNLPTVSGVGSTFGATGRLMKIELPKY

SEQ ID NO: 119202 - protein, 89 aa, Triticum aestivum
  Clone ID: PAT_TA_13620.pep
MPTITHYVLDPFLETGSLPNLQKLVPKAPPAGLLPPEKSSEKPIPVPVAPARTSTLPALYSTPESTPLPDSPSSFPGTWSPYVINHKRR

SEQ ID NO: 119203 - protein, 143 aa, Triticum aestivum
  unsure (1)..(143): unsure at all Xaa locations
  Clone ID: PAT_TA_13621.pep
NWSTRRPQMDFPVQSAIXCTLEDVDVIKEGKARIAGYALSGGGRGIERVDISVDGGKTWIEARRYQKDNVAYVSDGPQSDKWAWVLFEATLDIPANAEIVAKAVDSAANVQPEKVEDIWNLRGILNTSWHRIKIQNSSGRSKL

SEQ ID NO: 119204 - protein, 197 aa, Triticum aestivum
  Clone ID: PAT_TA_13622.pep
MAPTSKMALGIKRASRSHTYHRRGLWAIKAKHGGAFPKAEKPAAVAEPKFYPADDVKPRTVSTRKPKPTKLRSTITPGTVLILLAGRYMGKRVPVRRVNQAYVIATSTKVDISGVKVEKFDDKYFARDKKTRAKKTEGELFETEKETTKNLPSFKKDDQKAIDAELIKAIEAVPDLKNYLGARFSLRDGDKPHEMTF

SEQ ID NO: 119205 - protein, 149 aa, Triticum aestivum
  unsure (1)..(149): unsure at all Xaa locations
  Clone ID: PAT_TA_13623.pep
MAGADPNRSFMKDVKRIIIKVGTAVITRNDGRLALGRIGALCEQVKDLNAQGYEVIMVTSGAVGVGRQRLRYRKLVNSSFADLQKPQMELDGKACAAVGQSGLMALYDMLFTQLDVSSSQLLVTDSDFDNSNXRERLRETVESLLELRV

SEQ ID NO: 119206 - protein, 173 aa, Triticum aestivum
  unsure (1)..(173): unsure at all Xaa locations
  Clone ID: PAT_TA_13624.pep
DRCPGCKGEKVLQEKKVLEVHVEKGMQHNXQKITFPGEADEAPDTVTGDIVFVVQQKEHPKFKRKGDDLFYEHTISLTEALCGFQLVLTHLDNRQLLIKSNPGEIVKPDSFKAISDEGMPMYQRPFMKGKLYIHFTVEFPDSLAPDQCKAQEAYDEDDEMPGGGAQRVQCAQQ

SEQ ID NO: 119207 - protein, 366 aa, Triticum aestivum
  Clone ID: PAT_TA_13625.pep
MVLTHVQSDEAAASAAVFASRYVQEPVPSYELGARSISKDAAYQIIHDELLLDGSPRLNLASFVTTWMEPECDRLILEGMNKNYADMDEYPVTTELQNRCVNIIARLFNAPVGAGETAVGVGTVGSSEAIMLAGLAFKRRWQNRRKAEGKPYDKPNIVTGANVQVCWEKFARYFEVELKEVKLSEGCYVMDPDKAVEMVDENTIFVAAILGSTLTGEFEDVKRLNDLLAAKNKRTRWDTPIHVDAASGGFIAPFLYPELEWDFRLPLVKSINVSGHKYGLVYPGVGWVIWRNKEDLPDELIFHINYLGADQPTFTLNFSKGSSQIIAQYYQFLRLGFEGYKNVMENCMESARTLREGLLRTGRFDV

SEQ ID NO: 119208 - protein, 110 aa, Triticum aestivum
  Clone ID: PAT_TA_13626.pep
ARLNPTKGNKSWSSTAVAAALELVDPPGCRNSARVKVVRTSIARVLTVISQKQKSALREAYKNKRLPLDLRPKKTRAIRRRLTKHQLSLKTEREKKREKYFPMRKYAIKA

SEQ ID NO: 119209 - protein, 243 aa, Triticum aestivum
  Clone ID: PAT_TA_13627.pep
ARGRRRSLTPTNAPPLHTLTSQKKKSQIHSSLRCANPAPPLPPPWTPAPPPLLPPDPPPPTPTATPRSRWTCSSRSRRAPTPSPWSAARRPPSRCAAPSSTGASAACWRSAPPPPPATTPPSSAASPTRSRTATPTAPRASCSPCPPTSPPCSASTRASPSSPSPPASSCSAASARARSSGSPSRRGESRAVGLQRAGGMQGVAVAVQNEAGEREWAEGRLQARGAAGGARTWGRAAVTGAGG

SEQ ID NO: 119210 - protein, 93 aa, Triticum aestivum
  Clone ID: PAT_TA_13628.pep
TTESASLLSFLRGGGLLGRLGGLLGGLGRLALLLRRLLGEQHGVDLVELILGHLRYLLTDVPPQPNSPPDNVFRPDRPGKTGPWSQKEGTCPS

SEQ ID NO: 119211 - protein, 106 aa, Triticum aestivum
  Clone ID: PAT_TA_13629.pep
FFFFKALQTCIRKAQVIAISSYHISQQKQLFVTLVTNQHSSMTKSIRKSQKLSCSSFIIWRYHGLSWTSVLLVLGTSTYFLHILDLDTHDVFCILRTRGRTRGFFY

SEQ ID NO: 119212 - protein, 199 aa, Triticum aestivum
  unsure (1)..(199): unsure at all Xaa locations
  Clone ID: PAT_TA_13630.pep
DRVTLIKDYRGKIETELTKICDGILKLLESHLVPSSTAPESKVFYLKMKGDYYRYLAEFKTGAERKDAAENTMVAYKAAQDIALAELAPTHPIRLGLALNFSXVFYYEILNSPDRACSLAKQAFDEAISELDTLSEESYKDSTLIMQLLRDNLTLWXTSDISEDPAGRDXREAPKHDSKRGGSRLYVAEASTQCLLLSN

SEQ ID NO: 119213 - protein, 146 aa, Triticum aestivum
  Clone ID: PAT_TA_13631.pep
MALSRAQTNSGESLISSTFASRYVRTALPRFRIPEQSIPKDAAYQIINDELMLDGNPRLNLASFVTTWMEPECDKLIQNSVNKNYVDMDEYPVTTEFQNRCVNMIAHLFNAPIGEDETAVGVGTVGSSEAIMLAGLAFKRKWQNKM

SEQ ID NO: 119214 - protein, 173 aa, Triticum aestivum
  Clone ID: PAT_TA_13632.pep
MVLSRASSDTDVSVHSTFASRYVRSSLPRYRMPENSIPKEAAYQIINDELMLDGNPRLNLASFVTTWMEPECDKLIMASINKNYVDMDEYPVTTDLQNRCVNMIAHLFHAPLGESETAVGVGTVGSSEAIMLAGLAFKRRWQNKRKAEGKPFDKPNIITGANVQVCWEKFARY

SEQ ID NO: 119215 - protein, 220 aa, Triticum aestivum
  unsure (1)..(220): unsure at all Xaa locations
  Clone ID: PAT_TA_13633.pep
PTWSSTNARRQRRGEDVVHPLKASLEDLYNGTSKKXSLSRSVLCSKCKGKGSKSGASMRCPGCQGSGMKVTIRQLGPSMIQQMQQACNDCKGTGESINDKDRCPGCKGEKVLQEKKVLEVHVEKGMQHNQKITFPGEADEAPDTVTGDIVFVVQQKEYPKFKRKGDDLFYEHTISLTEALCGFQLVLTHLDGRQLLIKSNPGEVVKPDSFKAINDEGMPM

SEQ ID NO: 119216 - protein, 77 aa, Triticum aestivum
  Clone ID: PAT_TA_13634.pep
VSRSTTGGIQDHRLHGVPPTDARVSPLVNRIKLFTEHRAQLVYVDCLENVISDILRSNAASTELICPQKFQNRERWY

SEQ ID NO: 119217 - protein, 117 aa, Triticum aestivum
  Clone ID: PAT_TA_13635.pep
NSDEASPSLSLSLNPTAALVSLRRASPCPLALPMYPVVVGNSSPHAGSSVGSLFPNLDGARVCSPTRCAPLILRCHGCIFSSYGPEVMAVFRFASYSLDLSSFASPRTFLQDPCFRR

SEQ ID NO: 119218 - protein, 134 aa, Triticum aestivum
  unsure (1)..(134): unsure at all Xaa locations
  Clone ID: PAT_TA_13636.pep
FGTDLDRATNELVIRVQPDEGIYLKINNKIPGLGMRLDRSNLNLHYAARYPKEIPDAYERLLLDAIEGERRLFIRSDELDAAWEXLFTPLLKELEQKRMAPELYPYGSRGPVGAHYLXAAKYNVRWGDLGGSEH

SEQ ID NO: 119219 - protein, 214 aa, Triticum aestivum
  unsure (1)..(214): unsure at all Xaa locations
  Clone ID: PAT_TA_13637.pep
RAAVRGQRELVELLFPKTNPIPSVPDWSVDGIITTMKSPQTRVQDRASAEERKADLKSQGKEAFAKKDYFTAMYYYGLVMEIDPLDATLFANRSLCWLRMREGDRALADAQRCKMLRPXWSKAWYREGSALSFMEDYQGAVDAFQEALRLDPESSEIKKMLSEAQKQGYSLRVGPAMELTYKQVPMSYKTVIILSFHRLLIYYQACSYCSPLTS

SEQ ID NO: 119220 - protein, 195 aa, Triticum aestivum
  Clone ID: PAT_TA_13638.pep
MAGADPNRSFMKDVKRIIIKVGTAVITRNDGRLALGRIGALCEQVKDLNAQGYEVIMVTSGAVGVGRQRLRYRKLVNSSFADLQKPQMELDGKACAAVGQSGLMALYDMLFTQLDVSSSQLLVTDSDFDNSNFRERLRETVESLLELRVIPIFNENDAISTRKAPYEDSSGIFWDNDSLAGLLALELKADLLVLL

SEQ ID NO: 119221 - protein, 91 aa, Triticum aestivum
  Clone ID: PAT_TA_13639.pep
MPGLTAPSDYAEEPPRHPALRINSKEPFNAEPHRSALVSSYITPVDFFYKRNHGPIPKVDDISRYSVSISGLVNKHIQLSMDDIRMLPKYQ

SEQ ID NO: 119222 - protein, 170 aa, Triticum aestivum
  Clone ID: PAT_TA_13640.pep
REQKLELHRGGGRSRTSGSPGLQEFGTSHFENESYQSYLKLLQALLHDNPSLSREMNIESQIMLVSVKILRKYLNCAGQEQSKDASCKDPVVHWTLPLSAAKKEELSARTPLVLHVMRLLGGLERECFRRNLPLLFPLLANLVRCEHSSREVQVALYDVFQSSIGPNISV

SEQ ID NO: 119223 - protein, 244 aa, Triticum aestivum
  Clone ID: PAT_TA_13641.pep
AREVGKTDPQLPYPQPQLPYPQPQPFRPQQSYPQPQPQYSQPQQPISQQQQQQQQQQQQQQILQQILQQQLIPCRDVVLQQHSIAHESSQVLQQSSYQVLQQLCCQQLRQIPEQSRCQAINNVVHAIILHQQQQQQGQHQQSSQVSYQQPQQQVLHTDGQRREALVHGSVRQGGGGRRRQGPRGRRLAVRLLQGARQGDAAGEAHRRQGQAHLQDRRKEDQGRRRRSRARCLGFCSRPCPEIYI

SEQ ID NO: 119224 - protein, 115 aa, Triticum aestivum
  unsure (1)..(115): unsure at all Xaa locations
  Clone ID: PAT_TA_13642.pep
VDGRLKVVVSETQVISMWTMLPPVEGEPSSPPRWXRQVLIDKQDWGVHSSVQFEGFGLRSGTVILYVGRVGLIRLNLATKEAVIVYHRSDTAYISQVCLHEMDLSSLLQTMKPLS

SEQ ID NO: 119225 - protein, 114 aa, Triticum aestivum
  Clone ID: PAT_TA_13643.pep
MAMFKGSLLVFALLLAAAFLVASAEETQAKEEPTADVQDYYRGGGGYPGRGYPGRGGGYYPYPGRGRGGYPGRGGGGYCRWGCCGRGYYGGCRCCSRADEVPEPMYRAEAEVHH

SEQ ID NO: 119226 - protein, 71 aa, Triticum aestivum
  Clone ID: PAT_TA_13644.pep
MEQCRQGKSAKRIRSDELDAAWELFTPLLKELEQKRMAPELYPYGSRGPVGAHYLAAKYNVRWGDLGGSEH

SEQ ID NO: 119227 - protein, 111 aa, Triticum aestivum
  Clone ID: PAT_TA_13645.pep
ADIDQDRKSQLVDLGEVWCSADRCGGDSAAAAAAAAAAADHGVTSISIRSSRCRFSNDSTGQGVAAPSKIPYRVLPGAKAPFFVVVEGGEIISSSSPPPPHGAAVGKAYVR

SEQ ID NO: 119228 - protein, 120 aa, Triticum aestivum
  Clone ID: PAT_TA_13646.pep
MNAPDRYERFVVPEGTKKVSFEKDTKIMNAASFTIEREDHTIGNILRMQLHRDPNVHFAGYKLPHPLQYKIIVRIHTASQSSPTQAYTQAINDLDKELENLKQAFEDEKTRFEERMKQGY

SEQ ID NO: 119229 - protein, 120 aa, Triticum aestivum
  Clone ID: PAT_TA_13647.pep
VIRVQPDEGIYLKINNKIPGLGMRLDRSNLNLHYAARYPKEIPDAYERLLLDAIEGERRLFIRSDELDAAWELFTPLLKELEQKRMAPELYPYGSRGPVGAHYLAAKYNVRWGDLGGSEH

SEQ ID NO: 119230 - protein, 355 aa, Triticum aestivum
  unsure (1)..(355): unsure at all Xaa locations
  Clone ID: PAT_TA_13648.pep
MVISHASSSAGEAVYSTFSSRYVREELPRYRMPEGSIPKEAAYQIISDELMLDGNPRLNLASFVTTWMEPECGKLMMDSVNKNYVDMDEYPVTTELQNRCVNMIAHLFNAPIGEDETAIGVSTVGSSEAIMLAGLAFXRNWANKMKEQGKPCDKPNIVTGANVXQVCWEKFARYFEVELKEVKLTEGYYVMDPKKAVEMVDENTICVAAILGSTLTGEYEDVKLLNDLLVEKNKKTGWNVPIHVDAASGGFIAPFLQPELEWDFRLPLVKSINVSGHKYGLVYPGVGWVIWRSKDDLPDELIFHINYLGTDXQPTFTLNFSKGASQIIAQYYQLIRLGFEGYKHIMENCKLNAAV

SEQ ID NO: 119231 - protein, 181 aa, Triticum aestivum
  Clone ID: PAT_TA_13649.pep
PSRVESGTQPEIDLATITDRMEVKKAVQSGNVQEAIEKINDLDPTILDTNPEIYFHLQQQKLIELIRVGKIHEALEFAQEELAPRGEENLAFLEEIEKTVALLVFEDVKNCPYGELLDVSQRLKTASEVNAAILTSQSHEKDPKLPSLLKMLIWAQNQLSEKAAYPRINNLSTADLEDPAI

SEQ ID NO: 119232 - protein, 236 aa, Triticum aestivum
  Clone ID: PAT_TA_13650.pep
RPANPVPAAASASSPSWVLSPPTCQGSVKARYQQVAFSGKIVYCRTAIEVEKATREIVRKIESMKASGPVSLGFDLEWKPFPRRGEPPCKVALMQLCMDKTHCYLMHIIHSGVPPILKSLLEDSSSVKVGVCIDNDARKMFNDYDVRVQPLMDLSTVANVKLAGPYKRWSLAALTEMVTCKELPKPGNIRMGNWESFVLSKKQLEYAATDAYISWYLYEVLRSLPDYTPDIETEVV

SEQ ID NO: 119233 - protein, 235 aa, Triticum aestivum
  Clone ID: PAT_TA_13651.pep
RYKNKRLPLDLRPKKTRAIRRRPTKHQLSLKTEREKKREKYEEMVEFMEKVTKTVDSEELTVEERNLLSVAYKNVIGARRASWRIISSIEQKEESRGNEDRVTLIKDYRGKIEVELTKICDGILKLLDSHLVPSSTAPESKVFYLKMKGDYYRYLAEFKSGTEILNSPDRACDLAKQAFDEAISELDSLSEESYKDSTLIMQLLRDNLTLWTSDISEDAAEEMKDAPKGESGDGQ

SEQ ID NO: 119234 - protein, 120 aa, Triticum aestivum; identical to SEQ ID NO: 119228
  Clone ID: PAT_TA_13652.pep

SEQ ID NO: 119235 - protein, 184 aa, Triticum aestivum
  unsure (1)..(184): unsure at all Xaa locations
  Clone ID: PAT_TA_13653.pep
MVLSHAASAGSSDDSVHSTFASRXYVRASLPRFRMPXENSIPKEAAYQIINDELMXLDGNPRLNLASFVTTWMEPECNKLMMDSINKNYVDMDEYPVTTELQNRCVNMIAHLFNAPLGETETAVGVGTVGSSEAIMLAGLAFKRRWQNKMKAAGKPCDKPNIVTGANVQVCXWEKFARYFEVEL

SEQ ID NO: 119236 - protein, 136 aa, Triticum aestivum
  Clone ID: PAT_TA_13654.pep
MIQCSTKTHSVEKRVRPASMATFKGFLLVFALLLAAAFLVASAEETQAKKEEPTADVQDYYRGGGGYPGRGYPGRGRGGGYYPYPGRGGGGYPGRGGGGYCRWGCCGRGYYGGCRCCSRADEVPEPMYRAEAEVHH

SEQ ID NO: 119237 - protein, 155 aa, Triticum aestivum
  unsure (1)..(155): unsure at all Xaa locations
  Clone ID: PAT_TA_13655.pep
MASNHRRFLLSGAVLLSVLAAVAALESVEDECRPGVAFPHNALATCHTYVIKRVCGRGPSLPMLXVKERCCRELAAVXPDYCRCEALRVLMDGVRVEGGHVLEGRLGDRRDCPREAQREFAATLVTAAECNLPTVSGVGSTLGATGRWMTIELPK

SEQ ID NO: 119238 - protein, 217 aa, Triticum aestivum
  Clone ID: PAT_TA_13656.pep
LQSSVLHSRPKSAVGTPAYIAPEVLSRREYDGKLADVWSCGVTLYVMLVGGYPFEDQDDPKNIRKTIQRIMSVQYTIPDHVHISMECRQLMARIFVNVPSKRITMREIKSHPWFLKNLPRELTETAQAMYFRRDNAVPSFSEQTSEEIMKIVQEARTMPKSSRPSYGWGDEGSDDEEEKEEEERPEVVEEEEEDEYDKRVKEVHASGELRMSSLRIS

SEQ ID NO: 119239 - protein, 197 aa, Triticum aestivum
  unsure (1)..(197): unsure at all Xaa locations
  Clone ID: PAT_TA_13657.pep
MSVPGKDSNMQQLVPMAPPARVSGGELVAKASVGDSGKQLVLVEGGGKSSGGVKLREDEEDLEVKLRRIMENVPVRVSNTSGSSAGSGSGDFHQYRQMRRREQDRITRMERDYEKRKQVAEFNLRREERLRAAEERTAKKRLKRQKKXKQRKKEKRAKPNGGGEEEPNSRVPNRVEESSDDDEGSDYEGDDKFKQCT

SEQ ID NO: 119240 - protein, 400 aa, Triticum aestivum
  unsure (1)..(400): unsure at all Xaa locations
  Clone ID: PAT_TA_13658.pep
MVVTVAATGSDTAEPLHSTTFASRYVRDQLPRYRMPSGSIPXEAAYQIISDELMLDGNPRLNLASFVTTWMEPECGKLMMDSVNKNYVDMDEYPVTTELQNRCVNMIAHLFNAPIGEDETAIGVSTVGSSEAIMLAGLAFKRKWQNKRKEQGKPCDKPNIVTGANVQVCWEKFARYFEVELKEVKLSEGYYVMDPVKAVEMVDENTICVAAILGSTLTGEFEDVKLLNDLLVEKNKETGWNVPIHVDAASGGFIAPFLHPELEWDFRLPLVKSINVSGHKYGLVYPGVGWVVWRSKDDLPEELIFHINYLGTDQPTFTLNFSKGASQIIAQYYQLIRLGFEGYKHIMENCQANAAVLREGMEATGRFSIVSKEDGVPLVAASLKDSTKFSVFDVSENLRK

SEQ ID NO: 119241 - protein, 196 aa, Triticum aestivum
  Clone ID: PAT_TA_13659.pep
GTSPPARPRPRVSPSLSLSLSPVSLLPIESESMESSRSRKRTRQELDSTGDPPPEREVVARGGASPPWRDDDRDGHYVFDLGENLTRRYKILSKMGEGTFGRVLECWDRETREYVAIKVVRSIRKYRDAAMIEIDVLNRLAENERYRSLCVQIQRWFDYRNHICIVSLIFFCSVMQVLHVDSKCQLLHSLPSPIAH

SEQ ID NO: 119242 - protein, 119 aa, Triticum aestivum
  Clone ID: PAT_TA_13660.pep
MNAPDRYERFVVPEGTKKVSFEKDTKIMNAASFTIEREDHTIGNILRMQLHRDPNVLFAGYKLPHPLQYKIIVRIHTASQSSPTQAYTQAINDLDKELENLKQAFEDEKTRFERMKQGY

SEQ ID NO: 119243 - protein, 320 aa, Triticum aestivum
  Clone ID: PAT_TA_13661.pep
MALSRAQTNSGESLISSTFASRYVRTALPRFRIPEQSIPKDAAYQIINDELMLDGNPRLNLASFVTTWMEPECDKLIQNSVNKNYVDMDEYPVTTEFQNRCVNMIAHLFNAPIGEDETAVGVGTVGSSEAIMLAGLAFKRKWQNKMKAEGKPHDKPNIVTGANVQVCWEKFARYFEVELKEVKLREGYYVMDPAKAVELVDENTICVAAILGSTLNGEFEDVKMLNDLLVAKNAETGWDTPIHVDAASGGFIAPFIYPELEWDFRLPLVKSINVSGHKYGLVYAGVGWIIWRNKEDLPDELIFHINYLGADQPTFTLNFS

SEQ ID NO: 119244 - protein, 117 aa, Triticum aestivum
  Clone ID: PAT_TA_13662.pep
MATFKGFLLVFALLLAAAFLVASAEETQAKKEEPTADVQDYYRGGGGYPGRGYPGRGRGGGYYPYPGRGGGGYPGRGGGGYCRWGCCGRGYYGGCRCCSRADEVPEPMYRAEAEVHH

SEQ ID NO: 119245 - protein, 126 aa, Triticum aestivum
  Clone ID: PAT_TA_13663.pep
DRASAEERKADLKSQGKEAFAKEDYFTAMYYYGLVMEIDPLDATLFANRSLCWLRMREGDRALADAQRCKMLRPGWSKAWYREGSALSFMEDYQGAVDAFQEALRLDPESSEIKKMLSEAKSKATR

SEQ ID NO: 119246 - protein, 360 aa, Triticum aestivum
  Clone ID: PAT_TA_13664.pep
MVLSHAASAGSSDDSVHSTFASRYVRASLPKFRMPENSIPKEAAYQIINDELMLDGNPRLNLASFVTTWMEPECNKLMMDSINKNYVDMDEYPVTTELQNRYVNMIAHLFNAPLGETETAVGVGTVGSSEAIMLAGLAFKRRWQNKMKAAGKPCDKPNIVTGANVQVCWEKFARYFEVELKEVKLSEGYYVMDPEKAVEMVDENTICVAAILGSTLNGEFEDVKMLNDLLVKKNEETGWDTPIHVDAASGGFIAPFLYPELEWDFRLPLVKSINVSGHKYGLVYAGIGWCIWRSKEDLPDELIFHINYLGADQPTFTLNFSKGSSQVIAQYYQLIRLGFEGYRNIMGHCQENAMVLKEGW

SEQ ID NO: 119247 - protein, 114 aa, Triticum aestivum
  Clone ID: PAT_TA_13665.pep
VLSSYVCFSDGGSVGRRWRGGRDDFTAFHDDEEGGFGTGKGSVGNLGGSCHTLAGAVVAESTPAAADADDAVVSSSSTIAGATAHRPADLAMVDRSALSILIDVCVRGWMMDEL

SEQ ID NO: 119248 - protein, 399 aa, Triticum aestivum
  unsure (1)..(399): unsure at all Xaa locations
  Clone ID: PAT_TA_13666.pep
MDPDAAPPPPFPPGSASADADCDATLPVDLLLEIAARSDAVSVVRCAAAAKPLRRAILDRGFRRLLAQRATATSGYDPSLLRGVSYKIEDSDADRPARVLQAVPPDEPSVLRFNESLAFEPVASRDGLVVXLRRLRPRPLFGQSIEEGPPGSVLRVCHSFTGAVSVLPSVSIRDYRKHALLSVDDNGRAFELLVADERLRIQIYSSREGRWGPXRAALPRRQSRPFHDSYPLVIGRTVHWLCNPEPLPPGRHLSGPEPYIVAVDVDTMEATVIDLPRGCTSRMTASMSHRGLLLAASVDGRLKVVVSETQVISMWTMLPPVEGEPSSPPRWIRQVLIDKQDWGVHSSVQFEGFGLRSGTVILYVGRVGLIRLNLATKEAVVRLPPQRYGIHLAGLPARD

SEQ ID NO: 119249 - protein, 119 aa, Triticum aestivum
  Clone ID: PAT_TA_13667.pep
MRAISSAAGGMLRARLSAAARLRGGHGDGGGRWTTPGHEVRPKGYPMNRTPPPPGESRKWEDWELPCYVTSFLTVVILGVGLNAKPDLTLETWAHHKALERLQQQELAAASASADALSE

SEQ ID NO: 119250 - protein, 228 aa, Triticum aestivum
  Clone ID: PAT_TA_13668.pep
KEDMNRLVMNFLVTEGFVDAADKFRVESGTQPDIDLATITDRMEVKKAVQSGNVQEAIEKINDLNPTILDTNPELYFHLQQQKLIELIRAGKINEALEFAQEELAPRGEENQAFLEEIEKTVALLVFEDVKNCPYGELLDVSQRLKTASEVNAAILTSQSHEKDPKLPSLLKMLIWTQNQLNEKAAYPRINNLSTAALGRSSYMSCAQSVRVLTTLGTSSHVCMYTLS

SEQ ID NO: 119251 - protein, 219 aa, Triticum aestivum
  Clone ID: PAT_TA_13669.pep
MAPTSKLSTGIKRASRSHAYHRRGLWAIKAKNGGAFPKADKAAAAVEPKFYPADDVKPRVPSTRKPKPTKLRSSITPGTVLILLAGRFMGKRVVFLKQLKSGLLLISGPFKINGVPIRRVNQTYVIATSTKVDISGVDVAKFDDKYFAREKKQKVKKTEGELFETEKEASKSLPDFKKDDQKAVDSALIKAIEAVPELKTYLGARFSLRDGDKPHEMVF

SEQ ID NO: 119252 - protein, 227 aa, Triticum aestivum
  unsure (1)..(227): unsure at all Xaa locations
  Clone ID: PAT_TA_13670.pep
MAPNPAAIALLAALDGNLRLLKKMSKKMDLRETKDPKGLNALHFAANKGSLEICKFLLEDVXVDVNSVSSVGATPMFYAALKGNLQVARYLLDHGSDPAKPSERGLTPLHNAAEHGHCEIVRLLLSKGVDVDVINYRGTPLHMTAAKGQHQAMKILLEHGADPNRVVNHIFSPLMMACCGNSLECMKLLIEAGADVNGNSSSGPTPLTGAVDDGSTEFAKFLLEAGA

SEQ ID NO: 119253 - protein, 391 aa, Triticum aestivum
  unsure (1)..(391): unsure at all Xaa locations
  Clone ID: PAT_TA_13671.pep
MVLSHAASAGSSDESVHSTFASRYVRASLPRFRMPENSIPKEAAYQIINDELMLDGNPRLNLASFVTTWMEPECNKLMMDSINKNYVDMDEYPVTTELQNRCVNMIAHLFNAPLGETETAVGVGTVGSSEAIMLAGLAFKRRWQNKMKAAGKPCDKPNIVTGANVQVCWEKFARYFEVELKEVKLSEGYYVMDPEKAVEMVDENTICVAAILGSTLNGEFEDVKMLNDLLVKKNEETGWDTPIHVDAASGGFIAPFLYPELEWDFRLPLVKSINVSGHKYGLVYAGIGWCIWRSKEDLPDELIFHINYLGADQPTFTLNFSKGSSQVIAQYYQLIRLGFEGYRNIMDNCQENAMVLKEGLERTGRFNIVSKDQGVPLVAFSLXDSSRHDEF

SEQ ID NO: 119254 - protein, 635 aa, Triticum aestivum
  unsure (1)..(635): unsure at all Xaa locations
  Clone ID: PAT_TA_13672.pep
MDAVENAVAPAAPSTVANGTSSSITVEEFEDLASLVKDDEASVSITVVGASGDLAKKKIFPALFALYYEGCLPKHFSIFGYARSKMTDAELRDMVSKTLTCRIDKRENCSEKMEEFLKRCFYHSGQYDXEEDFRELGKKIKQHEGPRVSNHLFYLSIPPNIFLDVVKCASKSASSVSGWTRVIVEKPFGRDSESSAALTKGLKQYLTEDQIFRIDHYLGKELVENLSVLRFSNLVFEPLWSRQYIRNVQLIFSEDFGTEGRGGYFDSYGIIRDIMQNHLLQILALFAMETPISLEAEDIRNEKVKVLRSMKPLRLEDVVIGQYKSHTKGGITYPGYTEDKTVPKGSLTPTFAAAALFINNARWDGVPFLMKAGKALHTKQAEIRVQFRHVPGNLYKGSFGTDLDRATNELVIRVQPDEGIYLKINNKIPGLGMRLDRSNLNLHYAARYPKEIPDAYERLLLDAIEGERRLFIRSDELDAAWELFTPLLKELEQKRMAPELYPYGSRGPVGAHYLXAAKYKVRWGDLGGSGTLGRERGFTREVMISVFGVAISAKGLAAHAQLVGVVRGTDLNKGERLAMLVFIDRSTVSEYICWYHWLTYSMILKRKPRAESSFILAVRRLIWLSGWAGLLYWDC

SEQ ID NO: 119255 - protein, 100 aa, Triticum aestivum
  Clone ID: PAT_TA_13673.pep
MRPQALLAALVVVAVLAAALPLAHSQDAGATPSAWPCCDKCGSCTRSIPPLCTCMDMSPTGCNKACKTCAKPNSTLAGGDGFRCADRIANFCKRRCTPVA

SEQ ID NO: 119256 - protein, 131 aa, Triticum aestivum
  Clone ID: PAT_TA_13674.pep
SRAAPCTQILAPPHALLLHALLVRYTSSYVRFSDGGSVGRRWRGGRDDFTAFHDDEEGGLGTGKGSVGNLGGSCHTLAGAVVAESTPAAADADDAVVSSSSTIAAATAHRPADLAMVDRTALSILVDVCVG

SEQ ID NO: 119257 - protein, 310 aa, Triticum aestivum
  unsure (1)..(310): unsure at all Xaa locations
  Clone ID: PAT_TA_13675.pep
MAPPRAVICVGDVHGYISKLESLWANLRSALPADAFATALVIFLGDYNDRGPHTRRVLDFLLALPARHPAQRHVFLCGNHDLAFAAFVGALPPPPDGSPFAATWAQYIDNEAHEGWFXGPGHEDMHVQGRRWGGVIKERWNPKKGLPYKGSIYDAQPTFESYGVAHGSPDLMKAVPEEHKKFLHDLVWVHEEEDVRIDTDGGQILCKLIAVHAGLEKSLDLXEQLRVLRTRDTRVPKVQMLSGRQDVWNIPQDLAGKQTIVVSGHHGKLHVDGLRFIIDEGGGYADKPIAAVVFPSKEVIRSTEGTASQN

SEQ ID NO: 119258 - protein, 283 aa, Triticum aestivum
  unsure (1)..(283): unsure at all Xaa locations
  Clone ID: PAT_TA_13676.pep
MFLSRIVLRDLDSIDSPASMATSKKVVTRDEWERKLRDVKIRKEDMNRLVMNFLVTEGFVDAADKFRVESGTQPDIDLATITDRMEVKKXAVQSGNVQEAIEKINDLNPTILDTNPELYFHLQQQKLIELIRMGKINEALEFAQEELAPRGEENQAFLEEIEKTVALLVFEDVKNCPYGELLDVSQRLKTASEVNAAILTSQSHEKDPKLPSLLKMLIWTQNQLNEKAAYPRINNLSTAALEDPSYMSCCAQSVRVLSTELRHQQPCLHVHSVVGLLFVSSVF

SEQ ID NO: 119259 - protein, 411 aa, Triticum aestivum
  unsure (1)..(411): unsure at all Xaa locations
  Clone ID: PAT_TA_13677.pep
MAPNPAAIALLAALDGNLRLLKKMSKKMDLRVTKDPKGLNALHFAANKGSLEICKFLVEDVGVDVNSVSSVGATPMFYAALKGNLQVARYLLDHGSDPAKPSERGLTPLHNAAEHGHCEIVRLLLSKGVDVDVINYRGTPLHMTAAKGQHQAMKILLEHGADPNRVVNHIFSPLMMACCGNSLGCMKLLIEAGADVNGNTSSXHAPLTGAVDDGSTEFAKFLLEAGADPNIPNQHGDIPIKRAAVRGQRELVELLFPKTNPIPSVPDWSVDGIITTMKSPQTRVQDRASAEERKADLKSQGKEAFAKKDYFTAMYYYGLVMEIDPLDATLFANRSLCWLRMREGDRALADAQRCIMLRPGWSKAWYREGSALIFMEDHQRAVDAFQEALRLDPDSSEIKKMFSEAKSKATR

SEQ ID NO: 119260 - protein, 492 aa, Triticum aestivum
  Clone ID: PAT_TA_13678.pep
SPAAIMVISNASSSAGEAVYSTFSSRYVREELPRYRMPSGSIPKEAAYQIISDELMLDGNPRLNLASFVTTWMEPECGKLMMDSVNKNYVDMDEYPVTTELQNRCVNMIAHLFNAPIGEDETAIGVSTVGSSEAIMLAGLAFKRKWANKMKEQGKPCDKPNIVTGANVQVCWEKFARYFEVELKEVKLTEGYYVMDPKKAVEMVDENTICVAAILGSTLTGEYEDVKLLNDLLVAKNKETGWDVPIHVDAASGGFIAPFLQPELEWDFRLPLVKSINVSGHKYGLVYPGVGWVIWRSKADLPDELIFHINYLGTDQPTFTLNFSKGASQIIAQYYQLIRLGFEGYKHIMENCKLNAAVLKEGIDATGRFDVLSKADGVPLVAIRLKDSTNFSVFDISENLRRFGWIVPAYTMPADAEHVAVLRIVIREDFNRSLAQRLLTDINKIVGELDAHAVHAIKLSTAAAAEGASKSTVDAVTEAFKGLAGNKKAGVC

SEQ ID NO: 119261 - protein, 452 aa, Triticum aestivum
  Clone ID: PAT_TA_13679.pep
MPTITHYVLDPFLETGSLPNLQKLVPKPPPAAPLPPEKSSEKPIPVPVAPARTTTLPALYSTPESTPLPDSPSSFPGTWSPYLINHKRRGPGLIKTSSQGDVGSEGSLPKFPEGLPALPKRSEAFQVQESEFRFTQESDGVVNNGVEETLDEQNEGVQKGKVTLFGQDEQDQPEFEFRHESPDALVRPVNVGRLVNNGMPRDGENDAFLEPQDSQSVTSNSEAEDAGGQGWWKPSSPYGTSAGTPGAEFYDAFEEISSDGATRSSRCIDDEYREMRLSMLTEIEGRKQAEEVAETWQKEWKKLSHHLSLIALSLPSPTVAENDDDTSADPGAELCQQITVSQLVAAAIARGIARVEVESEMESVISAKNFEIARLSDRVQYYEAANREMSQRNQEAIEMSRQQRNKPKMRQKWFWGSVGIAVTLGTAAIAWSYMPASQSQAGDSNSTNTNSD

SEQ ID NO: 119262 - protein, 153 aa, Triticum aestivum
  Clone ID: PAT_TA_13680.pep
MANSNLPRRIIKETQRLLSEPAPGISASPSEENMRYFNVMILGPAQSPYEGGVFKLELFLPEEYPMAAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 119263 - protein, 345 aa, Triticum aestivum
  Clone ID: PAT_TA_13681.pep
MGKKKKRVEKVFCYYCDREFDDEKILVQHQKAKHFKCHVCHKKLSTAGGMAIHVLQVHKESVTKVPNAKPERDSTEIEIFGMQGIPSDVLAAHYGEEEDPSSKVAKVEVPTIRPPIMPNYPLGMPFPPRPYGAARPMYNPAMMVRPPIWPLQQPQPWFAQQPPVSVPPMMAGQAPQQPLFPIQNMPNPMMTSAPANLLQTSYAMPTTGVPSPVAPQASQPLFPVNTSGNGAANSSFSSSISPATIAANSPASVGTAGYGYVANNHGTGGPAIGQPPAPATNSKTSATQPATSEVYLVWDDEAMSMEERRLALPMYQVHDETSQMSSVDAAFDRRISDITFSRQLT

SEQ ID NO: 119264 - protein, 119 aa, Triticum aestivum
  Clone ID: PAT_TA_13682.pep
MRAISSAAGGMLRARLRAAVRLRGGHGDGGGRWTTPGHEVRPKGYPMNRTPPPPGESRKWEDWELPCYVTSFLTVVILGVGLNAKPDLTLETWAHHKALERLQQQELSAASASAEALSE

SEQ ID NO: 119265 - protein, 120 aa, Triticum aestivum; identical to SEQ ID NO: 119228
  Clone ID: PAT_TA_13683.pep

SEQ ID NO: 119266 - protein, 345 aa, Triticum aestivum
  unsure (1)..(345): unsure at all Xaa locations
  Clone ID: PAT_TA_13684.pep
MGKKKKRVEKVFCYYCDREFDDEKILVQHQKAKHFKCHVCHKKLSTAGGMAIHVLQVHKESVTKVPNAKPERDSTEIEIFGMQGIPSDVLAAHYGEEEEPSKVAKVEVPTIRPPIMPNYPLGMPFPPRXMVQPRPMYNPAMMVRPPIWPLQQPQPWFAQQPPVSVPPMIXLGQAPQQPLFPIQNMPNPMMTSAPANLLQTSYPMATTGVPSPVAPQASQPLFPVNTTGNGAANSSFSSSISPATIAANSPASVGTAGYGYVANNHGTGGPAVGHPPAPATNSKTSATQPATSEVYLVWDDEAMSMEERRLALPMYQVHDETSQMSSVDAAFDRRISDITFSRQST

SEQ ID NO: 119267 - protein, 190 aa, Triticum aestivum
  unsure (1)..(190): unsure at all Xaa locations
  Clone ID: PAT_TA_13685.pep
MATATSPLLSLSSLSASLPSPSRAPASLSLRAIAPQARLSTSYAAFPIGGFGASASTGRLRRRGLQVVCAARAAXTGRQPDSVXKKRERQNDRHRIRNHARKAEMRTRMKKVXRALEKLRKKADAQPEXIIEIEKMISEAYKAIDKTVKVGAXCHRNTGDHRKSRLARRKKAIEIIRGWYVPNAEPAATA

SEQ ID NO: 119268 - protein, 488 aa, Triticum aestivum
  unsure (1)..(488): unsure at all Xaa locations
  Clone ID: PAT_TA_13686.pep
MVISHASSSAGEAVYSTFSSRYVREELPRYRMPEGSIPKEAAYQIISDELMLDGNPRLNLASFVTTWMEPECGKLMMDSVNKNYVDMDEYPVTTELQNRCVNMIAHLFNAPIGEDETAIGVSTVGSSEAIMLAGLAFKRKWANKMKEQGKPCDKPNIVTGANVQVCWEKFARYFEVELKEVKLTEGYYVMDPKKAVEMVDENTICVAAILGSTLTGEYEDVKLLNDLLVAKNKETGWDVPIHVDAASGGFIAPFLQPELEWDFRLPLVKSINVSGHKYGLVYPGVGWVIXWRSKADLPDELIFHINYLGTDQPTFTLNFSKGASQIIAQYYQLIRLGFEGYKHIMENCKLNAAVLKEGIDATGRFDVLSKADGVPLVAIRLKDSTNFSVFDISENLRRFGWIVPAYTMPADAEHVAVLRIVIREDFNRSLAQRLLADINKIVGELDAHAIHAIKLSTAAAAEGASKSTVDAVTEAFKGLAGNKKAGVC

SEQ ID NO: 119269 - protein, 153 aa, Triticum aestivum; identical to SEQ ID NO: 119262
  Clone ID: PAT_TA_13687.pep

SEQ ID NO: 119270 - protein, 159 aa, Triticum aestivum
  Clone ID: PAT_TA_13688.pep
MDATATGAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPKINPVLLPKKTAEKEGQAPKSPKKAAKSPKKAATPKKA

SEQ ID NO: 119271 - protein, 397 aa, Triticum aestivum
  unsure (1)..(397): unsure at all Xaa locations
  Clone ID: PAT_TA_13689.pep
MPGLTAPSDYAEEPPRHPALRINSKEPFNAEPHRSALVSSYITPVDFFYKRNHGPIPKVDDISRYSVSISGLVNKHIQLSMDDIRMLPKYNVTATLQCAGNKRTAMSKVRKVRGVGWDVSALGNATWGGAKLSDVLELVGIHKLSSVTSLGGKHVEFVSVDRCKEEKGGPYKASIPLKQATDPDADVLLAYEMNGETINRDHGYPLRVVVPGVIGARSVKWLDSINIIKEECQGFFMQKDYKMFPPTVDWDNINWSTRRPQMDFPVQSAICTLEDVDVIKEGKARIAGYAVSGGGRGIERVDISVXGGKTWVEAHRYQKSNVPYVSDGAQSDKWAWVLFEATLDIPANAEIVAKAVDSAANIQPEKVEDIWNLRGILNTSWHRIKIQNTSCVSRSKM

SEQ ID NO: 119272 - protein, 489 aa, Triticum aestivum
  unsure (1)..(489): unsure at all Xaa locations
  Clone ID: PAT_TA_13690.pep
MVISHASSSAGEAVYSTFSSRYVREELPRYRMPEGSIPKEAAYQIISDELMLDGNPXRLNLASFVTTWMEPECGKLIMDSVNKNYVDMDEYPVTTEXLQNRCVNMIAHLFNAPIGEDETAIGVSTVGSSEAILLAGLAFKRKWANKMKEQGKPCDKPNIVTGANVQVCWEKFARYFEVELKEVKLTEGYYVMDPKKAIEMVDENTICVAAILGSTLTGEYEDVKLLNDLLVEKNKKTGWNVPIHVDAASGGFIAPFLQPELEWDFRLPLVKSINVSGHKYGLVYPGVGWVIWRSKDDLPDELIFHINYLGTDQPTFTLNFSKGASQIIAQYYQLIRLGFEGYKHIMENCKLNAAVLKEGIDATGRFDVLSKADGVPLVAIRLKDSTNFSVFDISENLRRFGWIVPAYTMPADAEHVAVLRIVIREDFNRSLAQRLLADINKIVRELDAHAVHAIKLSNAAAAEGASKSTVDAVTEAFKGLAGNKKAGVC

SEQ ID NO: 119273 - protein, 193 aa, Triticum aestivum
  Clone ID: PAT_TA_13691.pep
DRLTHVQVPFTWNLSLSSLSASLPSPSRAPASLSLRAVAPQARLSTSYAAFPIGGFGASPSTGRLRRRGLQVVCAAEPPKTGRQPDSVKKRERQNDRHRIRNHARKAEMRTRMKKVFRALEKLRKKADAQPEEIIEIEKMISEAYKAIDKTVKVGAMHRNTGDHRKSRLARRKKAIEIIRGWYVPNAEPAAAA

SEQ ID NO: 119274 - protein, 188 aa, Triticum aestivum
  Clone ID: PAT_TA_13692.pep
MATATSPLLSLSSLSASLPSPSRAPASLSLRALAPQARLSTSYAAFPIGGFGASASTGRFRRRGLQVVCAAEPPKTGRQADSVKKRERQNDRHRIRNHARKAEMRTRMKKVFRALEKLRKKADAQPEEIIEIEKMISEAYKAIDKTVKVGAMHRNTGDHRKSRLARRKKAIEIIRGWYVPNAEPAAAA

SEQ ID NO: 119275 - protein, 129 aa, Triticum aestivum
  unsure (1)..(129): unsure at all Xaa locations
  Clone ID: PAT_TA_13693.pep
GKQIRLSFYSIIIXTTRGSTNHPSPDADIDQEFKIERADRSTMARSGGRWVVAAAIVVLLLTTVSSASAAAGVDSATTAPAKVWQLPPRIPTEPFPVPKPPSSSSWKAVKSSLPPRHRLPTEPPSEKRT

SEQ ID NO: 119276 - protein, 267 aa, Triticum aestivum
  unsure (1)..(267): unsure at all Xaa locations
  Clone ID: PAT_TA_13694.pep
MAQPAKLSREENVYMAKLAEQAERYEEMVEFMEKVAKTVDSEELTVEERNLLSVAYKXNVIGARRASWRIISSIEQKEESRGNEDRVTLIKDYRGKXLRVELTKICDGILKLLDSHLXVPSSTAPESKVFYLKMKGDYYRYLAEFKSGTERKDAAENTMVXAYKAAQEIALKELPPTHPIRLXGLALNFSVFYYEILNSPDRACDLAKQAFDEAISELDSLSEESYKDSTFIMQLLRDNLTLWTSDISEDAAEEMKDAPKGESGDGQ

SEQ ID NO: 119277 - protein, 219 aa, Triticum aestivum
  Clone ID: PAT_TA_13695.pep
MAPTSKMALGIKRASRSHTYHRRGLWAIKAKHGGAFPKAEKPAAVAEPKFYPADDVKPRTASTRKPKPTKLRSTITPGTVLILLAGRYMGKRVVFLKQLKSGLLLISGPFKINGVPVRRVNQAYVIATSTKVDISGVNVEKFDDKYFARDKKTRAKKTEGELFETEKETTKNLPEFKKDDQKAIDAELIKAIEAVPDLKNYLGARFSLRDGDKPHEMTF

SEQ ID NO: 119278 - protein, 156 aa, Triticum aestivum
  unsure (1)..(156): unsure at all Xaa locations
  Clone ID: PAT_TA_13696.pep
MANSNLPRRIIKETQRLLSEPAPGIXSASPSEENMRYFNVMILGPAQSXPTKGGVFKLELFLPXEEYPMAAPKVRFLTKIYHPNIDKLGRICLDILKDKWSPALQIRTVLLSIQALLSAPNPDDPLSENIAKHWKSNEAEAVETAKEWTRLYASGA

SEQ ID NO: 119279 - protein, 262 aa, Triticum aestivum
  Clone ID: PAT_TA_13697.pep
MAQPAELSREENVYMAKLAEQAERYEEMVEFMEKVAKTVDSEELTVEERNLLSVAYKNVIGARRASWRIISSIEQKEESRGNEDRVTLIKDYRGKIEVELTKICDGILKLLDSHLVPSSTAPESKVFYLKMKGDYYRYLAEFKSGTERKDAAENTMVAYKAAQEIALAELPPTHPIRLGLALNFSVFYYEILNSPDRACDLAKQAFDEAISELDSLSEESYKDSTLIMQLLRDNLTLWTSDISEDAAEEMKDAPKGESGDGQ

SEQ ID NO: 119280 - protein, 421 aa, Triticum aestivum
  Clone ID: PAT_TA_13698.pep
MFGRGPPKKSDSTRYYEILGVPKDASQDDLKKAYRKAAIKNHPDKGGDPEKFKELAQAYEVLSDPEKREIYDQYGEDALKEGMGGGGMHDPFDIFQSFFGGGGNPFGGGGSSRGRRQRRGEDVVHPLKVSLEELYNGTSKKLSLARNVLCSKCNGKGSKSGASMKCAGCQGAGYKVQIRQLGPGMIQQMQQPCNECRGSGETISDKDRCGQCKGEKVVHEKKVLEVVVEKGMQHGQKITFPGEADEAPDTVTGDIIFVLQQKEHPKFKRKGDDLFYEHTLTLTEALCGFQYVLAHLDGRQLLIKSNPGEVVKPDSFKAINDEGMPMYQRPFMKGKLYIHFTVDFPDSLSLDQCKALETVLPPKPASQYTDMELDECEETMAYDIDIEEEMRRRQQQQAQEAYDEDEDMPGGGGQRVQCAQQ

SEQ ID NO: 119281 - protein, 719 aa, Triticum aestivum
  unsure (1)..(719): unsure at all Xaa locations
  Clone ID: PAT_TA_13699.pep
MAGADLNRSFIKDVKRIIIKVGTAVITRNDGRLALGRIGALCEQVKDLNAQGYEVIMVTSGAVGVGRQRLRYRKLVNSSFADLQKPQMELDGKACAAVGQSGLMALYDMLFTQLDVSSSQLXLVTDSDFDNSNFRERLRETVESLLELRVIPIFNENDAISTRKAPYEDSSGIFWDNDSLAGLLALELKADLLVLLSDVDGLYSGPPSEPSSKLIHTYIKEKHYHEITFGDKSRVXGRGGMTAKVQAAVWASTGGVPVVITSGCASHSLVKVLRGEKIGTLFHKNASLXEPSKDTSVREMAVAARDCSRRLQNLSSEERKKILLDVADALEANEDLIRSENEADLAAAHEAGYESALVSRLTLKPGXIASLAKSVRTLANMEDPINEHTXKRTEVADGLVLEKTSCPLGVLLIIFESRPDALVQIASLAIRSGNGLLLKGGKEAMRSNAILHKVITNAIPNNVGEKLIGLITTRDEIADLLKHDDVIDLVIPRGSNKLVAQIKSSTKIPVLGHADGVCHVYIDKSADMDMAKRIVMDAKIDYPAACNAMETLLVHKDLMKTPELNDILVALKTAGVNLYCGPVAHKVLGYPKADSLHLEYSSMACTVEIVDDVQSAIDHIHRYGSAHTDCVVTTDDKVAETFLRQVDSAAVLYNASTRFSDGARFGLGAEVGISTGRIHARGPVGVEGLLTTRWLLRGKGQVVNGDKDVEYTHKSLPLQ

SEQ ID NO: 119282 - protein, 262 aa, Triticum aestivum
  Clone ID: PAT_TA_13700.pep
MAQPAELSREENVYMAKLAEQAERYEEMVEFMEKVAKTVDSEELTVEERNLLSVAYKNVIGARRASWRIISSIEQKEESRGNEDRVTLIKDYRGKIEVELTKICDGILKLLDSHLVPSSTAPESKVFYLKMKGDYYRYLAEFKSGTERKDAAENTMVAYKAAQEIALKELPPTHPIRLGLALNFSVFYYEILNSPDRACDLAKQAFDEAISELDSLSEESYKDSTLIMQLLRDNLTLWTSDISEDAAEEMKDAPKGESGDGQ

SEQ ID NO: 119283 - protein, 422 aa, Triticum aestivum
  unsure (1)..(422): unsure at all Xaa locations
  Clone ID: PAT_TA_13701.pep
MFGRGPPKKSDSTRYYEILGVPKDASQDDLKKAYRKAAIKNHPDKGGDPEKFKELAQAYEVLSDPEKREIYDQYGEDALKEGMGGGGMHDPFDIFQSFFGGGGNPFGGGGSSRGRRQRRGXEDVVHPLKVSLEELYNGTSKKLSLARNVLCSKCNGKGSKSGASMKCAGCQGAGYKVQIRQLGPGMIQQMQQPCNECRGSGETISDKDRCGQCKGEKVVHEKKVLEVVVEKGMQHGQKITFPGEADEAPDTVTGDIIFVLQQKEHPKFKRKGDDLFYEHTLTLTEALCGFQYVLAHLDGRQLLIKSNPGEVVKPDSFKAINDEGMPMYQRPFMKGKLYIHFTVDFPDSLSLDQCKALETVLPPKPASQYTDMELDECEETMAYDIDIEEEMRRRQQQQAQEAYDEDEDMPGGGGQRVQCAQQ

SEQ ID NO: 119284 - protein, 122 aa, Triticum aestivum
  Clone ID: PAT_TA_13702.pep
MARIKVHELRGKNKADLQGQLKDLKAELSLLRVAKVTGGAPNKLSKIKVVRTSIARVLTVISQKQKSALREAYKNKQLPLDLRPKKTRAIRRRLTKHQLSLKTEREKKREKYFPIRKYAIKA

SEQ ID NO: 119285 - protein, 219 aa, Triticum aestivum
  Clone ID: PAT_TA_13703.pep
MAPTSKMALGIKRASRSHTYHRRGLWAIKAKHGGAFPKAEKPAAVAEPKFYPADDVKPRTVSTRKPHPTKLRSTITPGTVLILLAGRYIGKRVLFLKQLKSGLLLITGPFKINGVPIRRVSQAYVIATSTKVDISKVNVQKFDDKYFAREKKTRAKKTEGELFESEKEATKNLPDFKKDDQKAIDAELMKAIDAVPDLKNYLGARFSLRDGDKPHEMTF

SEQ ID NO: 119286 - protein, 421 aa, Triticum aestivum
  Clone ID: PAT_TA_13704.pep
MFGRGPPKKSDSTRYYEILGVPKDASQDDLKKAYRKAAIKNHPDKGGDPEKFKELAQAYEVLSDPEKREIYDQYGEDALKEGMGGGGMHDPFDIFQSFFGGGGNPFGGGGSSRGRRQRRGEDVVHPLKVSLEELYNGTSKKLSLARNVLCSKCNGKGSKSGASMKCAGCQGAGYKVQIRQLGPGMIQQMQQPCNECRGSGETISDKDRCGQCKGEKVVHEKKVLEVVVEKGMQHGQKITFPGEADEAPDTVTGDIIFVLQQKEHPKFKRKGDDLFYEHTLTLTEALCGFQYVLAHLDGRQLLIKSNPGEVVKPDSFKAINDEGMPMYQRPFMKGKLYIHFTVDFPDSLNLDQCKALETVLPPKPASQYTDMELDECEETMAYDIDIEEEMRRRQQQQAQEAYDEDEDMPGGGGQRVQCAQQ

SEQ ID NO: 119287 - protein, 122 aa, Triticum aestivum
  Clone ID: PAT_TA_13705.pep
MARIKVHELRGKNKADLQGQLKDLKAELSLLRVAKVTGGAPNKLSKIKVVRTSIARVLTVISQKQKAALREAYKNKRLPLDLRPKKTRAIRRRLTKHQLSLKTEREKKREKYFPMRKYAIKA

SEQ ID NO: 119288 - protein, 221 aa, Triticum aestivum
  unsure (1)..(221): unsure at all Xaa locations
  Clone ID: PAT_TA_13706.pep
MAPTSKMALGIKRASRSHTYHRRGLWAIKAKHGGALPKAEKPAAVAEPKFYPADDVKPRTVSTRKPHPTKLRSTITPGTVLILLAGRYMGKRVVFLKQLQSGLLLITGPFKINGVPIRKXVTKTYVIATSTKVDISKVNVQKFDDKYFAREKKTRAKKTEGELFESEKEATKNLPDFKKDDQKVIDAELIKAIVAVPDLKNYLGXARFSLRDGDKPHEMTF

SEQ ID NO: 119289 - protein, 219 aa, Triticum aestivum; identical to SEQ ID NO: 119277
  Clone ID: PAT_TA_13707.pep

SEQ ID NO: 119290 - protein, 122 aa, Triticum aestivum
  Clone ID: PAT_TA_13708.pep
MARIKVHELRGKNKAELQGQLKDLKAELSLLRVAKVTGGAPNKLSKIKVVRTSIARVLTVISQKQKSALREAYKNKRLPLDLRPKKTRAIRRRLTKHQLSLKTEREKKREKYFPMRKYAIKA

SEQ ID NO: 119291 - protein, 421 aa, Triticum aestivum
  Clone ID: PAT_TA_13709.pep
MFGRAPKKSDNTKYYEVLGVPKNAAQDDLKKAYRKAAIKNHPDKGGDPEKFKELAQAYEVLSDPEKREIYDQYGEDALKEGMGGGGGGGVDPFDIFSSFFGPSFGGGGGGSSRGRRQRRGEDVVHPLKASLEDLYNGTSKKLSLSRSVLCSKCKGKGSKSGASMRCPGCQGSGMKVTIRQLGPSMIQQMQQACNDCKGTGESINDKDRCPGCKGEKVLQEKKVLEVHVEKGMQHNQKITFPGEADEAPDTVTGDIVFVVQQKEHPKFKRKGDDLFYEHTISLTEALCGFQLVLTHLDNRQLLIKSNPGEVVKPDSFKAISDEGMPMYQRPFMKGKLYIHFTVEFPDSLAPDQCKALEAVLPPKPASKLTDMELDECEETTMHDVNMEEEMRRKAHAAAQEAYDEDDEMPGGGAQRVQCAQQ

SEQ ID NO: 119292 - protein, 145 aa, Triticum aestivum
  Clone ID: PAT_TA_13710.pep
MTTRLKKNRKKRGHVSAGHGRVGKHRKHPGGRGNAGGMHHHRILFDKYHPGYFGKVGMRYFHKLSNRFYTPTINVERLWSMVPAEKAAEAGGDKAPVVDVSQFGYFKVLGKGMLPEKPIVVKAKLISKIAEKKIKAAGGAVVLVA

SEQ ID NO: 119293 - protein, 242 aa, Triticum aestivum
  Clone ID: PAT_TA_13711.pep
MLGKNASSLLQPKRPHASTQGIPMAPTSKMALGIKRASRSHTYHRRGLWAIKAKHGGAFPKAEKPAAVAEPKFYPADDVKPRTVSTRKPKPTKLRSTITPGTVLILLAGRYMGKRVVFLKQLKSGLLLISGPFKINGVPVRRVNQAYVIATSTKVDISGVKVEKFDDKYFARDKKTRAKKTEGELFETEKETTKNLPSFKKDDQKAIDAELIKAIEAVPDLKNYLGARFSLRDGDKPHEMTF

SEQ ID NO: 119294 - protein, 134 aa, Triticum aestivum
  Clone ID: PAT_TA_13712.pep
ITIPGISASPSEENMRYFNVMVLGPAQSPYEGGVFKLELFLPEEYPMAAPKVRFLTKIYHPNIDKLGRICLDILKDKWSPALQIRTVLLSIQALLSAPNPDDPLSENVAKHWKSNEAEAVETAKEWTRMYASGA

SEQ ID NO: 119295 - protein, 421 aa, Triticum aestivum
  Clone ID: PAT_TA_13713.pep
MFGRAPKKSDNTKYYEVLGVPKNAAQDDLKKAYRKAAIKNHPDKGGDPEKFKELAQAYEVLSDPEKREIYDQYGEDALKEGMGGGGGGGVDPFDIFSSFFGPSFGGGGGGSSRGRRQRRGEDVVHPLKASLEDLYNGTSKKLSLSRSVLCSKCKGKGSKSGASMRCPGCQGSGMKVTIRQLGPSMIQQMQQACNDCKGTGESINDKDRCPGCKGEKVLQEKKVLEVHVEKGMQHNQKITFPGEADEAPDTVTGDIVFVVQQKEHPKFKRKGDDLFYEHTISLTEALCGFQLVLTHLDNRQLLIKSNPGEIVKPDSFKAISDEGMPMYQRPFMKGKLYIHFTVEFPDSLAPDQCKALEAVLPPKPASKLTDMELDECEETTMHDVNMEEEMRRKAHAAAQEAYDEDDEMPGGGAQRVQCAQQ

SEQ ID NO: 119296 - protein, 145 aa, Triticum aestivum
  Clone ID: PAT_TA_13714.pep
MTTRFKKNRKKRGHVSAGHGRVGKHRKHPGGRGNAGGMHHHRILFDKYHPGYFGKVGMRYFHKLSNRFYTPTVNVERLWSMVPSEKAAEAGGDKAPVVDVSQFGYFKVLGKGMLPEKPIVVKAKLISKIAEKKIKAAGGAVVLVA

SEQ ID NO: 119297 - protein, 145 aa, Triticum aestivum
  Clone ID: PAT_TA_13715.pep
MTTRFKKNRKKRGHVSAGHGRVGKHRKHPGGRGNAGGMHHHRILFDKYHPGYFGKVGMRYFHKLSNRFYTPTVNVERLWSMVPSDKAAEAGGDKAPVVDVSQFGYFKVLGKGMLPEKPIVVKAKLISKIAEKKIKAAGGAVVLVA

SEQ ID NO: 119298 - protein, 421 aa, Triticum aestivum; identical to SEQ ID NO: 119295
  Clone ID: PAT_TA_13716.pep

SEQ ID NO: 119299 - protein, 292 aa, Triticum aestivum
  unsure (1)..(292): unsure at all Xaa locations
  Clone ID: PAT_TA_13717.pep
QGRFHVSIQNTLGLVALLHPFLESGLLILKSLLQVLKSFHKVGLESSSTGSSFPADSAKPVPLAVVSLDSRQXDSGNLVNPFMRVTNXMTRHLATLRESXVTPAVYPRLVEFLHFDIQSTGQKSHCVSIREDHRNALFXLNSRIPLVRTSSESTVSCSGKAPEGAIPGPSPGRXHAATRSRRVSSSSNPPTADGFGAGTPEPSPQSQSFSRSYGSVLPTSLAYIVPXPRGCSPWRPDAVMSTTGRERYSVLRIFMGRRGRTGHRATCGALPATGPYLRLNRFQGWQAVKQKR

SEQ ID NO: 119300 - protein, 142 aa, Triticum aestivum
  Clone ID: PAT_TA_13718.pep
VRPRVRVRVVVVNITHTRSTYTQTLTLEDRSMAPSPAAAVKTTRATCVLLILLLLADGRSRPVAGQAPPAPEEAVAIEADADGRGNGTRGGGRSAGTPKELSAIDCQVCESTCRVKCLVNNLLQWGSCYQHCKADNCNEWCR

SEQ ID NO: 119301 - protein, 117 aa, Triticum aestivum
  unsure (1)..(117): unsure at all Xaa locations
  Clone ID: PAT_TA_13719.pep
HRGDQGAAGDYLVRFDMPGMTREDVRVSVQARTLVVVAEKAAKPGEADGEKDKDNEEDGEEEEAWPAASYGRYRTRVELPENVEVERIAAEVRDGVLYLXIPKVSPSGGKVVSIQVQ

SEQ ID NO: 119302 - protein, 102 aa, Triticum aestivum
  Clone ID: PAT_TA_13720.pep
SKLKQGRSGGMESGKEAAVNAGASARAGMEKTRAAVQGQVDKAAAYTTGHREAAVVNKEAAEVKKQQRIHAAEEEKQRAVRGHAAAKECAETEARHGGHGDE

SEQ ID NO: 119303 - protein, 84 aa, Triticum aestivum
  unsure (1)..(84): unsure at all Xaa locations
  Clone ID: PAT_TA_13721.pep
VEECSACGGSGLCPRCKGEGFVFKEVGEEAAGRARRAAKNMATRYTAGLPXKWTYCNRCSSTRSCTACDGSGAVPARAKTTTTN

SEQ ID NO: 119304 - protein, 101 aa, Triticum aestivum
  Clone ID: PAT_TA_13722.pep
MATAAGGARRALAGLRSASPSTLSRTFSRPAVAQSPELAASALPRAPRRRLAISRVPVAALGGAQGLIPLHSATASALLTSMLGLKPGSWGWLSEGFATPL

SEQ ID NO: 119305 - protein, 68 aa, Triticum aestivum
  Clone ID: PAT_TA_13723.pep
MQSFFIFFFFFFFFCRPFGPAAAAASRHREFDTQSACCAATSAMRAKWKKKRMRRLKRKRRKMRQRSK

SEQ ID NO: 119306 - protein, 223 aa, Triticum aestivum
  unsure (1)..(223): unsure at all Xaa locations
  Clone ID: PAT_TA_13724.pep
SQPAPLPSAKDRWLRRHGKREAQTRAPWPGARGRRPRSTRTGCSRRPGARRRGAAPAARRTSSTSRTSGGRSVRRTPAPRTSRALARSRRPPAPAGGRSRWTMPPPGARRRARVAADEHPGLAEDRGGREEGPPRRGAGGQRRRRGGPRRGGGGPPERVGGAAARAXRGAAAPGRRRRTRGGAGRSRGATSAASGTPSGRGPASRTDRRACMASAWLDRPLLV

SEQ ID NO: 119307 - protein, 88 aa, Triticum aestivum
  Clone ID: PAT_TA_13725.pep
VAAKGNSGDKKPKVDKRPALPPSPGTAAKGNNGDKKPKVDEWTALPPSPGTAAKGSSGDKKPMQAGKLARPGRVKVRRYKLLAEVISC

SEQ ID NO: 119308 - protein, 109 aa, Triticum aestivum
  Clone ID: PAT_TA_13726.pep
PTTVASATFLFSFLFLFFSLLHVRMGQWLTWWAGGCPTHARGWIRGPREYHSRPQIVPDPTQAVGVSASITNLRHRWLPHRRVEGPGAACSSSEEQDPPGMCAPDATPL

SEQ ID NO: 119309 - protein, 147 aa, Triticum aestivum
  Clone ID: PAT_TA_13727.pep
RPCVFGSWSACDPVPLSAMTPVCGWPGVYKCCDPRGLPSIVVRHPERSSSCELGTLGLAYRTLFVPFCPVWCGGPGALRVMMAPLELCFHRPPPTYKYAPFYLPGSHSFHLGMPAGTRSSVGSRGAHVHQLGKELPLSCCVNIIFSA

SEQ ID NO: 119310 - protein, 251 aa, Triticum aestivum
  unsure (1)..(251): unsure at all Xaa locations
  Clone ID: PAT_TA_13728.pep
FGRGGGFAMFSARQCYFDRLCRRLCRGVGAVVVSVEYRLAPEHPYPAAYDDAVDALRFIDANGVPGLDEGVRVDLSSCFLAGESAGGNIIHHAANRWAAAAPTPNSVRLAGLLSVQPYFGGEERTESELRLDGVVPIVTIRRADFXWRASLPEGASRDHPAAHVTDENAELAEAFPPALVVVGGFDPLQDWQRRYADVLRRKGVKVQVAEYPDGFHGFYGFPAVADAGKVFQEMKAFVESNRVAPVKSTAR

SEQ ID NO: 119311 - protein, 169 aa, Triticum aestivum
  Clone ID: PAT_TA_13729.pep
WIPVVPALLWQAAALPSPVAHCRCHRIDRILSAGRRGEELRGIIQRGRTIGTITCNTGPWRGAGAATRRVSVGSRSLWNRIIGASELSWSAAAASKQLEDWRSTMAAMKSSGPAFSSKKKNGGNSWVVGRMPRALFLWLGCRHCHIQPIYLNYKLSCNPSFLEVKDLEE

SEQ ID NO: 119312 - protein, 115 aa, Triticum aestivum
  Clone ID: PAT_TA_13730.pep
AWSRPRYSGKVCKKITPPGRRCSPSSLLILRHQLGDKLSLQEGVLSRPRVCQKPSRFRREQMKGSDNVRPKWTPKPSGATRPSPVQSHWTRVFGQGLRVDEASLMKDAELSQAER

SEQ ID NO: 119313 - protein, 170 aa, Triticum aestivum
  Clone ID: PAT_TA_13731.pep
MTMSSPASTHLLRSAPAAPLLPRRASLQLSCVASGAAPRSRRRSGRLEVVRAATAEVAEAAGAPAYTTESLILYFKAEGTMEERSIPKITQALEGMDGVSDLEVLIEEGIGSVVLTKATTVQATGVASNLVEAIQGVGFKLQTLSLSFEDFDKEDAAAVSGEGADVQASE

SEQ ID NO: 119314 - protein, 65 aa, Triticum aestivum
  unsure (1)..(65): unsure at all Xaa locations
  Clone ID: PAT_TA_13732.pep
ACFLLALINTVARIISYPAGKAGLVQNMEKPPFIIRRHXANATQPTPWERXTNDXSTILVXVRPX

SEQ ID NO: 119315 - protein, 219 aa, Triticum aestivum
  Clone ID: PAT_TA_13733.pep
QTSLDRFHLKEKRKANRRFKAMAAAIRLAASRLIGGQRPQAVFKSVVLPLVEVGRRRLIPSLINGGRPASFSLRSMSSGGAGCKEFFSGAAAAAHPPNGNRALKQPFGEPVPKLDPERAWAYRQYCEIETKKHELFYLIAELEKRHPYRRYTGKNMELLFQLFGHVDPNPSDPLWCRAHARERLNNCLLYGMPPPMAPWMYMDWESWRNMFAFALGIGP

SEQ ID NO: 119316 - protein, 183 aa, Triticum aestivum
  unsure (1)..(183): unsure at all Xaa locations
  Clone ID: PAT_TA_13734.pep
RGPVVXHXLXXVGSLSLFRHEHPHXVDVRSRRPPRWRGSKTGKFWETHLGHRCRLRRHIPPGHLCREEEQILAVMLPCSVFRGGGPRHRPRAGQCTARKTPSQMAVWKPQQLMLGLGRNNGRQATPAPTRIPAKQRPTTSSCQGGQRRRWAQDIRAPNRRAQVSRKDCHRTICKSFQTKKKKK

SEQ ID NO: 119317 - protein, 88 aa, Triticum aestivum
  unsure (1)..(88): unsure at all Xaa locations
  Clone ID: PAT_TA_13735.pep
GEPARRLGLHYVPYKILPSESSLFRRYARDDPVLTDPVAVNAKGWQVTKKVYLDGQXVRLDMARFRRRLREAYDHWAAQRRRQQSQPL

SEQ ID NO: 119318 - protein, 125 aa, Triticum aestivum
  Clone ID: PAT_TA_13736.pep
ECTLAESLEDVVFSFRFVSFQGRKRRGGSPQSPRANEFLSLPADILQVGASFVIRTAPKRNQEREGRGCPKSRGEQRERQRHQNPSGLGAVWRLHCMRVAGRLAGAAAPEAGACPAVGTRCLLGN

SEQ ID NO: 119319 - protein, 92 aa, Triticum aestivum
  unsure (1)..(92): unsure at all Xaa locations
  Clone ID: PAT_TA_13737.pep
GSIVLTRYKHSIIQALTELNQPEIATSCTSLLPFSSSSSYRLSAPSSSELLSSRLVTFFSSSVRAAFLSSGPIVGSASYLRIFTRTRARXTT

SEQ ID NO: 119320 - protein, 386 aa, Triticum aestivum
  Clone ID: PAT_TA_13738.pep
MRMTTMNSRTTTTMTSPPGGLGVFANTETRSCSVEGSLRFKNLFGYCETWRPRTRGGLDQTMELNVGAIIPRIGPIPTPLMARVSFLSEDWLKSSLREHLMGVSVGLLSTMNYNLAYNLSWKTIIDPARLSSSSIRDQLEHSLLSSIKYTYKIDQRDSSIRPTCGYAFLSSSQVGGLAPDSKNTRFVRQEFDLRVAMPLGVWNGALNAGVAAGVIHPLATGSTGSISSLPERFYLGGNRSLVCRLGGPSSLLGFKSRGLGPTDSQACAPKNSENAAPISPELDALGGDIAVTAFADLSFDLPLKPLRELGIHGHAFVSAGNHAKFTERDIRGFSVTEFLKTFRSSAGFGVVVPTRLFRIEMNYCHILKQFDNDRAKTGIQFNFSSP

SEQ ID NO: 119321 - protein, 128 aa, Triticum aestivum
  unsure (1)..(128): unsure at all Xaa locations
  Clone ID: PAT_TA_13739.pep
MEPCKILGYDIPKGTTVLVNAWAIGRDPKHWEDPEEFKPERFKSGMVDXKGTNFEYIPFGAXGRRMCPGMTFARGSMEIVLASLLYHFDWELPNGVKPDGLDMTEEMGLTVRRKNDLYLHAVVHVPLI

SEQ ID NO: 119322 - protein, 54 aa, Triticum aestivum
  Clone ID: PAT_TA_13740.pep
WQDFWAEMMVYIAPSNNVAGHIELLAEGGEFVTHVWALLMHAGILERPSTTIIP

SEQ ID NO: 119323 - protein, 193 aa, Triticum aestivum
  unsure (1)..(193): unsure at all Xaa locations
  Clone ID: PAT_TA_13741.pep
XQVGVNVQLMVFXXAGVKGEGEEIVLVNPVVYKFXXRLSVYEEGCLSFPGIYANVXRPDTVKIDAHGASGARIPARVXALTGRAFQRENDHGRGSEHIGGAAEDGGESRGEQRTSQAGNYGELPGDAGRGTISKKRGTREVARGTSRLRQTVQQMWHGQQEAALQTQVVVAVLVGVDTADIQVMADRQCPVKD

SEQ ID NO: 119324 - protein, 98 aa, Triticum aestivum
  Clone ID: PAT_TA_13742.pep
GSTSVAISFLNSCSPSVSHKSSVCVPLLHFPQISLLIDHYILVSAHYCFLLLNQCPLSLRNLESSCLVPYFHLSSNFQLSGILSLSSVAFVNQVRSTT

SEQ ID NO: 119325 - protein, 420 aa, Triticum aestivum
  unsure (1)..(420): unsure at all Xaa locations
  Clone ID: PAT_TA_13743.pep
METVVGIYLNTPKSEKLHQXGDNERLKIVLFFLLGWRAGMEDALSALLDIDEDTXCFGVFDXHGGKVFDKFCAKYLHRXVLKSEVYLAGDLGAAVHGAFFRMDEMMRGQRGWRELQALGDKINQFTGMIEGLIWSPRGSDSNDRHDDWAFEEGPHSDFSGPTCGSTACVAMIRNSQLVVANAGDXRCVISMKGLARNLSRDHKPKLDWEIWNLSKAGXFASMXEANMGLQILTSMLWIFAMKDKFFAPDKQMLTANLDVNTVXELCDDDDFLVLACDGIWDCMSSXQLVDFIHRSTXRPREAFHAVCEKVLXRCLAPXSTLGGEGCDNMTXMILVQFXKKPIDHGKNASAGEQSAVGDKNVSAGEQSTAEDKNASASDQSAVEDKNASAGGQSAVGDKNASAGGQSPGDIEQSANEEKNS

SEQ ID NO: 119326 - protein, 159 aa, Triticum aestivum
  Clone ID: PAT_TA_13744.pep
THPHIDIHRGGGKEKEGCACTCTAWRVPRRKHSSVWWLHWWFCRCSWQQLRWPWPAYSRNRRRGHGQQSQTYQWSTSYCLMGEETPVAAGRHATLAPASKVIAAAQIIRIAGTKTGKDAAWLRFLFIRKEAARLFHGRTSKILSRCLSQATIVCVQRCG

SEQ ID NO: 119327 - protein, 171 aa, Triticum aestivum
  unsure (1)..(171): unsure at all Xaa locations
  Clone ID: PAT_TA_13745.pep
ELGANKPKXARFSVIIAVSTSAAIGAVFLAVFLAWRTELPRFFSDNEEVVSEAAKLGYLLAATIFLNSIQPVLTGVVIGAGWQTLVAFINIGCYYLVGIPLGFLFGFKLKLGALGIWAGMSIGTLLQTVVLLIICFRTKWKKQAMLAEGRIREWGGSSETLPAATNGGIDR

SEQ ID NO: 119328 - protein, 77 aa, Triticum aestivum
  unsure (1)..(77): unsure at all Xaa locations
  Clone ID: PAT_TA_13746.pep
LVNAPTVKLVLAGPNTKPLRCFQRCQQMSMTTGVHPSPVNLRGCTHXLLXTNLQXCXXPHGFFQNNFQVQLVSWVQP

SEQ ID NO: 119329 - protein, 55 aa, Triticum aestivum
  Clone ID: PAT_TA_13747.pep
IHSRSAVKILEASSNLYSAIIDDKLCMKIGEGPWCPSDPEWKLAACGDRYAVWHK

SEQ ID NO: 119330 - protein, 391 aa, Triticum aestivum
  Clone ID: PAT_TA_13748.pep
TYAGNGASSRTDQLAASPYMVQPVFGSSTGPLQKSSSRWNHQEASPQGVEPDRHLVKSYASLPYPKDETLSRHSILGPNGLHGQWTRPVSGVKVQYPSYPELTSGNIPSLIPAILNQNDSHGPNTTSLDGLTNNNGDMQSVLSLDDGQWSLPVKEPASVSPASFEEEFSQLNIRQPNPPPVLAQVHPERRPISPSRVADPRPGLAPCDTGRFQNLHVPVALMESFLRLAEANTAKNLETCGILAGNLKKRTFYVTTLIIPKQESTSDSCQATNEEEIFEVQDKGSLFTLGWIHTHPTQTCFLSSIDLHNHYSYQVMLPEAIAIVMAPTDTTRKHGIFHLTDPGGMGVIHDCQETGFHPHEEPLDGTSIYEHCSHVYMNPTVKFDMVDLRRV

SEQ ID NO: 119331 - protein, 65 aa, Triticum aestivum
  Clone ID: PAT_TA_13749.pep
TLLAAFLVDGSKHNLDHLHEVIVYNRIVDFRDPLNLVHVCGASHYTCGATNIMPSVHGVLRRQNR

SEQ ID NO: 119332 - protein, 292 aa, Triticum aestivum
  Clone ID: PAT_TA_13750.pep
AFPCLPSVRPPPRAVRARAERPRGRRPALTVVAAGTRTSGAEARGSLVLALVSQALAASQRRAVDLVTEAAKYALPSGRFEPRNLEEALMSVPDLETVPFRILKREEDYEIRQVESYYVAETTMPGRTGFDFSGSSQSFNVLASYLFGKNTSSEQMEMTTPVFTRKEEVRGETMDMTTPVITKKSADGNKWKMSFVMPSKYGPDLPQAKDPSVTIKEVPSKIVAVAAFPGLVTDDDISQRESRLRKALQKDTQYRVKEDSVVEIAQYNPPFTLPFARRNEVALEVEGVDSAS

SEQ ID NO: 119333 - protein, 160 aa, Triticum aestivum
  Clone ID: PAT_TA_13751.pep
MAGTYERSYMHFPGGPQRIPVQVAVGHNVHGGLWATMVQREQVVVSHRISHHATCVWCVWVWLCACPLMGASTQSSFGQRRLAIWIRRSVVLAVLGEEVPAIGAAFPGCFLGRGGSARRCCFSRLLLGRRRFRPSALLSPVASWAEEGARSICSPSRLDP

SEQ ID NO: 119334 - protein, 200 aa, Triticum aestivum
  unsure (1)..(200): unsure at all Xaa locations
  Clone ID: PAT_TA_13752.pep
IXFFVQFFFFFFPDDIKCITVQLHTVNSIRFIRHVCTHDKDWSCAGSTDTEYACDNATPVPCLVEGQGHQVRRLLMEQVGHGDRVSDLTLRPCRFQASMYSILHSSRSSAESRHHCLQTREQLRRSTQSSCEKTREITSAGARSAAGVARSPSFGGGGGGAMADPLSQESPVLGLALEILELFVSSSPRLIGLFPCLWML

SEQ ID NO: 119335 - protein, 70 aa, Triticum aestivum
  Clone ID: PAT_TA_13753.pep
RGTISVYSKTILQKWGKADPSFPTMVDIYVRTASTFTNLRGKYGSGSHHEICVCSIAISVRLLWRWGICS

SEQ ID NO: 119336 - protein, 134 aa, Triticum aestivum
  Clone ID: PAT_TA_13754.pep
ASPCQQLELVLPEYSHMEQVLKNQNFVQTVLLNHHLKAPQSKCSLVASTFPQSSTICRHSCTSPVAVSYGITWPQRCTFVLPSPSPTSSSSSHASAHASADHKLTKLKLDCQRTKLSIGKEDGETQMGSPDCGR

SEQ ID NO: 119337 - protein, 89 aa, Triticum aestivum
  Clone ID: PAT_TA_13755.pep
ALNRKPMRVSISCCFFCHASFFSCSLFFTASISSCCLLCVSSHALAWWHYFSTESQRPLQWRHEEGTMSKSLRDIAHCRGEESRVLESA

SEQ ID NO: 119338 - protein, 152 aa, Triticum aestivum
  Clone ID: PAT_TA_13756.pep
ICGEEQAGGQGGAHLYHAHDHFGSTKHAVLDAYICKSNIGKSSLKLTWFSQYNVQFCVKHLRYTSPSIPSLHHRCRSADGDAAFCGAGELPTRFILDSSATGSSSSSATSPRTVRTRCVAFPNESVILCPAIMKHFLRSTFKPVINKTISGT

SEQ ID NO: 119339 - protein, 63 aa, Triticum aestivum
  Clone ID: PAT_TA_13757.pep
QIFWDMPLRFGGGIKARDLSGLALSKAELVSKLQAFEQAKQVLEEKFNGVVQEVSEIKCLLSG

SEQ ID NO: 119340 - protein, 91 aa, Triticum aestivum
  unsure (1)..(91): unsure at all Xaa locations
  Clone ID: PAT_TA_13758.pep
GSENPDISDESEPLVESNANHKNIDAQLSNSVPAEKSKLSVKGQADHSYSVHPVQVHHVEDKARFQAEIAVKPKVMEESEAKPESPYKGLX

SEQ ID NO: 119341 - protein, 179 aa, Triticum aestivum
  unsure (1)..(179): unsure at all Xaa locations
  Clone ID: PAT_TA_13759.pep
GCSSCSADQCGVRFPCAVRFAFLLFLLDFGCAEQLQLILNFLKLTNFVLQFTHPPTRLSXPPVCGTTLDGGRRIRAGVQFAGVARVVHWFRLCCSPAYSPIQQRVTFVTRTGISHAVHLGGVGIPGFAEKCGSSGRAGVQLNRLYLAARLALAGSMELDPEPRNLIPFLFEEFLCKLGQ

SEQ ID NO: 119342 - protein, 70 aa, Triticum aestivum
  Clone ID: PAT_TA_13760.pep
NDLTRSNHHRVASHRRQVIANVGAQGSYGVIAPNSLKVLLGSWFTGTSFWLHQWRAISCYLNPPFSPCLK

SEQ ID NO: 119343 - protein, 58 aa, Triticum aestivum
  unsure (1)..(58): unsure at all Xaa locations
  Clone ID: PAT_TA_13761.pep
TNNIYSCGLEKREQKYTRELMIEYTXEEKRISSLSTDDRIHKYLYSIIRFFHXQTVQE

SEQ ID NO: 119344 - protein, 107 aa, Triticum aestivum
  unsure (1)..(107): unsure at all Xaa locations
  Clone ID: PAT_TA_13762.pep
SKRRPLPPAHTRSMAGARGTNRRRRRPAAPXSPSDPLRTHPPAPSVRRPPPPWARGWAARRPHSRSSTPSWPPDASAPAPTSPTAQHRSEGSAPARPGSVRRPPLLT

SEQ ID NO: 119345 - protein, 214 aa, Triticum aestivum
  Clone ID: PAT_TA_13763.pep
MSMHPMSLSLQPFTANSINKYSLRSTSANYDRGFIKLVPIGRSSGHWATNFRPNSVSRPETSVGHDCVVGENDGVIIVDHGSRRQESNLMLHDFVSMFKARTCYKIVEPAHMELAEPTIKEAEGKCVQQGASRVIVSPYFLSPGQHWKQDIPSLASEASKEHSSVPYIITAPLGLHELMVDIMSDRIKYCLRHAAGGVDECTVCAGPGKCHFYS

SEQ ID NO: 119346 - protein, 67 aa, Triticum aestivum
  unsure (1)..(67): unsure at all Xaa locations
  Clone ID: PAT_TA_13764.pep
XGQGSRKWKLDQSDGFFVQFESPILRKIWFVASTTEKGRALCRSPEPLDITIHEILPRIFKENEATA

SEQ ID NO: 119347 - protein, 322 aa, Triticum aestivum
  Clone ID: PAT_TA_13765.pep
MADGGGGRAAELKDQGNEHFKSGNYLKAAALYTQAIKLDSDNPTLYSNRAAAFLQLVKLNKALADAETTIKLKPEWEKGYFRKGCVLEAMEQYEEAISAFQIALQHNPQNTEVARKIKRLTQLAREQKRAVDVENLRSNIDIGKNLQSLKKELVTKYGDAEMGQNIFSFVISVIESAIKVWHDTGKVDAKVNFLLDDQKTDTEKYAPVVNIEKAFESPHTHGSCFAYLRQYSEESFSKAACMVAPKSIISYPQVWKGQGSRKWKLDQSDGFFVQFESPILRKIWFVASTAEKGRALCRSPEPLDITIHEILPRIFKENETSA

SEQ ID NO: 119348 - protein, 206 aa, Triticum aestivum
  Clone ID: PAT_TA_13766.pep
RLDSASCISLAERGLRTLLDSVKKNSFSDPGSPVISRKSQIIDQFLLVRPRVRRCLSYLLDERTVRIVSGSSFIFSAPKEQWMKVFEPLTVSADSCQSGLVEVMEICLLGLVSRRWDTLIESFVSHIFSSLPISKQYADLHQLLQGTYRGECPDKIRNLKENDILEYARQSLESEPHILWLLPPVLTAAAIPPRSSLFEIYLAEID

SEQ ID NO: 119349 - protein, 137 aa, Triticum aestivum
  Clone ID: PAT_TA_13767.pep
LDGTSRNTSACQKPPSCLLTSDKLLGPLIGRPASGEDGEGELLGSSPPGAAGLPLLLLPRPRGGGRGRRQPQDVPAEGGSGSRRRVRRWWAGDADDGGGGGGRRRDASTAEGRRGDVGQEGGPADRGLPGVRGQRPP

SEQ ID NO: 119350 - protein, 113 aa, Triticum aestivum
  Clone ID: PAT_TA_13768.pep
PPPAWLEGVDSVLHKRKATWLSTSSIYAVGSSSNNGIYALDFHPDTSSTCHVDYNEETKGSEENQPAENKFIPLSERVLSCAAHPLSHDIICGTEFSSLLMVSQKYETVRDPE

SEQ ID NO: 119351 - protein, 248 aa, Triticum aestivum
  Clone ID: PAT_TA_13769.pep
MEDYPEELRTPPVSLVSIVGCPEMHSTISAALSSQQPPMNTLALPDFAKANILSRTAKSRDPLAPPQAATGILKKDWLLKPSARVPAAVAAMFRADQVTGDPAQWLQACSDLENLKSIIQGRHTKLVVILVQTQAGDELGEEVMVALRKRAEIDSKHLIVLVESDEAERNASLLKLRTIFAELCSTYYKGEGRRIKARIEKRNFSSVELSVRYCFKVAVYAEFRRDWPEALKFYEEGVRVLREMIGTS

SEQ ID NO: 119352 - protein, 192 aa, Triticum aestivum
  unsure (1)..(192): unsure at all Xaa locations
  Clone ID: PAT_TA_13770.pep
YSWIKLNVIPIDTNLKSNSSQPVETTPPIKRLLHAWHDILGKLPDEDARKAIHTFSEXVHIILVHQDEEIKLRQRIQDTRKEHERKSRQFEDWARKYMEKRAGIPPEAGNPDGTRADPLAERKAAMEKLENSLKELEEAYTKQCKVVREKSLSLLRTNLPELFRIVSDFSLQSAAMFKSLWSISTTNDQLDD

SEQ ID NO: 119353 - protein, 94 aa, Triticum aestivum
  unsure (1)..(94): unsure at all Xaa locations
  Clone ID: PAT_TA_13771.pep
RYLRDGGPRNRPCWKLVKKXYVAVWRNPLNNSCYMSXDPXGKPPLCDSDDXPDNVWYFFNPSNLLLLVKPQFGLNICNNTKFIKMIFTFKKKKK

SEQ ID NO: 119354 - protein, 116 aa, Triticum aestivum
  Clone ID: PAT_TA_13772.pep
ERWASTQGLLNKLWTLREHTTTQVQEDGGGQVNSTSEPLPANREMATELVSVPRDASMSQCSNAAPSWARTDATRSPRWNSLQSSEPELTELTEEYNRLSGVRRPTRKRRSRSVPW

SEQ ID NO: 119355 - protein, 331 aa, Triticum aestivum
  Clone ID: PAT_TA_13773.pep
SVVAAEVEISVDQHTKADSSVPQLSRPQEPSTSTPSVREVLPATGPSKDADNISNCSERRNVVKIRVRRSASSSKADGADHQDHSHGGRNENEAGPCSSMSVDAPMVGAPNEPPTTSNHNIEEQNSCHDRESRMSASVSNAKVMDTYEISKELQCTADSRIDAADSRLDVVPKDEFSPVVNVREDVDKPGSQLERVSTSYVGTQAPDSVNGLHSKEKKRKDKKDKKRNRDEKRDKKDDPEYLAKKRLKKEKKKMEKELARKQKEGDRASQQDIVVKPSDSQGTVAATPPAPEQSAEPQVSNKDAAVDTARTLTPPPTKKIKIKFKPLKKIG

SEQ ID NO: 119356 - protein, 91 aa, Triticum aestivum
  Clone ID: PAT_TA_13774.pep
RPGDGRRVQRGRGCEVHEGGAAVHSGDAAAAAVDAAGAGDAGEGGCPVEGERAHGAGLRPQGQQGQPLHIHGRCFAHLDGVSAKVKKVRPF

SEQ ID NO: 119357 - protein, 53 aa, Triticum aestivum
  Clone ID: PAT_TA_13775.pep
IHPFPKQVIPNEGSTCKSTCCTPYWCFLIFSKSTYFSRENNYKLFLRGITKFG

SEQ ID NO: 119358 - protein, 79 aa, Triticum aestivum
  Clone ID: PAT_TA_13776.pep
KDNQFAESLSCLEKATAVKSASKWRPRPTNVESLLAYFKEKNDTESVDRLMSLLRSRGCAENEEYKSLFDTYALAVAGT

SEQ ID NO: 119359 - protein, 140 aa, Triticum aestivum
  Clone ID: PAT_TA_13777.pep
MLKFLSRVVVEYNPLDPRKAAAVELLAQCNGRKAKDSNPTCSVELRRLPSPAAADDPKAQPPPRVLVTYLNGAEEAFVAADGATAQGMRDQILARGRLLETEQLFREAGEKWPVVIPEEELGMSFPGIKPKKAEEKPQAS

SEQ ID NO: 119360 - protein, 98 aa, Triticum aestivum
  Clone ID: PAT_TA_13778.pep
LQLSYEPINGAGRGTEMDLTSTAVYIRKLSRSGRQVHSNENAKPSGCKGRLSDALGAPRDGQMCSCKIGEILFKLNLCHKLLGSFSLLGGCMDWRDYG

SEQ ID NO: 119361 - protein, 79 aa, Triticum aestivum
  Clone ID: PAT_TA_13779.pep
LPESEHRVGFHDTVEIYLHLMAVAVSEYPYTSSNPEKKRSNSNRSNWSKILFRILHALLLPLSSSLSVAFDFVPPFLVC

SEQ ID NO: 119362 - protein, 184 aa, Triticum aestivum
  Clone ID: PAT_TA_13780.pep
MEKLDESKFEQQLQLWALRIPRELASAVTRLLRSGPLLDMPRVKPVVEDPGSDKNRLVVLSEKIQNQDLSDIPEQVYNSLKQLCSVDVVPYMLTLGYSYWSADHILKQILPEGVEVPSSFETIGHVAHLNIPDDLLAYKDVIAKVIYDKNHPRIQTVVNKVGAISNEFRVPKFEILAGKKDMVT

SEQ ID NO: 119363 - protein, 47 aa, Triticum aestivum
  Clone ID: PAT_TA_13781.pep
RPRRPHSTSTELDKRGEQDVDRTTCSGMFWSRRSCQREQQCNAEINA

SEQ ID NO: 119364 - protein, 288 aa, Triticum aestivum
  unsure (1)..(288): unsure at all Xaa locations
  Clone ID: PAT_TA_13782.pep
AADNPEIGLMGSCVLVMLMKGENVYVMNVGNSRAVLARRPEPNLDNILGKATEKDLQQLKAEIMDGLQSVQLNAEHSTSVEEEVKRIKAEHNDRNAIIHGXRVKGKLNVTRAFGAGYLKEPKWNSMLLGCFKIDYIXGKGPYINCIPSLHHHRIGPNDKFLVLSSDGLYXYFTNKEVVDEVEMFTAAYPKGNPAEHLVREVLLRAAREGXGLDYHELLNISHDERREXYNDDVSVIVISVQRGSSGSTTAEGSWLAVPRESCPHNAESPGPKWIVLVVCLCNKVSRQW

SEQ ID NO: 119365 - protein, 90 aa, Triticum aestivum
  Clone ID: PAT_TA_13783.pep
FFFFFSGEHLIAPVVLLPDASACRCTSESRGTARPCGGVITLPFCPSCSFRVRVHGRGKTFCDFCVFAFNLISTRKPMPSPPPRYHCCNL

SEQ ID NO: 119366 - protein, 110 aa, Triticum aestivum
  Clone ID: PAT_TA_13784.pep
MVAIARAGSVAAEAVMALAAWMVWAEGGLHGRPGATLAPFAAQLLAAAAWPALALRLGAGWAGMACCAAMAAGAAACVRGFGGVNPVAGDLAKPCVAWAVLLAVMNYKML

SEQ ID NO: 119367 - protein, 137 aa, Triticum aestivum
  Clone ID: PAT_TA_13785.pep
ELAVIDGISEIPITDALQSLQQIKKLRHPYSKALAQAEDAIAEAFAKIGDQEQARKHCEASIMILKKLYHPKHIAIAHELIKLVSIELSLGDRASAAATFAQAEAIFSLYYGPDVERILPYVDALKRTVSGGFIGAP

SEQ ID NO: 119368 - protein, 91 aa, Triticum aestivum
  Clone ID: PAT_TA_13786.pep
NIDLNDYDALLALDENNHQHTGASESQINNLPQSVFQSTSTEEPCTVCLENPSFGDTIRTLPCFHKFHKECIDEWLRRKKLCPVCKCEITS

SEQ ID NO: 119369 - protein, 237 aa, Triticum aestivum
  Clone ID: PAT_TA_13787.pep
PRVRDAPLLERLIILEPPIAGCDCVRINIACAPNLRVLGYLEPRVHKLQIGDNVIECMTFQPDTMTSRCAVVPSVRILALKVNFRIFSKVKMLASFLGCFPNISIPHIESALHAPSTTAYQPTWEHHAKFWEEISAVRCWKSRVKRMVFHKFRGNQKEFEFLKFIARDAQELESLLLVPFDEKFTSAVEVNEIIDRCRCPQFQAWASKVLLVSPKVDGAWNLQKALDLTIDDPFLRC

SEQ ID NO: 119370 - protein, 572 aa, Triticum aestivum
  Clone ID: PAT_TA_13788.pep
HPVMHPHVPEVDIAPNPASTKDEADNGRCDLPDVRGSDVEDDIEGNTSEHSSERNIVEDEEAKGDISLMVCDLNNDVAEQSSPVVCDLNNDVAEHSPSTIAVESEDLPPEASLKRSLIRKLIQELVTEPSQTFPELTCGSEQFDESYLGRENAEHEATREFLAQGCSAGESESVCQIPGAQQQSTSICFNDSGNVPVSGCILETEGVTTFAVQDTQVCPPDNDFAVCMPSQAVENEPPPADYDNKPDLRSYAPEHAEALKDDGCVVKGQDTFGESMLDCSHNNQTISSHAEVMMHDIMDSKCGSFSINSAAMAYKEQSLETNINEVLYDCCDEDMDPVMMSDAREVDIAPDPASTKDEADNGRCDLPDVMGSVAAGDIEGNTSEHSSERNIIEDEEAKGDISLIVCDLNNDVAEQSSPVVCDLNNDVADSPATIAVESEDAKHEETSVDLKVEDDIEVGMEETCAAADKISDGMRHISPESKEGNIDSAVPHEPKEGETSSIVSGDSKNWSDEAHVDSVDAHGNVGSGAGETVPCEVDTNHTDAEMPDIDSTLCVKNETVCEDTPVMLKGSS

SEQ ID NO: 119371 - protein, 169 aa, Triticum aestivum
  Clone ID: PAT_TA_13789.pep
CPRNQSGGGRVGPAARVPRSTTGRRIWDWETRLRWRRSVGWWRTGRASATIDWRRGDWGRAIDGERKRRDDRSGGDRSGASSSTSDQKLRSTKLRKACCVCASAMSEHQGWADLPNVLLHSVIAMAGSFSDLLAFACTCRSWREAFFSFPSKAAFSTIFPPVLLQPEVP

SEQ ID NO: 119372 - protein, 63 aa, Triticum aestivum
  unsure (1)..(63): unsure at all Xaa locations
  Clone ID: PAT_TA_13790.pep
STLGAQIRGARSSGSARVPRHVVLNHLYIXEKGWGAQPLVALGHTHRFRSKYVTTVLYKAIER

SEQ ID NO: 119373 - protein, 55 aa, Triticum aestivum
  Clone ID: PAT_TA_13791.pep
GDRARTKTVMFGEYKCKGPGASSRQRVPWSRALTYEEARPFLGRDYINGEQWLRL

SEQ ID NO: 119374 - protein, 217 aa, Triticum aestivum
  Clone ID: PAT_TA_13792.pep
VFKAYTVPKVTSFKERSIERNYDFSALRSIVARNGHYLTFIGALVTLQIFLQMNRVNTTTSLLPMLIQTISSRSKAAVFSKMVIILVNSCSILGSAFTTKHHGRAATLTVSIVLMVFCQMAIPLIVEFHIGFGGASRMPRGYTAAMFLLTCVVSCGLSWSWGSMFWTFPGKKAHSAGQLLGMALNLALCYAQMQYFLMMLWRLKNAILAYYAMWIWS

SEQ ID NO: 119375 - protein, 43 aa, Triticum aestivum
  Clone ID: PAT_TA_13793.pep
KLEVMERNSEVGETLRMAQVGRAQAPVALWTRTKPVIESEYAA

SEQ ID NO: 119376 - protein, 99 aa, Triticum aestivum
  Clone ID: PAT_TA_13794.pep
VDTGGWRVGAAKRRAWVAWGRRQAWLARGTNAAASEHGGFPFVFKSRALTEGRKEKDPDLTVVTGQIRQYGQGGAQIWAGRTGAYHCPFIFLTLLHHET

SEQ ID NO: 119377 - protein, 100 aa, Triticum aestivum
  unsure (1)..(100): unsure at all Xaa locations
  Clone ID: PAT_TA_13795.pep
FCVAIATSHQILAPDSAVPLFRAALNSGEXIESALKDMATILKQANRAEEAIDAIRSFRDRCPNEARESLDNILLDLYKGTHGHEATAATNTISTLGRRR

SEQ ID NO: 119378 - protein, 89 aa, Triticum aestivum
  Clone ID: PAT_TA_13796.pep
PPLLREFHLEITHGHCCVSIVDVSNGPSSVWEFVLELQRPRLHLFWASHQPGELRSQRGLRLLPPGGASRHHHRLSSPLPASPITPSTS

SEQ ID NO: 119379 - protein, 188 aa, Triticum aestivum
  Clone ID: PAT_TA_13797.pep
PVPFFFKFDRLGVRVPTMMVSPWIKKGTGAGRPPNGPTATSEYEHSSIPATIKKIFNLRSDFLTKRDEWAGTFEHIFTQLDQPRTDCPETLPEVPFERATPAKEHGILSDFQRELIELASFLNGDYMLTSSAQETQKKMTVKQADAYVRRAIKGFLQASKQARRLGANESAIVTMRSSLTSKSTTSSP

SEQ ID NO: 119380 - protein, 284 aa, Triticum aestivum
  Clone ID: PAT_TA_13798.pep
MAVPGGEGEGRGRPVVLVTGCSEGGIGHAMARAFAAEGCAVVATARSRASMRGLEGDPRYLLLELDVRSEESVRRAVEDALRELGRVDVLVNNAGIHLVAPVAEVPMESFHQVFDTNVYGTMRMIQAVIPHMMERKEGTIVNVGSITALAPGPWAGAYSASKAALHALSDTLRVELRNFGINVMIVAPGGTKSNIGSNSADKYDQINDWKYYKKYEKSLRARTDISQGAGCVAAEDLAKRVVKLVLKKNPPAWFAYGQFTAILTILYYAPLWFRDYFYRLVMKM

SEQ ID NO: 119381 - protein, 121 aa, Triticum aestivum
  unsure (1)..(121): unsure at all Xaa locations
  Clone ID: PAT_TA_13799.pep
SYKAGSVVVCRIVSTLCFLVTTDDVSGGVTVTFVFPTAMNATLFLVSGLTTSLRGAGAXQACQEENAECFHHLVVASHSENLRHRAMGGLXVGSREMLLLAGCLLISFVSXNSQGLILDXN

SEQ ID NO: 119382 - protein, 99 aa, Triticum aestivum
  Clone ID: PAT_TA_13800.pep
GTWAWRSSCFQPKPQHGGLEMRGVIWSGGKLHRRPPWLPGTAADDDDDDDEEFPVLALCCLKILVHSNSVVVVVVVEYQVSVSVHGSRWGSVTIDLFIN

SEQ ID NO: 119383 - protein, 107 aa, Triticum aestivum
  Clone ID: PAT_TA_13801.pep
PTPTAHLGPRARDSVVLNTTGHHYFLCGFPGHCAIGQKVDVRVLSSAAPSTAPAMTPAPAAAGGGSAGRAGAAPSPHANAAPAVSSSFAVTVAAAVLSVAAAGLNLL

SEQ ID NO: 119384 - protein, 108 aa, Triticum aestivum
  Clone ID: PAT_TA_13802.pep
TDVHGVYDRPPTDPDAVHLKEGGVDATGGWSIVKPALQGNRKEVEISVAAHDTTGGMETKILEAAAIARLGVDVYITKVDTEHSLRALKGDVNTSSDDWLGTVIRAAK

SEQ ID NO: 119385 - protein, 120 aa, Triticum aestivum
  unsure (1)..(120): unsure at all Xaa locations
  Clone ID: PAT_TA_13803.pep
LTKRTRRCMSCCLLGHLLDPPTPAPPSAAAGLANREPEPAALAGRLQQLLPGDHHLRQARTAHPAPERPGSTRTASRRARSDRYRRRGTTAANPPALTPPRRGRPSASPPPSPSRGGRXA

SEQ ID NO: 119386 - protein, 110 aa, Triticum aestivum
  Clone ID: PAT_TA_13804.pep
LSMPSKKCNHKKRICVPTESQPHVPMKCEMSKNSLLAQCSISSQGLWLQETWHQAQENKLESIPSPSETRWTLTAAEKQLLFTVSYGTSWSRDLHQDDTKSDRKILKTTP

SEQ ID NO: 119387 - protein, 164 aa, Triticum aestivum
  unsure (1)..(164): unsure at all Xaa locations
  Clone ID: PAT_TA_13805.pep
ESVMSKALNYLVACSKLPFVLQKLRKRWQTVSCSVKEFANPIGNIFQTLESLNTCTSLVLCWLITICPSVLSFGSGKDAYLLQLYWGFQVRSLDHVNRTKNFSQKYTHWGTFXCPNSSITRIPRQIGQDCGLLKGQDSQMNTSXRRDMXINGSDXXTXLXSNRS

SEQ ID NO: 119388 - protein, 124 aa, Triticum aestivum
  Clone ID: PAT_TA_13806.pep
GLVSHRTGSMHRGNRVATTPSMQEPARDTYRGPAGAVAPGAASRPRGRYGRARRSRLPPREGGAHQRKGARSGGDMKGDGRHSARVTQVMRRRKKRWMKMSPSLRKTNLEPSVLMWTCGRVSNY

SEQ ID NO: 119389 - protein, 92 aa, Triticum aestivum
  Clone ID: PAT_TA_13807.pep
RAAGSMVTTQSTRACQPKWRTRSEAPVSDGTFRCNCTADLCFFSYIKEFAFSFVALGRLHAPQPPPPWGCDPDPTNRASKLSTYPLVYHDMT

SEQ ID NO: 119390 - protein, 103 aa, Triticum aestivum
  Clone ID: PAT_TA_13808.pep
KGYSKPKARPFSGTAYIHKSPLIAHTHAPEFRCEACDHNQPKDATSHHRVGSDRKSYPVPKMLCSSSFSSNFVHSVASFTVRCWSSSSADLSASIFLTLASSR

SEQ ID NO: 119391 - protein, 151 aa, Triticum aestivum
  Clone ID: PAT_TA_13809.pep
PAASLADGIEQQPSLTHACSLADGPWSVYPRFLVTLRSSGSNGLPRIGASSRICERPTSRPDGWLPPVVAVDPWSKAGGAPPHLQPPRVREDGQQRRWHPGNTSCRRCSLQKAFFLFVFADFGCALHLVRRFWMCGCPMQCASDFRHLLDE

SEQ ID NO: 119392 - protein, 62 aa, Triticum aestivum
  Clone ID: PAT_TA_13810.pep
AFLAEFLPDRPAASPGLPLIFASLMGKAASYFPPDDMKTLSSLDDFLVSVGAVKKTVSGRKR

SEQ ID NO: 119393 - protein, 102 aa, Triticum aestivum
  unsure (1)..(102): unsure at all Xaa locations
  Clone ID: PAT_TA_13811.pep
LASQIQGSSLGSLTNRPFQPGGEIHPRTEERRPTRKGGGPCGTGLSGRMGASRGTQTPPDGESCLPTYRRRRNPLRNGLHREAGTPTKKRTKCNGPPXRHNR

SEQ ID NO: 119394 - protein, 71 aa, Triticum aestivum
  Clone ID: PAT_TA_13812.pep
QLIVRFVNLEMGFCAFDRVGSSPSLVCLFSVADALALVCSLSAAAKGHESNRHCPWLMAPWPLTVTDQIVI

SEQ ID NO: 119395 - protein, 93 aa, Triticum aestivum
  Clone ID: PAT_TA_13813.pep
AGVRDDERRRGVRKSHAGVAGMATATPSPMVAWILGRSPAGVRRLRVTDSPFPVVPEDGNSGSSERVDAEADDFIKRFYEQLRMQHSIAIPEC

SEQ ID NO: 119396 - protein, 188 aa, Triticum aestivum
  unsure (1)..(188): unsure at all Xaa locations
  Clone ID: PAT_TA_13814.pep
VRGRVGGRVGGRVGPQWTWLSDELARVDRKATPWLIVLMHSPWYNSNNYHYMEGETMRVQFESWLVAAKVDIVLAGHVHSYERSRRFSNVAYNIVNGKATPVRDLDAPVYVTIGDGGHAXIEGIANNFTEPQPSYSAFREASFGHATLEIKNRTHAYYAWHRNHDGAKATADSVWLTNRHHLPTDDSK

SEQ ID NO: 119397 - protein, 90 aa, Triticum aestivum
  unsure (1)..(90): unsure at all Xaa locations
  Clone ID: PAT_TA_13815.pep
PPGAFAGDPLDDHASLCLSSSAALGLSWLTLALDSSVGALVSRMXGLICKRILHNQAPGWKTDMSISQSLSPSRPVVTLSCGWNLPQEFS

SEQ ID NO: 119398 - protein, 118 aa, Triticum aestivum
  Clone ID: PAT_TA_13816.pep
LFSEGEGRKRLRVRGEAETKPSPPSAGTGRRGRRGARRTKAASSQPRRLEPPAKIKQTSDQTVHESWLGIIITIPRFQEWIVRTSHVMNLRLLVKSYLCILEVMHLMERDHQVMGLQL

SEQ ID NO: 119399 - protein, 566 aa, Triticum aestivum
  unsure (1)..(566): unsure at all Xaa locations
  Clone ID: PAT_TA_13817.pep
RPPTRPPTRPPKPCPSRPPRREMADDNGGGGDDYVSEAVRPEGDTHTREEGLSKSRDRDREKDKDKERHRDRDRDRGRDRDRGRDRDLDKDRDRDKDRDRHQRHHRDKREHRDRPDDHDRHRSRDSERRRDRERDGHRRHRSRSRSRSRGRDDHRSRSHSKSIQRVSGFDLGPTXNAVLPHFPSIPTPRQLPGSSIPGVFPNMLPFGDGLCWPIVGRTQGITQQATRHARRVYVGGLPPSANEQSVAIYFNQVMAAIGGNTAGPGDAVLNVYINHDKKFAFVEMRSVEEASNAMALDGILFEGAPVKVRRPTDYNPSLAAALGPSQPSSNLNLAAVGLTPGSAGGLEGPDRIFVGGLPYYFTEAQVRELLESFGPLRGFDLVKDRETGNSKGYAFCVYQDLNVTDIACAALNGIKMGDKTLTVRRANQGSAQPRPEQENILLQAQQQVQLQKLVYQVGALPTKVVCLTQVVTADELKDDEEYEDIMEDMRLEAGKYGNLVKVVIPRPHPSGEPVSGVGKVFLEYADVDGSTKAKTAMHGRKFGGNPVVAVFYPENKFADEDYDAAA

SEQ ID NO: 119400 - protein, 86 aa, Triticum aestivum
  Clone ID: PAT_TA_13818.pep
MATVPVNPKPFLNNLTGKSVIVKLKWGMEYKGYLVSVDSYMNLQLADTEEYIDGQFSGNLGDILIRCNNVMYMRGVPEDTEIEDAA

SEQ ID NO: 119401 - protein, 141 aa, Triticum aestivum
  Clone ID: PAT_TA_13819.pep
RGTWIGRNGERDERGLGSPGAERITVQTARRTPESRRCSTRGGQLRFEGYKPDTSEVALDADDEEKRSAVAAHSQKLAMAFGLLSTPEGTPVRVVTNLRMSKECHAYSALISEIFGREVVVRDRNRFHRFRRGTCSCGNYW

SEQ ID NO: 119402 - protein, 54 aa, Triticum aestivum
  Clone ID: PAT_TA_13820.pep
GATQGVVQKYAGNIRGLFGLRFTYEFPKAMVSLGGVAVKTGRQGEIRRRCSRFN

SEQ ID NO: 119403 - protein, 178 aa, Triticum aestivum
  unsure (1)..(178): unsure at all Xaa locations
  Clone ID: PAT_TA_13821.pep
MARAHGAFLLQLLAAGLQVVALAATVTVTQTDDPRCRPSLPRRGAVAVYPSDMEQLQFLLNPKFVEAEWFLHAALGRGIDYLDRNLSAGGPAPVGARKASLDFRTTEIAAELGYQEVGHIRAITQANGGFPRPAIDLSADRFAAIMDDALGARLDPPFDAYQRLXNGNRLNSSPKILA

SEQ ID NO: 119404 - protein, 97 aa, Triticum aestivum
  unsure (1)..(97): unsure at all Xaa locations
  Clone ID: PAT_TA_13822.pep
ERDLPACSHLLEIQHCCFLKSNSSRKMTSRLPTRHVRARRMVLSGSALPPLSSASSVSALXLSAXSVVXIQNXLXYFTRSCXNEDISDESKFAPPEH

SEQ ID NO: 119405 - protein, 127 aa, Triticum aestivum
  Clone ID: PAT_TA_13823.pep
LHCTAFIRSSEFLVSSHQAAGQHLQKVPAALWDDDKQGNWIGRRTDPCSHTPTMQCPQKPVGAVGLVGDGDVDAAADGAARADGRGHGGGGGGGARGLVGAAPSSGNFWQPEARSRVFPRRARSEVR

SEQ ID NO: 119406 - protein, 125 aa, Triticum aestivum
  Clone ID: PAT_TA_13824.pep
GTRQNVVYVEAGSAPANTDVSELAALLAKDLVDETATVVRFPGDVVIYGANLTFVDMEQVDLYGLEIMGQRPAHVEYGMDGVGQGGAVLVQSDASGRGRVIMVVLPNDDVQALRAELRNTLFLAP

SEQ ID NO: 119407 - protein, 53 aa, Triticum aestivum
  unsure (1)..(53): unsure at all Xaa locations
  Clone ID: PAT_TA_13825.pep
GHXHDASHXRMPCGPXYSVVXRPRYRHNYGHYTVWMDWLFGTLREPEDLLKKD

SEQ ID NO: 119408 - protein, 213 aa, Triticum aestivum
  Clone ID: PAT_TA_13826.pep
MGLRDKKRNQRRVLSRRSAGPRTGEGKDFLPLEGKEPSVRQRQPEEPESTATVLYIGHIPHGFYEDQMQGFFQQFGAVKRVRVARNRKTGKSKHYGFIEFENPEVAKIVADEMNNYLLFEHTLQIAPVPPEKVHAKLWKGVRKGFIPVDRVAIERKRLSKDKTVEEHKKMLEGIVKRDEKRRKRIKAAGIDYECPALIGSVQPSAKKIKFDED

SEQ ID NO: 119409 - protein, 217 aa, Triticum aestivum
  unsure (1)..(217): unsure at all Xaa locations
  Clone ID: PAT_TA_13827.pep
MGLRDKKRNQRRVLSRRSAGPKTGEGKDFLPLEGKEQRVREKKQPEEPESTATVLYIGHIPHGFYEDQMQGFFQQFGAVKRVRVARNRKTGKSKHYGFIEFENPEVAKIVADEMNNYLLFEHTLQIAPVPPEKVHAKLWKGVRKGFIPVDRVAIEQRRLSKNKRVEEHKKMLKGIXKRGMSKRRKRIKAAGIDYECPALIGSVQPSAKMKKFDEDLL

SEQ ID NO: 119410 - protein, 86 aa, Triticum aestivum
  unsure (1)..(86): unsure at all Xaa locations
  Clone ID: PAT_TA_13828.pep
QSLLPEALSNAIRFMLDPXEVKSRXLELAIAIGNEDGVAAAVGSFHRHLPSGLPLTPPPAPXEEERLDLLQLLSRYLEKCCLPFNS

SEQ ID NO: 119411 - protein, 364 aa, Triticum aestivum
  unsure (1)..(364): unsure at all Xaa locations
  Clone ID: PAT_TA_13829.pep
MSDGQDTLDLSALGAGAPNAAELSAEDKANLVESIQNTLQGLAARHTDVLESLEPKVRKRVEALREIQSQHDESEAKFFEEGAALEAKYQKMYEPLYSKRHDVVNGVVEAEGVTKDSGEAAPDEKEEKGVPDFWLNAMKNHEILAEEIQERDEEALKYLKDIKWYRITEPKGFKLEFHFNTNPFFKNEVLSKTYHMIDEDEPILEKAIGTEIEWYPGKSLTQKVLKKKPKKGSKNTKPITKIENCESFFNFFSPPQVPDDDEEIDEDTAEQLQNQMEQDYDIGSTIRDKIIPHAVXFTGEAAQDEDFDGIMDDDEDDDEDDEEDEDDEEDDEEDEDDDDGDKKKGGRVPAGEGQGERPAECKQQ

SEQ ID NO: 119412 - protein, 183 aa, Triticum aestivum
  Clone ID: PAT_TA_13830.pep
AEGLTMWSPNVNIYRDPRWGRGQETPGEDPTTASRYGVAFVKGLQGNSSASLLQTSACCKHATAYDLEDWNGVARYNFDARVTAQDLEDTYNPPFRSCVVDGKASCVMCAYTGINGVPACANSDLLTKTVRGDWGLDGYVASDCDAVAIMRDAQRYAPTPEDAVALALKAGLDIDCGTYMQQH

SEQ ID NO: 119413 - protein, 127 aa, Triticum aestivum
  Clone ID: PAT_TA_13831.pep
YKIPTQDQPAIFLHEEASQRSHSGRVRASEYTFSADSVQPKTAHYSGEKSKEASGHAPFPAVLKQQGAHDDSAHHGEERRGDVLPAERRRRLYGPQRALVRRILLLLSRASLRFHLAVNKGRGFLHQ

SEQ ID NO: 119414 - protein, 294 aa, Triticum aestivum
  unsure (1)..(294): unsure at all Xaa locations
  Clone ID: PAT_TA_13832.pep
VRGRVGQTPTVPVPEAPKQEAAKAPPLQQIPLTPEAVKQQPGSEEAATAPRREWKPLCDLTSNRRIDWCELDGDVRVHGAKATVTLVGAPQAEEWRIRPYPRKVDPNAMRHVTNITVRSTKTLPGAGEDAECAIRHSVPALLFSDRGYTGNYFHAYTDVILPLFLTAKQYGGEVQFLVSDLQMWWVGKFLPVFKSLSNYDLVDLAADNRTRCFRHVQVGLTCHADFSIDPXSAAPNGYSMVRLHQAHARRLTASPRRLAVPAAGARPRRLLFPPPKNGVRTGKRVQGGLHKGAF

SEQ ID NO: 119415 - protein, 180 aa, Triticum aestivum
  Clone ID: PAT_TA_13833.pep
MKFNRCRRRSRDSKKAAYYGEERLSELPSDVVVNVLETVKTRLKKAAGNGEDRLSELPNDVLLNILERVGTLDAVRTCILSKQMQKLPAMLSQIVIDLSPRDLVQMDGVVADVTDKILSTRSPQITVRKLKLKFFLVPSRCLSIGKSVGLAMATQKLDAAEFEIMPLMDNRCCTDAHRLL

SEQ ID NO: 119416 - protein, 180 aa, Triticum aestivum
  unsure (1)..(180): unsure at all Xaa locations
  Clone ID: PAT_TA_13834.pep
XGGRLDPRXXXSEQEELMVWMRTAAMPRFRKLYGRVEADLDAGETVAVAVRGGWRRTRTAGKRWRWRCGTGTICTGFRGGRRWCCPPRGRWAGAARPLAGASLSPARPAEPPRRRSRLFAPSTARDGGLSGGGSGWPSTGHDGGGIQGLTGLLCTGLHRCSTAQDTAGRVRVYGPGRRGR

SEQ ID NO: 119417 - protein, 82 aa, Triticum aestivum
  Clone ID: PAT_TA_13835.pep
IYTLYVEKKEFLKIMRGTQGIARHSGSLYSFPTQEHIAKLRYITLFLTYERRSFYLQVCLISTGISMHSVRFFCSDLLIFVI

SEQ ID NO: 119418 - protein, 109 aa, Triticum aestivum
  Clone ID: PAT_TA_13836.pep
SVSAKDRFRPRPRGPKFGRNPFFSAEIQNTGPNPWIGECKGNMMIHFISKWFFHTHRPIGHCTVRRTNSDPIDARGEKEELAKVQAFKERLLRVPEPRGHSFLQIFIVA

SEQ ID NO: 119419 - protein, 180 aa, Triticum aestivum
  Clone ID: PAT_TA_13837.pep
FGIGGGLLLNPVLLQIGIPPQTAAATSSFMVLFCASMSMVQFILLGMDGIGEASVYAGICFFASIAGVVLIERVVRKSGRVSMIVFLVPAIMALSTVIVTCFGALDVWTQYTGGGYMGFKLPCWLTFVSTIVYTTWVYESMAERCLATNCFFWLGVYVFSEERFCSWCCYGCLWAMRSSV

SEQ ID NO: 119420 - protein, 163 aa, Triticum aestivum
  unsure (1)..(163): unsure at all Xaa locations
  Clone ID: PAT_TA_13838.pep
MRITISATGPSKFFTTRFNCKDYHMIVWPGVRTSDVGNVGRIVVPKRDAEANLPALLERDGLILKMEDMRLPVTWNFKFRYWPNNKSRMYVLESTGEFSKNHNLETQGAFIVSKSLEXSKYLVRGEKVPGQCATLICPECKEAGRIYNKQCGFTRNLHAKKRR

SEQ ID NO: 119421 - protein, 324 aa, Triticum aestivum
  unsure (1)..(324): unsure at all Xaa locations
  Clone ID: PAT_TA_13839.pep
RPYNAADADINVPYYGSYRTWERISDPPAYGNEESEDEGVDPPVNFSLAQTYVEDYLRSASYDQREDIYSSVSLCPTRKTVPIGPNYQAELPECASGNCRSSVDGNADVSSSSHIRDIKEAESDKWIRNSVIPMPGSVELSSVLKPVCCKTDCSCVDEGSIACVRKHVKEARERLMSALGSEHLQRVKDPXHGEEEVALKWTEDEEHLFQXVVSLNPASXGRNFWXELPLAFPLKTNKELVSYYFNVFRLKEEGXQNRLDPMNVDSDNDEWEGRDDDEFAVTERAGEDLLLSLTDQDDGACNQVPLQGNMHEESGEEDEFDCCG

SEQ ID NO: 119422 - protein, 319 aa, Triticum aestivum
  unsure (1)..(319): unsure at all Xaa locations
  Clone ID: PAT_TA_13840.pep
MATRARRALISLLVLLLVSATGVASKSFAITNNCEYTVWPGILSSAGSPEMDSTGFALAPGESRTMPVPAGWSGRLWGRTLCSTDPAGKFACVTGDCGSGRQDCAGGGAAPPATLAEFTMDGYDSVDFYGVSRGAAPPATMLEFTMDGNDGMDFYDVSLVDGYNLPMLVAPNDGAPADAGATGGNCAPTGCVVDLNGACPGDLRVSSTTAGAGGVACKSACEAFGTAQYCCSGEYGSPGTCRPSAYSQFFKNACPRAYXYXXXDATSHLTCAGGVSAYAIAFCPSTTSVKSAGSNPQAPAGLPLINGTMVYQGGDQFAG

SEQ ID NO: 119423 - protein, 667 aa, Triticum aestivum
  Clone ID: PAT_TA_13841.pep
MATPYTPKSILITGAAGFIASHVTNRIVRNYPDYKIVVLDKLDYCSNLKNLLPASSSPNFKFVKGDIASADLVNFLLVTENIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGKPLPIHGDGSNVRSYLYCEDVAEAFEVILHRGEVGHVYNLGAKRERTVTDVAKDVCRLFNLEADKVIQLVDNRPFNDQRYFLDDARRKSLGWSERTRWEEGLRKTMEWYVANSDYWGDVSGALLPHPRTLMMPGYEGSEEIKGMLNLFTNNQTKMVAPTSESSSQTRLLKFLIYGRTGWIGGLLGKICEKQGIPYEYGKGRLEERFSIVLDIQTVKPTHVFNAAGVTGRPNVDWCESHKPDTIRTNVVGTLTLADVCREHGLLVINYATGCIFEYDANHPEGSGIGFKEEDKPNFTGSFYSKTKAMVEELLNEYENVCTLRVRMPISSDLNNPRNFITKISRYDKVVNIPNSMTVLDELLPISVEMAKRNLRGIWNFTNPGVVSHNEILEMYKKYMDPSYKWTNFTLEEQAKVIVAPRSNNEMDATKLKREFPELLSIKDSLIKYVFEPNRKVPAT

SEQ ID NO: 119424 - protein, 368 aa, Triticum aestivum
  unsure (1)..(368): unsure at all Xaa locations
  Clone ID: PAT_TA_13842.pep
MSARLQECDEQRGKRMPKRGRERLYLVFDDWCHGYSIRMVNLLQHTAGSGHPAPVHFSEPFCRIMAPLVSYFTSAFGSKILAVFSRDPEADSESYFPMLDVRSRCVTFAPGQGCPIPPIYYLPVGNELFSLSFCSFEMLCSEELSPRLQDQSCGMGWSWKQLSEKPPFYVDNVTSYSLHPQXRTFLFSTKTGATEATYTFDTEKRSWKLLGYWKLPFAGCGHFDLGLNCFVGLSKEPDTLGQLYSCEVPIYDTDDGLCPCPVVKLCKENLLSECPIDMHVGATLVYMGGKSEFCLVQCVSPDQDRMDEEDVAHGVQLPGRRFYCLTTSSLSFNKDKELTTGNNRRLQYYKVPKEATKPFLQDPVAFWM

SEQ ID NO: 119425 - protein, 169 aa, Triticum aestivum
  Clone ID: PAT_TA_13843.pep
MAALARSAAAVAALALLASAVAGEVFFQEKFDGGWEDRWVKSEWKKEDNTAGEWNHTSGKWNGDADDKGIQTSEDYRFYAISAQYPEFSNKDKTLVLQFSVKHEQDLDCGGGYVKLLPADVDQKKFGGETPYSIMFGPDICGYATKGMHAILTKNGKNHLIKRGMPCDF

SEQ ID NO: 119426 - protein, 188 aa, Triticum aestivum
  Clone ID: PAT_TA_13844.pep
MGAGTSSSMLGGAFLLLVLSSATEVQGGPSSSAAPCSPLDYLCNNLGPWYVGANDCVSTLCIDPSCRSAPGLPELAVIATRLTVSNATVAKASIEHALAHVKDGKARKVMRSCLQLYTGAIPRLQWAARSAAAGRYSGVPEVILAARYVSSKCTNLAGEGALPKENVEFFMMAYVAEAVVEGVQLFIS

SEQ ID NO: 119427 - protein, 193 aa, Triticum aestivum
  Clone ID: PAT_TA_13845.pep
MSNKRRGYAGDGGEKRSRRIKHLYLVLDDWTKGYSIHKIQADSFDSDMVCGFGITVVVDEMLYALSYHFRVKQHSFGVMSWGSTAPDALQQPTEGWSWKTLPPPPPTFHRRVNSYALHPDGCTIFMSTANFMTAPSKGCMGTYSFNTKDSVWRWHGEWALPFSGQAHLDRELNAWVGLGWDGYLFACQGASPS

SEQ ID NO: 119428 - protein, 172 aa, Triticum aestivum
  Clone ID: PAT_TA_13846.pep
TRPQIDQNLNIMYRQMVSSAKKTRLFMGQPYRAGDQPDPGAGSLENLPHNTVHIWTGDPAQPNSEDMGNFYSAARDPIFFAHHGNIDRLWHVWRGLRPGNADFTDADWLDTAFLFYDEEARPVRVRVRDCLDPAAMGYAYQDVGLAWPTAPPGKRSRRTPAPAAGALPATLR

SEQ ID NO: 119429 - protein, 253 aa, Triticum aestivum
  unsure (1)..(253): unsure at all Xaa locations
  Clone ID: PAT_TA_13847.pep
MASSFAALAALAISCLLILHPCSVSGWSDGGATWYVPPEGAGTDGGACGYQHDVEKPPFSAMITAGGPSIFKNGKGCGACYQVRCTGNAACFGFPVTVVVTDEXCRGGPCLAEAAHFDLSGKAFGAMAKPGQADNLRKAGNIRVQYNRVPCNWHGLNIVFKVDARSNPNYLAVLIEYEAGDGDLSAVDLQQRGGGWASMQELSGAVWKYKSRSTLQAPISIGLTFGSGKQLIASNVIPSGWQAGRTYRSVVNY

SEQ ID NO: 119430 - protein, 107 aa, Triticum aestivum
  Clone ID: PAT_TA_13848.pep
VSKEARSQLLSTWLEPFYEDFGWMRRACKGLDRHLIEEGLANTILTLPLATQQEIFLAWFNRFLNSGEDCPNIQRGFEVWWRRAFWKRSAEPEQPPRLRITAICDNS

SEQ ID NO: 119431 - protein, 150 aa, Triticum aestivum
  Clone ID: PAT_TA_13849.pep
RGRGRGTNLVAKVPLFRLLLVPFLAAICPVVSLGCARIVGRKETPMYFFPRMTHFLALFSLFNANCGEHLEAQIPSYLTLINGIRIRKSLVLNAVIRAECLSFGFSSFSMSSMLTICSTKSLFGRRPLRSRLSWSLVLSFEKQSTTRGFI

SEQ ID NO: 119432 - protein, 123 aa, Triticum aestivum
  Clone ID: PAT_TA_13850.pep
ASANKEYSHCFLPVAFLDRSVVVGTAQFNAAGLVGPIATGSTSHHRSIQSLDLCSLLLFVWWKWNGIKRDDACSLTTGASVQFRSCGLPFRASSDISGSMLLYSLFFQFQLRVRAKQAAGRAR

SEQ ID NO: 119433 - protein, 57 aa, Triticum aestivum
  Clone ID: PAT_TA_13851.pep
RPSFISKMMRGPRLLFPSYFQQYTGTFPHSTGTYTSRTGVVTTARTELIGRTHPLGA

SEQ ID NO: 119434 - protein, 59 aa, Triticum aestivum
  Clone ID: PAT_TA_13852.pep
QVTELRVFGCPNLSHVVGLDSLQQLWLDEDMQEVTSRWVPGLQEEHRRLHGEDAGGYTI

SEQ ID NO: 119435 - protein, 214 aa, Triticum aestivum
  Clone ID: PAT_TA_13853.pep
GQKLRADLHRGREEEDFEDDGTSSTKKWKRPRKDSDPADPGAGNDDPEDDGTPNAKKQKKADADPTASGEDKDGVQDPSNSGLEGDLELDVVPSSTNDKETSKLVPTDARPDIGSLRPSVDAAARGTADARPDIGSLRPSVDAAARGTADARPDIGSSRPSVDAAAARGTADGNSSRAPEKKHNMALPVQFTSREFNKGADREGSKEFMDATPS

SEQ ID NO: 119436 - protein, 355 aa, Triticum aestivum
  Clone ID: PAT_TA_13854.pep
MAGARCYALLVVAIVLTAQLCGCTAYVGRDGFTVEFIHRDSVQSPFHDPSLTSHGRLLAAVRRSAARASALARSYAGGSPHGAVSEVVHGQFEYLMHVNVGTPATRVLAIVDTGSNLVWFKCTNVRTAATTTPAAIAGGASLVFNPSSSSTFGRVYCQSGTCHKLPGTSCDASSRCKYAQSYVDGSKTTGLLSTESLIFDDGPGGCVGCRQRRQLLVPNFSFGCSTATAGTFRADGVVGLGSGDFSLITQIGAGTSLGRRFSYCLAPYYVNASSPLNFGARAAVTEPGAATTALLRPDPRKPLYTVVLESVRIGNARFEHLSNVIIDSGTTLTFLDKVLLDPIMEHMTRRIHFVR

SEQ ID NO: 119437 - protein, 197 aa, Triticum aestivum
  unsure (1)..(197): unsure at all Xaa locations
  Clone ID: PAT_TA_13855.pep
MDESDERGNGGGQHHGYEWKLPXAALSANTTSVHVTALDGVVNVNSLFTVAVFVGLSLATPGELRSLAGDPSCDAGPDVARSLLVLEVVAFSSFLFSSLVAQGLKLAINLINSKDPDDTHAHIDARLLRLGMLASAVGSVVGCVFLMASMVMVVQIRLGTLGCASNRAAAKAAAGLVGLVSTALVVYISTVFYTFTH

SEQ ID NO: 119438 - protein, 181 aa, Triticum aestivum
  unsure (1)..(181): unsure at all Xaa locations
  Clone ID: PAT_TA_13856.pep
MDSPPPFIYCPPAGDADDAGEKALIKAAIDGNLGRLKRIVKRLTKGNGDRSAIFSFNNDGLSVLHIAASFGHLDICKYLVEELKGDVNAPGHGVALGATPFMVSAQSGDVATVKYFLDHGGDVMKADDKGRTVLHHAAAIGCCKXTEFLLSKGVPVDIDCGRGTPLFLAANNEQDKTLRFW

SEQ ID NO: 119439 - protein, 515 aa, Triticum aestivum
  unsure (1)..(515): unsure at all Xaa locations
  Clone ID: PAT_TA_13857.pep
MSAAAQETTAGGGGDGKRQGPCRPGHLKLGYHIVVSNAVYVLLAPFAAALALRXSRLTPSDLAAARAYLLANLHPAVSLVSVATALATVYLARRPRAVYLLDFACYKPGPDHVVTRETFMKQSSKAGVFTDDNLAFQRKILERSGLGQGTYFPAAVLNSPPNPCMAEARREAEAVMFGAIDSLLAKTGVRARDIGVVVVNCSLFSPTPSLSAMVVTHYKLRGNVASYVLGGVRCSAGLISIDLAKQLLQVHRNSYALVVSMENITLXNWYWGNDRSMLMSNCLFRMGGAAILLSNRAADKRRSKYQLVHTVRTHHGADDRAYRCVFQEEDKAGRVGVALSKDLMAVAGEALKTNITTLGPLVLPMSEQILFLTSLIGKKIFGLKMKPYIPDFKMAFEHFCIHAGGRAVLDTIEKNLELSDWHMEPSRMTLNRWGNTSSSSLWYELAYTEAKGRVRRGHRAWQIAFGSGFKCNSAVWRALKDIHPSKEAGSNPWIEEIHRFPXVEVPKVESVVSSP

SEQ ID NO: 119440 - protein, 279 aa, Triticum aestivum
  Clone ID: PAT_TA_13858.pep
MTTAEAPAPQPPPAGCRRRPHHQRPPLPPPSQLDLSFAMRGRLRDRAPPSPCIPAPARAAAASFMTAHGARAGLDQQGGRGEAGPKHLDHPLASTVLPQGLALNFFVFQASSCGPTTHGGPWSRPVASARPSHDTKLVLSHVDPLTEQQIVAVYGLQQSAVQTEEALSQGLDTLYQALSDTVVSDALTCCSTPNVSNYMGQMGLAVHKLTTLEGFVRQAEKLRQQMLHRLHQVLTARQMARSLLAVSDYFHRLRVLSSFWVNRNRMAPQDQQLEAGPHT

SEQ ID NO: 119441 - protein, 110 aa, Triticum aestivum
  Clone ID: PAT_TA_13859.pep
GDLVFLDISVLPMTGDMGLAEIGQGCPQIKDIALLHCPGVTDVGLGHLVRGCLQLAWWRPGYCKRVTSTGVATVVSSCSRLKKLLVEEAKVSERTRRRAGPILSFLCSGL

SEQ ID NO: 119442 - protein, 134 aa, Triticum aestivum
  Clone ID: PAT_TA_13860.pep
FPLHKGLPSSFCKDHLPPREHKMVLEDEEGVEFDAVYIGNRTGLSGGWRGFSMHHDLEDGDSLVFELAEPDRFKIYIFKAIEDGKEAEPNDNNADVDSDSAQEVPDQTDSPVSEPPSSPEPLKGAKRRKLRGRR

SEQ ID NO: 119443 - protein, 117 aa, Triticum aestivum
  unsure (1)..(117): unsure at all Xaa locations
  Clone ID: PAT_TA_13861.pep
MVGDGINNAPALAAATVGIVLAQRASATAVAVADVLLLQDNLCVVPFCIAKARQTTSLVKQSVALALTCIVFAALPSVLGFLPLWXLTVLLHEGGTLLRLLEXSIRGLNPPTWSWGR

SEQ ID NO: 119444 - protein, 155 aa, Triticum aestivum
  Clone ID: PAT_TA_13862.pep
SAQIKPAARLPSLLMAPKHLPPESLPRRIPTGGFHPITIHVRVNRDGTYLPRYLPVTGGPFRDFADLEDAVRARYASIYLNWHRRRKPNDPPPPSTLMHQGGVSSLEMAIEAALYWPDGARKRSKSDHAERARNGRRPLLQALVDSITRITIFWG

SEQ ID NO: 119445 - protein, 96 aa, Triticum aestivum
  Clone ID: PAT_TA_13863.pep
GSTPPPPPLPRSAPAVPPPPPSPTPLLPGPPILVPPPSPPSPALPTPPPRAAPSFPLPQRRATNLSERPGGRNGPRGQPVRRRRPPPLPRAPRRPR

SEQ ID NO: 119446 - protein, 228 aa, Triticum aestivum
  unsure (1)..(228): unsure at all Xaa locations
  Clone ID: PAT_TA_13864.pep
RGRADCLAPAAPAGGAGARAPGSVEGINAGLYARELMDTSLQSRTALLGAPRLRSQDVLALPVVEARPPGSSSTLVAHLLGPVLPTAGLGXPGVLGLWIGRGYTQTKPMTYGFNFPLQIENGVDPSRLVQNYSIDLQEGDTIITASDGLFDNVYDHEAAAIVSKSLEADRKPTEIAELLAARAKEVGRSGSGRSPFSDAALAEGYLGYSGGKLDDVTVVVSIVRKSEL

SEQ ID NO: 119447 - protein, 148 aa, Triticum aestivum
  Clone ID: PAT_TA_13865.pep
TRPESMRVALEEWFIKYDVDLVFAGHVHAYERSHRVSNVDYKVTSGSRYPVPDESAPVYITVGDGGNTEGLASRFNDPQTDYSAFREASYGHSTLQLKNRTHAVYQWHRNDDGKHVLADKVVFHNQYWESGTRRRRLKKKRHLRYESL

SEQ ID NO: 119448 - protein, 99 aa, Triticum aestivum
  Clone ID: PAT_TA_13866.pep
HVVRRPLVLKLLVVSCRLAINHSCGSTPAVLPLYCCPHHALLRIGGLDEQCLLLPRAAVRGRAGPQKYFCFCIYLYNDRWMGCSSFCCMVMLIIHQRGG

SEQ ID NO: 119449 - protein, 160 aa, Triticum aestivum
  unsure (1)..(160): unsure at all Xaa locations
  Clone ID: PAT_TA_13867.pep
EGKPXXGXXPLSXLXFPPGHPLPRSXRXXPVFIAGGKGGWXLXWXGXPPRWRSRSTGGTIGFGLGGRESAARRGGRWGNRLDCDGRSLSFSLSRWGWGWGWTKRRKGIESRMREGGRLGCPQSSLQDEEEERAFHARPLRWSLPCLVRSRGCVVAHASAD

SEQ ID NO: 119450 - protein, 334 aa, Triticum aestivum
  Clone ID: PAT_TA_13868.pep
PRVRSHIHLVLEIFVLCTIFFVHQDLAGPASLNAPAARKEASPKGTRAGAPPRRRPHKDWRIRRAAGIRQAQISYAQALPSKNDDDTKYYFAVHLTGDNDKGYYGISANMDVYGHNLNVGQLSAGAIWIHNWEGDVNKKLNTIIVGWVVWPYRFNDSRTHLFTVWTKDNHRSTGCVNLDCPGFKVVKGSPISPGDIISPISGISRKRQTITIRVSKESSSGDWWLYYGINGVPIRVGYFPASLFDSLSTKATQISIGGHARSTKNTIAPPMGSGAFASNPGQAASIHDIWLIHKDRRSTPIGNDARTKVTDGKLYSASPIGRAQFFYGGPGGKS

SEQ ID NO: 119451 - protein, 415 aa, Triticum aestivum
  Clone ID: PAT_TA_13869.pep
TNPVQQVMYKTREIKTKVEQSETMVQEICRDIKKLDCAKRHITSAITALHRLTMLVSAVEQLQVMASKRQYKEAAAQLEAVNQLCSHFEAYRDVPKISELREKLKNIKKILKSHVYSDFTSLGTGKETEDEDLLQQLSDACLVVDALEPSVREELVKNFCSKELISYKQIFDGAELAKLDKTERRYAWIKRRLPANEDTWKIFPPSWHVDYLLCIQFCKITRTQLVDILNNLKEKPDVATLLLALQRTLEFEEELAEKFSGGTTTARNRELESDDENEGTEHNKIVSDIRKKYEKKLGVPNDEAEQDKEKQKDLSVPGAGFNFHGIISSCFEPYMAVYIELEEKSLVEQLDKLIQEEKWEIEEGSQTNILSSSMQVFLVIRRSLKRCSALTKNQTLFNLFQVFSRILKAYAAKLY

SEQ ID NO: 119452 - protein, 152 aa, Triticum aestivum
  Clone ID: PAT_TA_13870.pep
TDSPMRYVDIGIPANSPGKQSIGCLFWLLARMVLQMRGTILPGHKWEIMVDLFFYRDPEEAKELEEDEALGAPEYAAVAEYTAPAGDTWGAEWPGAAAPAAAAEAPAGAEWTGAPAPAADGWDAVPAPAPTGWEQGSAPAPAAAPAATQNWE

SEQ ID NO: 119453 - protein, 322 aa, Triticum aestivum
  Clone ID: PAT_TA_13871.pep
MAAEGGGVRALSQREQDIQMMLAADVHLGTKNCDFQMERYVYKRRTDGIYIINLGKTWEKLQMAARVIVAIENPQDIIVQSARPYGQRAVLKFAQYTGANAIAGRHTPGTFTNQMQTSFSEPRLLILTDPRTDHQPIKESALGNIPTIAFCDTDSPMRYVDIGIPANNKGKQSIGCLFWLLARMVLQMRGTILQDTSGKSWLICSSTGTQFSQTQWEIMVDLFFYRDPEEAKELEEDEALGAPEYAAVAEYTAPAGDTWGAEWPGAAAPAAAVEAPAGAEWTGAPAPAADGWDAVAAPAPTGWEQGSAPAPAAAPAATPNWE

SEQ ID NO: 119454 - protein, 339 aa, Triticum aestivum
  unsure (1)..(339): unsure at all Xaa locations
  Clone ID: PAT_TA_13872.pep
RRIRARQMMSGDELMMSAEGRSFVDGGMKEIEAGGGGYRRGANDDFMVYGQDNSMDRRSSLDPLAEAHYKRPTPLEEKKNVHSMGDESFMIPVTSNSQDNLGAAGRTAIDIDAELGSSVQKTSDAKAGAELFYEPDELIPERGFEDVSFGYDPSMDYDSHMQIQHDVSVEDANAEDLSVCVEGEEKMPGKDKKLRGSQEGLDKRRKDASARRLSAPKGPLTDAQKRAQNLRAYKASLQKEKKELEAEQMKRLERLKQEREKRIAARSGASNPQKNSXKQAQXSKSVPASNGVSTSDLSGGTTESLIERLKKLAQPKTNASTLNPKPATADHPRRRSLPQ

SEQ ID NO: 119455 - protein, 381 aa, Triticum aestivum
  Clone ID: PAT_TA_13873.pep
MSSLVSAPFATATGARKKARAPAPLHSFLLAGRRGRRAAAATIRCAVAGNGLFTQTNPDVRRVVPAERGLPRVRVVYVVLEAQYQSSVTAAVMQLNADPRRAAEFEVVGYLVEELRDVDTYAAFCDDVAVANVFIGSLIFVEELALKVRDAVAAHRDRMDAVLVFPSMPEVMRLNKLGSFSMAQLGQSKSPFFQLFKRNKKDSSGFADSMLKLVRTLPKVLKYLPSDKAQDARLYILSLQFWLGGLAGTTLQNFLKMIAVSYVPALKGADITYSDPVLFLDTGIWHPLAPAMYDDVKEYLNWYGTRRDANDRLTNPEAPVVGPLRRPCHRVTAVVRHFVPVPGAREPRGAGVIPVLARARDLSGPVGRGLVRPISGAPVVT

SEQ ID NO: 119456 - protein, 73 aa, Triticum aestivum
  Clone ID: PAT_TA_13874.pep
THKYFTDDYGLFTKNEETGQLEHLLPEKSSLRHHLRCPDPQFVDFLSYLLQINPRKRPTASEALEHPWLSSEY

SEQ ID NO: 119457 - protein, 129 aa, Triticum aestivum
  Clone ID: PAT_TA_13875.pep
MGSALLSMVRMMKPKKDGAPPAFVHDLPHHGTTATPCRQRTEEERDASIICHVHHALRHYNASNPGSEFVPVKPLMAAYVGFQSHIWVHVSFVARRKKIASSKRRRNQANDADKTFFAELRYSHHHSGA

SEQ ID NO: 119458 - protein, 103 aa, Triticum aestivum
  unsure (1)..(103): unsure at all Xaa locations
  Clone ID: PAT_TA_13876.pep
CLHLGYRLKSVTSNKATKGSALGYHQFSQENLEKIEFVNRAVCRSMFDSDQECIVRRVPRGNRVLEICKALCSLGQQKQNICLSYNLFCQFKNVSQHXNSKLP

SEQ ID NO: 119459 - protein, 207 aa, Triticum aestivum
  Clone ID: PAT_TA_13877.pep
MGAEQQQQQTAGGSRFAAAFGLLRQYMKDQPGGGVVTVGLMPGGGDGVEAVAPEERIRTMELFPQQAGMVRDSRERTGPERAPLTIFYAGRTVVFDDFPAEKAKELMQLAGSFGALPAASDAGAEPVCQNAPGQPCFAGTDRATLCDLPIARKASLHRFLEKRKSRLAAADPYPAPVAAPGAGTAGKPVPEDGGAPWLGVNSALQLN

SEQ ID NO: 119460 - protein, 210 aa, Triticum aestivum
  Clone ID: PAT_TA_13878.pep
MGAEQQQQQQAAGGSRFAAAFGLLRQYMREQPGAGGGGMVTVGLMPGGGVDGVDAVAPEQRIRTMELFPQQAGTVRGSHERTGPERAPLTIFFGGRTFVFDDFPAEKAREIMQLAGSFCAPPPVSDAGAGAEPACQNAPGQPCLSDLPIARKASLHRFLAKRKSRLAAADPYPAPLAAPGAGAAKETAGKAVPEDGGAPWLGVNSALQLN

SEQ ID NO: 119461 - protein, 201 aa, Triticum aestivum
  Clone ID: PAT_TA_13879.pep
VRRLYLPPETGAGAGKKLPVLVYFHGGGFVIGSAASAAYHRCLNDLTAACAAVAVSVDYRLAPEHPLPAAYEDSLAALKWVLSAADPWLAERADLSRIFLAGDSAGGNICHHLAMHHDLRGAAGRLKGIVLIHPWFWGKEPIGEEPRPGRAEGVEQKGLWEFVCPDAADGADDARMNPTAEGAPGLENLACGKLMVCVARG

SEQ ID NO: 119462 - protein, 167 aa, Triticum aestivum
  unsure (1)..(167): unsure at all Xaa locations
  Clone ID: PAT_TA_13880.pep
VRPRTPIPLLPHIISRGLPSHGPQESKKSGSIQETNIRRHGRGGDARSARARRRAQPQPAAAAPRRLLQPDAGGERGAPRPLDRRRRQGGARRRAGVRLPRRHLRRQPRRAAAVAPAGERPRGPAHLGGSSARPGSRAPARRPSAPAESRHRGYWRXERSKAEGAAA

SEQ ID NO: 119463 - protein, 69 aa, Triticum aestivum
  Clone ID: PAT_TA_13881.pep
HNLVTGDDALKTMTVATVAFNRPRLHILNRKTDGQHDITKRPIPASTNGDNHHFNRILLLLRRPKRHYR

SEQ ID NO: 119464 - protein, 145 aa, Triticum aestivum
  unsure (1)..(145): unsure at all Xaa locations
  Clone ID: PAT_TA_13882.pep
ARLPWRRRPPARSRTCQRRFGTSPARPPRSSGPAPASCRRSRCPCTTRGRPSRRXAVGAGREAVPXRRAASAGRAPARAGPARRSSCGTRRRRTWTGSPAHVGRRCCRKAGRLPRERRRGRRWWVCSSCLLDLCRRVGGRVGGRV

SEQ ID NO: 119465 - protein, 160 aa, Triticum aestivum
  Clone ID: PAT_TA_13883.pep
MAAAAAGKRPSCAVVLGLLLAAVSAAGAEFITWEDLTMPAVARLIRGAPVDVKSAAAGRGGVGVSTIVVSQDGTGHSRTVQGAVDMVPAGNTRRVKILVRPGVYREKVTVPITKPFVSLIGLVSCRTVITWNARSLDIYSSGHQVVTLYSDFFAVLADLF

SEQ ID NO: 119466 - protein, 358 aa, Triticum aestivum
  unsure (1)..(358): unsure at all Xaa locations
  Clone ID: PAT_TA_13884.pep
MVKAMAGCPAKMGFRMPAEWEPHEQCWMGWPERPDNWREHAEPARKTFERTAIAISKFEPVTICASAKQYPRVHELMEHQPNIRVVEMSMNDSWFRDTGPTFITREGGSDIGLAEQTIAGIDWEFNAWGGLGGGCFDDWSLDRSIAKKIVEIERIPCFARTLVLAGRGTLAGRDGTCSTTGGCXLGVTKIIWIPLGLHGDEDTNGHVDNLCCFIKPGVILLSWTDDENDPQYEISVKALSALTQAVDAKGRQIEVVKIHVPGPLYITKEEGEGVLATGHAVPRVPGKRLAASYVNFYPANGGIIAPAFGDKKRDEEACEVLQKAFPDREVVMVEGAREIVLGGGNIHCITQQQPVRPS

SEQ ID NO: 119467 - protein, 139 aa, Triticum aestivum
  Clone ID: PAT_TA_13885.pep
CCQVKFGQINEISCALAACWFYGLVLVAWVVHQWLAAGSRHMAMPVVAEGWVTVGVATCGACLPGYWTAPSLSGLLSAESGQRAHSWMRGRHAIGLSCYMYKRVLFVCGAGWVMALFFPHEAPPVDLLIFVVVRIKYQC

SEQ ID NO: 119468 - protein, 192 aa, Triticum aestivum
  Clone ID: PAT_TA_13886.pep
GSAPLLPISSTLFSCQSSSLFRCISRRSTTLPRPPLPYPSWPPPKPCLPCHGSRPFPPRCPTLRSRAGPLSSSCLLRAPSPPPANATAPASNPASWTRGLAAARPLLPAVPPRPRGPAARLAAPPLPPPPPPRHRATRPLRAPLPTGSCHLPPSPRPVDLPVSVRVSSLVPVARPVPGLPLPKLRHEKGYQT

SEQ ID NO: 119469 - protein, 127 aa, Triticum aestivum
  Clone ID: PAT_TA_13887.pep
SARPPPPPVRSGPPPPPAPSPPPPPPPAPPPPRPYAPSPPPPPRPSLPDPPPPWPSLPYPAPPPPPPLLDSPPGPLPVFPAPPGRGLSRPGRRRRLGGGPRARPSRCLWRPRSRSSCEAATASVGDA

SEQ ID NO: 119470 - protein, 180 aa, Triticum aestivum
  unsure (1)..(180): unsure at all Xaa locations
  Clone ID: PAT_TA_13888.pep
SGAPHCGRAIRVVDASERYCEVECPCGLRRXFCFNCAAPAHSPCPCPMWDKWDAKFRGESENLKWIAVNTKSCPKCLRPIEKNGGCNHVSCPCGQHLCYACGGRLDTLHNCNRYDEAGHANYDSIRRQMLRYTHYCDRFNVHVNSRKVEQTHLWPAIQKRAVLLESATAIRPLIREASWM

SEQ ID NO: 119471 - protein, 224 aa, Triticum aestivum
  Clone ID: PAT_TA_13889.pep
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQIN

SEQ ID NO: 119472 - protein, 127 aa, Triticum aestivum
  Clone ID: PAT_TA_13890.pep
VPWDPAVSQWRRSRGKDDRVQWDPGGSWGRRLGGKPNLKKGGCQGPPLAHMGLPLDIIWACLWTSHGPGPAGNPLAAAATNTWAKATNNLSSGSRHEPAAALSSSSFGSLLNPHFLLQLVSQISYLL

SEQ ID NO: 119473 - protein, 170 aa, Triticum aestivum
  Clone ID: PAT_TA_13891.pep
MPRPPAAPLAPAVAWAPLLLVLLSAPAARCAGQALVPGVMIFGDSVVDAGNNNRLATLVRADFPPYGRDFPATHAPTGRFCNGKLATDYTVESLGLSSYPPAYLSDEAQSDNRTLLHGANFASGAVGYLHATAALYGAISLGRQLDYFKEYQSKVAAVAGEKRAAALTSG

SEQ ID NO: 119474 - protein, 92 aa, Triticum aestivum
  Clone ID: PAT_TA_13892.pep
DSYCSQLYDSRCYIMVVLLNTRSFPLSCMGHLSRFGDSPGWHDWKMNCCALWGESSHPKRGVHHLVLVLRPHCLFVEIHQLFIVCVDFHFSE

SEQ ID NO: 119475 - protein, 75 aa, Triticum aestivum
  Clone ID: PAT_TA_13893.pep
PAILKPTYSWSSILVDLPAPHRARSPFVAAQHPSAASLESHPYVLAALHPRRPPSWSTSPPRITRRCPPSIRRRV

SEQ ID NO: 119476 - protein, 29 aa, Triticum aestivum
  Clone ID: PAT_TA_13894.pep
SQCKLSSSDLIFFFELSCYHVIEHTNMCT

SEQ ID NO: 119477 - protein, 98 aa, Triticum aestivum
  Clone ID: PAT_TA_13895.pep
LRAESVDGSQFALRGADLRKLLQHTFLKRLHLVRDEARLRIRLECRRGRRFPPKQPTSGRGLRRSNPRVICYHRLGFAGHESGKRNSQAIRSGEERRP

SEQ ID NO: 119478 - protein, 60 aa, Triticum aestivum
  Clone ID: PAT_TA_13896.pep
TRPSVSAAMRGRRWIERSMILARKEIMDASDERASRSCCFASFSSLYFSVCKIRCFSCQF

SEQ ID NO: 119479 - protein, 187 aa, Triticum aestivum
  Clone ID: PAT_TA_13897.pep
YGTSCCFIEFASLIGSRFDFDRYGLVPRSSPRQADLILTAGTVTMKMAPSLVRLYEQMPEPKYVIAMGACTITGGMFSTDSYSTVRGVDKLIPVDVYLPGCPPKPEAVIDALTKLRKKISREIVEDRTLSQNKNRCFTTSHKLYVRRSTHTGTYEQELLYQSPSTLDISSETFFKSKSSVPSHKLVN

SEQ ID NO: 119480 - protein, 186 aa, Triticum aestivum
  unsure (1)..(186): unsure at all Xaa locations
  Clone ID: PAT_TA_13898.pep
VRQKSDPQKAADTWSKLGMANSVLENQLRSLSKLSEDHWEAYESVVRSCSRLTFMKWTEVATNQHQELVVKSFIGXREMLSLEIRLHMREMGVAAGVPIEPESQTQLLDATMNMEGVLLAGVPGAGGFDAVFSVTLGEASGAVANAWSSVGVLPLLVREDSRGVSLEAGDPRTEEVSTAVSSIQIR

SEQ ID NO: 119481 - protein, 163 aa, Triticum aestivum
  Clone ID: PAT_TA_13899.pep
EEPHQNSGGPVPRKSNSRFLLKGGSSSLGSPFPTDRQNYNEEPDNQTQCSMSITGSDVSDSVIFSHAKSPGLGTRNNSSDDFDTPRSKSSCFSFTHEPVKAVDNCDIRQYLRSFSRVISKETSNYCADDYAVQKVSENRLTDMVAFKNRIEYGGLVLCNIRTF

SEQ ID NO: 119482 - protein, 198 aa, Triticum aestivum
  Clone ID: PAT_TA_13900.pep
RRLLRRILDPNPGTRISFSEILDNSWFRTGLDKGLISYNTPTEGIVAVDMDPTCDPFSSCTTETIQEATELTNLNAFDIISLSSGFDLSGMFEDKSKKESKFTSTNTAATIITKLEDIAKRLRLRLMKRDGGLLKMQSLQPGRKGVMSIDTEIFQIAPNFHLVEIRKTSGDTLEGGPVKHDMRPALKDIIWAWQGEQP

SEQ ID NO: 119483 - protein, 234 aa, Triticum aestivum
  Clone ID: PAT_TA_13901.pep
KTPCQGPPLICPKKTLQHLSTEKGLTCIFTVDGSSRPTRPPARAARSPVSRAQLSAGCSLPDPPAAVRSAVGEAGGLHPWRRALCSDAGPGAQGVALVGVCRLLPGAADRYGMERLKSICEEKLCKFLNAAAIATILTLAEQHHCDGLKKACSRFLGSPANLRALLDSDGFDHLSRSCPFVAQNLLPSSPLGRACGCCNSCSPRRPGFRGPAAVPSSVPRSQVVFSALHRAFAP

SEQ ID NO: 119484 - protein, 128 aa, Triticum aestivum
  Clone ID: PAT_TA_13902.pep
MSRSGMPAAAPVRTPETWQQPPPGTPPHSPDGADPPPQPHKPAAGPDPPASRQARPRLREWPQRMPRRHHPWSRPSFAGEPLRRRRGKEEGGGRDGRLGFLSPSRQGDDAGVGRSVVRVLRTRGSTRV

SEQ ID NO: 119485 - protein, 74 aa, Triticum aestivum
  Clone ID: PAT_TA_13903.pep
RRKLLGFSTDQGTDIRRDVFHWKNRIILHVNLQHEIFDVVGSASERLELHLKSVLVLQIAHCCCGPEPQELSGL

SEQ ID NO: 119486 - protein, 137 aa, Triticum aestivum
  Clone ID: PAT_TA_13904.pep
HGKEAIAGGMFPSSSRSSLPEYKAWLGISKSSTCKRSTPAMVEMEARLAELRRVSSEERAEERRLADERTQQAMQQAVQQAVLAQTSQCFAMFAAYCTQNGMPAMTMPHQSGHGSNTDGSSHARGPSDNNLGGSPNV

SEQ ID NO: 119487 - protein, 157 aa, Triticum aestivum
  Clone ID: PAT_TA_13905.pep
FFFYDRNRIQTPLAIGQSRRAKRFYGTGQLIHSRNRTQKQARRQGPASRIVPPASTISISSQPHPSTHHTRPTALMNGPIAARPCRGRKRCDRSGPRQNEPPPFFFLAFPLPAVQPSEKGNARTLTPWLAYPSAAPYPTPTLPPARARRRSAAPPAT

SEQ ID NO: 119488 - protein, 70 aa, Triticum aestivum
  Clone ID: PAT_TA_13906.pep
QPKKTATLVAAPYKPFQHLARFTLPENLSATSIALYTLVYIAKYKCKYASNLFFFFSQPSRGSCVFVTMN

SEQ ID NO: 119489 - protein, 178 aa, Triticum aestivum
  unsure (1)..(178): unsure at all Xaa locations
  Clone ID: PAT_TA_13907.pep
MATGISNGRGPSTNDALQSILAAARPFLRGDLAAVDPELPSLVSVLVSAGAGECYHKHGTFLAHLLDVYRILRLWGAPDAVARCGLFHSSYSNSYVNLAIFEPDVSRARVRGIVGAAAERLVHLFCVVPRHALMHDDLHLRYTDAELRDHLAXXEASLQAARSXGGRPEDKAEPGRAK

SEQ ID NO: 119490 - protein, 421 aa, Triticum aestivum
  unsure (1)..(421): unsure at all Xaa locations
  Clone ID: PAT_TA_13908.pep
MASRTTFADALAAARPYLRGEEDQCGDPALPALTAVLRAAGAGECWHKHGTFLAHLLEVYRILRLWGAPDAVARCGLYHSAYSNSYVNLAIFEPDVGRGRVAAVVGDEAERLVHLFCVVPRQQLVHDDLLFHYDDGELVADLARSEESLRDARRGVFDEDEPWRRKIQRLLPADGITVKHIRTGEDVALSRRVAATFLMMTMADFSDQLFDWQDRLFNNANGRLEFRGNTWTSLWPGTGKPGLWTTSISRMGVLYSLIVREEEIYIAHRAHTSQEGNNSAATRDEDIALVIPPVFDGCTKVLDAEDQKAARDLYWEAVCSDEEATDRSKVEELLRQSITKNPFVGEPRLVLAHMCLNTDMXEEVQEQAEQGLKLLLEWGSSWDNRMPWEGWVSWGRAMLTKAKEKDWPHTSFGILSLGLVK

SEQ ID NO: 119491 - protein, 256 aa, Triticum aestivum
  unsure (1)..(256): unsure at all Xaa locations
  Clone ID: PAT_TA_13909.pep
MDTKHADSFDERDVVVVDAGCVRAVLGELVLTFLFVFTGVAAAMAAGVPELQGAAMPMATLAGVALAQALAAGVLVTAGFHVSGGHLNPAVTVALLARGHITAFRAVLYVAAQLLASSLACILLRYLSGGQATPVPVHTLGTGIGPMQGLVMEIILTFSLLFVVYATILDPRTTVPGYGPMLTGLIVGANTIAGGNFSGASMNPARSFGPALAAGVWTNHXVYWVGRLVGGPLAGFVYRVLMAMAKAHEPLLGWDF

SEQ ID NO: 119492 - protein, 93 aa, Triticum aestivum
  Clone ID: PAT_TA_13910.pep
VRYSIEHRSDCVRLFNLRGRGGDRTPHRRRKRAMEGEVEGSGSVRGTRVSLLVGGAAGARRRPQGGAGGRSTRLELRLVIVESNLRLVTYICY

SEQ ID NO: 119493 - protein, 161 aa, Triticum aestivum
  Clone ID: PAT_TA_13911.pep
MAKNTCKLCFRRFASPRALAGHMRSHSVRNLAAKQQISSASSASTSFTAAADDDVSFKKPLPIYALRENPKRSLRVTDVAFSDRESEAESTPSYPKRAHAVGAGAETEPLSSVSDAATPEEDVALSLMMLSRDSWASMGRGDSDGDYFDDRSDWGYTAPAS

SEQ ID NO: 119494 - protein, 57 aa, Triticum aestivum
  Clone ID: PAT_TA_13912.pep
DVILLLEQSNKCCCSSQLLTTFSARKNKHFKKGWSATNFNLNHTSKIMVLTTASIIL

SEQ ID NO: 119495 - protein, 124 aa, Triticum aestivum
  Clone ID: PAT_TA_13913.pep
RVKSLFSAIGKVWTAEEKYFDAVTGLSGSGPAYIFLAIEAMADGGVAAGLPRDLALGLAAQTVLGAATMVSETGKHPGQLKDQVTSPAGTTIAGVHELEKGSFRGTLINAVVAATTRCRELSKN

SEQ ID NO: 119496 - protein, 93 aa, Triticum aestivum
  Clone ID: PAT_TA_13914.pep
TSTFGACIGIWETRQVTYSYRLGSSISVTYFHQQWHLSSDYIPCHAMNKRRKIPTCINQQWTVSHPVNANVEAHLLVRPTVDQVRMRLHQDRG

SEQ ID NO: 119497 - protein, 94 aa, Triticum aestivum
  Clone ID: PAT_TA_13915.pep
GEAAAVPKGYFAVYVGAEARRDAWAMGYLHQPAFRALMELAAEEFGFGQAGGLRIPCREEDFVAIVAALEATAESRQRRRSAAGRKSRSNATPW

SEQ ID NO: 119498 - protein, 137 aa, Triticum aestivum
  Clone ID: PAT_TA_13916.pep
THASEFQAGLGGLGGGDARGAVPLPGGAVQVRSVAPIPLVSWVKTSTLLGGGGALGVASFLKAPFLGARWAVGSSAKWWVCSGGSSWSSLSAASSSAAQRLQGHCATAPPSVPAVLPHPCPVRGCWVVLCSLRSLRG

SEQ ID NO: 119499 - protein, 285 aa, Triticum aestivum
  Clone ID: PAT_TA_13917.pep
GRYFPLPPLIVAQAKLHPAPLPSSSGGAAAASELGKGCQVSVLYSRSRIKCRARSRLPSMGYGMMPSRSTTSALTSGARRRSASLTGCSPWWREGAGGGSDSSFSNKLDLVPDLEDGHRLVLFSRCCHGDGNGNRTRCRARFPRLGWCIFSSVPGVELRHALLLSVSAASPTTFLAEWRPREAMVSALASFLPPGLMPLGRQLFSFGMESSSSVFYRRWSGGCPVIPSGFVPGDGRTGSVLELIFGLDCNLDSLDRVLLVSFRDYAVVLFSFESWSELCTITAGN

SEQ ID NO: 119500 - protein, 160 aa, Triticum aestivum
  Clone ID: PAT_TA_13918.pep
MAFDKIQVANPIVEMDGDEMTRIIWKWIKDKLIFPFLDLDIKYFDLGLPNRDATGDKVTIESAEATLKYNVAIKCATVTPDEGRVKEFNLKAMWRSPNGTIRNILNGTVFREPIICKNVPRLVPGWTKPICIGRHAFGDQYRATDTIIRGPGKLKLIFDG

SEQ ID NO: 119501 - protein, 63 aa, Triticum aestivum
  Clone ID: PAT_TA_13919.pep
PKFMKLTVFIFQQASDLFFTVVPFLLHLISQFFFYLCNKASIIMREINTELTHYKLSTRGSEH

SEQ ID NO: 119502 - protein, 198 aa, Triticum aestivum
  Clone ID: PAT_TA_13920.pep
KSAMMTTAYVVNSTGGSVLDEKHGKADAYAMGVGHVNPTRAADPGLVYDLGVIDYAGYICWLLGDRGLATIVRNKSLTCAKLPKVRDVELNYPTITVPLKPTALMVNRTVTNVGPPSSTYVAKLDMPKSLTARVTPHKLVFSKAGEKKTFSASVSGKGVHGQKHVEGSLSWVSTRHVVRSPIIAVPNLPESPPSQESF

SEQ ID NO: 119503 - protein, 256 aa, Triticum aestivum
  Clone ID: PAT_TA_13921.pep
MEPSSQPEPVVGVATAGSQAYPPPAAYPAPAMPAAIPPGSQPAVPFPANPAQLSAQHQLVYQQAQQFHQQLQQQQQQQLREFWATQMEEIEQATDFKNHTLPLARIKKIMKADEDVRMISAEAPVVFAKACEVFILELTLRSWMHTEENKRRTLQKNDIAAAITRTDIYDFLVDIIPRDDMKEEGLGLPRVGLPPAALGAPADAYPPYYYVPAQQVPGVGMMYGGQQGHPVAYAWQQPQGQQAEEAPEEQQQSPSN

SEQ ID NO: 119504 - protein, 59 aa, Triticum aestivum
  Clone ID: PAT_TA_13922.pep
VLSIFLVSTNGLTILFSPGEVIKGCCCSSQVCRVASIWSAVYIYVMWKNLLCLCRSLFH

SEQ ID NO: 119505 - protein, 361 aa, Triticum aestivum
  Clone ID: PAT_TA_13923.pep
LQFPWLDFRFSFSFIRPFTVGFEGMHHLAQKCIQLKPSFDTNGLTGLLNGILSENPEVVLAECTKKLGPWMATHCMELVAADNDYADIMLHEERPNFGGISIEELHRLVYAQVLCSHSSTWQIAPTYLSSCLNQGLGLLEILLLKQPIQDNRLVLKTLELCRLYELENVGTDIMKIAGCYHWKHGRKGTGVYWFQQAHDKVRLDRIAQQLFERIGKSVADDNFKQWEGLLELLGSDIGSAGGLEFLHRYRDFKRSLQQALEGRTGEAARQTVEFLIQLMRNPSTPQRFWLPLLHDSVKLLNCKPRPLLNVAETTLLLNKLQELSMAKLRPDFCSNHLPSHALSSVRLALGSNLARAILEEA

SEQ ID NO: 119506 - protein, 65 aa, Triticum aestivum
  Clone ID: PAT_TA_13924.pep
RGRGRGLGFEKLTFVPIQRKLIDLPLLSPSEINWVNEYHEQVWEKVSPFLSGNPLNWLLVNTRPL

SEQ ID NO: 119507 - protein, 78 aa, Triticum aestivum
  Clone ID: PAT_TA_13925.pep
DHFQQSGRPLKTGGAAAKALGKLQLRDKKRKEEMERLEKEKQAEIRSYKGLMVQDKMTSNKQVASGSKTLQELEEDFM

SEQ ID NO: 119508 - protein, 100 aa, Triticum aestivum
  Clone ID: PAT_TA_13926.pep
PTPLAPLCIFIHERDPPRSVFAPPWLCACLQYTDMRRATTRIGDMQYASTPITCSFICELIPKLTCLKFSPCFFVIQLCCGYWQESINTGKRGEGRTSSV

SEQ ID NO: 119509 - protein, 162 aa, Triticum aestivum
  unsure (1)..(162): unsure at all Xaa locations
  Clone ID: PAT_TA_13927.pep
RGRGRGREPNYDIYREDITFVDPLNTFHGIDNYKTIFWALRFHGRLLFSEIGLDVSRIWQLTETSIVVRWELWGTPRVPWESYGCFSGTSRYQAGRPGEIYEHKVDNLALDFPRPAGKVGSITNLVVAAXHRAPNPTFWDVVGTGDGCFMDKAFTRAVAWRQ

SEQ ID NO: 119510 - protein, 241 aa, Triticum aestivum
  Clone ID: PAT_TA_13928.pep
TRPRTRGLLINGRGQFNCSLAAAHTPGTKQCTAGGNRHCAPVILPVEPNKTYRLRIASTTSLASLNLAIGKHKLTVVEADGNYVAPFVVDDMDIYSGDSYSVLLTTDQDPSSTYWVSIGVRGRTPKTAPALALLNYRPNRGFKLPAIAPPVTPAWNDTAHSKAFTTQIKARAGTPPPPATSDRRIELLNTQNKLDGHIKWSINNVSLVLPATPYLGSLKLGLKTALAAARPAHTFGRAYDV

SEQ ID NO: 119511 - protein, 112 aa, Triticum aestivum
  Clone ID: PAT_TA_13929.pep
HAGIFPTSRARASGCHGLHPTGARGCVEEGALAGRCRVGQQGARDGLGGVGSVQSGYVRGLRGEGSGQPRAFWGLRGPSRRCFNQEEEKARLVTCRTETLPASKMELCPIAP

SEQ ID NO: 119512 - protein, 56 aa, Triticum aestivum
  unsure (1)..(56): unsure at all Xaa locations
  Clone ID: PAT_TA_13930.pep
MGLLSHRVERSELKPSDHIYTWRAAYSYSHHGIYVXAEGKVVHFTTKNEAGTGGLD

SEQ ID NO: 119513 - protein, 200 aa, Triticum aestivum
  Clone ID: PAT_TA_13931.pep
PPQSLRSKERGNLDQSAETERRGRRHPRQLRQQSVKPRSNHRSTERGEGQETRSVQDRSGTKEITKSRSGRHRSEANIDKQGTTEIINSRNGRHRSEANVDKQGTAELLNSKNGRHRSEANVDRQSKPINIVANVASFVPLVKQKLQSTTVCVKKDVKVKALKAAEAAKRLEEKKQKEQEKRKAAAKAERERLKQEKEPL

SEQ ID NO: 119514 - protein, 424 aa, Triticum aestivum
  unsure (1)..(424): unsure at all Xaa locations
  Clone ID: PAT_TA_13932.pep
MAGAGEDESAPPPPSALLDQKPMEETAAAAGKLTRLEHEHGAPDETSFRMEDLPAEVQPVIMSQLPLKEAVRTSIVSRSWRMLWTFHSDLCFDGPTPNDLDSDTDDEFAGQDSTKMKRAKFIETVNSVIQQHSGIGINKFSVRCGMHKEYTDHLDRWIGFATSSXSLFLASVSIKPRSVISGFTILRRLVLXLVQIFGDFPGLLAKCSRLEDLEIIRCSGVDDFIIPNTLDKLQNLLIAGTDVQMVVIHAADLAHFEYEGRLIPIVLHGCSKLEKATIAFDTTNPYALAHAFNIITSISPVKILIVRAIISTYAQSLELPLRPQGMFMHLRHMTCQIVVYCRELNEDNGLLQLAHWLDAAPRLETLHLHMHYLSPGAFFSAEVAGAEGPCMCRHDHLKTVFMGGFQCYKSQIELACSILGNAFV

SEQ ID NO: 119515 - protein, 158 aa, Triticum aestivum
  Clone ID: PAT_TA_13933.pep
VLSLELPLRPQGMFMHLRHMTCKIIVLARDVNDYNGVLQLAHWLDSAPRLETLDLHLPMQMSYLRSGAFVSAEVAGVEAPCMRRHDHLKTVFMSGFQCYKSQIELACCILGNASVLEQLTVEAIWGDDDYRRICEWAEVTSKRFGKVITVLDAPLNSE

SEQ ID NO: 119516 - protein, 31 aa, Triticum aestivum
  Clone ID: PAT_TA_13934.pep
HASAATLLLHYTKRLGPGLILPICSCICHDR

SEQ ID NO: 119517 - protein, 314 aa, Triticum aestivum
  unsure (1)..(314): unsure at all Xaa locations
  Clone ID: PAT_TA_13935.pep
MATSTLSTVMVSNLSLKAALRDVKEFFSFSGDLVHVEMQSGDELSQVAYITFKDKQGAETAMLLTGATIVDMAVIVTPATYYELPADVLAALEPKDAKSSALEKAEDIVGTMLAKGFILGRDALDKAKAFDEKHQLTSTATARVSSFDKRIGLSEKISVGTSVVNDKVKEMDQKYLVSEKTRSALAAAEQGVSTAGSAIMKNRYVLTGAAWVTGAFSKVANTANDVGAKAKEKIAAEQEGKTVAAGHAQADMSDAREKPRDLDGEVTKIHVSENXEDIPYLPLQFPITVDDQRCSQHAARSPRTELGLIHIAIH

SEQ ID NO: 119518 - protein, 140 aa, Triticum aestivum
  Clone ID: PAT_TA_13936.pep
FTIEQNPMSSRLCARGTNDSEADYSKQWGFEKLVFRNSITGVRRDRKYAIQAKHAYATGVHMSENVIGNTTHKTEHLIRYYHYHNTINVPGELCRELVPVPPKGGVTWSDKTPWYYDDSMKRVANAVREFEKRTIGNVRV

SEQ ID NO: 119519 - protein, 117 aa, Triticum aestivum
  Clone ID: PAT_TA_13937.pep
NGHQLSGFQDSPSSNSAMNRKMAGYELATPHLCIYSDGKDCHLGRRCLCQLQPYSHWVGIQGEDAERGSGNRFAVEPNLSKNEPRSHLIYAKINILRSFLNIHFHPSNGIRTLHHGW

SEQ ID NO: 119520 - protein, 74 aa, Triticum aestivum
  Clone ID: PAT_TA_13938.pep
HPPPPPPPPEIARPPAPPSSTSTGFPIPSASDSAPATPSSPPPPPGPPAGCARRPAGRLDAPRFYLPPARLSVK

SEQ ID NO: 119521 - protein, 160 aa, Triticum aestivum
  Clone ID: PAT_TA_13939.pep
EQWEDQAKFHLTGIDTDDGCWEASASPWRTSSASQTPMFSACEQHTKQVWELTENGQLVSSYSGLCATMRSNKEGENETTGARAWTAIGDKGEIYVAIFNLDTARRKITVSVPDLEKVVGRKLARCTCTEVWSRKRWSVMKGGISAVVASHGSMLFEIQC

SEQ ID NO: 119522 - protein, 102 aa, Triticum aestivum
  Clone ID: PAT_TA_13940.pep
RRRSCNAAAIEATMQRPRRRSCYALCNGHRRCRSSGPRDCWNLQGASLVAVTCPMEQLVRVSSGGQCRSPSEPPPVASERRCGWISQQVAAGHASHVSVHRT

SEQ ID NO: 119523 - protein, 143 aa, Triticum aestivum
  unsure (1)..(143): unsure at all Xaa locations
  Clone ID: PAT_TA_13941.pep
DEPRATGPRLELDLWCFGKESDDLDLTLSLKPSSVSDLGKHVPXEHREEENLLYPGYGNPPVQPGLWPLMSSSHRPLGEAPAMPSWQQAYIADXQATALPAXGGGGGGGGFPGSSPFGLFPLQPNLMXKRSLAPAPIRQVNFF

SEQ ID NO: 119524 - protein, 87 aa, Triticum aestivum
  unsure (1)..(87): unsure at all Xaa locations
  Clone ID: PAT_TA_13942.pep
GQKAEVAAAAPEEAKKSPNVQRKLXKRQQGRTLDSPIEEQFSGGRLLACILFRPGQCGKADGYLLEGKELGFYMRKLPKKKGKGAPA

SEQ ID NO: 119525 - protein, 189 aa, Triticum aestivum
  unsure (1)..(189): unsure at all Xaa locations
  Clone ID: PAT_TA_13943.pep
LSLPRCAAASTSIPSWPPSHPQQPCTAGRPKERSSPPRPDLMERTPGLATPVVAVARSDRGSRRRASMSAEQSSPTVVVARSRPASRRWLPRPPHSLSPLSFNHGGAPPRIAVVGGARLTPLTSSAATAPYLHGAPLLHPMQASERRRLXGLYLDSTGRGRPASPRPRPLASRRRVASLSTKRGRGVRE

SEQ ID NO: 119526 - protein, 125 aa, Triticum aestivum
  Clone ID: PAT_TA_13944.pep
WLCAGWAPFSHRGHCFTVVDNAHLCGVVIAAHAPQNTCAPPEGRLCVARPSAHTSSRPPRPTPPSFPPAVGQPRPSLALRCQLRPPGLLAVLTLLRHNRGRSSGSHTSSRSSQTRAWPSTFSDSS

SEQ ID NO: 119527 - protein, 70 aa, Triticum aestivum
  Clone ID: PAT_TA_13945.pep
SSLPRPNVIALLDLNLPLIKEYYVIVSEPQEWTPCVNLINTDQNNAVCVWHVDPQISEPGPHLQSSRTRG

SEQ ID NO: 119528 - protein, 417 aa, Triticum aestivum
  Clone ID: PAT_TA_13946.pep
HQLKCCGVFEVVRISRAGYPTRMTHQQFAERYGFLLSHSVASQNPLSISVAVLQQFSIPPEMYQVGYTKLFLRTGQVAALENAKNRMLHGALRIQRNFRGLHTRREYYTLKKGATALQSFVRGEKARFRFDYLFKRWRAAVLIQKYTRRRLAATMFTDQLKNIVVLQSVMRGCLARKKFKCLQEEKESKVINSKGEPVRRRRTTEVEGRVSKAEALLRDKEEENAMLKQQLEQYENKWSEYETKMKVMEEAWKKQLSSLQLSLVAAKKSLAADDMVTRAARTDTTPTHAQYDSEDTMSTGTHTPEGTELKYQNHNPEPRVVTGNSDRRINAVNHLAKEFEDRRQVFDDDAGFLVAVKSGQIGSNMNPDDELRKLKDRFATWKKDYKSRLKETKVNLQKVGSHDEKSRKRWWGKKSSK

SEQ ID NO: 119529 - protein, 171 aa, Triticum aestivum
  Clone ID: PAT_TA_13947.pep
AHPSGYLGEDPRGVPNNLMPYVQQVAVGRRPSVTIFGNNYATKDGTGVRDYIHVLDLAEGHIAALRKLFDSSSNIGCEPYNLGTGKGTSVLEIVNAFEKASGKKIPLVIGQRRPGDAEILFAGTGKAERELNWKAKYGITEMCRDQWNWASKNPYGYGSPDSTKQNGSNSH

SEQ ID NO: 119530 - protein, 47 aa, Triticum aestivum
  Clone ID: PAT_TA_13948.pep
TRPVVCSALVHRAHDESRATPCRKYSERKVAHESNRQHHRDRLSTAP

SEQ ID NO: 119531 - protein, 175 aa, Triticum aestivum
  unsure (1)..(175): unsure at all Xaa locations
  Clone ID: PAT_TA_13949.pep
SAARHYAPPRGPRWREGLDRSCPPPTHPAGASVWRGSSLHAPLHRPRPGLRFDAPLLPAGTVPDYGPPGXAPXAVTLLAYLSLWWFGIFNPAIVYDHLGEIYSALVFGSXVFWLCLYIKGHVAPSSSDSGSSGNGVIDFYWGMELFPRIGKHFDIKSLQTCRLGDVLGCLGGPTG

SEQ ID NO: 119532 - protein, 132 aa, Triticum aestivum
  unsure (1)..(132): unsure at all Xaa locations
  Clone ID: PAT_TA_13950.pep
TMKGAIGYVDWYLICPCTKKKXKKKTRTSSXLXSSRMXRPVSTLFLXFTXXVKXMIXLLQQEWMXPLLSTXRXXXKKIVKGSFLYPEKGXFKPWQGFLWFPXFGFXGGQPXLXXPQPXLXPRAPXFFXAWDQ

SEQ ID NO: 119533 - protein, 169 aa, Triticum aestivum
  unsure (1)..(169): unsure at all Xaa locations
  Clone ID: PAT_TA_13951.pep
LVPNSARAEEKMGLYKKARTAVEACDRELDEKARQVQEFKAERLRKXXQVEELESIVRLKQAEAEMFQLKASEARQEAERLQSIALAKSERAEQDYASLYLKRRLEEAEAEKQFLFEKIKLQDGHRPPQASSVPGDSSQAPSQALMLSKIQDLLKNVRTMPTKSEAHSK

SEQ ID NO: 119534 - protein, 110 aa, Triticum aestivum
  Clone ID: PAT_TA_13952.pep
PIQFVDWCPPGFKCGINYQPPGVVPGGDLAKVQRAVCMISNSPSVVEVFSRMDRKFDLMYAKGAFVHWYVGEGMEQGKFFKAREDFAALEKDYEKVGVELDKGEDGDKGD

SEQ ID NO: 119535 - protein, 182 aa, Triticum aestivum
  unsure (1)..(182): unsure at all Xaa locations
  Clone ID: PAT_TA_13953.pep
LASIIALFFLATRGAGAPHRHTGPRVGLGGAAAPAQDTATGPQRREGEDQAQSSARWSMIPGSSNERRRHRKSRGRASERDGPRARAARGHAVVPSTPGWPCTQGSRGTRAGVRPPPAQPRPFQRNRGDDEAGLERAGVGASPGLTTLERTVATPDGHHSNKGEAGLYGASDKGQTYPXIXV

SEQ ID NO: 119536 - protein, 166 aa, Triticum aestivum
  Clone ID: PAT_TA_13954.pep
ETFHASRGRGEKPRLERDRERSDRKAASRRRPRSSPPPPSFPGSDRRDGPPPPSGAPPPCSVHQRPQRPWSSRSSFPRSPLLLEVPVPSGDGNGGGSAVNFHLLRPRETDAKNLLVQIQEPEPSLLNNFTWRRQNLLHWCSEPLTLANDLLYPKTLGGGGGVVFSG

SEQ ID NO: 119537 - protein, 145 aa, Triticum aestivum
  Clone ID: PAT_TA_13955.pep
VDSCDVLMGAHGAGLTNFFFLRTDAAMLQVVPWGHMEHSAMIFYGVQAKEMRLRDVEYSITAEESTLYEKYGKDHPAVSDPESIHKQGWQLGMKYYWLEQDIRPAVTGYARAPHEERRALREQGRGEIHPKAAGRVARICSFLKL

SEQ ID NO: 119538 - protein, 250 aa, Triticum aestivum
  Clone ID: PAT_TA_13956.pep
HASGIIPNRNPSRLPPAAALMASKALLPRECLPRRSPGGGAEPITVYVRVDEEGNYHPRYFSAKIGRVFRDLQDLEQAVRTFYTSIYIARRLLKRPLDPPPSPTDDIFQFEFVVEPAADVSSLKASTALEEKSSGSDKVPDEKPAEVSSLKDSLKATTLEEKSSSSSSSGQQPDQDTVMASPPSGNCLASPSGPGIWQRERQDWGFGYYIRVDLKGSFHTYPKAGGPFQSLEEVDKAMDRYFHEHRNPNL

SEQ ID NO: 119539 - protein, 140 aa, Triticum aestivum
  Clone ID: PAT_TA_13957.pep
RNCAHNLVISMEAKLVVILAACLLIFFSNGGDAQCTVKHLVVAQTTAPTQPGETYPKHMVTVKNTCVCMQLNVKMDCAGFDSSIDVIPADTITPDGDNSLCTLNGGRPVYGNGTVTFSYAWSTDISFRPVSSYMECSVAP

SEQ ID NO: 119540 - protein, 380 aa, Triticum aestivum
  unsure (1)..(380): unsure at all Xaa locations
  Clone ID: PAT_TA_13958.pep
MGQDERQHPELPAMEKELSADAVACDHCSGPQAVVYCRADSARLCLPCDRHVHAANAVCSRHLRAPLCAACRATGAVFRHAGPEFLCSNCDFGRSRDAELPLHDRCTVQGYTGRPSAHDLAALLGVPDLDKPSAGKADDGWWAIWEEPQVFSLEDLIVPTTSCHSFQPLVTPSSPKIQNSPEGKTNDEVIRQLRELAEVDMGGGQITPREEAEQAAHQLPSWTESQHTTGNGDFGTDNSHEVATMPTPGYENGGWNNNDCHALKDDCKTEYEQEQAPANSAEACLSSFVQMSELCPSMSNGSMMDDXQQANHGTGMPMQAFPKRSGFDVVAGPDRDIVISRYKEKRRTRRFDKQVRYESRKARADSRLRIKGRFAKANQS

SEQ ID NO: 119541 - protein, 153 aa, Triticum aestivum
  Clone ID: PAT_TA_13959.pep
KHNDYKILIGPSVPSTCIARIGASSGPSGVPPIFSACPLPSVLVHNHVVPKPPSSTHRDASQFPFLPFLALCPVHVPHHSSPTPPQALSSVPPLRAWITYWCTPWPLLYRPFMGASARRLAYALSFLKSIVDTTTLYSYLLIMQKSEGISLTA

SEQ ID NO: 119542 - protein, 193 aa, Triticum aestivum
  Clone ID: PAT_TA_13960.pep
MFLWDWFYGVLASLGLWQKEAKILFLGLDNAGKTTLLHMLKDERLVQHQPTQHPTSEELSIGKIKFKAFDLGGHQIARRVWKDYYAKVDAVVYLVDAYDKERFTESKKELDALLSDDSLANVPFLILGNKIDIPYAASEEELRYHLGLSNFTTGKGKVNLVDSNVRPLEVFMCSVVRKMGYGDGFKWVSQYIK

SEQ ID NO: 119543 - protein, 184 aa, Triticum aestivum
  Clone ID: PAT_TA_13961.pep
RPSYPSAGAAHASAHFLRRLAGVPWRQIAGEAVSGVSLVAQGLCAVHVFSEHVLGVAFPRGSSMLPALNMAGDVLLTDKVSPRRGRVGPGDVVLLLSPEDPRKVVAKRVVGMEGDEVTYPVDAGNSDATKTVVVPQGHIWVQGDNIYSSNDSRQFGPVPYGLVKGKMSYRIWPPSRIGSIDPKE

SEQ ID NO: 119544 - protein, 128 aa, Triticum aestivum
  Clone ID: PAT_TA_13962.pep
HASGMKLSAIKYLDPIRAEKIFRKCNVDSGLIVIEVSHGSIAEELGVRPGDIIYSMNGECIATTVELENLIMRICGTYLEQGGAIGSCMDIPVGILHMRKGRKGPSRTLSLILNVSDDVEVFKSDMDF

SEQ ID NO: 119545 - protein, 309 aa, Triticum aestivum
  Clone ID: PAT_TA_13963.pep
MASHFVLSTGAKIPSVGLGTWQSEPGVVGDAVYAAVKAGYRHIDCAQVYGNEKEIGFALKKVFDEGITSRQDLFITSKLWCTNHAPEDVPVALDGTLQDLQTDYVDLYLVHWPIRMKKGAGFSPENVIPADIPATWAAMEGLYDSGKARAIGVSNFSCKKLEELLAVARVPPAANQVECHPVWQQAKLRDLCASKGIHFSAYSPLGSPGTFKSYSVLEHPVVVSTAEKLGKTPAQVALRWGIQAGHSVLPKSTHEERIRANFDVFDWSIPSDLFAGFSEIEQTRLIRGKFWTHPEGVFKSEEEIWDGEI

SEQ ID NO: 119546 - protein, 112 aa, Triticum aestivum
  Clone ID: PAT_TA_13964.pep
VGSAWSGATATFKPSALRQENNHHPLPAYQVFDEMSSKQEVFTDGILRVTVHHVYYPISEERLQQVFTEYGLVKISMFQRIHHVEAVVQLRSRSGAVRALAMHGRCIYERAC

SEQ ID NO: 119547 - protein, 110 aa, Triticum aestivum
  Clone ID: PAT_TA_13965.pep
LGHVRRLHLLLFLHQFSPLLREVLLLLHQFSEQNMIPRILPATRIGDPGIPFRLHLTRSPHLVFSPIAARRRVLRSGSPSAAAAAELRIFETCAMYSASTTRVRAAYHRT

SEQ ID NO: 119548 - protein, 102 aa, Triticum aestivum
  Clone ID: PAT_TA_13966.pep
VRERRGDDGTGAAELSGAARRLLALLPCLPNPPREDPSPSSSSSTLQRNWILSKRRRGFAASSRRRLVGYAPTPWCRCCCFLRGCTLSCSAALDLFDEMPGY

SEQ ID NO: 119549 - protein, 164 aa, Triticum aestivum
  Clone ID: PAT_TA_13967.pep
ISFFVFSPDVLPFCKSGGSGVQIQGGRADRSSRRSYIQNVCAWQLSPLGRLIVRPSGVLFPPPASPLLLSLLGNQDLPDISTHTLNQIRTPNETTISPFFILPEVQQWNYDINCSVTFRCRVLLDLPQRIVSTTKCGSSSFLYRRLTRFRLISTENTMQVCTRS

SEQ ID NO: 119550 - protein, 130 aa, Triticum aestivum
  Clone ID: PAT_TA_13968.pep
PRVRGRVGRCWCARRTQPALCRVVPCPRGWRSTVYTHFAGRPEPKTGCFDCSWADWVLRSRGRDRESLQWKSTFLPTDLSTFFCVDLHEIYRWHVVICCRNSRFTAYFCSLRQRLSVVTSWSNGLTSIVT

SEQ ID NO: 119551 - protein, 209 aa, Triticum aestivum
  unsure (1)..(209): unsure at all Xaa locations
  Clone ID: PAT_TA_13969.pep
FGVXXXQXLPXQTAKYPFRGPLRCXGXNTPAVGDXRMGSMTCAANPEDILGXPPQEPCGXNRXXSLSPTLDKGPCQSPDXNRRPHPGYQPVPPPAPAKAAAVAAGDGRAPSRPRSTSAAPQRTERDRGWYVRWVSGGGCIGWACAGGCPVWASALRCAGSETALHGRESGKRAGGVGVRGAGGWGRCVASVISVSCLVVQEVFMNQPKT

SEQ ID NO: 119552 - protein, 88 aa, Triticum aestivum
  Clone ID: PAT_TA_13970.pep
DSCVLPVAHNTVSKQLETGALIHESKKYAEEAREQYNARKRAAYRKKKNEDIISLQEENRPVLAKSGEFINVRLLDALSLICRHIVCT

SEQ ID NO: 119553 - protein, 166 aa, Triticum aestivum
  unsure (1)..(166): unsure at all Xaa locations
  Clone ID: PAT_TA_13971.pep
MRRLARHYTAYLSITYKASKTDPPAGKAPPTCFPSDPSGLQRGLLYLKEAYGNIPIYIQENGQSSSNXLSDTERTGYLKGYIGSTLAALRNGVNVKGYFVWAFLDVFEYLSGYQARYGLYRVDFDDEARPRQARLSARWYSAFLKNNNDDIHVQSELNSTGWHAEQ

SEQ ID NO: 119554 - protein, 160 aa, Triticum aestivum
  Clone ID: PAT_TA_13972.pep
RRPGLFFAFVLYYPICISAFFTEDVESDAADCKLLQSYCCRVYLFLCSLTCGINFFVRRGEVEEEAGVAEDSGAAWLGPPGGARRCATGRTLHEGACALFFFLKVSLLKTFYVFWVLTPVMVCVLLLRGVDQCGVVFVCFFRAVCILDVFKTFCWCRGWV

SEQ ID NO: 119555 - protein, 272 aa, Triticum aestivum
  Clone ID: PAT_TA_13973.pep
TRPWVNTVKPKLGLEVSTRVLQAVNFTDDNIKSLYIVRTEWRAALKNLLKDTGILVLPTMAGHPLKRNSKQRLSSEFEDKMYAFVSIAALSGCCQATVPLGNHNDHPISISFVAAHGSDKFLLRAILDMYSAVQEQIVLASKLALPPVIDRDVDTSELLKEKGNNSFQRKQWSKAIESYSGAIKLNDTNATYYCNRAAAYLELGRFKQAEADCDQALLLDKKNVKAYLRRGTAKKSVLNYQEALQDFRHALALEPQNKTALSAKKRVQKHLR

SEQ ID NO: 119556 - protein, 92 aa, Triticum aestivum
  unsure (1)..(92): unsure at all Xaa locations
  Clone ID: PAT_TA_13974.pep
RCPKAFSRGWPGQPRLKLLPFSRGLWHEPELMGLRPLVPVRATNRYLSGRQLFASVRQRHLGLLGLETGQTSAARALSSGGPGAPGFALGEX

SEQ ID NO: 119557 - protein, 146 aa, Triticum aestivum
  Clone ID: PAT_TA_13975.pep
TRPPGFWASPALARTFRGRRACYFNTGVMVLDLPRWRAAGYTAQIEGWMELQRRVRIYELGSLPPFLLVFAGRIAAVDHRWNQHGLGGDNYQGLCRGLHAGPVSLLHWSGKGKPWDRLDAGRPCPLDAVWAKYDLLRPDTGIDAVL

SEQ ID NO: 119558 - protein, 58 aa, Triticum aestivum
  Clone ID: PAT_TA_13976.pep
MAWSRIARSSQLSQSLSRIASEGGAPTPAASALRNAAALGPRSRHAVVVYHTASCVGL

SEQ ID NO: 119559 - protein, 85 aa, Triticum aestivum
  Clone ID: PAT_TA_13977.pep
FFFFVEHCPFPSGSALGPVMYADIPARWVPENMLKIETFNLVFGQTAVDHMNFTQGGKGIYGKSSSQCNSVALKNRKMHYHRKII

SEQ ID NO: 119560 - protein, 268 aa, Triticum aestivum
  unsure (1)..(268): unsure at all Xaa locations
  Clone ID: PAT_TA_13978.pep
MGKGDREKEAKRRRRGRSSKRSRNATPSSDSDSSPSPDSSPSRSPGPRSRSNSKPEKSSSSRRRRHHHKNSGRSRSSRDDDRHRHRRRRRDERARHSSDGSDLSGSGSDDSGWMEEAQEIVRGILSEFPAITSELRQLLQMIDSGEGIDISGISDKPLVKXRFEETFSDPLKFERKXANGAYFAFSQXGVPTLDVGWTQYLERLPALDMGQMDPXARNRLRAPLPTFHGLPGGAFPPGQGRKVDRGAVPPWKRGRGPALPPRELRPPA

SEQ ID NO: 119561 - protein, 46 aa, Triticum aestivum
  Clone ID: PAT_TA_13979.pep
VELEAAVCLCTTIRLKLLNINLVLPLALQLLLTCGKTPPTGYTCSI

SEQ ID NO: 119562 - protein, 105 aa, Triticum aestivum
  Clone ID: PAT_TA_13980.pep
MMSYYMHETGGFFYKNCCLWKIDKSPDNKNITGPKLGRTRPHHGPSPVSGGACRPRAGPRRGRPRRVRSIWNRSARAAEALYSFLKQNDSGRFKLTPGSVLRRAG

SEQ ID NO: 119563 - protein, 208 aa, Triticum aestivum
  Clone ID: PAT_TA_13981.pep
RAGLKLSLCTAGRRVMRRTNQQQAGSGHRGYRTHASIRSSWAPWIPRASILPRHSAAALPPRAAAETSRSPPPPPRHRRPFALPPGAADLHGSRRCGSLPGSTRASHRTVLCTSMAVGHHAPLPDDVANGVVATRKERNAMEVSSVVQYNQNMVRHNSMSAKELKAPTHATVQASSILYIGFFGIRIPSAEALNEDIKPNFITPPNLS

SEQ ID NO: 119564 - protein, 163 aa, Triticum aestivum
  unsure (1)..(163): unsure at all Xaa locations
  Clone ID: PAT_TA_13982.pep
MKMIAAVIVCVLVLXLDITAGILGLQAQAAQNKTKKVTVLFIQCEKPVYKAYQLGLAAAVFLVVAHAVANFLGGCACICSQLEFIRASINRKLAATLIILSWIALIVGFSLLLAGAMSNSKSKTSCGFVHGKTLGLGGIMCFVHAGITVAYYVTATAAAHEIH

SEQ ID NO: 119565 - protein, 321 aa, Triticum aestivum
  Clone ID: PAT_TA_13983.pep
MAAASSLHVAAPAATPRVGSAGPKSASAARSVRVARSGAAARHGGRLVACAAVATKADAPASEAASKSEGHEVLLFEALREGLMEEMQADPTVCVFGEDVGHYGGSYKVTKGLADMFGDLRVLDTPIAENSFTGMGVGAGMKGLRPVVEGMNMGFLLLAYNQISNNCGMLHYTSGGQFKIPLVIRGPGGVGRQLGAEHSQRLESYFQSIPGIQMVACSTPYNAKGLLKAAIRSDNPVVLFEHVLLYNLKEKIPDEEYICSLEEAEMVRPGSQLTILTYSRMRYHVMQAVKTLVNKGYDPEVIDIRSLKPFDLHTIGNSIKK

SEQ ID NO: 119566 - protein, 268 aa, Triticum aestivum
  Clone ID: PAT_TA_13984.pep
MLETSLFLIPLLRALLPVWAAVVEGMNMGFLLLAYNQISNNCGMLHYTSGGQFKIPIVIRGPGGVGRQLGAEHSQRLESYFQSIPGLQMVACSTPYNAKGLMKAAIRSENPVVLFEHVLLYNLKEKIPDEEYTLCLEEAEMVRPGEHVTILTYSRMRYHVMQAAKTLVNKGYDPEVIDIRSLKPFDLHTIGNSIKKTHRVLIVEECMRTGGIGASLRSAIIDNFWDYLDAPIMCLSSQDVPTPYAATLEDATVVQPAQIVAAVEQICQ

SEQ ID NO: 119567 - protein, 86 aa, Triticum aestivum
  unsure (1)..(86): unsure at all Xaa locations
  Clone ID: PAT_TA_13985.pep
TTTTWPTTTTSPAAAAPSTTPPAASTRTPAAAAAPAEPXSRSSRRTPGGSPRSRPSPSSSTTTRSRRSSTPRPSTAPPTTSPSTLP

SEQ ID NO: 119568 - protein, 115 aa, Triticum aestivum
  Clone ID: PAT_TA_13986.pep
TGVNDVCATVEVSILGRLNHLSLIRLSGASPSLHARRLHVLTYVMFEFTKNSALSKWLHSDEVLGWSKHVQVALDMAAGLNYVQRYSKSSNIMLNTCFLPKLTNFGLTLARTRGS

SEQ ID NO: 119569 - protein, 111 aa, Triticum aestivum
  Clone ID: PAT_TA_13987.pep
LKKVQIDGFCSAKSIVELTCHILKNATSLESLTLDCIFGADAVGESVRCSAPESGKCMATSRRIILEAHKALGAVKRYIVEKVPSSVKLHIGGPCTRCHVMDVMLPQVSNM

SEQ ID NO: 119570 - protein, 205 aa, Triticum aestivum
  Clone ID: PAT_TA_13988.pep
DLETLALDSAHSSPAAATDPLLRPPSSSSNGAAATRHEPFVIDDFLDDDEDEEDDDHAPQPLPASRAPAAAANGEAGPEFSRITVSDPKKHAEPVSGAAGVIPGSGSYFSYLVTTRLADGAAEVRVRRRFRDVVALADRLAAAHRGLFVPARPDKSLVEGQVMQRHDFVSQRCTALQRYLRRLAAHPVVGRSPDLRTFLTEPGAI

SEQ ID NO: 119571 - protein, 141 aa, Triticum aestivum
  Clone ID: PAT_TA_13989.pep
CSVREGCQIANVIHELKDFRKSANVDIHFIPASRRGKTTPKVWTRSGAPGGTVREGWPKAEVRPDQADLRNGASAAVQSIQGGRRVRPAADLRAVTAGWEGKEPKPLSPVLKTSNQPVTKSWESGRGVATSENLWCRITSR

SEQ ID NO: 119572 - protein, 167 aa, Triticum aestivum
  Clone ID: PAT_TA_13990.pep
MGGHDGRSRKRRSSPSSGEEEERERKKRRDKKESRRSGRDGRGSDEEEERRRRKKKHGDRGKDKERDSKERRSKEKDKSKRKDKDVPSLKQDIKEISKDDYFAKNNEFATWLKEEKGKYFSDLSSESARDIFLKFVKQWNKGKLPSHYYEGITIGPRSAHNWNIKKA

SEQ ID NO: 119573 - protein, 246 aa, Triticum aestivum
  Clone ID: PAT_TA_13991.pep
MAGARSAATRLTHSSLFLLSRAAAAAATRRTNLPSSPRDYSKMASSVGGNGYSDVTRVLFCGHYWPASTIYTKEYLQNYPFIQVDEVGLEHVPDVIQNYHICVVKNKCIDSDIIAKATKMKIIMQYGVGLEGVDINAATEQKIKVARIPGSTTGNAIACAEMAIYLTLGVLRKQKEMDTAVIQKDLGLPVGETIFGKTILILGFGAIGMEIAKRLRPFGVKIFATKRNWSSYTVSGVLAGLVRPKI

SEQ ID NO: 119574 - protein, 145 aa, Triticum aestivum
  Clone ID: PAT_TA_13992.pep
TRPIILKGHYGWEEIVDLTAVSQLFQLRCVTVSAYGKIKLPTKLGELVYLETLDIEKCTLMESIPSDIVHLPRLSYLLLPNWTKLPEGIGNMKSLRTLRGLDMEKSSLKCFMGLSKLTNLRELHMSIDFSLGLSDIRDCTLPALP

SEQ ID NO: 119575 - protein, 395 aa, Triticum aestivum
  Clone ID: PAT_TA_13993.pep
RNSARGPPPPPAAAKSSSATATASGTKKRKSNVRALTHEEVKALGLELLSSRAHLNHAPTLLALLSPTAPLSIALEALISLQSFFEPLLPSIPSASAAAAAAGGASGDPELVFGAWLRQRFEEFVAALVELSVSPHSDEAIREVALDAFMDFVKLGKDGSFHSAIYHKFLHAVVHATNSIDDVLELLGSKYAKYADVCFFTYTSLDKIANSLGSQTTGSGKDVLQNGDDGAEDRSAVCVRNVYNILVHIPALDFKKESKFDMWSTVGLSSKGEKDTSEGSSATRISKKLKLKFTKAWLAFLKLPLPLDVYKEVLATLHQNVIPSMSNPAILCDFLTTSYDIGGVISVMALSGLFILMTQHQLEYPKFYDKLYALLTPAVFMAKHRSVFLQVSSSQ

SEQ ID NO: 119576 - protein, 486 aa, Triticum aestivum
  Clone ID: PAT_TA_13994.pep
MSTASADVGDAGDGASSAATAPAGRRIPPASSMPWVRNLRRFVGTGAGLGSEALMELETKRILLEIFKERQRKSAEAGSIPSFYKKKPEDGSISNRVQRLAKYRFLKKQSELLLNADDLDAMWVCLRENCVIDDATGAEKMNYEDFCHIATVCTEQIGQKCKRFFSPSNFMKFEKDDSGRIAILPFYLYVMRTVSLTQARIDMSELDEDSDGFLQPHEMEAYIRGLIPNLAQLRDMPSAFVQMYCRIAARKFFFFCDPHRRGKACIKKVLLSNCLQELMELHQESEEEVTDTEQAENWFSLTSAQRICDMFLALDKDTNGTLSKQELKEYADGTLTEIFVERVFDEHVRRSKVGGGNSREMDFESFLDFVLALENKDTPEGLTYLFRCLDLNGRGFLTTADIHTLFRDVHQKWIEGGNYELCIEDVRDEIWDMVKPADPLRIALADLLSCKQGGTIASMLIDVRGFWAHDNRENLLQEEEEQVEEA

SEQ ID NO: 119577 - protein, 68 aa, Triticum aestivum
  Clone ID: PAT_TA_13995.pep
PQQQMGQHSIPAADKNSLLSFSFGWILPTEVQGENKFLIYTGKGSSFKSPPVSILHERSTSGYSSLIS

SEQ ID NO: 119578 - protein, 115 aa, Triticum aestivum
  Clone ID: PAT_TA_13996.pep
TAQTVELIPWCLPNTAKRHNQWKGLYGRLDWEGNFPTSVTDPQPMGKVGMCFHPDQDRIITVRECARSQGFPDGYHFAGNIQSKHRQIGNAVPPPLSYALGRKLKQAIDAKPRLA

SEQ ID NO: 119579 - protein, 153 aa, Triticum aestivum
  Clone ID: PAT_TA_13997.pep
MSAENTINDVLAKENSLSPGDRMNAVGTNMESITRVELDLAFASEKLLNLEMLVMEIARRATEFEPLTLESGSVSSETAEDAFELDTLYGILDAEVQELDDMISSLQIDAKNVEDKVYDEESGGKVKAKLDAAMASGKQMQDLIADIMKGVCK

SEQ ID NO: 119580 - protein, 205 aa, Triticum aestivum
  Clone ID: PAT_TA_13998.pep
TRPASERIQQTLPAEVRFGRGWVGEYEPPLPPILVMQDQLRSQVSSDTNMQRNAARPRDNERLRPTESINSKDMSLSLLNRITTGNNVVGVTGSLESPELKPRLFGVSAEPQHRNTDALPLHDKHRASRNAVKTKRATNDQVRKGRHSSNACPPEVQPQRSECSKGASSSVLDVPAVNKMAGHRPFFQPPEAVKSSSNEKKRRPS

SEQ ID NO: 119581 - protein, 231 aa, Triticum aestivum
  Clone ID: PAT_TA_13999.pep
TRPRVRRFWTDILPIQNWITLVIALGLFEMTLWYFEYLNFNSSGVRPVGITTWVVTVGAIRKTISRLLILSISMGYGVVRPTLGGLTSKVLLLGLTYFLASELLDISENVGTINDISGKAKLFLVLPDAFLDAFLILWIFTSLSRTLEKLQARRSSVKLDIYRKFTNALAVSVIGSVVWIGYEVYFKATDPFSERWQSAWIITAFWDVLAFVLLIEICYLWAPSQSSQRYA

SEQ ID NO: 119582 - protein, 97 aa, Triticum aestivum
  unsure (1)..(97): unsure at all Xaa locations
  Clone ID: PAT_TA_14000.pep
MAEPWPSYSSSSRGKKKRPRSPDGDATSSQGRTENSTSLEDNLIFSDTLIALQLMRTQFPMLLPKHAETVNTXLLVESQLYSSVKDRTQVDRDLESL

SEQ ID NO: 119583 - protein, 232 aa, Triticum aestivum
  unsure (1)..(232): unsure at all Xaa locations
  Clone ID: PAT_TA_14001.pep
MEGGMGGGGGGGGPQELSADNVRGIVLALLSSGFIGSSFIIKKKGLRRAAVSSGISAGVGGHSYLLEPLWWVGMITMIVGEIANFVAYAFAPAVLVTPLGALSIIVSAVLAHFILNERLHALGVLGCVMCIAGSMVIVIHAPLEQEITSVKEIWHMATQPSFLLYVASVIVLVSVLVFHFSPLWGQSNVLIYTAICSLMGSLSVMSVKALGTSLKLTFEGTNQLXYPETWFF

SEQ ID NO: 119584 - protein, 247 aa, Triticum aestivum
  unsure (1)..(247): unsure at all Xaa locations
  Clone ID: PAT_TA_14002.pep
PRVRRHQAPPAPPDQFTLALRKALMFFNAQKSGKLPKHNNVPWRGDSCLKDGRSDQTSRRDLSGGYYDGGSAVKFNFASAFSMTLLSWSVIEYNAKYEAAGELGHVRDTIKWGADYLFGTCNSTAHSIDRLIAQVGGAAMSDGPSQPNDHYCWMRPEDIDYPRPVTECHTCPDLGAEMAAALAAASIVFKDNRVYSHKLLHGATTVWDFARKGGSRQTYKSXRSDAAKFYNSTGYWDEYMWGGSWMY

SEQ ID NO: 119585 - protein, 303 aa, Triticum aestivum
  Clone ID: PAT_TA_14003.pep
DAWADAWADAWAALLLTGSIDETVRAWQPDDLAAASPPAGGYALGVISLAAHPAGVIAAAVSIDSHVRVFDVDSGASVATLDAAPSEVWGVQFHPKGVALAAAGGGSGSVKLWDTEKWQPIASLPVPRPEGAHPDKTGSGKFVLSVAWSPDGKLLACGSMDGTIAVYDAVRMKFLHHLEGHHMPVRSMVFSPVDPHVLLTGCDDSHIHIYDAKEKGLIGAMSGHASWVLSIDVSPDGMAVATGSSDRTVRLWDINARASVQTMSNHSDQVWAVAFRPPGGEGVRAGRLASASDDKSISLYDYS

SEQ ID NO: 119586 - protein, 319 aa, Triticum aestivum
  Clone ID: PAT_TA_14004.pep
TRPQDSVEGDMLSFESEASFPTEVSGKENQHNMMALSKGQISSVCKDENNASLNACGLFPEIEVPLQQADKKYKFFELPPEIYLARPSYNPSCSDGLGCSGKESSAVYLAPQDSSGIKSRCPDRLVQELNAYNSFVVKPCSADFVGNANEQESQNQISESLNASNRRNPRRAASSRNRAPVEHDQINKGSSSTCKSKKVESSCSLVESTLIKFPNKTTKVRIYINRPVNSTAWGSLEKLADGFGQNCEPSTSNSHLISLENGGRSNKRSGKKEQPIVRKARSSRCPKNKFPAFSVTRYAPDELNGEPTFSVMDGAYGYP

SEQ ID NO: 119587 - protein, 203 aa, Triticum aestivum
  unsure (1)..(203): unsure at all Xaa locations
  Clone ID: PAT_TA_14005.pep
MGAATAGQQAGGTPDKLRHVESMSERPSGAGSISGISAVVLGESLADEEHELVFPSAEFSATALVSXAPYKEMYERSIKDPAGFWSEIADAFYWKEKWNPSEVCSENLDVSKGPVHISWFKGGKTNICYNAVDRNVEAGNGDKIALYWEGNEPGQDGKLTYSELVEKVCQLANYLKXSVGVGKGDAVIIYLPMLLELPIAMLA

SEQ ID NO: 119588 - protein, 323 aa, Triticum aestivum
  unsure (1)..(323): unsure at all Xaa locations
  Clone ID: PAT_TA_14006.pep
TRPGRDMNNQRRMDPRYRGRGGGYHGHPRNFRGPRMSDESEIDFEDEPIVGRRRPHENDYGHLHRTQHRRLRSPPHQMPGCLMREMEHDRFSGREIMDPRLLEHGQMDDVPDDMMEQRFFMPHPHSQHTLGDHAFIHRDSSHSPGQRRGAPVHFHRGRSPETMQRSPPLNRSDRPYLPHQRHIRRRGSPFDRVGHDERGMQRNMKRCGMHQGVEGETFEPPLHPAQLAELHAEAELTERRRXGERRAYRRSLERSPMGGDEEMLSYHGDGDIDFADGDGGPREPDGRGFXNRMERAGRARKWVQVRWPQGGCRDNPEMTKEVL

SEQ ID NO: 119589 - protein, 55 aa, Triticum aestivum
  Clone ID: PAT_TA_14007.pep
PDNTVLSPLNDTPSISKYKSFFDTVIVSKNVLYFDRGSTSAATTLCHSLWCLFQY

SEQ ID NO: 119590 - protein, 200 aa, Triticum aestivum
  Clone ID: PAT_TA_14008.pep
PRLRGRVGGPARAPAHTPTTLPLPPHLRSRIPGPSVVPCSTPPFSLLPFDPAPPSLPRQSFEFSSLPLSPSLPLPCPRPVLDSSAAPTKKPRACVRARRFGPVRPLFLPCRPLLRAHCRPAPARGIPPPNKFLSRGRFSEDGQEEKSRARCLAAWIRVPRAAAWSWDFGTRAFRGSGRTPPPPRRGRAGSRSSVEAFRVR

SEQ ID NO: 119591 - protein, 172 aa, Triticum aestivum
  Clone ID: PAT_TA_14009.pep
VRGRVAKITTEERVELSIVEHLPNNGDAGVEEDHLWPTKDGPLPIFLKFENVEYKVKLSAKNPLTAAKVAFSSHMRVDHAGSSCKHILKGIGGSVDPGEILALMGPSGSGKTTLLKILGGRLGGAVKGQITYNDTPYSPCLKRRMGFVTQDDVLFPQLTVEETLVFAAFLRL

SEQ ID NO: 119592 - protein, 148 aa, Triticum aestivum
  Clone ID: PAT_TA_14010.pep
MDAWSGVSADAAAAGANGLGGGWRADVEAAAATSGLGGWGEASAELLDVEAYVAPYSGRTRLARLMAISYKCGVEAIQFEALRVAHDEAKAGEDTMFYLYVVREIDGRLGQGYLLDQAWVDSGNRRAEQRKETLLSQLQIYQSNQIRE

SEQ ID NO: 119593 - protein, 201 aa, Triticum aestivum
  unsure (1)..(201): unsure at all Xaa locations
  Clone ID: PAT_TA_14011.pep
MSQFHHTQHGGDGDFQMWQQQMMYKQLQEFQRQQNAQQIDHGARMQPSFGXQFQAPARAAPADQLPXITNEMPSNEATAYAWPQXLLVGDPRLPSNSQMVNTGSNTNWEQYGGAPAMGNFMNGPVSPPTQSQPMRPMGLATQQMNQSFYQIPATSRGGSVNQYPQFLGIPADLQNAMTRASSHQPEKVSRPFSSLMDEPSP

SEQ ID NO: 119594 - protein, 295 aa, Triticum aestivum
  Clone ID: PAT_TA_14012.pep
HASATHNSADQLQSSSADQQSMKKSVDSRSSGISADRNLVRSTVVAPGYVPTEADERIIVELPSLMVRPLKVVRGIFQVTSKRINFIIDEHPAAGNVDDHASARGQCYQQDKDRSWLISSLHQIYSRRYLLRRSALELFMVDRSNFFFDFGDMEARKNAYRAIIHTKPPNLNDIFLATQRAEQILKRTQLMERWANWEISNFEYLMELNTLSGRSYNDITQYPVFPWIIADYQSKVLNLDDPSAYRDLSKPVGALNPKRLKKFQERYSTLEDPIIPKFHYGSHYSNAGTVLYYLF

SEQ ID NO: 119595 - protein, 97 aa, Triticum aestivum
  Clone ID: PAT_TA_14013.pep
VHVAVVFVSSPPCLALHFPSFCSPELCRSLLYVGSSNPSACCGPFLPCLEMWRQALGVYSDGGCEVGEVIVAAVVSPINFISAGLGVCSFVIRCSCR

SEQ ID NO: 119596 - protein, 227 aa, Triticum aestivum
  Clone ID: PAT_TA_14014.pep
TPPVRRATPRPISPYGNNYHDSQTGSSYYHGRNAIGSQGVTLAASFDPPYSENARSAKYSERDRIYGGKAAQNKAPKVEARDWPAGSHADLLSDWQRGQPEGDYRSRKPQVGHGVKVKSYKSIEQQINGAHSGSDPRGRISQVKINVKSNSQHGRIGQKDSRSKAAHVQSEETESDSSERFEDGADMNLVEEQPNLQYSELHIPAYGAKKSNKLSKSVKTNYPAPTA

SEQ ID NO: 119597 - protein, 195 aa, Triticum aestivum
  Clone ID: PAT_TA_14015.pep
MADLSLVCAASLPLTLLAAYALQPLADARRRLPPGPRPLPLLGNLLDIGEHPHRSFASLADIHGPLMFVRLGTVPAVVATSPEAAREVLQKKNASMAARRGLDAWRVMDHDANSMVALPPRGKWRAFRQHSRAALLGPRPLDEHRAVREEEARELVRRLSAAGGAPVDVAREAFVAMVNVLCRGMFSEKLDPAVV

SEQ ID NO: 119598 - protein, 172 aa, Triticum aestivum
  Clone ID: PAT_TA_14016.pep
MFDSLLNSKFHNKCTHAIKCTRTRLDLVRKKKQAMVKFLRKDVADLLTNNLESHAFGRMEGLIVEMNQASCYDMIEQYCDYIGKQLNNLQKQSECPHEALEAVSTLIFAAARYPDLPELCELRHVFTEKYGASIEPFVSSEFVQKLQNKSFTKEEKLQVIEDVAEEFAIPFN

SEQ ID NO: 119599 - protein, 73 aa, Triticum aestivum
  Clone ID: PAT_TA_14017.pep
TCHSLYCCFCGYCYPLLQCCLNLLACSCELANCFLLITTTHCRCILLARTLLPVYYIYSSCSSTRALVQNTDH

SEQ ID NO: 119600 - protein, 262 aa, Triticum aestivum
  unsure (1)..(262): unsure at all Xaa locations
  Clone ID: PAT_TA_14018.pep
MRSTGPAATATVTRVAQRVVAPSAPTPGGELPLSWLDRYPTQRALIESLHVFKGRAGDEXAESPVKAIERALAAALVSYYPIAGRLALSDGGELVVDCTGEGVWFVEATASCTLEEVDYLEYPLMVPKDELLPHPTYPASDPLAEDSVILLVQVTQFACGGFVVGFRFSHAVADGPGAAQFMSAMGEIARGRAAPSLMPAWGREAIPSPPAASVGPLPVPTELRLQYLAMDISTDYIDHFKAPXLEETXHRCSAFEVLIAKA

SEQ ID NO: 119601 - protein, 150 aa, Triticum aestivum
  Clone ID: PAT_TA_14019.pep
SPPFPITTVSLLDRVLLSGAFPSSLVLGVHLAACLCVFFSGSCNLGHRRVGSRPTPSLVLCYWCRATLLHFQPAWQPLSCISACYICLLLLGSHLAVATGLLLSFVPLAWIPCLPSPLRRVLLFRLSACASWGRTMKLLHDCFCRISLLI

SEQ ID NO: 119602 - protein, 183 aa, Triticum aestivum
  unsure (1)..(183): unsure at all Xaa locations
  Clone ID: PAT_TA_14020.pep
MGVLTLVHILVSFAACAEAIRRADFPPGFTFGTASSAYQYEGAVNEGQRGPTIWDTLASRPGRVIDFSNADVAVDHYHRYKEDVDLMKDIGVDAYRFSISWARIFPSMXSDGTGKPNEEGLSYYNSLIDVLLGKGIQPYVTLFHWDLPQALEDKYGGWLNSQIVEVSLLHALPRMKSCTIYVT

SEQ ID NO: 119603 - protein, 243 aa, Triticum aestivum
  Clone ID: PAT_TA_14021.pep
APAIAGISSTASPPWTAGPELLRRRIPAMDGRPRTPSTPQLWRRMRGRRVGWGISASSAAICHRRRPRQPARQDPDPRSYSASVVKEEQRRTLEGPVAGAAEEPRRPPGGPVVEAAEEPRRAPERSRPEAMAAGACVLFLPLVRVCCSCRFLPLVNAGCSCYGKRPVGAMERGRSRCWERCLVFGLGLLSSRTNSFDRCPDSFRTNRSVWGGPRPNVRPLSASLIRIKQEANRHPPASRIGRV

SEQ ID NO: 119604 - protein, 144 aa, Triticum aestivum
  Clone ID: PAT_TA_14022.pep
IRGVPGGAAPDAGRSSSRGCGGAAPAAGRSSSRGCGGAAQSAGRSRLEAIAAGACVLFLPLVRVCRFLRFLPLVNAGCSCYGKRPVGAMERGCSRCWEGCLVFGLGLLSSRTNSFDRCPDSFRTNRSVWGGPRPNVRPLSASMP

SEQ ID NO: 119605 - protein, 233 aa, Triticum aestivum
  unsure (1)..(233): unsure at all Xaa locations
  Clone ID: PAT_TA_14023.pep
MEEPMSTLTHDLIAEILSRVPYKSLCICKXVCPAWRGIIADPAHRKKMAQTLAGFLYRITADATAEPRGLAGVNYADLSAFPWASVPETHPRLPLPPDSTDRFVSLEGSCDGLFLASIRTGTPAAAGTSRYMVSNPATGEYIVLPHSGQDAGDCCRAYLGFDSAVSTQEFHLFEFVLDLSPPLLRRRLSVVASGARIYSSKTGAWVAMEPKWDIQVGLCFGQPGVFHKGCLHL

SEQ ID NO: 119606 - protein, 134 aa, Triticum aestivum
  unsure (1)..(134): unsure at all Xaa locations
  Clone ID: PAT_TA_14024.pep
MLIVLTVILMGAKVEGESYNPGYYATGDLHMDSNGWRSPYYEDRTSNGQLYNXFMTKQADGYSEYDNETLKRTMLSHEAMFRQQVYELHRVYKIQRDLMKHYENKDAYAYPELADASQTNSSSPVQPNGSKMIW

SEQ ID NO: 119607 - protein, 210 aa, Triticum aestivum
  unsure (1)..(210): unsure at all Xaa locations
  Clone ID: PAT_TA_14025.pep
ARPASKTLALASSSAAAAMASAAPKRCYYEILGLSRDCSPTDIKLAFRRLALTLHPDKQAPGSDVAAATAAFQELQHAHSVLSDPQERAYYDSHRSQILFADPVSSRSGTASASPVPDLFSFFSTSAFSGFSDSGRGFYKVYGDVFDKVYAQEVAYARRMGIPTXLQSPRXPVXGNLRSPPTQVTAFYSYWLGFGSVMDFVLASGTHPCG

SEQ ID NO: 119608 - protein, 185 aa, Triticum aestivum
  unsure (1)..(185): unsure at all Xaa locations
  Clone ID: PAT_TA_14026.pep
MAEEGRSLAAAPTWSVAAVTTLMVAACFLIERSLSRLAKWLRKTKRKAMLAALEKIREDLMLLGVISLLLSQTARWISEICVPSTLFTSIFYXCTEEDCADLDQHGDSANDTHIARILVGGQSMHVCDEGHEPFVSYEGLEQLHRFLFILGFTHVLYSFVTVVLSMIKIYSWRKWETQASTLSRE

SEQ ID NO: 119609 - protein, 159 aa, Triticum aestivum
  unsure (1)..(159): unsure at all Xaa locations
  Clone ID: PAT_TA_14027.pep
PRPNGLWVPRPPAPRPXPPSPPPSPRPPAPPSPRSASAPVPRRTQPAPPPXPAPPPPPPPPPRPAAPPPRPRARPRGPGAPAPPPPPTAPSAPACPVVPRAAPPGAGQPSPAGPAGSRAGSATAVPPPRPGSWPSTTTLGPRRPARGRPPGPRRRGHHR

SEQ ID NO: 119610 - protein, 242 aa, Triticum aestivum
  unsure (1)..(242): unsure at all Xaa locations
  Clone ID: PAT_TA_14028.pep
MLPLRRLSWACRRRGLAQFAAGTPREAADAVVVGAGAVGLAVARALAMAGREVVVVEAASSFGTGTSSRNSEVIHAGIYYPPRSLKANLCVRGREMLYKYCTERAIPHKRLGKLIVATGVAETAKLDMLLKSAKDNGVDDLQMMEGSQAVEMEPELRCLKALLSPSTGIVDSHSFMLSLLXADAENLGATISYNTAVISGRVGDEGIRLHISXESKELGEHSIGSPVPXVVLPPKLLINAAG

SEQ ID NO: 119611 - protein, 270 aa, Triticum aestivum
  Clone ID: PAT_TA_14029.pep
TRPAHSTSLSIPQLPPTQIKITSTSAGTSARRPSTPPARVRAMRTLVAVPVLLLVAQLLGASCHGQEQRKNYVVHLEPRDGEGSAAVPVEDWHRSFLPEAAPSSAGDGGADAGPRIIYSYSHVLTGFAARLSDAEADALRGRPGCIRLYPEVFLPLATTHSPGFLGLQTGKDGFWSRSGFGRGVVIGLVDTGILPSHPSFGDAGMPPPPMKWRGACEFKAIAGAGGCNNKVIGARAFGSAAVNDTASPVDDAGHGTHTGSTGAGFCVDLA

SEQ ID NO: 119612 - protein, 125 aa, Triticum aestivum
  unsure (1)..(125): unsure at all Xaa locations
  Clone ID: PAT_TA_14030.pep
MGGLFASTAATSPLGTAAGSKGKNSWKQKSIVTIALTLLTSSQASPLGSAGALYRTWNSQGVTEDNRLSTSFXDKLVFIPIPAALYMVKNLLQYYIFAYVGAPAYQFLKNLNIITPGLFVRFMLN

SEQ ID NO: 119613 - protein, 375 aa, Triticum aestivum
  Clone ID: PAT_TA_14031.pep
IRHEVDFATTAYRQQVEALAKKQLLEEQERQALEAAKELEEMNDMASHRKKSKKKKRKAGKFKSLKKGRVSSDSEAMHDETSVDTMSIDDNAPSPELMSDESPHHGSHKRKKMTPRNEEVSSSSRALKKFKKAPKSNCTPESSSHKHSLEGKQLKLMDEVNHAAPHAAGIKSDGRISMPSMPAKRVMVIKPERLKKKGLLWPRDCALDSWTTEEDAVLCGTVHEYGPVWELASDFLHSIPGGAFYRGRYRHPVHCCERFRELFCKYVLSATDNANSEKAPSGAGKAVLKVSEDQTRMLLNVISEIPNNELLLQKHFMAILSSVWRSKCAHESRHVTSVCSSATHKPVRLSENWSMANDKPSFNLVRTALVDAQAQ

SEQ ID NO: 119614 - protein, 203 aa, Triticum aestivum
  unsure (1)..(203): unsure at all Xaa locations
  Clone ID: PAT_TA_14032.pep
ASQTFLSESGQSRKRADYFAQQYGKVIEYQMLPCLDLSKSKDKPNYVPIELCKLVEGQRYPMANLNKDTDRALKGKALIKAAERKWEIETAVKAEDGPCRGEIAQQFGISLDVKMMEVTGRVLSPPMLTLGSSRGAPGNLSITPSNCQWNLMGKKLVEGKXLHCWGIVDFIARHLTTSTKRLERLIIFPNAYLSMKNILSSTN

SEQ ID NO: 119615 - protein, 180 aa, Triticum aestivum
  unsure (1)..(180): unsure at all Xaa locations
  Clone ID: PAT_TA_14033.pep
MAPQHFLVVAFPGQGHINPARALAERLARAAPGARVTLSAAVSAHRRMFPSLASPDDEVHDGAISYVPYSEGYDHXSASWLGDGDKVQRYAEVFRRVXRVTFSAVLDRSRXXGRPSTXSLYAISXVWPPRSPFXAGSPGVYWXRPATCLNNSVQKSYDNCQPGLRVIRAPRWDSEFYDEE

SEQ ID NO: 119616 - protein, 132 aa, Triticum aestivum
  Clone ID: PAT_TA_14034.pep
MTMWLGISNSKQGEGQGAVVAMLGLCAISISMSMLPLAAPTIHHEGGAQGGGGNPNPANALVALVNADRAAAKLPALRTTKGLGCMALQCIARCLALSPATACAADGTLAPPCHPPETDITEVYAANCGVEL

SEQ ID NO: 119617 - protein, 223 aa, Triticum aestivum
  unsure (1)..(223): unsure at all Xaa locations
  Clone ID: PAT_TA_14035.pep
PRVRPSATSYSDPNEETSAEAWGIPHKMLVKLVDAFANWLKSGQETLKQIGSLPPPPAPNPANLDLKERFKDLRAQKSLNTISPSSDEARAYFQREEFLRYSIPDRAFCYTAADGEKSIVAPLRRGGGKPTSKARGHPMLLPDRPPHVTILCLVRDAASRLPGRTGTRADVCTLLKDSQYLNHAESNKEAAVNQVVSGALDRLHYERDPCVXYDNDKKLWTYL

SEQ ID NO: 119618 - protein, 173 aa, Triticum aestivum
  unsure (1)..(173): unsure at all Xaa locations
  Clone ID: PAT_TA_14036.pep
PTGSGHGRLNVGLNQGKHIQKAICVDADIMGSVDLIEQIKGGFMEFDKLIASPXMMPKVASLGKILGPRGLMPNPKAGTVSPNITQAIDEFKKGKVEFRVDKTGIAHIPFGKVNFPEEDLIANFMAVVRSIERNKPSGAKGIYWKTAYVCSSMGPSIKLNIKEMLDYGADSSN

SEQ ID NO: 119619 - protein, 179 aa, Triticum aestivum
  Clone ID: PAT_TA_14037.pep
MAMDASPRLYRRLRKASDISIATPAPASSNRMRTKEEHSSCCEDKISSLPEEILIMILDKLDARTTITTTVLSKRWLDLPRRSHAFYDLSIYDILPPRYHRLKKIAMETKASYEAVKRTQNLTDICDKYDRYNAIKDRSEQWMWKVRLLTPILQRYERLAMRCYVKRVNAFLLPPDNVQ

SEQ ID NO: 119620 - protein, 147 aa, Triticum aestivum
  Clone ID: PAT_TA_14038.pep
PRVREYAEIFDILGHGIFNADGDSWRSQRAKSQLLMAAPRFRSFSARCTRDKVDKSLLPFLAHVADADAGARCDLHDVILRMTFDMTCNLVFGVDPGCLRIGLPVVPVARAMDDVLNATFLRHVFPPACWSLMYRYELRPGEEVASS

SEQ ID NO: 119621 - protein, 222 aa, Triticum aestivum
  Clone ID: PAT_TA_14039.pep
MAAAAAAGSDLVVVRLPSPSAEDPLHHDKKKLLEARKLSCSFQVPISSSPVDACKLLDQMIHAARVAHMDELELYFAGGDDYGPFSARNELESLNLLLKTVNTLLVAANDGAKGVRPRVRDEILVRLRSVGLTDKHQMALQTENHETEDSLLKWGEQHGVKSKLQIAFFEGAGRGMLASEDIGVGDIALEIPESLIIYEELVWQADMYLALKEANSISHSAY

SEQ ID NO: 119622 - protein, 214 aa, Triticum aestivum
  Clone ID: PAT_TA_14040.pep
MASSETGRTPAQGAEDASASPWPLRKLQSFAPGLWSQYKAYEDVLVERAKVTISDALVLASEHQAEAIGCATVAGFILFRGPRRFLYRNTLGRFKTEKDLLNDVEQSMIEYKTSIESLRKDSKYTLDKVVIGESDLQRGRTDLRSTGKQIQSVIRSIYKAESTAAGLMDQLRIIPTRQSLELRAEVASMASGLKNRRHVLEERVNRISEYGVRV

SEQ ID NO: 119623 - protein, 138 aa, Triticum aestivum
  unsure (1)..(138): unsure at all Xaa locations
  Clone ID: PAT_TA_14041.pep
IDLNLTGVFLCTQAAXKVMMKKKKGRVINIASVVGLTGNAGQANYSAAKAGVIGFTKTVAREYASRNINVNAIAPGFIASDMTAELGEELEKRILSTIPLGRYGQPEEVAGLVEFLALNPAASYITGQVLTIDGGMVM

SEQ ID NO: 119624 - protein, 145 aa, Triticum aestivum
  unsure (1)..(145): unsure at all Xaa locations
  Clone ID: PAT_TA_14042.pep
LPRAKSSLPNFPKSPPLPNPXELSPAHIKEMGQQSKRTRAPAPREAPPPAPLLTPPPAHLLVPPPAHLLVSPAPKSAPPPGIPSAFPSKQRTSTWIPPRPQDLWRLVCSNQVNRVLRLKALFGHRLPASVTPTSPLVHGWQYGLS

SEQ ID NO: 119625 - protein, 130 aa, Triticum aestivum
  Clone ID: PAT_TA_14043.pep
QPAARRAGRRRCTLRTAPSCLARSRSRRDPAASSPWEPTPHGKVRGRRKRLPRAQGERRGRAPQYRLAKGPGAAGRGGARNRPPPKSGERRGRGAERRRRSGHRAAGRQRGQDRRRQRTRARERKPGRRG

SEQ ID NO: 119626 - protein, 238 aa, Triticum aestivum
  unsure (1)..(238): unsure at all Xaa locations
  Clone ID: PAT_TA_14044.pep
PTNLINRLRAMKXSTPPESPSSREACSPLSRKNHASERIHLVPGVKRFSPPLTGPSNSDALSRKKHIIKRIVVVRVTPKRSRRPESPSSNTDGETQSTGDASASIYRKKKIIKRVLDIGQPKVDIASLIFTPARDSCSCHSPTNEPLLEEEFATSKQMMNDSISKPDGVEPANYCVDANPRMDKLIPPASRSKSSSEESTWTQEKMVNIPILATEEKKVLTDHKQEQGPEELQNLLDL

SEQ ID NO: 119627 - protein, 218 aa, Triticum aestivum
  unsure (1)..(218): unsure at all Xaa locations
  Clone ID: PAT_TA_14045.pep
TRPGELHVAGLKSIIKDIEDVARTSSVVSGVNQSSSANPGGGHPQIVEGAYAWGFNILTWQRHLTYLTWPEILRQFGLSAGFGPQLKKRTEDVYHDDNEGRNSADVISTLRNGSAAVKSAALMKERGYTNRRRSRHRLTPGTVKFAAFHVLSLEGDEGLSILXEVAEKIQRSGLRDLTTSKTPEASISAALSRDTKLFERPRPLHIXVKTXYRKDPLI

SEQ ID NO: 119628 - protein, 119 aa, Triticum aestivum
  Clone ID: PAT_TA_14046.pep
YGVSVVHQPGRPERPQAPRGRHRRAGWDRRAGRTGRGRGGGWGGAGSCRGGAQGADGGRARAVGGNGERGGKMAQGQGGRAGGGARGAFGPCCTASTAGFWSCPARGRTCVGRPPSQRW

SEQ ID NO: 119629 - protein, 104 aa, Triticum aestivum
  Clone ID: PAT_TA_14047.pep
LKQKCIACKKKKNASVVECVVHQGVKNGFLKPKCNVLLFNVVHLCTDLLCYSEVTISVEICFTDNQNWPSEGHADYYVYVETVDCRKVSRFLVREIFSSAYLYA

SEQ ID NO: 119630 - protein, 139 aa, Triticum aestivum
  unsure (1)..(139): unsure at all Xaa locations
  Clone ID: PAT_TA_14048.pep
MLGGGKMKGDAVSGGSSSISPMVSFVLGAAAATVCVLFFMSASPGRSLVDIAAWSHNNGTATQHHHLRSVADAADAAHNATAVAVAAPAPAPVQASPYGDLEEVLARAATADRTVIMTQINAAWTKPGSLLDLFFXXFR

SEQ ID NO: 119631 - protein, 120 aa, Triticum aestivum
  Clone ID: PAT_TA_14049.pep
PTEKRSQSSSAASQSASPRVQPEFLSGSCCRRSNPVPREKKEPGLGGEEVEGAEGSGQRRASGMGGGSEPEVWWGEDEDEDIGPGPGLGLVAEETGGASASGGGKHHRSAVGLGGDWISH

SEQ ID NO: 119632 - protein, 229 aa, Triticum aestivum
  Clone ID: PAT_TA_14050.pep
RPRVRAVLHGVTVVSSAGNSGPGAGTVSNTAPWLVTVPPGPMDREFPAYLVLGNKKQIKGQSLSPVPLPANEHYRLISSVEAKAEDATVAQAQLCIEGSLDKKKVRGKIVVCMRGKNARVEKGEAVHRAGGAGLVLANDEATGNEMIADAHVLPATHITYSDGVALLAYLNSTRSASGYITLPNTALETKPAPFMAAFSSQGPNTVTPQILKPDITAPGVSILAAFTGL

SEQ ID NO: 119633 - protein, 133 aa, Triticum aestivum
  Clone ID: PAT_TA_14051.pep
TCCPSEKTCLKLVSRMNIFSINVSGTNLVLDTSIGATSFFGRRKYLLVGGMMEDRSTSDIILVLRRLEQTGRAHDCVRISRWLGSYHGIIATYTSTQYYSLRSKLLVAKMDVSKRILVLNTSILKTSNSERRE

SEQ ID NO: 119634 - protein, 192 aa, Triticum aestivum
  unsure (1)..(192): unsure at all Xaa locations
  Clone ID: PAT_TA_14052.pep
MPLPLPVPTSRLLAAISAAASSTADLRRLSHLLLTPYTPLPPLRCLNTLLMALARHRMLPDMESFASRMPARNLRTYTTLINAYCLAGDLPAAKRHLASLLRAGLAPDSHAYTSFVLGYCRAGLLSHACRVFAXMPLRGCARTVFTYTALLHGLCGAGMVREAVAVFAGMRADGCAPDTHVYATMVHGLCGA

SEQ ID NO: 119635 - protein, 185 aa, Triticum aestivum
  Clone ID: PAT_TA_14053.pep
MATATSTSCRIAGTEVPITGSDKLRWIDLTVPSPPSPAPASPADPFVSVPPRAASGCHVVFSGRDSQRYLAWRIHEEHQNVLEVIELCALKEFPSSGLRLVFQEALCPFAFMCESEGARRGESVYLLYVLTISGVAILCNLRSPFSYVSGSILSQNDIVGFNLQTHTQSAKVTAVKAKPGCLVIG

SEQ ID NO: 119636 - protein, 139 aa, Triticum aestivum
  unsure (1)..(139): unsure at all Xaa locations
  Clone ID: PAT_TA_14054.pep
MKYSKEAKPERAGGGGAGARAVPVALMLLLLCGFSFYLGGIYSTGRTFTFSSTTTSIIPIVSTTKQEGSAVALAIARNGNGDDXVEFSECPADYHDYTPCTDPKRWRRYGNYRLNFMERHCPPPPERAVCLVPPPRGYK

SEQ ID NO: 119637 - protein, 228 aa, Triticum aestivum
  unsure (1)..(228): unsure at all Xaa locations
  Clone ID: PAT_TA_14055.pep
TRPRTRGLGGKSQSNGGERANTESRSHLKVRSATLSSAEAALSMRKYCIDFVKSKSAXIRSATYTLLTSYIRYVPHVFNEEAVKILSSTILGAFNEKDPLCHSAMWDTILVVSRKFPEAWSYCNIHKVVLNRFWHFLQNGCYGSKQASYPLIVQFLDVIPSEVATEKFAIEFLQNLWAGRNQRQLSAADSLVFFIAFKQSFLWLLKKVPRNSVGDSTDNIHNRLITNV

SEQ ID NO: 119638 - protein, 74 aa, Triticum aestivum
  Clone ID: PAT_TA_14056.pep
MEPAAAADGASDEPVHKGRTNSILLPILAVLLAYLLYRYLRPRLRGLRLDRLPFRVPGCLRRRGNATRSTLLPY

SEQ ID NO: 119639 - protein, 137 aa, Triticum aestivum
  unsure (1)..(137): unsure at all Xaa locations
  Clone ID: PAT_TA_14057.pep
MQASSRSSSMERTSQWLSSQDVQTDLVVRVAGAAFPLHKAVMVPKCGYIRKXVAVATRPDPPATVEFESDGYRAAPTPSEKAARYCYGAXFQISARNAAASXCAAAFLHMQPATLAAAESRKRSDLPDCLPPKALLA

SEQ ID NO: 119640 - protein, 127 aa, Triticum aestivum
  Clone ID: PAT_TA_14058.pep
IYLRHLKLESKLQMIPDRLYVQESFQFSFSQTTSNNNVVTIYAARSRTPSKVIMITNELYSTVQMDTNSVGRADGSPQPVMILHSADCNFSQVYSDSNSEPTVKNRGRACNHRPIRWTVPAPRPDPK

SEQ ID NO: 119641 - protein, 256 aa, Triticum aestivum
  unsure (1)..(256): unsure at all Xaa locations
  Clone ID: PAT_TA_14059.pep
QRHTHTVMAHRDGLXEGSSFWQTQRWSCPGCQEVRCTRADLIGMVSPEVTGTATGTQPSQTVRQGNARGLVHLARQQLRGDDDTAALSWQWSRGTRTARELAAMIRRRGLREDGPAERQHAGFGQTLKRCRHRCLQLAAPGAPRRGRSGSPTARPSRAPAGRTLQWRAPRRRRPRRRRGTRRRRRTVAAGPPPQATGDHPSRRGSRLLLRLPPYHCQACSACAPWPISPFREPPVRPSVDSSPPQQEELRSTRTPD

SEQ ID NO: 119642 - protein, 171 aa, Triticum aestivum
  Clone ID: PAT_TA_14060.pep
MSKKKAVTTMTLKDFHGGSIPSELPLPSAPGVSARPPDRPTAAPSASSTASARPRTPAASSAAAAAAAVPSFLTNPSRIGRHFDEDERTPFELAAPRRPGPSPPSFPSVPAVAPARSGPGNAWGAKREVAPAAPPVVPAASSGQIWSATRIAQASAVEKVISGRWHLSKPS

SEQ ID NO: 119643 - protein, 565 aa, Triticum aestivum
  Clone ID: PAT_TA_14061.pep
MAALVTSQLATSGTVLSVTDRFRRPGFQGLRPRNPADAALGIRTVGASAAPKQSRKPHRGNRRCLSMVANGHRVMVISPRYDQYKDAWDTSVISEIKVVDRYERVRYFHCYKRGVDRVFVDHPCFLEKVRGKTKEKIYGPDAGTDYEDNQQRFSLLCQAALEVPRILDLNNNPHFSGPYGEDVVFVCNDWHTGLLACYLKSNYQSNGIYRTAKVAFCIHNISYQGRFSFDDFAQLNLPDRFKSSFDFIDGYDKPVEGRKINWMKAGILQADKVLTVSPYYAEELISGEARGCELDNIMRLTGITGIVNGMDVSEWDPIKDKFLTVNYDVTTALEGKALNKEALQAEVGLPVDRKVPLVAFIGRLEEQKGPDVMIAAIPEIVKEEDVQIVLLGTGKKKFERLLKSVEEKFPTKVRAVVRFNAPLAHQMMAGADVLAVTSRFEPCGLIQLQGMRYGTPCACASTGGLVDTIVEGKTGFHMGRLSVDCNVVEPADVKKVVTTLKRAVKVVGTPAYHEMVKNCMIQDLSWKGPAKNWEDVLLELGVEGSEPGIVGEEIAPLALENVAAP

SEQ ID NO: 119644 - protein, 615 aa, Triticum aestivum
  Clone ID: PAT_TA_14062.pep
MAALVTSQLATSGTVLSVTDRFRRPGFQGLRPRNPADAALGMRTVGASAAPKQSRKPHRFDRRCLSMVVRATGSGGMNLVFVGAEMAPWSKTGGLGDVLGGLPAAMAANGHRVMVISPRYDQYKDAWDTSVISEIKVVDRYERVRYFHCYKRGVDRVFVDHPCFLEKVRGKTKEKIYGPDAGTDYEDNQQRFSLLCQAALEVPRILDLNNNPHFSGPYAMLCRAVPRRAGEDVVFVCNDWHTGLLACYLKSNYQSNGIYRTAKVAFCIHNISYQGRFSFDDFAQLNLPDRFKSSFDFIDGYDKPVEGRKINWMKAGILQADKVLTVSPYYAEELISGEARGCELDNIMRLTGITGIVNGMDVSEWDPIKDKFLTVNYDVTTALEGKALNKEALQAEVGLPVDRKVPLVAFIGRLEEQKGPDVMIAAIPEIVKEEDVQIVLLGTGKKKFERLLKSVEEKFPTKVRAVVRFNAPLAHQMMAGADVLAVTSRFEPCGLIQLQGMRYGTPCACASTGGLVDTIVEGKTGFHMGRLSVDCNVVEPADVKKVVTTLKRAVKVVGTPAYHEMVKNCMIQDLSWKGPAKNWEDVLLELGVEGSEPGIVGEEIAPLALENVAAP

SEQ ID NO: 119645 - protein, 623 aa, Triticum aestivum
  unsure (1)..(623): unsure at all Xaa locations
  Clone ID: PAT_TA_14063.pep
VWAPLASASHTTRANQEQEERTSLPPRGTTFAPSPGPGRRLWVRVTALVRPRRPIRAVKSFLSAGSHNAQPRRRPAARRRSPPPGPAWATPKRFGRTLVLVVGPRGPAGAPARHGGLPERVPPPMAANPRRALLGSPPDAQSMDGCETTVVSASNEASKXRRAGNFSAPRAGXGRVFVDHPCFLEKVRGKTKEKIYGPDAGTDYEDNQQRFSLLCQAALEVPRILNLDNNPYFSGPYGEDVVFVCNDWHTGLLACYLKSNYQSNGIYRAAKVAFCIHNISYQGRFSFDDFAQLNLPDRFKSSFDFIDGYDKPVEGRKINWMKAGILQADKVLTVSPYYAEELISGEARGCELDNIMRLTGITGIVNGMDVSEWDPTKDKFLAVNYDITTALEGKALNKEALQAEVGLPVDRKVPLVAFIGRLEEQKGPDVMIAAIPEILKEEDVQIVLLGTGKKKFERLLKSIEEKFPSKVRAVVRFNAPLAHQMMAGADVLAVTSRFEPCGLIQLQGMRYGTPCACASTGGLVDTIVEGKTGFHMGRLSVDSAPSRSSARQAYHEMVKGTAXILDPPAYHEMVKNCMIQDLSWKGPAKNWEDVLLELGVEGSEPGVIGEEIAPLAMENVAAP

SEQ ID NO: 119646 - protein, 297 aa, Triticum aestivum
  Clone ID: PAT_TA_14064.pep
PTRPHQHHMWDAWDMAAEICLSKLPHLIADPNAEFQPSPFFTEQLTAFEVWLDHGSEDKKPPEQLPIVLQVLLSQSHRFRALVLLGGFLDMGPWAVDLALSVGIFPYVLKLLQTSAMELRQILVFIWTKILSLDKSCQVDLVKDGGHAYFITFLDSLDAYPEQRAMAAFVLAVIVDGHRRGQEACMSAGLIDVCLRHLQPENPHDAQTEPLLLQWLCLCLGKLWEDFPEAQLLGLQSNAPEIVTCLLSEPQPEVRASAVFALGNLLDIGSPSVNGGDDDSDDDEKVRAEINVVRSLL

SEQ ID NO: 119647 - protein, 171 aa, Triticum aestivum
  unsure (1)..(171): unsure at all Xaa locations
  Clone ID: PAT_TA_14065.pep
TRPLEGSGHGGHPRHVARRHHHQEQAPPPPWPPQPSVRRLGRIRAPTPPLPQPQCQPRAHSNLLSSLVCSTGAAXAFGYVAQPMAMVTAPSALDSPTKLYISNLDYNVSNEDIKELFSEMGEIQRYSINYDKSGRSKGTAEVVFSARSSAVAALKKYNNVHLDGKPMKIEV

SEQ ID NO: 119648 - protein, 411 aa, Triticum aestivum
  Clone ID: PAT_TA_14066.pep
MYTGAKDPIPRPLLARNPVQIRSEMAREGVGAAMAPAAAEVRYGIVGVGMMGREHLHNLAHLAGEVEREQSVRVCVTCLADPHPESLLLGLRLAAELGLPPPQTFSGHRELLDSGLCDAVVVSSPNMTHSEILMDIIGYAKPHHVLVEKPLCTTVQDCKKVIEAAKQRPDILMQVGLEYRYMPPVAKLIDIVKSGTLGQVRMVAIREHRFPFLVKVNNWNRFNCNSGGTLVEKCCHFFDLIRLFADANPVRVMASGAIDVNHKDEVYDGKVPDIIDNAYVIIEFDNGCRGMLDLCMFAEGSKNEQEISVVGDTGKGEAFVPEGVVRVGKRAGGRDGVVTLKAEDERIKYQGLHHGSSYLEHLNFLSAIRAQGACSPAISLDDGLLSVAIGVAGQLSIEKGRFVTIEEVLSS

SEQ ID NO: 119649 - protein, 468 aa, Triticum aestivum
  unsure (1)..(468): unsure at all Xaa locations
  Clone ID: PAT_TA_14067.pep
ADDDDAVKLGLAESSAAGLDVLSNVFGDDILPTLMPLIQQNLARTDDESWKEREAAVLSIGAIAEGCITGLYPHLPQMVAFLIPLLDDKFPLIRSITCWTLSRYSKFIVQSLGHPNGREQFDKILMGLLRRILDTNKRVQEAACSAFATLEEEAAEELVPRLEVILQHLMCAYGKYQRRNLRILYDALGTLADAVGAELNQAKYLDIFMPPLIAKWQQLPNSDKDLFPLLECFTSIAQALGPGFSQFAEPVFVRCISLIQTQQLAKVDPAAAGALYDKEFIVCALDLLSGLTEGLGGGIESLVAQSNLRDLLLQCCVDEAPDVRQSALALLGDISRVCPIHLQPRLQEFLTAAAKQLTPQSVKDAVSVANNACWAIGELAIKIGKEISPVVISVVSCLVPILTTPESLNKSLIENSAITLGRLSWVCPDIVAPHMEHFMQAWCXALCMIRDDFEKEDAFHGLCAMVAA

SEQ ID NO: 119650 - protein, 193 aa, Triticum aestivum
  Clone ID: PAT_TA_14068.pep
MFKKNVDAKALQRLSGADKKKLRRTAKQRFPQASDDDLDAILPPKVEITVAKYPSRTLVYGIEGELPMLFDIDGRGHELFPTVYALWKVPYLLPAFTLKGGEVSHFILGGADLMFPGISVPPEGLPSFQAGQPWSVKVPGNPAPIAVGTTTMSNTEALKAGLRGKALRIAHYYKDLLWASADGRYVPNEGFYD

SEQ ID NO: 119651 - protein, 284 aa, Triticum aestivum
  Clone ID: PAT_TA_14069.pep
SEPGSSDIAVTDDLLKLRALCAKLNATADTVKTKAKGKSKSLGGDDFDILCNVEEQLDDIIDKILSELSNGDGVSTFEFIGSGVISALLNFLSRPTFGKEKVAEANLPKLRHLALTRYKAFIYVALPNDAVGNQTPMAFLVQKLQSALSSLERFPVVISHSGRTSSLGGSRPSSGLSALSQPLKLRLCRAAGEKTLKDYSSNIVLIDPLASLAAVEDFLWPRIQRSESISYPAVSSGKNSESVAPSATAPVASSTQSVRRPSTRSKSLADADSATKTDIQEGSG

SEQ ID NO: 119652 - protein, 233 aa, Triticum aestivum
  unsure (1)..(233): unsure at all Xaa locations
  Clone ID: PAT_TA_14070.pep
MLSGDVPPNQTVYFRNLNEKVKKEELKRSLYALCSQYGRIVDVVALKTHKLRGQAWVAFSEITAATNAFRGLQDFDFYGKKMRVQYAKTKSDCFAKADGSYAPKEKRKKQEEKAAEKKRRTEDGQQPGAIAPVAPSNGTGHQPSRFAKPPQEPAAPPNNILFLQNMPDQTTSMMLQILFQQYPGFRXVRMIEAKPGIAFVGYEDEDQSKVSMEALPGFKISPKKPMGISYAKK

SEQ ID NO: 119653 - protein, 140 aa, Triticum aestivum
  Clone ID: PAT_TA_14071.pep
PARAGRRRVTSGGARAWGVGGRTGAELGAGEGGGGAGGRARAPWRADGVPVRACLPVCGHRSRVVLDRASNPPDMDAHGRCPSMCPLRPTLLGRVSVVCDGAVRVHQPCYTCPVPCPCLLDLLDQTQQTLQQINNKLNKN

SEQ ID NO: 119654 - protein, 227 aa, Triticum aestivum
  Clone ID: PAT_TA_14072.pep
PPPPPPLPPRDRRRRRPRRPRGRCGRWVAPGPPGLRSARAARRRGRLELGPRARGAPLLVWRAREGGGDRSKTGAEAGGALHTSLTGGALYTSLTGGAAGELRPVHRCGDADPRRQPVLGRGGPAGAGLPRQPPRAPRLLPLHPRAGGVPPGGPTGWRGHARSASPLARRARGAWGASRCSPRASRGCCLGGWDTPAPPDCRGTAIRVLEALGVAARSPAGGTMLII

SEQ ID NO: 119655 - protein, 80 aa, Triticum aestivum
  Clone ID: PAT_TA_14073.pep
MGAFSYHAAHMAALTLAMLLALLRVCAAGNPPFSCGQGAPTQGLAFCNPALPPAQRAADLVARLSLAEKVSQLGDEAPGV

SEQ ID NO: 119656 - protein, 143 aa, Triticum aestivum
  unsure (1)..(143): unsure at all Xaa locations
  Clone ID: PAT_TA_14074.pep
MDPRGARWTAPSLCMALVLLQASISACAGAPKTYIVHMAASEKPSSFDFHHEWYASTVKSVSSAQVEAEEEDGAYARIVYNYETAFHGFAARLDEDEAERMAEAAGVLAVLPETVLQLHTTRAPLLGIGRAGGRXWAGLPKLL

SEQ ID NO: 119657 - protein, 293 aa, Triticum aestivum
  Clone ID: PAT_TA_14075.pep
MAMAAARPRLLLLLAAAAAALLLTPAHAFYLPGSYPHKYAPGEPLSVKVNSLTSIDTEIPYSYYSLPFCAPPEGVKDSAENLGELLMGDRIESSPYRFKMHANESDVLLCRSAPLSPPDFALLKRRIDEMYQVNLILDNLPAIRYTRKDDYFLRWTGYPVGIRVGVDYYVFNHLQFTVLVHRYEDPNVARVMGAAADASDGAAVPANTGKDASAAPGWMVVGFEVVPCSIKHNPEDARALKMYGKFPSKIKCDPSTVSMSIKENEPIVYTYEVSFVESDIKWPSRWDAYLKME

SEQ ID NO: 119658 - protein, 200 aa, Triticum aestivum
  Clone ID: PAT_TA_14076.pep
MAAPPISGHPHSSVDSPLPTDALLAHPQLPSAPAPQAPTASRFLIILTAALAVSTSYLLLLRPPFSAVSAAASTSSFARPLSKLPKPGVLLISSDGFRFGYHHKAPTPHIRRLIANGTSAAEGLIPVFPTLTFPNHYSIVTGLHPSSHGIINNFFPDPISGDNFNMGSHEPKWWLGEPLWVTAADQGVQASTFFWPGSEV

SEQ ID NO: 119659 - protein, 467 aa, Triticum aestivum
  Clone ID: PAT_TA_14077.pep
TVRNHVFVLREYMRDCRPRVRRRRFHSMIRTDNCLQRPSIIESLLRRHLSIIHLAEQHISMDLTEGIREVLLAESFTGLFSNLQVSERPVETNGGGSAIEIICSWYIENIVRDASRTGVVFDATHSCFRSSQPIGGGYLAESFTDKRELKALVRLFGGYGIDKMDKMLREHTSALLNCIDSALRSNRDALEGLAGSVNSGDRIERDANLRQIIDIEALADFCIQAGQAITFRQLLVEAVGAVLQEKVPLIYSLLKGLTMQLPDEAPDKNEIIRLRRVASSVGVGDKHDAEWVHSILAESTSASDNSWILLPYLCSAFMVSNMWSSAVYDVNTGGFSNNLHCLARCVSAVVGGSEYTRLAKEQRINSLSNGHTDELQETELLSRASAESNIKSAMQLHVKLSAGIVLDSWNDSSRPHIVPKLIFLDQLCELSPYLPRGPAEAHIPYTILRSIYHQLYGAAQMGSEPTE

SEQ ID NO: 119660 - protein, 206 aa, Triticum aestivum
  Clone ID: PAT_TA_14078.pep
PRVRPRVRVSDFGLSKTGPELDQTHVSTAVKGSFGYLDPEYYRRQKLTDKSDVYSFGVVLLEVICARPVIDPTLPRDMINLAEWAIKWQKRGELGQIVDQRIAGTIRPESLRKYGETVENCLANYGVDRPTMGDVLWNLEFVLQLQEAGPDISNVDSMNQISELPSDARRMGSLEIRTADEADESRTNMVTDVRPTMPSRWIYTER

SEQ ID NO: 119661 - protein, 161 aa, Triticum aestivum
  Clone ID: PAT_TA_14079.pep
MAQVVAAAGAAGAARPLGGASGADSLRPVARLPFGPRDVRERWSGSVASRGRREHPVASVISADAEVLPVSPDDDAVVKEEENFQHLKAVQQLATAANGVWSKPNVRRKTKIVCTIGPSTNTREMIWNLAEAGMNVARLNMSHGDHASHQKVIDLVKEYNA

SEQ ID NO: 119662 - protein, 221 aa, Triticum aestivum
  unsure (1)..(221): unsure at all Xaa locations
  Clone ID: PAT_TA_14080.pep
PRVRPTSSAPRLFLLCFFALLSHSHFSAARPHHLRLSAEDVATVEAALPARHLAKAKTTFFEVNRPLHPPRGSSGPCSTLLLSQSFALTLNKPPVTTAYSPPSCLKXAGGNVSLAVLEWRAXDCQGVQYXRIFGVXWLGGAELLRRNTAQPRPGGVTWSVHKDVTNYASFLAAGNSTLAVYLRGPIVGTPHAAYYANRALHLCFRGTAPLTSGASAPALLI

SEQ ID NO: 119663 - protein, 114 aa, Triticum aestivum
  Clone ID: PAT_TA_14081.pep
NFDRLQRHQAPPPTPPQKPPQRPQSPPPPETRVGEGEKNQLVTARSRRRGNAWLMIPICHALDGIGKVAQGTAWGWRGLGARIRAGARDRRRGRTETSGEGGRARGRTRGRTRG

SEQ ID NO: 119664 - protein, 215 aa, Triticum aestivum
  Clone ID: PAT_TA_14082.pep
RCVPWSDGMQLLKDAAEGKHFLPTGLEGIDTLLGGGLRKGQLTEITGQSSSGKTQVCLYSAAHVAARHMGAVLYLDTSNSFSPSRIAHILDELPISLIKEPKDMRLKRVMSSIICESVFDIFALFEVLDRLEVSLNCKVTNGSNKICLLIIDSVSSLLAPIIGGKNSQGRSMMISVAMILKKLAHKHNLSVLVTNHMVAGNGAPKPALGESWKAA

SEQ ID NO: 119665 - protein, 96 aa, Triticum aestivum
  Clone ID: PAT_TA_14083.pep
MAWRLALPLLLFYSPILLCSSSQVQDNDPSKLFKSASEMMSLRKYDGALGLLNAVLELDPNHSEAYRQRATGLRHRCRHKEAESDYNKFLELKPGT

SEQ ID NO: 119666 - protein, 300 aa, Triticum aestivum
  unsure (1)..(300): unsure at all Xaa locations
  Clone ID: PAT_TA_14084.pep
MAWRLALPLLLFYSPILLCSSSQEVQDNDPSKLFKSASEMMSLRKYDGALGLLNAVLELDPNHSEAYRQRATVLRHXCRHKEAESDYNKFLELKPGTASVXKELAQLLQAQNALESAYSQSDAGEFSKVLEYVNKIVLVFSPGCLKAKLLKAKALLALKDYSNVISETGFILKEDEDNLDALLLRGRAYYYLADHDVAXQKGLRLDPEHSELKKAYFGLKKLLKKTKSAEDNAAKSKFRVAVEDYKAALSNGXPDHTLYNVQLXLGLCKTLVKLGRXKGAINTCSGSAHKLRTLFEAFVT

SEQ ID NO: 119667 - protein, 103 aa, Triticum aestivum
  Clone ID: PAT_TA_14085.pep
HASENIGIGGERNKKPLLMAHKKNNTQALCLVVLLMMSSTLWSCEAIARNQGTTGLWTSCTPFRACQIPTPNNVAMCKISCEWRGYSFEKSHCDRSIWCCCEW

SEQ ID NO: 119668 - protein, 163 aa, Triticum aestivum
  Clone ID: PAT_TA_14086.pep
MAFLLPKLTTPPCRSPPPSPLKPQLGLPSHGGGRLHGAGSAQAAAPTHLNLPLLLSASQQEAPTAKSAETRNRAASGGGGGGGDPRRSDFYLNLGAAVRALRDDLPAVFLREPNYDIYREDITFVDPLNTFHGIDNYKTIFWALRFHGRLLFSEIGLVFTIWN

SEQ ID NO: 119669 - protein, 141 aa, Triticum aestivum
  unsure (1)..(141): unsure at all Xaa locations
  Clone ID: PAT_TA_14087.pep
TGRGRCDWCCEGDTRWARLLLVAMTLSGERLGQRLEASPSRRSISGAANGALPVLAMELSIGHRSIIGPATVLAXELFSGLSKAWPEAFSGAXNRNIRRARQNICQCFNGSXFGXXXNIRRNHFSXAXXRNHSXGPAKXXX

SEQ ID NO: 119670 - protein, 270 aa, Triticum aestivum
  unsure (1)..(270): unsure at all Xaa locations
  Clone ID: PAT_TA_14088.pep
MYVPRPSRSDGSRDAGEQPRVYQXWRGNNEFFLQGRLIFGPDARSIFLTMSLIFVPVVVFCVFVARHLINDFPDHCGISVMVVVVVFTVYDLTLLLLTSGRDPGIIPRNTHPPEPESIYGSNYIRGQTPLRLPRTRDVVVNGINVKVKYCDTCLLYRPPRCSHCSICNNCVERFDHHCPWVGQCIGQRNYRFFYMFVFSTMLICLYVFAFCWVYIIKISDAEQLSIGRAMLKTPASVVLIAYCSLCVWFVGGLSVFHFYLMSTNQTTYEN

SEQ ID NO: 119671 - protein, 191 aa, Triticum aestivum
  Clone ID: PAT_TA_14089.pep
HASAHASAPGPLPLASLPPEPRPQARVPYAAAGVSPPHHTRISPFHPHLRSSIAISRSEKRGPPHRLPPPPTSEAPYSWDDAAAALWNPRAGQGVVELRAGKSGADAVRSQFVRGQGLPAARAAGDQRTWELLKRFLKIMSIKCFLLSLSPPPYLYMLDRSGFIPLHDFRCRGPCAATDLGHLVYDSCTHV

SEQ ID NO: 119672 - protein, 497 aa, Triticum aestivum
  unsure (1)..(497): unsure at all Xaa locations
  Clone ID: PAT_TA_14090.pep
LGLCCAVFDFSDPAKSSAEKDIKRQTLLDLIDFVDSTTGRYPEAVIAACSRMLAVNLIRVFPPSYRSGGSSSGGGGEGDEDEPMFDPAWCHLQLVYELLLKFIGSNSLDAKIGKKYFDHSFIVRLLNLLDSEDPRERDSLKTILHRIYGKFMVHRPFIRKAVSNIFYHFVFETQRHNGIAELLEVFGSIISGFALPLKEEHKIFLWRVLIPLHKPKSVGVYLQQLTYCVTQFLEKDPKLAGSIIIGLLRYWPVTNSQKEVMFLSEIEEILEATSMVEFQKCMVPLFRRIAQCINSSHFQVAERALFMWNNDHIISLVAQNRQVIMPIIVPALEQNGQNHWNHAVLNLTANVMKMFSEMDEELFSACLTKCKEDEEKQASMXEKRRLKWANLESAAALQPVTGHTAVLVGWLTVRRPVPRPRLLPVAGAWAARRHPSGGPPRVAAPRPSAVRLQGSSFCFFSVRCNYAHYVYALEANVPVSERLVLRLITCNFCLFIL

SEQ ID NO: 119673 - protein, 53 aa, Triticum aestivum
  Clone ID: PAT_TA_14091.pep
YHGGACWTVGNKWARSLRQTTSCAKFHEPKSMVSSLRVLTDLKKLLQCMYSVF

SEQ ID NO: 119674 - protein, 119 aa, Triticum aestivum
  Clone ID: PAT_TA_14092.pep
MQTIYLPLDLKSLLGLLLLFQTTRVRFVFDDDSLEVKVGNQLQESGENVFVGGKNRWKYSTFVNWELWWPQFPILVYFKETQTKPEGQIHFFPVIFNGRQLYDIMVERAGSSETSGPGP

SEQ ID NO: 119675 - protein, 118 aa, Triticum aestivum
  Clone ID: PAT_TA_14093.pep
RASAARGEEHQPWRPLSRYLLPSSSPLHQEPGRQRSRYLLPSCSATPPSSWTCGFRWSIIGHCKSTMTEAFCGYEETGQETPLKHRSCISVWEKYREEDHQRNGRPGPRLSSTYRCTW

SEQ ID NO: 119676 - protein, 231 aa, Triticum aestivum
  Clone ID: PAT_TA_14094.pep
VDPRVRLELLMQSLFFSRASISDGESSKNLSCIKVAGLFLRDTFSRPPCTLIQPSMQAVPQEPVPIPASGQSFCPPGYPFGNQLLEFAAGIPLFSLYCLQTTPSPSPPKFASKTVITCQPLMVTLQEQSCLRIASFLADGVVPNHSATVADSSINSLSFSLKEFDLSVPLDAEEIARCSGTKTACSQSSFSGARLHVEDLHFCESPSSNCSLLNLDKDPACFLLWEYQPVD

SEQ ID NO: 119677 - protein, 281 aa, Triticum aestivum
  Clone ID: PAT_TA_14095.pep
MAALRDRGDAAIKLFGRTIPLLDAAAEVVTKLGNDANSNDVMPCVSNKLLNVEATPFCSKNREQNDQAISKHGVEVRTGFKSEEIKTGSDGSGQDKVLKKPDIIVPCPRCNSMETKFCYFNNYNVSQPRHFCRNCQRYWTAGGNIRNVPVGSGRRRNKHASHFRHAMMSCDANIAAPGDVSNEIHHLALPLLPQVLPGPIKENETVKEFGSQVPVCKPMSSIHNIEEQKDTHLVALASGDNSEEQSCPSPATVSGCSENQTPDSAVKKEPSNVLGYYNGIT

SEQ ID NO: 119678 - protein, 241 aa, Triticum aestivum
  Clone ID: PAT_TA_14096.pep
RASAVCKRWRCGVTDPRFQRRFCQHHRKPPLLGFFKHSVDGIVFKPVLDPPVRIPPQRFHMRLHGIDSGHGTGVKLLGCRHGRLLIMPWQRSELIVIAPITGKKLCLTVPSKFKGDCYLDGEVLCAAADHGHVHGSCHSSPFKVVLLSTSTYRHGPQPAFACVYSSETGMWSDLISTPTPCQLHGAYIHGSLIGNSLYWMCTHRMYIFEFDLDGQSLALITVPSKINDVRHNYDQREIIPD

SEQ ID NO: 119679 - protein, 124 aa, Triticum aestivum
  Clone ID: PAT_TA_14097.pep
TRPSNVRRNLSYFSNGRDYLVCRCRYFFSTNLVKFYKVWFMTKLMCNALRNGGSICRSQTWLLKADTVFVVFCMWMHTFCDRPSVADVVCAVRIPGSSHAAGEILIARLNMYSSKSHTEAEGNL

SEQ ID NO: 119680 - protein, 260 aa, Triticum aestivum
  unsure (1)..(260): unsure at all Xaa locations
  Clone ID: PAT_TA_14098.pep
SFTVYKKQMLTHFGELEKVSSYWGSLLCDGEGRSFVSAAFLEAGIVEYKYGRVDASRLHLASAQEACGIHLSLTGILGFRTIHQVDAKSQMVLVAKTSKPAPDDGQSTELAGPQSDGVASRKATSSVPDESGEFCDILRTPRLAENGNGSSSESMTSANTQIPLSAIQQAAVLAQCLHVSRRSRSDEMSGWXEMAPYIESIDSQDKSYFVVRSLCDVLRIRWXESTRSRTKQRALLMMENLVEDIAKEFPVVSQRAKLVF

SEQ ID NO: 119681 - protein, 147 aa, Triticum aestivum
  Clone ID: PAT_TA_14099.pep
LFDGIPLPLHYRKGKGVSFYRLFCGNSMSDAARLFPSDSSETRSRKRSRDIQELAGATILALVRIHLVSPADPLKPRHRWRGRISPRNGGRTNQSVEGERWQLGGGTEFGEIDAGGEEEGGREWVEENLPKTRGERRGAEEGEVGAW

SEQ ID NO: 119682 - protein, 227 aa, Triticum aestivum
  unsure (1)..(227): unsure at all Xaa locations
  Clone ID: PAT_TA_14100.pep
MANEQPAETYTVEELVAVNPYNPDILNDLEVFVNEQVSSKTYNLDANLSLLRLYQFEPERLSVQIVARILIKALMAMPAPDFSLCLFLIPEHVQMEEQFKTLIVLSHYLETGRFRQFWDEASKSRNILDVVPGFEQAIQSYAIHVLSLXTYQKVPRPVLAEAINIEGLALDKFMEYHAANSGWVIEKGARSQLIVLPRNEFNHPELKKNTADTVXCQHVTRIFPILS

SEQ ID NO: 119683 - protein, 264 aa, Triticum aestivum
  Clone ID: PAT_TA_14101.pep
MAMHPLSQGHPQAWPWGVAMYTNLHYHHQYEREHLFEKPLTPSDVGKLNRLVIPKQHAERYFPLNGGDSPGEKDLLLSFEDEAGKPWRFRYSYWTSSQSYVLTKGWSRYVKEKQLDAGDIVHFERVRGLGTGDRLFIGCRRRGESAPPPPVRVPPPALNAGEQQPWSPMCYSTSGSYPTSPANSHAYRRSVEQDHSDMLHAGDSQREADAKSSTASAAPSRRLRLFGVNLDCGPEPEAEAITPTYGYTHQSPYAAVATVPSYCS

SEQ ID NO: 119684 - protein, 163 aa, Triticum aestivum
  Clone ID: PAT_TA_14102.pep
VPGPPSELPTRPVIEWPQYCNHILQISHLRGTHAELVSAIEQALAKISSSQNEPNIGNIFSVDPHGSGSPSIGNTEVSDPSWQFPVPTAARLERSPSFPLQQRYQGFLGERSKGSTNSVQAKNILSISQPIASTPGDLSMAPKATAPPSLQASSHHSATISAS

SEQ ID NO: 119685 - protein, 128 aa, Triticum aestivum
  Clone ID: PAT_TA_14103.pep
MIKQILGRLPKKPAKSGEKDFAGAGSSSLSSPTADARTTTDLTMSSRIGNPNNYVTNPGQSYSNRNAGVGAGASNGFMAPPVYEALPSFREVPPSEKPALFLRKLSMCCVVFDFSDPTKDVKEKEVQR

SEQ ID NO: 119686 - protein, 203 aa, Triticum aestivum
  unsure (1)..(203): unsure at all Xaa locations
  Clone ID: PAT_TA_14104.pep
PSPSPPANPASSPAAAAAPPSXPSPCSPLPTPRLPAAPPXSQPPFGKNLTSTPTPPPVPPSSSSTSLLAASASPPRSTSSLPVMLQRLGPVVSVSCRALSCCCASWTTLACLGCTPFSPELQIHGCSGEPRCALAPPAHLLLNTLFFVQIPKYFVRVVNGKEATLLFSSVHHKDSSGDNLLLKSLICFFLEKEYHPQPLIDLV

SEQ ID NO: 119687 - protein, 328 aa, Triticum aestivum
  unsure (1)..(328): unsure at all Xaa locations
  Clone ID: PAT_TA_14105.pep
RASAATPALPPPAPLAPPRRARRPPGAVRPERPPPRPPPRVPPAAPPAPPAAPPAPAAPPAPAAGPGASPADGAPWGPPPLPSSSSAPLPPAPGGPTQVFSRRWRPLWSAAPLNLEVRVPHPGRGVPIRTSSVFPDAASEVISKHPGPARRFCFHGLCPGDLQDQAESWFRSRALAKLQELDVGYAFCDERNPGRNPLPPSALRSAPTLLVAKISCCDLPREMVPSMGFDLLQRLSLISVYISVDVFRGLLPACRALESLHMSNVLGTRCLHVRSPTLRSICFRNTSGXAELVIQDVPRLVRLLIPFGCRENCGTIRVISAPKLEIWG

SEQ ID NO: 119688 - protein, 312 aa, Triticum aestivum
  unsure (1)..(312): unsure at all Xaa locations
  Clone ID: PAT_TA_14106.pep
MERYKVIREIGDGTCGNVFRAYNIETNEIVAVKKMKRKFYHXXECISLREVKALQKLNHPNIVQLKEVTMENHELFFIFEHMDCNLYDVIRERSAPFSEEEIRTFMLQILQGLVYMHNNGYFHRDLKPENLLVTNGIVKIADFGLAREVCSSPPYTDYVSTRWYRAPEVLLQASAYTPSIDMWAIGAILAELFTLSPLFPGETETDQLYKICAVLGTPDHSLWPEGMNLPRSSSFQFFQIPPRNLWELIPNASLEALDLIKQLCSWDPRRRPTAEQALQHPFFNVRKWVPRPLQDASYPKMNEPRATPRLEL

SEQ ID NO: 119689 - protein, 136 aa, Triticum aestivum
  Clone ID: PAT_TA_14107.pep
MQKNKRASGHASSLRKVQSTIKKKEKIGSSRKRGITTRKGHLRENIFGYSSPDRDISSTKFEERQFGNVYEPGQADWCELSKRLASHLSVEVVSLALFDGDKMLYACTGIVLPRGTSRLDLTRFLTSSQLVAVFNF

SEQ ID NO: 119690 - protein, 115 aa, Triticum aestivum
  Clone ID: PAT_TA_14108.pep
RHRWRAASGPPRTRSRRKPRRRTHPGSRGSHRPHGSPPRNRPPPPPPPRRTARRPRTRSTEQPRKPEQGRKRSAGGARGMDGAAGEEQRRRRRRVVMAERACGGRAFSVAASRTR

SEQ ID NO: 119691 - protein, 206 aa, Triticum aestivum
  Clone ID: PAT_TA_14109.pep
HASGKALNTRLINFLRDKVQVELLLRYIVEETPEDAEKKRIFRFPFIACEIFICEVDVILKTLVEDEDLMNLLFSFLSPDHPHGTLLAGYFGKVVICLMMRKTLPLMNYVKSHPEIVSQLVDLIGITSLMEVLIRLIGADETMYSSYADSMQWLDDIQVLEMIVDKFSSSDSAEVHANAAEILCAVTRYAPPALATKISSPSFVGR

SEQ ID NO: 119692 - protein, 206 aa, Triticum aestivum
  Clone ID: PAT_TA_14110.pep
HASLHMLSGDEITELLDTISRSFDASSVSVKALGLTITTFKVQELLGTLLSKSTTDLQRIAKGMVETFYKNLPLSRDLDPQESMHGEELLSMASNILVQLFWRTRNLGYLLEAVLVLEFGLTVRKHVWQYKITLVHLYSYLGALPLAHRWYVSLEVKNILLESVSHHILPQMLSSPFLQQTASLVKDYLRFMDDHLKESADLTCLA

SEQ ID NO: 119693 - protein, 107 aa, Triticum aestivum
  unsure (1)..(107): unsure at all Xaa locations
  Clone ID: PAT_TA_14111.pep
MRTGGGCLGRAGGRVLLPLLLIATTVALLPRALALTDAADVSAINGLYVALGSPALPEWTANGGDPCGEKWQGVVCIGSNIDAINYIAATMGGQLGSXXXFTXXTXN

SEQ ID NO: 119694 - protein, 162 aa, Triticum aestivum
  unsure (1)..(162): unsure at all Xaa locations
  Clone ID: PAT_TA_14112.pep
MAASSAPLAFSASASALSARLRLAAPAPASCAATTRRRRPVVVRAKIREIFMPALSSTMTEGKIVSWAAAEGDRVAKGDAVVVVESDKADMDVETFYDGIVAAVLVPAGETAPVGAPIALLAESEEDVALAVAQAXALSSGQPQQQAPAPSDAXAPPPPPAA

SEQ ID NO: 119695 - protein, 231 aa, Triticum aestivum
  unsure (1)..(231): unsure at all Xaa locations
  Clone ID: PAT_TA_14113.pep
HLGPSDRLSVIAFSSTAKRLFHLRRMSHSGRQQALQAVNSLGAGGGTNIADALKKAAKVIEDRSYHAPAGAWALWSDGQDTYNISSNVRXNRVLIYRSTCSIFHSKPSCRRXVPVHGFGFGADHDSDALHSIAEVSGGTFSFIEDEGVIHDAFAQCIXGGLLSVVVQDMRLTVQCVHTGVHLXSIKSGQLLEXVAGDGRDGSIDVGHLYADEERDFLLSVSFPQSREQTIL

SEQ ID NO: 119696 - protein, 347 aa, Triticum aestivum
  unsure (1)..(347): unsure at all Xaa locations
  Clone ID: PAT_TA_14114.pep
MGTSSGANFHQQPPPQGMLPPRHGARAPSLQTSLSLASSEQVGSPEMQEPVSNSDQGHDSATESASSRETWPVEPEHSNAAAASSGGAVKKVEMEKDIRNGIPKLQVIRGSSRIDRVSLREIARERVDLVVEKMKVMPEEHLEEIKNELRSILEGTGGSHHIEEFLYLQKFVXGRGDLTPTMLSMAHHVQLEILVAIKTGIQAFLHPNVTIPQSHLVXVLLYKRCRNIACQSALPAEECRCNVCANRNGFCNLCMCVICNKFDFEVNTCRWVGCDFCSHWTHTDCAIRVGQIGTGQSIKSGTRHAEVLFRCPACQKTSELFGWVKDVFQPCAPGWDRDALVRDLSCL

SEQ ID NO: 119697 - protein, 366 aa, Triticum aestivum
  unsure (1)..(366): unsure at all Xaa locations
  Clone ID: PAT_TA_14115.pep
MTISLPATAAALSVVLAALCLLVVPAAGFYLPGVAPNDFEKKDHLPVKVNKLTPASAQLPYSFYSLPFCKPDTIVDSAENLGEVLRGDRIENSPYVFEMRVPQMCQIVCKISVGEKEGKVLKEKIEDEYRVNMILDNLPLVVPIQRVDQEGAYFYQHGFHVGAKGQYSGSKDEKYFIHNHLSFTVKYHRDAQRDVSRIVAFEVKPYSVKHEYGQWNDRKTHLTTCDPNAKRIITSSDSPLEVEAGKDIVFTYDVDFKESDIKWASRWDSYLLMTDDQIHWFSIVNSLMIVLFLSGMVAMIMLRTLYRDISKYNQLETXREEAQEETGWKLVHGDVFRPPANSDWLCVYVGTGVQFFGMMLVTMVFA

SEQ ID NO: 119698 - protein, 262 aa, Triticum aestivum
  Clone ID: PAT_TA_14116.pep
MPGRLLLLLPLQRRRRRQIIIPLKVQYMTWKMGRRTRQPRRWDKYASKDKNVPGTEMNKTIDNVQTNRTDLSSQTVNEASDRMEEELIRQELGQDGDKNESNVKHGAPPKPVCDLSDPRYDICEISGDARAIGVNRTILYVPPTAERGADGQEWAIKDQSRKYLEYIEKVKVKTLSAAESLVAPECTSQHAVPAVVFAMNGLTSNPWHDFSDLIVPLFITARAYDGEVQFLVTDLQPWFIDKYRLVLANLSRYDIVDFNKDA

SEQ ID NO: 119699 - protein, 136 aa, Triticum aestivum
  Clone ID: PAT_TA_14117.pep
RRRVHHRGARARRQSGQGGRRRSSRLSPIEGGGGWVKKRKEGGKGRLAQRGSSPSPVAGVAPSAASVRRAVPLCSLSRSLLRETGRNRGRKRRRLAWRSAARWRSTPSPATGAARLPAAGVREKRAGAREAERTRG

SEQ ID NO: 119700 - protein, 185 aa, Triticum aestivum
  unsure (1)..(185): unsure at all Xaa locations
  Clone ID: PAT_TA_14118.pep
MAGGAVVNTSGGKDYPGRLTLFVFFTCVVAATGGLIFGXYDIGISXGGVTSMNPFHEKLLPGGVTXKKQMKGSANQYCKYDXKLHPTPFTPSLYLRGARLLLLPPPPSTRVVGRKWSMFTGRLTFLIGAALKRGGGEIAMLIVGRILLGVGVGFANHSVPGYLSQGAPARQLGMVNLGSTLMSPK

SEQ ID NO: 119701 - protein, 108 aa, Triticum aestivum
  Clone ID: PAT_TA_14119.pep
MALLPLVLAVLVVSCAAQQPPVQPPPTPNAPPAGNPPPAPNAPPAGNPPPAPTAPPAGNPPPAPSAPPAPTTPPQAPQAPATPPPGPKAPATPPRAPTTPAGHPLVQE

SEQ ID NO: 119702 - protein, 120 aa, Triticum aestivum
  Clone ID: PAT_TA_14120.pep
PERTKGSANIWSTEFHQADKLPRRLLRCLNQLKVKAFTCNFGGTLSPPPGDGDRRCSRGASRRADVGRLVSWQELVSKTTRLIRRAHTIKYHLPGEQLSMLISITSDDDLRHMIDECIVL

SEQ ID NO: 119703 - protein, 112 aa, Triticum aestivum
  Clone ID: PAT_TA_14121.pep
MAAAGWLRRAASAVALPRMPSGLTIMPPPPPAPLPEAQSLVLPSLGAAIAPAMELMAVPKKKISKYKRGLRNGPRALKPVPVIIRCRCCGRVKLPHFYCCSGEKGNAGDSSS

SEQ ID NO: 119704 - protein, 248 aa, Triticum aestivum
  unsure (1)..(248): unsure at all Xaa locations
  Clone ID: PAT_TA_14122.pep
SVWTSVGFSYCPWANLNSRPFRVSAFGTVMKGQSIIGAYVSISQPVNFACPKIQPETRVPRLHDXEGTAPINRNKPIAFVGGGDSAMEEANFLTKYGSRVYIIHRRDAFRASKIMQARALSNPKIQVVRDSEVVDAYGGSEGGPLGGVNVNNLVAGEVSDFQVAGLFFAIGHEPATKFLAGQLELDSEGYVATKPGSTHTSVKGVFAAGDVQDKKYRQAITAAGSGCMAALDAEHYLQEVGAQEGKTD

SEQ ID NO: 119705 - protein, 214 aa, Triticum aestivum
  Clone ID: PAT_TA_14123.pep
TRPLASAVTCFTTPRNAPFIRAGLAGAGAGAAVVELPFPSEQDAPQSTDELPSSTSLVDFVTAVAALQPAFADALAKIEPRPDLLVHDGFLRWAKDIADELGMPRLVTLGFGGFATYVNRAVTAHRPHARVSSPSEPFPVHGVPDLRLTKADLNPPFDDPEPSGPHWDLICKNRISMYSSRGIIVNSFHELESIYIDLWNREFDVKMWPIGPLC

SEQ ID NO: 119706 - protein, 178 aa, Triticum aestivum
  unsure (1)..(178): unsure at all Xaa locations
  Clone ID: PAT_TA_14124.pep
AILSDGIFRKVCLPVSYAYSLPERLPSFSTSPPNFHPAWTASRPLPLPRKWEIXXHREDRKLAQXXCSLXGNXXFPXNXWXXSDEVSXXVXPXNXXXNXLXYTFXXAPXXXWALWXPPKYSFLKXGVWXIXXEXXXXKGXNXXXXGQXSWGVXXXIXXIKXXPXFXSWGENFKXTPRP

SEQ ID NO: 119707 - protein, 101 aa, Triticum aestivum
  unsure (1)..(101): unsure at all Xaa locations
  Clone ID: PAT_TA_14125.pep
MASPPRHLLPLLLLLALLAPSSAAAPGVIRLPRAGACAAPADPAVYDRPVIGIVTHPGDGAAGRIDNGTSTSYIXAASYVKFVEAXXARVIPLIYXEPXER

SEQ ID NO: 119708 - protein, 110 aa, Triticum aestivum
  unsure (1)..(110): unsure at all Xaa locations
  Clone ID: PAT_TA_14126.pep
CAGTTHHSHHHXTKAGRGPRRDRTGTERRAATPSTRGIPAPQTTNDPGARREVAMGTHHRRRHHSNRGDAPHNRHPITLASIHDLHLSQAVMVNLLNLNICNDYTSIRLA

SEQ ID NO: 119709 - protein, 128 aa, Triticum aestivum
  Clone ID: PAT_TA_14127.pep
MAEACPDNRRCLPAWMMKPCSSNEVSKTEHRNKQSAESDKGSGALDQAKPIRRQKKIVDPEDAGGLKALQRCQGKEKARRKSKDADRAVTDEFGEIEKITCENERKVRGRAAPKNSRKRMLEDVGSDA

SEQ ID NO: 119710 - protein, 201 aa, Triticum aestivum
  Clone ID: PAT_TA_14128.pep
PRVRRGRDTRLLFCTTGVLLRRLLVDRSLKGVTHVIVDEIHERGMNEDFLLIVLKDLLPRRPELRLVLMSATLNAEMFSSYFGGAPMIHIPGFTYPVRSRFLEDILEVTARSRPPYNQIDDYGQEKSWEMQKQALRKRKSQIASVVEDAVKAADLRDYSPQTRDSLSCWNPDSIGFNLIENVLCHICQKERDGAVPARAPS

SEQ ID NO: 119711 - protein, 197 aa, Triticum aestivum
  unsure (1)..(197): unsure at all Xaa locations
  Clone ID: PAT_TA_14129.pep
RTRAKIRXDCCIPGEPAXCSADVGGVLHWASLLFVALPDSQIPLEHRELEDLRSPALGRRQWIQDALSSGHDLELGVPARLRLRRRRQGGPRLPVQHLGHRPPWHGGSTTTTTIGGLPESVVALEAHHRCLAERRQGRPAGGRLRRGEGNLSSKARSHLRVSWGRPSNNGKQEAAPERERERERERRGDVDAGLVYE

SEQ ID NO: 119712 - protein, 238 aa, Triticum aestivum
  Clone ID: PAT_TA_14130.pep
MKSFLVFALLALAAASAVAQISQQQQPPPFSQQQQPPFSQQQQPPFSQQQQSPFSQQQQQPPFSQQQQPPFSQQPLISQQQQLPFSQQQQPQFSQQQQPPYSQQQQPPYSQQQQPPFSQQQQPPFSQQQQPSFSQQQQQPPFTQQQQPPFSQQSPISQQQQQQQQQQQQPFTQQQQPPFSQQPPISQQQQPPFSQQQQPPFSQQQQIPVIHPSVLQQLNPCKVFLQQQCIPVAMQRCL

SEQ ID NO: 119713 - protein, 326 aa, Triticum aestivum
  Clone ID: PAT_TA_14131.pep
MAMAIAALRREGRRVLLNTPSPAATMAALSPAASQSQIAPLGARSISTQIVRNRMKSVKNIQKITKAMKMVAASKLRAVQTRTENSRGLWQPFTALLGDAPSVNVKKNVIVAITSDKGLCGGINSTSVKVSKALQKMTSGPEKESKYVILGEKGKVQLIRDSRKHIEMTVSELQKNPINYTQVAVLADDILKNVEYDAIRVVFNKFQSVISFRPTLATILSPEVMEKESESGGKVGQLDSYEIEGGETKSEILQNLTEFQFSCVMYNAVLENACSELGARMSAMDSSSRNAGEMLDRLTLTYNRTRQASITTELTEIISGASALEG

SEQ ID NO: 119714 - protein, 202 aa, Triticum aestivum
  Clone ID: PAT_TA_14132.pep
HASAPAPVPPAPLLLHLRPPPRPGRRGGAPPQPIYPLAPPSHHHPPAPSITITNTQRHHHLLPPSPPPPRAPCETKQRVCLVPRASTPSTTRTSLPLPSSALCLLLLLLLPTPLCCSLPMSPAAAPPSCFAPVASLLPLPRCCPSSFPRYSESSPFAAASSPSLHAAVVPLPCCCSFLKKTTLLSFSESPTRCCSFYLFLSL

SEQ ID NO: 119715 - protein, 317 aa, Triticum aestivum
  unsure (1)..(317): unsure at all Xaa locations
  Clone ID: PAT_TA_14133.pep
SICCSDVQWFASADLGLGHGRWEPLGIKHLRAWVAQCRKARSPDRFMVPDHVFGLSDKPVRTFEGHSEDVLDLCWSKSQDLLSSSIDKTVKLWVRASVSCLKTFSRCAYVTCIQFNPVDDRYFVSGSLDEARSALSTSQKGIGHGHDPPEIVTSHHDPLDLQSALVGSHKGSCHLYDTSDNKLIQQRQIDLQTKIRARQGFVPRLQFLGLLLPGSPSSARSAAADSRIRVIDDFELVHKFKGFRNTNSQISACYAARGRYVISASENSHVYMWRNDDXPEQRSGSSKGVVSVANSYEXFYWXDVXVXAXXPSTGSTG

SEQ ID NO: 119716 - protein, 199 aa, Triticum aestivum
  Clone ID: PAT_TA_14134.pep
SIEQQDWYNSIYSRAGLVPMQWIDWDYIDSMDEFSGVRQRCAHVGLEQMMSYHCDWDIELIRQFYSTVYISDDNSSITWMADGRRVTTNKRAWEETFGIAGSIHTARIHSEFFFDDDDKRIMYTAAECTVDQTRGLSPLASIANKIIWKTIYPKSSGSKVHGYNWNLLHHIVEQHPFDIIALIFDEIKLLISDHSPFLK

SEQ ID NO: 119717 - protein, 129 aa, Triticum aestivum
  Clone ID: PAT_TA_14135.pep
RALSRGGGSSPGRRWWWVSGGTSLVGLRRRTAGIVEERWALVRLAARQWSRAARQRNLEAAARDLGLGGGGAMKARSGRSSWRVVGGRPPPSWGVRWCPPGDAGVRVERGGRVRSVPLLRFDLGLGLGS

SEQ ID NO: 119718 - protein, 195 aa, Triticum aestivum
  unsure (1)..(195): unsure at all Xaa locations
  Clone ID: PAT_TA_14136.pep
MAPPSLSSSHLLITASLPKPSSIRPPRLPVSSRPVPALLLALAASPAFPALAVDAPAPLEAAAPQLQLQAEAPTPAANPFADTLLTAPKPGSATQAADIPDGGQWRYSEFLAAVKKGKVERVRFSKDGGMLQLTAVDGRRASVVVPNDPDLIDILATTASHSVAKARRGPGLLAXNCLPYRLALSLRGEAAAGPG

SEQ ID NO: 119719 - protein, 320 aa, Triticum aestivum
  Clone ID: PAT_TA_14137.pep
NYCGRVLNYKKDGTAFWNLLTIAPIKDEDGRVLKFIGMQVEVSKYTEGNKDTVVRPNGLPESLIKYDARQKDQARSSVSELLLALKNPRSLSESSNSTFKRKSQESVGVLTGDGTGHASAESGSRRTSRTGARSSLQKISEVPEGGNKTRKSGLFSLMGLLGMGHGNVEKNMLKPRDEDPLLDSDDERPESFDDELRRKEIRRGIDLATTLERIEKNFVITDPRLPDNPIIFASDSFLQLTEYSREEILGRNCRFLQGPETDRATVRKIRDAIDNQTEVTVQLINYTKSGKKFWNLFHLQPMRDQKGDVQYFIGVQLDGT

SEQ ID NO: 119720 - protein, 739 aa, Triticum aestivum
  unsure (1)..(739): unsure at all Xaa locations
  Clone ID: PAT_TA_14138.pep
EDFHIYCAHFAADVVFTVKAAQPGGAALRGRASRXILHCLGQAMKRHRTLXVHDLCSLQEDHRGPRVHLRRSCQHLPAVARRGGAGRGGQGRPGAPSTLLSQRPGCRAAPCLHELAPVAAPPQAPLCLRRPGKQGLRPEGVLDARRVPRHLFQRRAEPRPPRAPPHLPGCRDQGGRGGGPAWCQVLPRHGGSGARNQIQTARTSVESLGMTWGYMATQDAGTAXYFRGTDVRCVLCPRKPDYGRSAVMGLQTAYMISHHQKIIAVDHDMPVRGSSSRRRIVSFVGGLDLCDGRYDTQFHSLFRTLDTAHHKDFHQLNFVDTSITKGGPREPWHDIHAKIEGPAAWDILYNFEQRWRKQGGDNDLLVDLRALANLIIPPSTVTFPDDQEAWNVQVFRSIDGGASFGFPNTPEQAARSGLVSGKNNTLDRSIQDAYIHAIRRAQHFIYIENQYFLGSSFAWKADDIRPEEIEALHLIPRELSLKIVSKIEAGEHFVAYVVVPMWPEGAPEGGSVQAILDWQRRTMDMMYYDIAIALQAKGIDASPKDYLTFFCLGNREAKRSGEYEPADRPLPGSGYEKAQNARRFMIYVHSKMMIVDDEYIIVGSANINQRSMDGGRDSEIAMGAFQPHHLNTKGQVARGQVHGFRMSLWYEHLGMLHNDFLNPGSRECVQRVNKMADKYWDLYASDELNDDLPGHLLTYPVAVTKDGTVTELPGARCFPDTAAPVLGIKSKHLPPILTT

SEQ ID NO: 119721 - protein, 278 aa, Triticum aestivum
  unsure (1)..(278): unsure at all Xaa locations
  Clone ID: PAT_TA_14139.pep
MAISTDSRSEEKPSQHSQVEKRWVLSDFDVGKALGRGKFGHVYLAREKRSSHIVALKVLFKSQLKQSQVEHQLRREVEIQSHLRPPNTLRLEGWVCDRSRAFPGLVLPATGERRWVXSRCKHFSESRAATXHDYHVDIWSLGILSRVQGELKIADFGWSVHTFNRRRTMCGTLDYLPPEMVEKTEHDYHVDIWSLGILCYEFXLYGLPRFGVKEHSETYRRIVKVDLKFPLKPFVSPAAKDLISQMLVKNSAHRLPLHKVLEHPWIVQNADPSGVYRG

SEQ ID NO: 119722 - protein, 175 aa, Triticum aestivum
  unsure (1)..(175): unsure at all Xaa locations
  Clone ID: PAT_TA_14140.pep
MPTSTLFSMNQQPIFTGVRGRVGAEASADADEDAEAEQPSSPSVKKAXEKGIVVVHEAKCKVYVKHDDATKGWKDIGVGQLSIRCKEGXEKASKESTPTVVIRNDVGKILLNAMIYKGIKMSVQKNTVASIFHTSDAQSESDGGNVVARTYLLRLKNEEAATNLSAVIKENAPLD

SEQ ID NO: 119723 - protein, 164 aa, Triticum aestivum
  Clone ID: PAT_TA_14141.pep
SRGDISCTLQLVCGARDPPAPGPEPNFFHHHHPTESTMDPFLQEYLERLGARLDAYTNAARSLADKLNALDVSWATSSPAVVHNPPSATTSPESTTNASAPVPDVSGSTTKAQEIPTVAHDAAPVCITMVPVTCSTECSTQVDTIDSVDEVHYAATTVHLAKAW

SEQ ID NO: 119724 - protein, 227 aa, Triticum aestivum
  Clone ID: PAT_TA_14142.pep
RHEGSFGENIEVEVNGSTKDTQTFAQQQAKQEMGTLANDDSNRMDDDAIDEEEDAQRRRSRSRKSSKEASNPALAYQLHPLKVVLHVYDTEDPGTKRRKLITLRFEYLAKLNVVCVGSEDSDGMDSNILCNLFPDDTGLELPHQMAKLYAGETPNFSEKDSRPYKWAQHLAGIDFLPEVPQSVGDSSNRASRNADLSSGLALYRQQNRAQTILQRIRSRKIAQMALT

SEQ ID NO: 119725 - protein, 128 aa, Triticum aestivum
  Clone ID: PAT_TA_14143.pep
MRCHGRRSALFAVAVVAAIVAAAAAAEVVHDGRRTYIVHCSHAAMPSEFAAHGDWYASSLQSVSGGAAEVIYTYDTLLHGYSARLTRAEARALEAQPGVLLVNPETRYELHTTRTPEFLGLDRAEALF

SEQ ID NO: 119726 - protein, 183 aa, Triticum aestivum
  Clone ID: PAT_TA_14144.pep
PRVRARRRHCSSSFSSALPLSSPTFAVFGANTGVGKTLVSAGLAASLLRSHAASPSAVLYLKPLQTGFPADSDAGFLYRRVPALVRPSHAAHLVASIDTLSPAPSVETPSPSREEAAFSYDGEGKAVRKLLACRTLYAWREAVSPHLAAEREGMTVEDAHVRSLLAACLAEGETLGKGEGDVC

SEQ ID NO: 119727 - protein, 121 aa, Triticum aestivum
  Clone ID: PAT_TA_14145.pep
PRVRTDNPHTPTRPPPPRPPPRGPPPPPRLPSPSPLSPPGPLLSPPPPPPPEPVRRPAVPPHPRPPRPADRRIRVRARSRGASSAPADPVGVSIRSGRRDPVGLRWAILRPGARIQGGGGG

SEQ ID NO: 119728 - protein, 168 aa, Triticum aestivum
  Clone ID: PAT_TA_14146.pep
MKAKSLPFIALEHKRDAYGFAVRPQHLQRYREYANIYQEEEEERSDRWKNFLDRQAEDDESSGEDAKIAPSIEDEGAVGDAGRTDLPDEKTAKQQRPHKIQIWSEIRPSLGHIGELMSLRVKKKKKQSSADEENTEDIKPSEDSDDEFYDVEKVDPSEGPVADSANAD

SEQ ID NO: 119729 - protein, 93 aa, Triticum aestivum
  Clone ID: PAT_TA_14147.pep
DRLPSLCPATPLEQNLVLPAWKDALLAPEQLQKAGSRSELLVSSFTAFGHALGKFIAYCSTNSSKCRLLVTISTIHAAEAEEEELMKLADSWS

SEQ ID NO: 119730 - protein, 273 aa, Triticum aestivum
  unsure (1)..(273): unsure at all Xaa locations
  Clone ID: PAT_TA_14148.pep
QSPNESGASAGVRVERASWEAYVLANKHFFEKIVEVINPEDDYVWVHDYHLMALPTFLRRRFNRLRIGFFLHSPFPSSEIYRSLPVREEILRTMLNCDLIGFHTFDYARHFLSCCSRMLGIEYQSKRGYIGLDYYGRTVGIKIMPVGIHMGQLQSVLRLPEMQQKVAELRQQFEGMTVLLGVDDTDIFKGINLKLLAFEYMLKTHPKWRXRAVLVQIANPARGKGNDIESIRAEIQDSCERINREFGQSGYSPIVLIDRNVPSVEKLAYYTVA

SEQ ID NO: 119731 - protein, 202 aa, Triticum aestivum
  Clone ID: PAT_TA_14149.pep
PRVRSLPFTAQSVPSADGAGISPPEVLGMPGVSDSKRDPRRDPRRLDPRRTVAPAATSPMQMTVEMTSVHQTNPLSNTLSPLHGKIEKCADYSPDPPNNEDDEHPSSKPHQPMDEKRSEFLDDSTEPDTKFEVYPPVEARFPSSDVNEEMNNPLTPEAISNNGSDSTDLEVGHFSPVSKTSTPEDTNHELPLLPSHLELSDS

SEQ ID NO: 119732 - protein, 288 aa, Triticum aestivum
  unsure (1)..(288): unsure at all Xaa locations
  Clone ID: PAT_TA_14150.pep
MVSVALQSSSTVSLLKLKGMDGLEVIHSFDQPASVSDALTITEKDEAFAVVQHVGSQIEFIVKVTSDLTNEIIREKVDIGQHRATRPKVFLNNYVRTDKSHGFRALVVMEDHSILLIQQGAVVWSREDGLASIVDVMASELPVEKDVVSVADVEHNLFEWLKGHVLKLKGTLMLASVDELAAIQALRVRSSEKNKMTRDHNGFRKLLIVLTKAGKVIALHTGDGRIIWSNLLPSXRASKSGERPSALRIYQWQYPSPRYRNRQTCVENQLVWVLGSDQSKTQHRANTM

SEQ ID NO: 119733 - protein, 885 aa, Triticum aestivum
  unsure (1)..(885): unsure at all Xaa locations
  Clone ID: PAT_TA_14151.pep
HGLADENESVRDAALSAGHIFVEYYATTSLPLLLPAIEDGIFSDNWRIRQSSVELLGDLLFKVAGTSGKAILEGGSDDEGASTEAQGRAIVEVLGRAKRNEVLAAVYMVRSDVSLTVRQAAVHVWKTIVANTPRTLKEIMPVLMDTLISSLASSSSERRQVAGRALGELVRKLGERVLPSIIPILSQGLKDPNASRRQGVCIGLSEVMGSAGKHQLLSFMGELIPTIRTALCDSTQEVRESAGLAFSTLYKSAGLQAIDEIVPTLLRAMEDDETSATALDGLKQILSVRTAAILPHILPKLVQPPLSSFNAHALGALAEVAGPGLSSHIXXTILPTLILAMDDEDVDVQSTAKKAAETIVLRIGDEGVETLIPELLRGVNDNQASMRRGAAYLIGFLFKNSKLYLADEAPDMMSTLITLLSDTDNATVLAAWEAFSRVVGSVPKEQLPTHIKLVRDAVSTARDKERRRRKGVPVLLPGLCLPKALQPFLPIFQQGLISGSAETKEQAAEGLGELIDVTSEKTLREVVVPITGPLIRILGDRFPWQVKSAILSTLTIIIAKGGLALKPFLPQLQTTFVKCLQDSNRSVRTRAASALGKLSALSTRIDPLVSDLLSMLQSGDDAVKESVLSALKGVVRHAGKSVSSAIRSRGCTLLKDLLQADADDVRSSAAKAIGTLSQYMDETETTDLVQTLLSMGTLPDWCTRHGALLTFSSISRHCPTKLCHSTSFPSIVDLLKDSLKDDKFPVREASTKTLGRLLCYQLQFGGSTLQLVQLLILALRDSSTEVRRRSLSCIKAAAKINHSALATHISILGPAIGDTLKDSSSPVRIAAERCAVHVFQLTKGADYVTTAQKHLTNMTGLEVRRLAKLPVESDDSESSDDDRRA

SEQ ID NO: 119734 - protein, 198 aa, Triticum aestivum
  unsure (1)..(198): unsure at all Xaa locations
  Clone ID: PAT_TA_14152.pep
MMGGGLLMDQGMAFSGVHNFVDLLQQNGADKNLGFGSLMPQTSSGDQCVMGEGDLVDPPTNNFPDAGEDDSDDDVDDIEELERRMWRDRMKLKRLKELQQSRGKEQAAGGGGAGDGLKPRQSQEQARRKKMSRAQDGILKYMLKMMEVCRAQGFVYGIIPEKGKPVSGASDNLRAWWKEKGRFDRNXPAGIAKYQADN

SEQ ID NO: 119735 - protein, 679 aa, Triticum aestivum
  unsure (1)..(679): unsure at all Xaa locations
  Clone ID: PAT_TA_14153.pep
MMGGGLLMDQXGMAFFGVHNFVDLLHXNGPDKNLGFGSLMPQAISWAPCVMGHGDLVRTPATNLCVTPGYGHPRPVMGEQATQAHHRSGSXPDAGEDDSRQDGGHIEWLERSMWRDPRNNKLLKELQQSRGNEHAAVSDVVRDRWMPRQSLEQARRKKMSRAHDGIPKYMLKMMVLCRPQGLVYGILPEKRKPVSGASANLRACRNANVPGAPGRPAALAALRAHAALPASAAELPARAASPHSLQELQDTTLGSLLSALMQHCDPPQRRFPLEKGISPPWWPSGDEEWWPELGIPKDQGPPPYKKPHDLKKAWKVSVLTAVIKHMSPDIEKIRRLVRQSKCLQDKMTAKEISTWLAVVKQEEELFMRLHPGARPPASAGGIASAISFNASSSEYDVDVADDCKGDEAGTHKMAMADPTAFNLGAAILNDKFLMQAPMKEETADMEYVQKRSAVAAEPELMLNNRVYTCNNVQCPHSDYGYGFLDRNARTNHRYTCKYNDPLPPSAENKATPPAPPQVFPAAYNQQNHGLNNLDFGLPMDGQRSIAELMNMYDTAFPANNKNMGNDDVTIIERPNAITPVMDEGFFGQGNGIGGNGDSMFSDVSNMMQQQQAQQPQQQQQQQQQAPAQQQFFIRDDAQAXFGNQMGSISGASDFRFGSGFNMSGTVDYPQKNDGPNWYY

SEQ ID NO: 119736 - protein, 72 aa, Triticum aestivum
  Clone ID: PAT_TA_14154.pep
VRLYLLLLGTTALSLVTTPLLLKMIPAVVHLGVLLRWFSVDSNQVELGLKGEVLRNDSGKRINLIIQGPHDS

SEQ ID NO: 119737 - protein, 177 aa, Triticum aestivum
  Clone ID: PAT_TA_14155.pep
RRSKKGGIGGPELLPPPPPAATGNYGGFSMFLRAARPGGNKMMGARGKARVRVRPEEVAEAAYLAASGQPFDVLYYPRASTPEFCVRAAEVRAEMRTQWCPGMRFKMAFETEDSCRISWFMGTVSVVQVADPIRWPNSPWRLLQVTWDEPDLLQNVKRVSPWLVELFSNMPDIHLAP

SEQ ID NO: 119738 - protein, 165 aa, Triticum aestivum
  Clone ID: PAT_TA_14156.pep
MSAKASNMSYRYPDNSQIPYYSSSMHVGGNGTCYVQQNHEDHHYVSSDDGSQNSDSKSQVIHPQYSTLESSSANCVYAANSSTSPQCISGSHISLHDSHSDHTYDSPASGITEVPGLGFTTLQELADALFGSDSDAVSSDRSLVIGAAMHQSNWRELLGISSGDL

SEQ ID NO: 119739 - protein, 131 aa, Triticum aestivum
  unsure (1)..(131): unsure at all Xaa locations
  Clone ID: PAT_TA_14157.pep
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKSAAAXEKEAKSPKK

SEQ ID NO: 119740 - protein, 250 aa, Triticum aestivum
  unsure (1)..(250): unsure at all Xaa locations
  Clone ID: PAT_TA_14158.pep
MKDDKSSNNMNETKWDEEIKKAAEKGQLSNMKECEDILEGERPRGKLLPDEIKPKVEAKFNELGDMCERGELEPEQAFELFKEFEDKMVSECTELMEAEPLTVNELSEADNKSVELNDPPGEGPVLRWESRIVFAPGGDAWHPKNRKVKLSVTVKELGLSRHAFRRLREVVGKRYNSGKDELTIISERFDHREENRKDCLRTLYALXEDAMKADELANAARNAYVKGRLQANSQFMDRLKMKTQKLRQAA

SEQ ID NO: 119741 - protein, 100 aa, Triticum aestivum
  unsure (1)..(100): unsure at all Xaa locations
  Clone ID: PAT_TA_14159.pep
LQGQAIPNVVQGIIWGPQQKQQQHPLGRVSFQKLLEKNPLGQGSFGPFXQNPQAQGFVHPQQLPQFEEIRNLALQTVPAMCKVYIPPNCPMGPFGILGIN

SEQ ID NO: 119742 - protein, 82 aa, Triticum aestivum
  Clone ID: PAT_TA_14160.pep
WLAGTPNSAFAMINPLLVVFCDGRPRRRVGETPQPRRFAEFGIDYKPAMQKGEPNQCDSPCRLFWWSRMTKFLRIRGSVSIA

SEQ ID NO: 119743 - protein, 237 aa, Triticum aestivum
  Clone ID: PAT_TA_14161.pep
RTAPNRPPPLPGRFPLIDLRTAPNLSPSPWPRGEGESARSTNHQSPTRAPRGRGRGQGRARDHHHHKRSSPRHHHLTDSPYNSSSWSLLLDRPTGQEEARSGRRERELAGSARGGDPTRRGALAMLAADDGAGLLGGAADALRAARAQPQPLRGGHGVRCAASARPTPRAPSRASASASPASSPASRAPCAKRRTRPPTRSILLLLLAVGTRALHHGQGAPPLAQRSAAAVLVRLGY

SEQ ID NO: 119744 - protein, 173 aa, Triticum aestivum
  Clone ID: PAT_TA_14162.pep
RPPGQVLDRAQEWVEKLLPDKQKERQGLLYGSLLDERNLLESQANEVASVLSEVEDPFDEIRLEADGLDSRVAALKAKESQKVQQELKSVKSQMDLLIKNFEVQLKNSKLEQYNSIMRKAESATASLAAAHQPTEFAVSDGENKSLYVPQIGDKVYVEGLGGGSMATVVEILK

SEQ ID NO: 119745 - protein, 58 aa, Triticum aestivum
  Clone ID: PAT_TA_14163.pep
LANASGRAAHTRPRRERPSGAVEGPVAVLLPEAGVGRQPGRRPQRLRPDAVQDERRVR

SEQ ID NO: 119746 - protein, 63 aa, Triticum aestivum
  Clone ID: PAT_TA_14164.pep
NPLGQGSFRPFKENPQAQGFVHPQQMPRFEEIRTLGVQTFPAMCKVYTPPNCPMGPFGILGDN

SEQ ID NO: 119747 - protein, 304 aa, Triticum aestivum
  Clone ID: PAT_TA_14165.pep
MASTMPFSAGLVSLGSPPPQRHSCRLQRYQRPCTLISSAIRHGQVKAMAGVSMDGLAQPQAPVAVVTGASRGIGRAIAVALGKAGCKVVVNYAKSGMEAEEVRREIVESGGTAISFSADVSIEAEVETMMRAAIDTWGTLDVLVNNAGITRDALLMRMKRAQWQEVVDVNLTGVYLCAQAAAAVMMKRKKGRIINIASVAGMIGNIGQANYCAAKAGVIGLTKAMAREYGGRNINVNAVSPGWVASDMTAKLGDDIERKALETIPLGRFGKPEEIAGLVEFLAVHPAASYMTGQVLPVDGGLSI

SEQ ID NO: 119748 - protein, 178 aa, Triticum aestivum
  Clone ID: PAT_TA_14166.pep
MVGSGMQRGAPLVVGRVIGDVVDPFVRRVALRVGYASRDVANGCELRPSAIADPPRVEVGGPDMRTFYTLVMVDPDAPSPSDPSLREYLHWLVTDIPGTTGVSFGTEVVCYEGPRPVLGIHRLVFLLFQQLGRQTVYAPGWRQNFSTRDFAELYNLGLPVAAVYFNCQRETGTGGRRM

SEQ ID NO: 119749 - protein, 103 aa, Triticum aestivum
  Clone ID: PAT_TA_14167.pep
SHVSPLYYTELSVALGSKSNGTFRTDACPGTEVVCYEGPRPVLGIHRLVFLLFQQLGRQTVYAPGWRQNFSTRDFAELYNLGLPVAAVYFNCQRETGTGGRRM

SEQ ID NO: 119750 - protein, 180 aa, Triticum aestivum
  Clone ID: PAT_TA_14168.pep
MVGSGMHAQRGDPLVVGRVIGDVVDPFVRRVALRVGYASRDVANGCELRPSAIADPPRVEVGGPDMRTFYTLVMVDPDAPSPSDPSLREYLHWLVTDIPATTGVSFGTEVVCYEGPRPVLGIHRLVFLLFQQLGRQTVYAPGWRQNFSTRDFAELYNLGLPVAAVYFNCQRETGTGGRRM

SEQ ID NO: 119751 - protein, 224 aa, Triticum aestivum
  unsure (1)..(224): unsure at all Xaa locations
  Clone ID: PAT_TA_14169.pep
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIGVDSXDGVSHTVPIYEGYAPSHANLRLELAGRDLTDWWRRILTERVTPYPHRQTENWRGHQGNLAKLALCF

SEQ ID NO: 119752 - protein, 250 aa, Triticum aestivum
  unsure (1)..(250): unsure at all Xaa locations
  Clone ID: PAT_TA_14170.pep
AVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDHLMKILTERGYSFTTTAEREIVRDVKEKLSYIAXDYDQEMETSRTSSFGEKSYELPDGQVITNXSERFRCPEGLFPAIFIGKETAGIHGNY

SEQ ID NO: 119753 - protein, 51 aa, Triticum aestivum
  Clone ID: PAT_TA_14171.pep
DDGAYSIPLPVATVRQTDRHREETAVHYRVLAKMRKPQYRSRSEKQKDDLK

SEQ ID NO: 119754 - protein, 116 aa, Triticum aestivum
  Clone ID: PAT_TA_14172.pep
MAPKAEKKPAAKKPVEEEPAAEKAEKAPAGKKPKAEKRLPAAGKTSAKDGDKKAKKKSKKSVETYKIYIFKVLKQVHPDIGISSKAMSIMNSFINDIFEKHAVSEGTKAVTKFTSS

SEQ ID NO: 119755 - protein, 140 aa, Triticum aestivum
  Clone ID: PAT_TA_14173.pep
MEHKETGCQSREGPILCVNNCGFFGSAATMNMCSKCHKEMAMKQEQAKLAASSFDSIVNGGDAAKEHLAAGNTAVAVAHVEAKTLITAQPADIAGPSEAAMENPKGPSRCSTCRKRVGLTGFNCRCGNLYCATHRYSDKI

SEQ ID NO: 119756 - protein, 120 aa, Triticum aestivum
  Clone ID: PAT_TA_14174.pep
NIKEIFFTPIPASRNNFGARVPQEQGLRPRSTNGFMSPNMGRAVGDIEMGRKPVAWDEPRMAAEIGDLGGLGNLLEDKDGRFRNASPDLSRDALVVGGLDEQGSSVMNPPRTSWGVEAGR

SEQ ID NO: 119757 - protein, 181 aa, Triticum aestivum
  Clone ID: PAT_TA_14175.pep
IRTRVLPTSAEGEIVRDIKEKLAYIALDYEQELETAKNSSSVEKSYELPDGQVITIGAERFRCPEVLFQPSMIGMEAAGIHETTYNSIMKCDVDIRKDLYGNIVLSGGSTMFPGIADRMSKEITSLAPSSMKIKVVAPPERKYSVWIGGSILASLSTFQQMWISKEEYDESGPAIVHRKCF

SEQ ID NO: 119758 - protein, 191 aa, Triticum aestivum
  unsure (1)..(191): unsure at all Xaa locations
  Clone ID: PAT_TA_14176.pep
GMGQKDAYVGDEAQSKRGILTLKYPIEHGIVSNWDDMEKIWHHTFYNELRVAPEEHPVLLTEAPLNPKANREKMTQIMFETFSVPAMYVAIQAVLSLYAXSGRTTGYCPGILGDGVSHTVPIYEGYALPHAILRLDLAGRDSXSLNEVLTERVTLHNTAEREMSVTQGNLHIRARYEQESRRKSVRNAMMN

SEQ ID NO: 119759 - protein, 102 aa, Triticum aestivum
  unsure (1)..(102): unsure at all Xaa locations
  Clone ID: PAT_TA_14177.pep
MADGEDIQPLVCDNGTGMVKAGFAGDDAPRAVFPSIVGRPRHTGVMVGMGQKDAYVXGDEAQSKRVSHLNYRLHXIVTTGDDMENLDILPTTLLHQDTCFSL

SEQ ID NO: 119760 - protein, 187 aa, Triticum aestivum
  unsure (1)..(187): unsure at all Xaa locations
  Clone ID: PAT_TA_14178.pep
RDLTDNLMKILTERGYSFTTTAEREIVRDIKEKLAYVALDYEQELETARTSSSVEKSYELPDGXVITIGAERFRCPEVLFQPSFIGMESAGIHEATYNSIMKCDVDIRKDLYGNVVLSGGSTMFPGIGDRMSKEILHLPQQHEVSGCSPERISVWIGGHLAPSTSQCDRLQGISINLEFGHRLLINC

SEQ ID NO: 119761 - protein, 213 aa, Triticum aestivum
  Clone ID: PAT_TA_14179.pep
VPIYEGYALPHAILRLDLAGRDLTDCLMKILTERGYSFTTTAEREIVRDIKEKLAFVALDYEQELETAKSSSSVEKSYELPDGQVITIGAERFRCPEVLFQPSLIGMEAPGIHETTYNSIMKCDVDIRKDLYGNIVLSGGTTMFPGIADRMSKEISALAPSSMKIKVVAPPERKYSVWIGGSILASLSTFQQMWISKEEYDESGPAIVHRKCF

SEQ ID NO: 119762 - protein, 76 aa, Triticum aestivum
  Clone ID: PAT_TA_14180.pep
MAKEREDRKRERANKTAGEKWRSMSDEEKAKYGGKKADAPASKVVNKKESTSSKKAKTDADEEGSDVEDDAEEDEE

SEQ ID NO: 119763 - protein, 160 aa, Triticum aestivum
  Clone ID: PAT_TA_14181.pep
MQSTPAMKMGPYGGPGGNHWDINALNPPKKIVSIQIWSTDSSCEGASGVINGISFSYLDMAGQLIPSGPWGSQTGKPHVINIGEDERLITVYGTSDGKFVTSLKFVTDRASDPYGPYGAPSTISTFSFQGGSILAFLGRSSDKLNAIGAYQTWGLIHLTI

SEQ ID NO: 119764 - protein, 124 aa, Triticum aestivum
  Clone ID: PAT_TA_14182.pep
FAAERKWALGLQSRAHPREIITEVLKALQELNVCWKKIGHYNMKCRWSPGFVETMMHNNNGFGVESAIIEADGLSDKSTHIVKFEIQLYKTRDEKYLLDLQRVSGPQLLFLDLCSAFLTQLRVL

SEQ ID NO: 119765 - protein, 143 aa, Triticum aestivum
  Clone ID: PAT_TA_14183.pep
MEHKETGCQSREGPILCVNNCGFFGSAATMNMCSKCHKEMAMKQEQAKQAVAHVEAKTLITAQPADIAGPSEAAMENPKGPSRCSTCRKRVGLTGFNCRCGNLYCATHRYSDKHECKFDYRAAAMDAIAKANPVVKAEKLDKI

SEQ ID NO: 119766 - protein, 181 aa, Triticum aestivum
  unsure (1)..(181): unsure at all Xaa locations
  Clone ID: PAT_TA_14184.pep
EKLAYVALDYEQELENAKSSSSVEKSYELPDGQVITIGAERFRCPEVLFQPSFIGXMKLLGIHETTYNSIMKCDVGXIRKDLYGNIVLKWWLKLCSPGIADRMSKEITALAPSNMKXKVVDRLERXYSVPGFGGPSFLPLIPSKQMWFPKGDMIIKSNISTFQIPIVRSGPSGCLNLQVST

SEQ ID NO: 119767 - protein, 229 aa, Triticum aestivum
  unsure (1)..(229): unsure at all Xaa locations
  Clone ID: PAT_TA_14185.pep
PQGQQGVLAGRDLTDYLMKILTERGYSFTTTAEREIVRDVKEKLSYIALDYDQEMETSKTSSSVEKSYELPDGQVITIGSERFRCPEVLFQPSFIGMEAAGIHETTYNSIMKCDVDIRKDLYGNIVLKWVGTTMFTGNPLDRMSKEITALGSLSSMKIKLLLPPWKGXTVSWXXGFTLDLLNTFPAMLDAKLDYDDPGHQWTGIFNSSGPKEPRDLNATSSIWCSCNVE

SEQ ID NO: 119768 - protein, 117 aa, Triticum aestivum
  Clone ID: PAT_TA_14186.pep
FTQLVVYHLRTSGSSVLSDTGLISFIRQCQIIRKNGRRKARGILQWRGVGYKLNHRKSAETRSKTRPQGLEALAVDDGGARFVVLSLGYPHLLECAEGGEDGATDPDTILPLGRRHD

SEQ ID NO: 119769 - protein, 209 aa, Triticum aestivum
  Clone ID: PAT_TA_14187.pep
VVKGQNAPPRDSNYPDLYIFRQIKEPRTHILYVPHGEKRVSCYFTHLLGRSATVKRQNPLRFNLHYRYSFAHSHLSSSLALPKTSHSCFLHRLLPCQPLLLLRRRFRALPSSTALALTLLLVLVLVTFPLGMFETVQLLPLELREPLGLCCCCRLLYIPGALPLHRLLGRALGGFLIGGLLVAVEWVAEVLDALDKRGAGGLGTAAPGC

SEQ ID NO: 119770 - protein, 160 aa, Triticum aestivum
  unsure (1)..(160): unsure at all Xaa locations
  Clone ID: PAT_TA_14188.pep
LSYIALDYDQEMETSKTSSSVEKSYELPDGQVITIGSERFRCPEVLFQPSFIGMEAAGIHETTYNSIMKCDVDIRKDLYGNIVLSGGTTMFTGIADRMSKEITALAPSSMKIKVVAPPERKYSVWIGGSILASLSTFQQMWIAKAEYDESXPSIVHRKCF

SEQ ID NO: 119771 - protein, 156 aa, Triticum aestivum
  unsure (1)..(156): unsure at all Xaa locations
  Clone ID: PAT_TA_14189.pep
MADGEDIQPLVCDNGTGMVKAGFAGDDAPRAVFPSIVGRPRHTGVMVGMGQKDAYVGDEAQSXKRGILTLKYPIEHGIVSNWXDDMEKXWHHXFYNDSVLPRRTPVLLTEVLEPKXNKEKMTRLFSXFNVPAMYVAIQSILSPYANGXTXGIVXXP

SEQ ID NO: 119772 - protein, 202 aa, Triticum aestivum
  Clone ID: PAT_TA_14190.pep
MEMKPAVQPVTGVPVGAAPVAWSSGLFDCFDDCGLCCVTYWCPCITFGKVAEIVDRGSTSCGTSGALYALLCSLTGCQWIYSCTYRSKMRAQYALPDGPCCDCCVHFCCEPCALVQQYKELKARGYDPEIGWHLNMERHSAGRCQPARRARRWAASWLAGRIQLLLYLLPFAFASFVFDKLSHILYLYAVTCVSMLDGDVMT

SEQ ID NO: 119773 - protein, 52 aa, Triticum aestivum
  Clone ID: PAT_TA_14191.pep
SHKHTVTMHKHRYSVLVLALAPWSRHVYRWHIPRVLTSRLEKNIACKYAIHF

SEQ ID NO: 119774 - protein, 230 aa, Triticum aestivum
  unsure (1)..(230): unsure at all Xaa locations
  Clone ID: PAT_TA_14192.pep
RELAYIHNCVGICHRDIKPQNVLVNPHTHQLKICDFGSAKVLVKGEPNISYICSRYYRAPELIFGATEYTTAIDLWSTGCVMAKLLLGQXPLFPGESGVDQLVEIIKVLGTPTREEIKCMNPNYTEFKFPQIKAHPWHKVFQKKLPPEAMDLVSRFLQYSPDLRCTAMEACMHPFFDELRDPNTRLPNGRPLPPLFNFRSQELNGIPPEVVERLVPEHARRQNLFMALRT

SEQ ID NO: 119775 - protein, 164 aa, Triticum aestivum
  unsure (1)..(164): unsure at all Xaa locations
  Clone ID: PAT_TA_14193.pep
EKLAYIALDYEQELETAKNSSSVEKSYELPDGQVITIGAERFRCPEVLFQPSMIGMEAAGIHETTYNSIMKCDVDIRKDLYGNIVLSGWVPTMFPGIADXRMSKEITSLAPSSMKIKVVAPPERKYSVWIGGSILASLSTFQQMWISKEEYDESGPAIVHRKCF

SEQ ID NO: 119776 - protein, 234 aa, Triticum aestivum
  Clone ID: PAT_TA_14194.pep
MDTCSFHPNEGWLEEDLRATETGRVGGRVGGRVGGRVGFNVPAMYVAIQAVLSLYASGRTTGIVLDSGDGVSHTVPIYEGYALPHAILRLDLAGRDLTDSLMKILTERGYSFTTSAEREIVRDIKEKLAYVALDYEQELETAKNSSSVEKSYELPDGQVITIGAERFRCPEVLFQPSMIGMESSGIHETTYNSIMKCDVDIRKDLSAPHSAAVPHRRPRPHPPQSPNRSPAPPP

SEQ ID NO: 119777 - protein, 86 aa, Triticum aestivum
  Clone ID: PAT_TA_14195.pep
PDVLQNCSKPSIDLTFQICSMTKTLSANHDAMETMAHSSICDLDLKQLNDRYRLVSLGLIRSTSCGRSTGRFHRTLPWRSTSAGRY

SEQ ID NO: 119778 - protein, 178 aa, Triticum aestivum
  Clone ID: PAT_TA_14196.pep
MKVKPGTEPATGVPVGGAPGTPTAWSSTGVPFGGAPGAPTAWSSGLFDCFDDCGLCCLTCCCPCITFGKVAEIVDRGATSCGTSGALYVLLASLTGCHWIYSCTYRSKMRAQYALPDEPCCDCCVHYCCEPCALVQEYKELKARGYDPEIGWHLNVERRNGGAGAGGVNPPGMQQMGR

SEQ ID NO: 119779 - protein, 318 aa, Triticum aestivum
  unsure (1)..(318): unsure at all Xaa locations
  Clone ID: PAT_TA_14197.pep
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILXTERGYSFTTQAEREIVRDIKEKLAYVALDYEQELETAKNSPRLRRXYELPDGXVITIGRREVRCPEAXLPASMIGWILWNHETXYNSIMXCDVDIXKDCMEHCPWWTTFQVYVDKNTCSTHK

SEQ ID NO: 119780 - protein, 195 aa, Triticum aestivum
  Clone ID: PAT_TA_14198.pep
AGRDLTDSLMKILTERGYSFTTSAEREIVRDIKEKLAYIALDYEQELETAKNSSSVEKSYELPDGQVITIGAERFRCPEVLFQPSMIGMEAAGIHETTYNSIMKCDVDIRKDLYGNIVLSGGSTMFPGIADRMSKEITSLAPSSMKIKVVAPPERKYSVWIGGSILASLSTFQQMWISKEEYDESGPAIVHRKCF

SEQ ID NO: 119781 - protein, 152 aa, Triticum aestivum
  Clone ID: PAT_TA_14199.pep
MAPKAEKKPAAKKPAEEEPAAEKAEKAPAGKKPKAEKRLPSAGKTSAKDGDKKSKKKSKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 119782 - protein, 287 aa, Triticum aestivum
  Clone ID: PAT_TA_14200.pep
DAWAGCQVSLSGLPASAAARRRAGIGRELTAPAAGGGAGAGAREGALRRPCRDPGRDPAGDCWPGSAAAMNGPSAGSGSGGEGPLVYQAWKGNNGRFIFGPDARSLFVTMFLIIAPVTVFCVFVAKELMNSFSYGLGLPVMVVAVVFTAYDLSLLFLTSGRDPGIIPRNAHPPEPEGFEGNAEVGANQTPPLRLPRVKDVVVNGITVKTKYCDTCMLYRPPRCSHCSICNNCVERFDHHCPWVGQCIGLRNYRFFYMFVFSTTLLCLYVFGFSWVYIIKIRDAEQIT

SEQ ID NO: 119783 - protein, 109 aa, Triticum aestivum
  Clone ID: PAT_TA_14201.pep
ASRNNFGARVPQEQGLRPRSTNGFMSPNMGRAVGDIEMGRKPVAWDEPRMAAEIGDLGGLGNLLEDKDGRFRNASPDLSRDALVVGGLDEQGSSVMNPPRTSWGVEAGR

SEQ ID NO: 119784 - protein, 311 aa, Triticum aestivum
  unsure (1)..(311): unsure at all Xaa locations
  Clone ID: PAT_TA_14202.pep
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEGAPXVCLTEAPLNPKANREKMTQIMFETFNVPAMYVAIQAVLSLYASGRTTGIVLDSGDGVSHTVPIYEGYALPHAILRLDLAGRDLTDCLMKILTERGYSFTTTAEREIGKXDSKEKLAYVVLDYEQEXENAKSSSSXVEKSYELPDGQEITALAPSSMKIKVVAPPERKYSVWIGGSILASLSTFQQMWISKGEYDESGPAIVHRKCF

SEQ ID NO: 119785 - protein, 155 aa, Triticum aestivum
  Clone ID: PAT_TA_14203.pep
MEMKPAAQPVTGVPVGAAPAAWSSGLFDCFDDCGLCCVTYWCPCITFGKVAEIVDRGSTSCGTSGALYALLCSLTGCQWIYSCTYRSKMRAQYALPDGPCCDCCVHFCCEPCALVQQYKELKARGYDPEIGWHLNMERRAGAGAVNPPGVQGMGR

SEQ ID NO: 119786 - protein, 174 aa, Triticum aestivum
  Clone ID: PAT_TA_14204.pep
LFSTTGYLGAGYQESMESSFSPITPSETQSPAHGNRQQPYMESPVALRPHFPADRKWALGLQSRAHPREVMTEVLKALQELNVYWKKIGHYNMKCRWSPPGFPGQENMNHTNYNFSAEPIETDDLGDKLNLIKFELQLYKTRDEKYLLDLQRASGPHLLFLDLCAAFLAQLRVL

SEQ ID NO: 119787 - protein, 155 aa, Triticum aestivum
  Clone ID: PAT_TA_14205.pep
MEMKPAAQPVTGVPVGAAPAAWSSGLFDCFDDCGLCCVTYWCPCITFGKVAEIVDRGSTSCGTSGALYALLCSLTGCQWIYSCTYRSKMRAQYALPDAPCCDCCVHFCCEPCALVQQYKELKARGYDPEIGWHLNMERRAGAGAVNPPGVQEMGR

SEQ ID NO: 119788 - protein, 208 aa, Triticum aestivum
  unsure (1)..(208): unsure at all Xaa locations
  Clone ID: PAT_TA_14206.pep
MACSFGLRKKKKKREIVRDIKEKLAYVALDYEQELETAKNSSSVEKSYELPDGQVITIXXERFRCPEVLFQPSMIGMESSGIHETTYNSIMKCDVDIRKDLYGNIVLSGGTTMFPGIADRMSKEITALAPSSMKIKVVAPPERKSNINSVLLPKKSPAAVGDGDAGEQPAKLLIVADGEQQVARDDAGLLVVLGRVARKLQHLGRDHA

SEQ ID NO: 119789 - protein, 465 aa, Triticum aestivum
  unsure (1)..(465): unsure at all Xaa locations
  Clone ID: PAT_TA_14207.pep
MAFGRGAKMDGRRPSSPSSSMCTTTTVVVFVALCLVGAWMMTSTTVFPVEPTSNKKSEPIEVSTSNKKTEVKDQRAEVGFGETDEAAKSGSVSSEKFEDTDNNDNVPDESHSNRDAPEEEKFPENTMEKPVEMAEEKESPKEKEDSKDSFDDANGKSEGQSAKEGGVTGQSGDEEEKITTDNDVEKSDGEKKEDQEGKSEDDATEQPQIEEKVEESGEKEPAAKANEVFPDGAQSELLKESNTENGSFPTQAAESKNEKEAQAASKSSGDEITYSWKLCNSSAVTDYIPCLDNEKAIKKLHSTKHYEHRERHCPAEPPTCLVPLPEGYKHPIEWPKSMDKVWYSNVPHTKLAEYKGHQNWVKVSGDHLLFPGGGTQFKNGALHYIDTIQQALPDIAWGKRSRVILDVGCGVATLGGYMFXRDVLTMSFAPKKTSXTQITFALPRGNSQHTTVMGTKXLPYPTRFL

SEQ ID NO: 119790 - protein, 191 aa, Triticum aestivum
  Clone ID: PAT_TA_14208.pep
MSTPAMKMAPYGGPGGNHWDINALNPPKKIVSIQIWSTDSSCEGASGVINGISFSYLDMAGQLIPSGPWGSQTGKPHVINIGEDERLITVYGTSDGKFVTSLKFVTDRASDPYGPYGAPSTISTFSFQGRLHPRLLGAAPQEKLNAIGAYKLGVGSIYPSWPAYVSADFRKFWLPFEHVFRPSTACIFKLN

SEQ ID NO: 119791 - protein, 153 aa, Triticum aestivum
  Clone ID: PAT_TA_14209.pep
MQSTPAMKMGPYGGPGGNHWDINALNPPKKIVSIQIWSTDSSCEGASGVINGISFSYLDMAGQLIPSGPWGSQTGKPHVINIGEDERLITVYGTSDGKFVTSLKFVTDRASDPYGPYGAPSTISTFSFQGGSILAFLGRSSDKLNAIGAYKLV

SEQ ID NO: 119792 - protein, 254 aa, Triticum aestivum
  Clone ID: PAT_TA_14210.pep
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNAPAMYVAIQAVLSLYASGRTTGIVLDSGDGVSHTVPIYEGYALPHAILRLDLAGRDLTDSLMKILTERGYSFTTTAEREIVRDIKEKLAYVALDYEQELETAKSSSSVEKSYELPDGQVITIGA

SEQ ID NO: 119793 - protein, 157 aa, Triticum aestivum
  Clone ID: PAT_TA_14211.pep
MKPGTEPATGVPVGGAPGAPTAWSSGLFDCFDDCGLCCLTCWCPCITFGKVAEIVDRGATSCGTSGALYVLLASLTGCHWIYSCTYRSKMRAQYALPDAPCCDCCVHYCCEPCALVQEYKELKARGYDPEIGWHLNQERRNGGAGGVNPPGMQEMGR

SEQ ID NO: 119794 - protein, 194 aa, Triticum aestivum
  unsure (1)..(194): unsure at all Xaa locations
  Clone ID: PAT_TA_14212.pep
GDLTDXLMKILTERGYSFTTTAEREIVRDMKEKLSYIALDYDQEMETSKTSSSVEKSYELPDGQVITIGAERFRCPEVLFQPSFIGMEAAGIHETTYNSIMKCDVDIRKDLYGNIVLSGGTTMFXPGIADRMSKEITALAPSSMKIKVVAPPERKYSVWIGGSILASLSTFQQMWIAKAEYDESGPSIVHRKCF

SEQ ID NO: 119795 - protein, 216 aa, Triticum aestivum
  Clone ID: PAT_TA_14213.pep
IDEESLVKVISLGFDKNLLVESIHNRLQNEVTVAYYLFLDNKSRTTTGYLGAGYQEAMESSFSPITPSETQSPAHGNRQQPYMESPVGLRPHFPADRKWALGLQSRAHPREVMTEVLKALQELNVYWKKIGHYNMKCRWSPPGFPGQENMSHTNYNFSAEPIETDDLGDKLNLIKFELQLYKTRDEKYLLDLQRASGPHLLFLDLCAAFLAQLRVL

SEQ ID NO: 119796 - protein, 198 aa, Triticum aestivum
  Clone ID: PAT_TA_14214.pep
MDAAGRDANPLAGYRIGKTLGIGSFGKVKIAEHIITGHKVAIKILNRRKIKSMEMEEKVKREIKILRLFMHPHIIRLYEVIDTPADIYVVMEYVKSGELFDYIVEKGRLQEEEARRFFQQIISGVEYCHRNMVVHRDLKPENLLLDSKCNVKIADFGLSNVMRDGHFLKTSCGSPNLRYLVIVRLCCIILSSCWLLQS

SEQ ID NO: 119797 - protein, 439 aa, Triticum aestivum
  Clone ID: PAT_TA_14215.pep
TRPGASGFTGKYVIREALKFLPPNASPLRSLALAGRSRDRVAAALRWAAAPGPAPDVPILVADASDPASLAAVAARARVLLSCAGPFRLHGRQVAAACAEAGADCLDISGEPEFMERVEADLHEVAAKNGSLIVSACGFDSIPAELGFLFNSRQWTPPSAPLSVVAYVNLESDRKIVGNFGTFQSAVLGVANASELQALRRSRPRPAKPRIPGPPPPKGSLIEHDKALGLWVMKLPSADTVVVKRTLAKVTEHPEGLPGADETPEFAEHRKEFWSSIKPAHFGMKISSRSILGLFWWLCTGLFIGILGGFSFGRSLLLKFPEFFSIGLFRKTGPTEEEVRSASFKMWFIGRGYSDLARASERGGKPDKEIVTRVSGPEIGYITTPIVLVQCALVLLSQRANLPKGGVYTPGAVFGPTDLQKRLEENGLSFELISARTLP

SEQ ID NO: 119798 - protein, 328 aa, Triticum aestivum
  unsure (1)..(328): unsure at all Xaa locations
  Clone ID: PAT_TA_14216.pep
MSCSHLSTAWSSSALASTSTRRRASTGSSSSLVVRCSLRDLRNRIDSVRNTQKITEAMKLVAAAKVRRAQEAVVSSRPFSEALVEVLYNMNQEIQSEDIDLPLTRQRAVKRVAIVVLTGERGLCGAFNNNVLKKAEARMEDLRQLGVDYTVISVGKKGNAYFQRRDYIPTERFLELAGIPTVKDSQAICDLIYSLFVAEEVDKVELVYSKFVNLVRSDPIIQTLLPMSPKGEICDVNGICVDATEDELFKLTTKEGKLTVXEREKIKIEMQPFSPVVQFEQDPSDLDVSSVYLNSSLRASRVVASNSRKMTHHRHASLKHGKRQQTGV

SEQ ID NO: 119799 - protein, 292 aa, Triticum aestivum
  unsure (1)..(292): unsure at all Xaa locations
  Clone ID: PAT_TA_14217.pep
VWDLTNPVPSLGDGTVGTDYAVPFRRLTGHGHFVQDVVISSDGQFALSGSWDGELRLWDLSTGLTTRRFVGHTKDVISVAFSVDNRQIVSASRDNTIKLWNTLGECKYTIXGGDMGGGEGHTGWVSCVRFSPNIQQPTIVSGSWDKTVKVWNLTNCKLRSTLAGHGGYVNAVAVSPDGSLCASGGKDGVTLLWDLSEGKRLYQLEAGSIIHALCFSPNRYWLCAATEESVKIWDLESKHVVQDLKPEVQVSKNQMLYCTSLSWSADGSTLYTGYTDGTIRVFKIQAGFAGYA

SEQ ID NO: 119800 - protein, 145 aa, Triticum aestivum
  Clone ID: PAT_TA_14218.pep
VVAVKKLVVGPWAGSAGPPHGEHRPTRPFGRHRAPSLNWPGVSGIVTLKKLECSKQANRYWLCAATEESVKIWDLESKHVVQDLKPEVQVSKNQMLYCTSLSWSADGSTLYTGYTDGTIRVFKIQAGFAGFFFFFFFQSSRFLFH

SEQ ID NO: 119801 - protein, 499 aa, Triticum aestivum
  unsure (1)..(499): unsure at all Xaa locations
  Clone ID: PAT_TA_14219.pep
AAGRDANPLAGYRIGKTLGIGSFGKVKIAEHIITGHKVAIKILNRRKIKSMEMEEKVKREIKILRLFMHPHIIRLYEVIDTPADIYVVMEYVKSGELFDYIVEKGRLQEEEARRFFQQIISGVEYCHRNMVVHRDLKPENLLLDSKCNVKIADFGLSNVMRDGHFLKTSCGSPNYAAPEVISGKLYAGPEVDVWSCGVILYALLCGTLPFDDENIPNLFKKIKGGIYTLPSHLSPLARDLIPRMLVVDPMKRITIREIREHSWFKARLPRYLAVPPPDTXAQQVKKLDDETLNDVIKMGFDKNKLTESLQKRLQNEATVAYYLLLDNKLRTTSGYLGAEYQESMDSSFSQVSPETPSSASEARQYGSPGFGLRHHFAAERKWALGLQSRAHPREIITEVLKALQELNVCWKKIGHYNMKCRWSPGFVETMMHNNNGFGVESAIIEADGLSDKSTHIVKFEIQLYKTRDEKYLLDLQRVSGPQLLFLDLCSAFLTQLRVL

SEQ ID NO: 119802 - protein, 153 aa, Triticum aestivum
  Clone ID: PAT_TA_14220.pep
MSTPAMKIGPYGGPGGNHWDINALNPPKRLVSIQIWSTDSSCEGAGGVVNGISFSYLDMAGQLIPSGPWGSQTGKPHVINIGEDERLITVYGTSDGKFVTSLKFVTDRASDPYGPYGAPSTISTFSFQGGSILAFLGRSSEKLNAIGAYKLGV

SEQ ID NO: 119803 - protein, 376 aa, Triticum aestivum
  unsure (1)..(376): unsure at all Xaa locations
  Clone ID: PAT_TA_14221.pep
MAEEDVQPIVCDNGTGMVKAGFAGDDAPRAVFPSIVGRPRHTGVMVGMGQKDAYVGDEAQSKRGILTLKYPIEHGVVGNWDDMEKIWHHTFYNELRVAPEEHPVLLTEAPMNPKANRXKMTQIMFETFSCPAMYVAIQAVLSLYASGRTTGIVMDSGDGVSHTVPIYEGFTLPHAIIRLDLAGRDLTDGLMKIMTERGYSFTTTAEREIVRDIKEKLAYVALDYEQELETARTSSAVEKNYELPDGQVITIGAERFRCPEVLFQPSMIGMEAAGIHEATYNSIMKCDVDIRKDLYGNVVLSGGSTMFPGIADRMNKEITALAPSSMRVKVVAPPERKYSVWIGGSILASLSTFQQMWISKAEYDETGPSIVHMKCF

SEQ ID NO: 119804 - protein, 87 aa, Triticum aestivum
  unsure (1)..(87): unsure at all Xaa locations
  Clone ID: PAT_TA_14222.pep
MSHSVKIYDTCIXGCTQCVRACPTRCIXEMIPLGMGCKSQSKLLPPPRTXEDCVGCKRCESACPTDFLSVRVXIKGLETTRSMALSY

SEQ ID NO: 119805 - protein, 377 aa, Triticum aestivum
  unsure (1)..(377): unsure at all Xaa locations
  Clone ID: PAT_TA_14223.pep
MADGEDIQPLVCDNGTGMVKAGFAGDDAPRAVFPSIVGRPRHTGVMVGMGQKDAYVGDEAQXKRGILTLKYPIEHGIVSNWDDMEKIWHHTFYNELRVAPEEHPVLLTEAPLNPKANREKMTQIMFETFNAPAMYVAIQAVLSLYASGRTTGIVLDSGDGVSHTVPIYEGYALPHAILRLDLAGRDLTDSLMKILTERGYSFTTTAEREIVRDIKEKLAYVALDYEQELETAKSSSSVEKSYELPDGQVITIGAERFRCPEVLFQPSLIGMEAPGIHETTYNSIMKCDVDIRKDLYGNIVLSGGTTMFPGIADRMSKEITALAPSSMKIKVVAPPERKYSVWIGGSILASLSTFQQMWISKGEYDESGPSIVHRKCF

SEQ ID NO: 119806 - protein, 292 aa, Triticum aestivum
  unsure (1)..(292): unsure at all Xaa locations
  Clone ID: PAT_TA_14224.pep
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAXGRDLTDHLMKILTERGYSFTTTAEREIVRDVKEKLSYIALDYDQEMETSKTSSSVEKSYELPDGPGITIGSERFPCPEVLFQPFLIGMEAAGIHENYYNSFIKGHVDF

SEQ ID NO: 119807 - protein, 110 aa, Triticum aestivum
  Clone ID: PAT_TA_14225.pep
VIRAKKKKKKNSRAHPWHKVFQKKLPPEAMDLVSRFLQYSPDLRCTAMEACMHPFFDELRDPNTRLPNGRPLPPLFNFRSQELNGIPPEVVERLVPEHARKQNLFMALRT

SEQ ID NO: 119808 - protein, 377 aa, Triticum aestivum
  Clone ID: PAT_TA_14226.pep
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNAPAMYVAIQAVLSLYASGRTTGIVLDSGDGVSHTVPIYEGYALPHAILRLDLAGRDLTDSLMKILTERGYSFTTTAEREIVRDIKEKLAYVALDYEQELETAKSSSSVEKSYELPDGQVITIGAERFRCPEVLFQPSLIGMEAPGIHETTYNSIMKCDVDIRKDLYGNIVLSGGTTMFPGIADRMSKEITALAPSSMKIKVVAPPERKYSVWIGGSILASLSTFQQMWISKGEYDESGPSIVHRKCF

SEQ ID NO: 119809 - protein, 153 aa, Triticum aestivum
  Clone ID: PAT_TA_14227.pep
MSMPAMKMGPYGGPGGNHWDINALNPPKKIVSIQIWSTDSSCEGASGVINGISFSYLDMAGQLIPSGPWGSQTGKPHVINIGEDERLITVYGTSDGKFVTSLKFVTDRASDPYGPYGAPSTISTFSYQGGSILAFLGRSSDKLNAIGAYKLGV

SEQ ID NO: 119810 - protein, 377 aa, Triticum aestivum
  Clone ID: PAT_TA_14228.pep
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDHLMKILTERGYSFTTTAEREIVRDMKEKLSYIALDYDQEMETSKTSSSVEKSYELPDGQVITIGAERFRCPEVLFQPSFIGMEAAGIHETTYNSIMKCDVDIRKDLYGNIVLSGGTTMFTGIADRMSKEITALAPSSMKIKVVAPPERKYSVWIGGSILASLSTFQQMWIAKAEYDESGPSIVHRKCF

SEQ ID NO: 119811 - protein, 335 aa, Triticum aestivum
  unsure (1)..(335): unsure at all Xaa locations
  Clone ID: PAT_TA_14229.pep
LSKAYNLLLSTLQAKCRETGSHXKKVLQDKRYKNRELQIMHMLDHPNIVGLKHYFFSTTERNELYLNLVLEFVPETVNRMARQYNRMNQRVPLIYVKLYTYQICRALAYIHNCVGICHRDIKPQNVLVNPHTHQLKICDFGSAKVLVKGEPNISYICSRYYRAPELIFGATEYTTAIDLWSTGCVMXAELLLGQPLXFPGESGVDQLVEIIKVLGTPTREEIKCMNPNYTEFKFPQIKAHPWHKVFQKKLPPEAMDLVSRFLQYSPDLRCTAMEACMHPFFDELRDPNTRLPNGRPLPPLFNFRSQELNGIPPEVVERLVPEHARKQNLFMALRT

SEQ ID NO: 119812 - protein, 323 aa, Triticum aestivum
  Clone ID: PAT_TA_14230.pep
HASDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDHLMKILTERGYSFTTTAEREIVRDVKEKLSYIALDYDQEMETSKTSSSVEKSYELPDGQVITIGSERFRCPEVLFQPSFIGMEAAGIHETTYNSIMKCDVDIRKDLYGNIVLSGGTTMFTGIADRMSKEITALAPSSMKIKVVAPPERKYSVWIGGSILASLSTFQQMWIAKAEYDESGPSIVHRKCF

SEQ ID NO: 119813 - protein, 120 aa, Triticum aestivum
  Clone ID: PAT_TA_14231.pep
MRSKANGDTAFKASGKNKTATGGVAKPKRAPTPFFAFLAEFRPQYMEKHPEAKGVAAVTKAAGEKWRSMSDEEKAKYGGKKADAPASKAVNKKESTSSKKTKTNADEEGSDVEDDEEDEE

SEQ ID NO: 119814 - protein, 262 aa, Triticum aestivum
  Clone ID: PAT_TA_14232.pep
MACAFSASTVSTAAALVASPKPAGAPQCLSFPRAIAGAAARPSRLAAASSRTARARSFVARASAEYDLPLVGNKAPDFAAEAVFDQEFINVKLSDYIGKKYVILFFYPLDFTFVCPTEITAFSDRHEEFEKINTEILGVSVDSVFSHLAWVQTERKSGGLGDLKYPLVSDVTKSISKSFGVLIPDQGIALRGLFIIDKEGVIQHSTINNLGIGRSVDETLRTLQALQYVQENPDEVCPAGWKPGEKSMKPDPKGSKEYFAAI

SEQ ID NO: 119815 - protein, 152 aa, Triticum aestivum
  Clone ID: PAT_TA_14233.pep
MAPKAEKKPAAKKPVEEEPAAEKAEKAPAGKKPKAEKRLPAAGKTSAKDGDKKAKKKSKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 119816 - protein, 380 aa, Triticum aestivum
  unsure (1)..(380): unsure at all Xaa locations
  Clone ID: PAT_TA_14234.pep
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYLMKILTERGYSFTTTXAEREIVRDVKEKLSYIALDYDQXEMETSKTSSSVEKSYELPDGXQVITIGSERFRCPEVLFQPSFIGMEAAGIHETTYNSIMKCDVDIRKDLYGNIVLSGGTTMFTGIADRMSKEITALAPSSMKIKVVAPPERKYSVWIGGSILASLSTFQQMWIAKAEYDESGPSIVHRKCF

SEQ ID NO: 119817 - protein, 357 aa, Triticum aestivum
  Clone ID: PAT_TA_14235.pep
AGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFSVPAMYVAIQAVLSLYASGRTTGIVLDSGDGVSHTVPIYEGYALPHAILRLDLAGRDLTDSLMKILTERGYSFTTTAEREIVRDIKEKLAYVALDYEQELETAKSSSSVEKSYELPDGQVITIGAERFRCPEVLFQPSLIGMEAPGIHETTYNSIMKCDVDIRKDLYGNIVLSGGTTMFPGIADRMSKEITALAPSSMKIKVVAPPERKYSVWIGGSILASLSTFQQMWISKGEYDESGPSIVHRKCF

SEQ ID NO: 119818 - protein, 378 aa, Triticum aestivum
  unsure (1)..(378): unsure at all Xaa locations
  Clone ID: PAT_TA_14236.pep
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFSVPAMYVAIQAVLSLYASGRTTGIVLDSGDGVSHTVPIYEGYALPHAILRLDLAGRDLTDSLMKILTERGYSFTTTAEREIVRDIKEKLAYVALDYEQELETAKSSSSVEKSYELPDGQVITIGAERFRCPEVLFQPSIIGMEAPGIHETTYNSIMKCDVDIRKDLYGNIVLSGGSTMFPGIADRMSKEITALAPXSSMKIKVVAPPERKYSVWIGGSILASLSTFQQMWISRAEYEESGPAIVHRKCF

SEQ ID NO: 119819 - protein, 175 aa, Triticum aestivum
  Clone ID: PAT_TA_14237.pep
MEHKEAGCQQPEGPILCVNNCGFFGSAATMNMCSKCHKEMVMKQEQAKLAASSFDSIVNGGDGGKAPVVAAVAASAEVVVAQVDVKALVVQPAADVAGTSEAVAVSPKRKEGPNRCSTCRKRVGLTGFNCRCGNMYCSLHRYSDKHDCQFDYRTAARDAIAKANPVVKAEKLDKI

SEQ ID NO: 119820 - protein, 377 aa, Triticum aestivum
  Clone ID: PAT_TA_14238.pep
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDCLMKILTERGYSFTTTAEREIVRDIKEKLAYVALDYEQELENAKSSSSVEKSYELPDGQVITIGAERFRCPEVLFQPSFIGMEAAGIHETTYNSIMKCDVDIRKDLYGNIVLSGGSTMFPGIADRMSKEITALAPSSMKIKVVAPPERKYSVWIGGSILASLSTFQQMWISKGEYDESGPAIVHRKCF

SEQ ID NO: 119821 - protein, 337 aa, Triticum aestivum
  unsure (1)..(337): unsure at all Xaa locations
  Clone ID: PAT_TA_14239.pep
MANMQESLGLVGTMRGHNDVVTAIAAPIDNSPYIVSGSRDKSLLVWDLTNPVQSLGDGTVGTDYAVPFRRLTGHGHFVQDVVISSDGQFALSGSWDGELRLWDLSTGLTTRRFVGHSKDVISVAFSVDNRQIVSASRDNTIKLWNTLGECKYTIGGDMGGGEGHTGWVSCVRFSPNIQQPTIVSGSWDKTVKVWNLTNCKLRSTLAGHGXGYVNAVAVSPDGSLCASGGKDGVTLLWDLSEGKRLYQLEAGSIIHALCFSPNRYWLCAATEESVKIWDLESKHVVQDLKPEVQVSKNQMLYCTSLSWSAXDGSTLYTGYTDGTIRVFKIQAGFAGYA

SEQ ID NO: 119822 - protein, 379 aa, Triticum aestivum
  unsure (1)..(379): unsure at all Xaa locations
  Clone ID: PAT_TA_14240.pep
MADAEDIQPLVCDNGTGMVKAGFAGDDAPRAVFPSIVXGRPRHTGVMVGMGQKDAYVGDEAQSKRGILTLKYPIEHGIVSNWDDMEKIWHHTFYNELRVAPEEHPVLLTEAPLNPKANREKMTQIMFETFSVPAMYVAIQAVLSLYASGRTTGIVLDSGDGVSHTVPIYEGYALPHAILRLDLAGRDLTDSLMKILTERGYSFTTTAEREIVRDIKEKLAYVALDYEQELETAKSSSSVEKSYELPDGQVITIGAERFRCPEVLFQPSIIGMEAPGIHETTYNSIMKCDVDIRKDLYGNIVLSGGSTMFPGIADRMSKEITALAPXSSMKIKVVAPPERKYSVWIGGSILASLSTFQQMWISRAEYEESGPAIVHRKCF

SEQ ID NO: 119823 - protein, 377 aa, Triticum aestivum
  Clone ID: PAT_TA_14241.pep
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTSAEREIVRDIKEKLAYVALDYEQELETAKNSSSVEKSYELPDGQVITIGAERFRCPEVLFQPSMIGMESSGIHETTYNSIMKCDVDIRKDLYGNIVLSGGTTMFPGIADRMSKEITALAPSSMKIKVVAPPERKYSVWIGGSILASLSTFQQMWISKDEYDESGPAIVHRKCF

SEQ ID NO: 119824 - protein, 378 aa, Triticum aestivum
  unsure (1)..(378): unsure at all Xaa locations
  Clone ID: PAT_TA_14242.pep
MADGEDIQPLVCDNGTGMVKAGFAGDDAPRAVFPSIVGRPRAHXGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTSAEREIVRDIKEKLAYVALDYEQELETAKNSSSVEKSYELPDGQVITIGAERFRCPEVLFQPSMIGMESSGIHETTYNSIMKCDVDIRKDLYGNIVLSGGTTMFPGIADRMSKEITALAPSSMKIKVVAPPERKYSVWIGGSILASLSTFQQMWISKDEYDESGPAIVHRKCF

SEQ ID NO: 119825 - protein, 377 aa, Triticum aestivum; identical to SEQ ID NO: 119820
  Clone ID: PAT_TA_14243.pep

SEQ ID NO: 119826 - protein, 475 aa, Triticum aestivum
  unsure (1)..(475): unsure at all Xaa locations
  Clone ID: PAT_TA_14244.pep
AANADLHHCCSLIYYLLLVLLAIILNVRTFFVSVSLGLLGASALLLVHRLACWGICLLAAILCLLLIRHAAPLLPSRLGDGRPGRYQAWKGNNVFFLQGRFIFGPDARSLFVTMFLIIAPVTVFCVFVAKELMNSFSYGLGLPVMVVAVVFTAYDLSLLFLTSGRDPGIIPRNAHPPEPEGFEGNAEVGANQTPPLRLPRVKDVVVNGITVKTKYCDTCMLYRPPRCSHCSICNNCVERFDHHCPWVGQCIGLRNYRFFYMFVFSTTLLCLYVFGFSWVYIIKIRDAEQITIWKAMAKTPASIALVVYTFIAVXWFVGGLSVFHLYLMSTNQTTYENFRYRYDQRANPYNRGVVENIKEIFFTPIPASRNNFGARVPQEQGLRPRSTNGFMSPNMGRAVGDIEMGRKPVAWDEPRMAAEIGDLGGLGNLLEDKDGRFRNASPDLSRDALVVGGLDEQGSSVMNPPRTSWGVEAGR

SEQ ID NO: 119827 - protein, 377 aa, Triticum aestivum; identical to SEQ ID NO: 119820
  Clone ID: PAT_TA_14245.pep

SEQ ID NO: 119828 - protein, 378 aa, Triticum aestivum
  unsure (1)..(378): unsure at all Xaa locations
  Clone ID: PAT_TA_14246.pep
MADAEDIQPLVCDNGTGMVKAGFAGDDAPRAVFPSIXVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYLMKILTERGYSFTTTAEREIVRDVKEKLSYIALDYDQEMETSKTSSSVEKSYELPDGQVITIGSERFRCPEVLFQPSFIGMEAAGIHETTYNSIMKCDVDIRKDLYGNIVLSGGTTMFTGIADRMSKEITALAPSSMKIKVVAPPERKYSVWIGGSILASLSTFQQMWIAKAEYDESGPSIVHRKCF

SEQ ID NO: 119829 - protein, 377 aa, Triticum aestivum; identical to SEQ ID NO: 119823
  Clone ID: PAT_TA_14247.pep

SEQ ID NO: 119830 - protein, 121 aa, Triticum aestivum
  Clone ID: PAT_TA_14248.pep
MRSKANGDTAFKASGKNKTATGGVAKPKRAPTPFFAFLAEFRPQYMEKHPEAKGVAAVTKAAGEKWRSMSDEEKAKYGGKKADAPASKVVNKKESTSSKKAKTDADEEGSDVEDDAEEDEE

SEQ ID NO: 119831 - protein, 175 aa, Triticum aestivum
  Clone ID: PAT_TA_14249.pep
MEHKEAGCQQPEGPILCVNNCGFFGSAATMNMCSKCHKEMVMKEEQAKLAASSFDSIVNGGDGGKAPVVAAVAASAEVAVAQVDVKALVVQPAADVAGTSEAVAVSPKRKEGPNRCSTCRKRVGLTGFNCRCGNMYCSLHRYSDKHDCQFDYRTAARDAIAKANPVVKAEKLDKI

SEQ ID NO: 119832 - protein, 358 aa, Triticum aestivum
  Clone ID: PAT_TA_14250.pep
MSCSHLSTAWSSSALASTSTRRRASTGSSSLVVRCSLRDLRNRIDSVRNTQKITEAMKLVAAAKVRRAQEAVVSSRPFSEALVEVLYNMNQEIQSEDIDLPLTRQRAVKRVAIVVLTGERGLCGAFNNNVLKKAEARMEDLRQLGVDYTVISVGKKGNAYFQRRDYIPTERFLELAGIPTVKDSQAICDLIYSLFVAEEVDKVELVYSKFVNLVRSDPIIQTLLPMSPKGEICDVNGICVDATEDELFKLTTKEGKLTVEREKIKIEMQPFSPVVQFEQDPVQILDALLPLYLNSQILRALQESLASELAARMSAMSSATDNAIDLRKNLSMVYNRRRQAKITGEILEIVAGADALSG

SEQ ID NO: 119833 - protein, 329 aa, Triticum aestivum
  Clone ID: PAT_TA_14251.pep
ETATTSKEGRRRGHNDVVTAIATPIDNSPFIVSSSRDKSLLVWDLTNPIQATQDSSSEYGVPFRRLTGHGHFVQDVVLSSDGQFALSGSWDGELRLWDLSTGVTTRRFVGHEKDVLSVAFSIDNRQIVSASRDRTIKLWNTLGECKYTIGGDLGGGEGHTGWVSCVRFSPNNFAPTIVSGSWDRSVKVWNLTNCKLRCTLDGHGGYVSAVAVSPDGSLCASGGKDGVTLLWDLTEGKRLYSLDAGSIINSLCFSPNRYWLCAATQDSIKIWDLESKHIVQDLRPEVPVSTKQMLYCTCLSWSADGSTLYAGYTDGTIRIYKISGFSYSS

SEQ ID NO: 119834 - protein, 332 aa, Triticum aestivum
  Clone ID: PAT_TA_14252.pep
MAGAQESLVYAGVMRGHNDVVTAIATPIDNSPFIVSSSRDKSLLVWDLTNPIQATQDSSSEYGVPFRRLTGHGHFVQDVVLSSDGQFALSGSWDGELRLWDLSTGVTTRRFVGHEKDVLSVAFSIDNRQIVSASRDRTIKLWNTLGECKYTIGGDLGGGEGHTGWVSCVRFSPNNFAPTIVSGSWDRSVKVWNLTNCKLRCTLDGHGGYVSAVAVSPDGSLCASGGKDGVTLLWDLTEGKRLYSLDAGSIINSLCFSPNRYWLCAATQDSIKIWDLESKHIVQDLRPEVPVSTKQMLYCTCLSWSADGSTLYAGYTDGTIRIYKISGFSYSS

SEQ ID NO: 119835 - protein, 169 aa, Triticum aestivum
  Clone ID: PAT_TA_14253.pep
MEHKETGCQSREGPILCVNNCGFFGSAATMNMCSKCHKEMAMKQEQAKLAASSFDSIVNGGDAAKEHLAAGSTAVAVAHVEAKTLITAQPADIAGPSEAAMENPKGPSRCSTCRKRVGLTGFNCRCGNLYCATHRYSDKHECKFDYRAAAMDAIAKANPVVKAEKLDKI

SEQ ID NO: 119836 - protein, 395 aa, Triticum aestivum
  Clone ID: PAT_TA_14254.pep
LLLGNRDARHTRLGGSPRSERSPCWLCCVSFIYGRLSARRNGNGIVAFAFPYPSRVFDVIHCARCRVPWHIEGGKLLLELNRLLRPGGYFVWSATPVYQKLPEDVEIWNAMSSLTKSMCWKMVKKTKDTLNQVGMAIYQKPMDNNCYEKRSEDSPPLCKETDDADAAWNVPLQACIPKLPIGPSVRGSKWPEMWPQRLEKTPFWIDGSRVGVYGKPANEDFEADYAHWKRVVSKSYVNGMGIDWSKVRNVMDMRAVYGGFAAALRDQKVWVMNIVPIDSADTLPIVYERGLFGMYHDWCESFSTYPRTYDLLHADHLFSKLKKRCKLLGVFAEVDRILRPEGKLIVRDDAETISELESMAKSLQWEVRMTYAKGKEGLLCVQKTTWRPKEIEASM

SEQ ID NO: 119837 - protein, 116 aa, Triticum aestivum
  Clone ID: PAT_TA_14255.pep
MSHQKNEKDVGDAPKSHRIRITLTSRKVQSLEKVSAELIERARSKGLTIKGPVRLPTKNLKITTRKTPCGEGSKTWDSYELRVHKRLIDLHAPTEVVKSVIVNIEAGVEVEVTIAA

SEQ ID NO: 119838 - protein, 228 aa, Triticum aestivum
  unsure (1)..(228): unsure at all Xaa locations
  Clone ID: PAT_TA_14256.pep
NPKIGAILWAGYPGQAGGLAIARVLFGDHNPGGRLPVTWYPEEFTKVPMTDMRMRADPATGYPGRSYRFYQGETVYKFGYGLSYSSYSRRLVSSGTPNTDLLAGLSTMPSPAAEQGVASYHVEHIGPQRCEQLRFPAVVEVENHGPMDGKHSVLVYLRWANATAGRPAKQLIGFRRQHLKAGEKARLTFDISPCEHFSRGXKDGSKVVDKGFHFLMVDKHEMEITFEV

SEQ ID NO: 119839 - protein, 121 aa, Triticum aestivum
  unsure (1)..(121): unsure at all Xaa locations
  Clone ID: PAT_TA_14257.pep
MERTRGHRRRKLSVAAGVGVGGGEDRLSALPDDVLVHILLKLRDAPVAARTSVLARRWRRVWALLPELHFPVGTDPDRIRAALTAHDAPALRHLFVAGIEVTPEIAAXWXPIAARRLSGVX

SEQ ID NO: 119840 - protein, 95 aa, Triticum aestivum
  Clone ID: PAT_TA_14258.pep
PPKVVQGIIWAPPQKHPPPPSGRVSFQQPLQQNPLGRGSFRPFQQNPQAQGFFHPQQMPPFEEIRNLAPQTVPAMGKVYTPPNCPLGPFGILGAN

SEQ ID NO: 119841 - protein, 168 aa, Triticum aestivum
  Clone ID: PAT_TA_14259.pep
MATREAGKKMIMLKSPDGMEFEVEEAVAMESQTIRKMIEDDCADTAILIPNINSKILSRVIEYCNKHVPTTGATGAAASDTVAPAALAEDLKIWDAEFIKVNRATRFDLIQAASYLNIKGLLDLTSQTTIDTISDNSLEEIRSFLSTKNDYLPEEEQTIRRENQWAFQ

SEQ ID NO: 119842 - protein, 267 aa, Triticum aestivum
  Clone ID: PAT_TA_14260.pep
FVISAAAALLGLLLFAGGTKRFRHFMPCGNPAATVGNVFVAATKKRHLTIPAQVEKLYELDGTHSVNGGKKIAHTPGYRFLDKAAVIEDPSILLPGEQPASRPRHLYTVTQVEQVKCILRLIPIWLCSIIYSTTYSQMSSVFIEQAQAMDNTLNKFTIPAAGIGIFEIIGVTSFVFIYTFCIAKPLSRRSKEPTELQRMGIGLVISTAAMIAAALVERQRLKHAERYRLSVLWQIPQYLLIGASEVFMYVTMTDALQRPAPGRHGRP

SEQ ID NO: 119843 - protein, 281 aa, Triticum aestivum
  unsure (1)..(281): unsure at all Xaa locations
  Clone ID: PAT_TA_14261.pep
RPGTLPTTHPSFAPQKHLEMFPAWQAPPLPEEPAEIFIGILSAGNHFAERMAARKTWMSAAQKTSNVVARFFVALHARKEVNLELKKEAEFFGDIVIVPFMDSYDLVVLKTVAICEYGVRAVSAKYIMKCDDDTFXVRLDAVMAEVKKIPTGRSLYIGNMNYRHNPLRIGKWAVTYEEWPEEDYPTYANGPGYVISADIADSIVSEFTDHKLRLFKMEDVSMGMWVGRFNHTXPVEYVHSVQFCQFGCIDDYYTAHYQSPRQMLCLWDKLQAGKPRCCNMR

SEQ ID NO: 119844 - protein, 90 aa, Triticum aestivum
  unsure (1)..(90): unsure at all Xaa locations
  Clone ID: PAT_TA_14262.pep
MENLPNVPASIAEKNQGNETSDDAGEPEEVPDVFVYREDVVSLKSNKDARGLVMEVAGEYDSXEGSITDDESDAEEEVRRSAPKTENFGP

SEQ ID NO: 119845 - protein, 150 aa, Triticum aestivum
  Clone ID: PAT_TA_14263.pep
PTRPTRLCTQTVVGSYGYMAPEYLYRGEISAQSDIYSLGLVIIEITTGEQNPREKDQPSARSFVDKVRKEWTLENITSKYSSLDHESLQQVKTCIDIGSNCVEIDRTKRPRIEEIVDSLNGLRSSQKVTEVSRPPTTGKKLMGSIFGLKK

SEQ ID NO: 119846 - protein, 155 aa, Triticum aestivum
  Clone ID: PAT_TA_14264.pep
MLYMLAQDKYRLCTLTVVGFYGYLAPEYLYRGEISAQSDIYSLGLVIIEIATREQNPREKDQPSARSFVDKVRKEWTLENITSKYSSLDHESLQQVKTCIDIGSKCVEIDRTKRPRIEEIVNSLKGLHPSQRVTEVTRPSTTTKKSISSFFGHKK

SEQ ID NO: 119847 - protein, 149 aa, Triticum aestivum
  unsure (1)..(149): unsure at all Xaa locations
  Clone ID: PAT_TA_14265.pep
MAPVSFLELSLSLLCFVVFYYFHARSKRKNPVIPLEWPLVGMLPALLANLPRLHDWVTSLLTASPLNFRFVGPPRSGMELFLTSDPANVRHVFTSNFANYPKGPEFAEIMDILGGGIFNADGDSWRRQRAXXQLLMSXXXXXAFVTRCS

SEQ ID NO: 119848 - protein, 195 aa, Triticum aestivum
  Clone ID: PAT_TA_14266.pep
RAGVLRSYVFPFTLMTVALSMLAVKGLKEQGRLGRSFGKVTIRDQPPSNTIQKILALKEAMASVENYLQNLNVSLLKIRTILLAGQPEVTTQVAIVLLASSAVLLVFPFKYVLAFVTFDLFTRELEFRREMVRAFMNFLKERWESIHAAPVVVLPYEGAESSPKTLPAKASGQSEPQNVQGGSGYVTSKNGISSS

SEQ ID NO: 119849 - protein, 111 aa, Triticum aestivum
  Clone ID: PAT_TA_14267.pep
IQFVDWCPPGFKCGINYQPPRVVPGGDLAKVQRAVCMISNSTRVVEVFSRIDHKFDLMYAKGAFVHWYVGKGMEKEKFFKARKDFAALEKDYKKVGVEFDKGEDGDKGDEY

SEQ ID NO: 119850 - protein, 50 aa, Triticum aestivum
  Clone ID: PAT_TA_14268.pep
LGGPKNGREAVRHLGKGLGVRHSPPKPYVGSKGRKFKRVCGRRTTRGFRV

SEQ ID NO: 119851 - protein, 126 aa, Triticum aestivum
  Clone ID: PAT_TA_14269.pep
FMLYFVHLSLCSCFSPTITISRRLNVRFTIVSKNQQPTKGAHTILILPIHHHEQISTALQLTFMTRRRHKQITLDIHLASKQRLQNTILILPSLSSPVAVPPKLPPKTDFCWNDSCCTLFICGNKP

SEQ ID NO: 119852 - protein, 196 aa, Triticum aestivum
  unsure (1)..(196): unsure at all Xaa locations
  Clone ID: PAT_TA_14270.pep
GKRKVPCVKRRVHALQLNNRTCIYKKNSEEVCVDVLDGSLQLRITWTKRLLPTGHVDNFLXSLAFVRKFFEDRHPSISGRHHFFPNIGRPILNYPKDDKLRSIATSFLGAASASRGKRLDLSNTLFFPTCLDNHWIVFAVNFKWKLFAFLDSFYDKDSYLHKPTREKFITFVIPLWFILFLTFWSLERISPHLYEF

SEQ ID NO: 119853 - protein, 328 aa, Triticum aestivum
  Clone ID: PAT_TA_14271.pep
VSSRTYPRQLPPTLSTAESSVPVVSPPRWCISSHRTKGVKTLGGSFTTRALILVLGYAYPPYDCYKTVELNRPEIEQLRFWCQYWILLAMLTVFERVGDNFISWLPMYSEAKLAFIVYLWYPKTQGTSYVYESFFKPYIAKHESEIDRNLLELRTRASDMAVTYFHKVADYSQSRFHEILQYVASQSQRSRSQAQQQQQRPPPPRTRMANPAPPPVPAPTAPPMPPQPAQVPPTPPRMQVQDKGPVPVAPPGAVPPVQQQTPSGPGPVTGNSPPNSEDMLVDQSGPSTSNVPLRPTMPDDEETLIQEAIRLTRGRLRRRMGGSGPPSN

SEQ ID NO: 119854 - protein, 261 aa, Triticum aestivum
  Clone ID: PAT_TA_14272.pep
APGSAAPPAPRPLSAAPLPAAAAVPSPRLANKVSPLSPAALTSLHPAAQSSRLPRAATACFARLPAAHPGSGSWGRAAVSVAAPRRPRRAPGVVYAAATTEKSIYDFTVKDVDGKNVSLSKFKGKALLIVNVASQCGLTTANYTELSHLYEKYKTQGFEILAFPCNQFGFQEPGSNTQIKQFACTRFKAEFPIFDKVDVNGPFTAPIYKFLKSSAGGFLGDIVKWNFEKFLVDKNGKVVERYPPTTSPFQIEKDIQKLTAA

SEQ ID NO: 119855 - protein, 86 aa, Triticum aestivum
  Clone ID: PAT_TA_14273.pep
CPKMQNTNYFALCVCYILDAIADQHLWLHGYSWKLDVAMKQKDLHWLGGMESSSTIWDTTYIANKLTSGPNTRIPSYLSFKPCMLI

SEQ ID NO: 119856 - protein, 293 aa, Triticum aestivum
  Clone ID: PAT_TA_14274.pep
MLRRNTRLRREYLYRKSLEGKERQHYEKKRRVREALEEGKPIPTELRNEELALRREIDLDDQDRAVPRSIIDDEYAGATLREPKILLTTSRNPSAPLTQFVKELKVVFPNSQRMNRGGQVISEIVESCRSHEITDLILVHEHRGQPDGLIVCHLPLGPTAYFGLLNVVTRHDIKDRKAMGKMSEAYPHLILDNFTTKTGERTANIMKHLFPVPKPESKRLITFANRDDYISFRHHIYEKHGGPKSIDLKEVGPRFELRLYQIKRGTMDQSEAQNEFVLRPYMNTAKKQKSLGV

SEQ ID NO: 119857 - protein, 96 aa, Triticum aestivum
  unsure (1)..(96): unsure at all Xaa locations
  Clone ID: PAT_TA_14275.pep
TYSTAVTNVLHLRSLCTGAGFKTREVKVRSPVRKSRTRDTDRPVGTPCPAASHALLILGGVPDHWTATSRTRIRTRPLRLPSSGRNVCNAFPXFNQ

SEQ ID NO: 119858 - protein, 224 aa, Triticum aestivum
  Clone ID: PAT_TA_14276.pep
EGMNDLAAGTDYGLPNVARPARVRLARSQQSALWRLPTPAVFGDRPLVVTKNATYTAHNIAEFFEAVGFPEGVRPYVTRVLPAWEALPAPMVPATSIIGVGVSTPETFVYGEDGFAGTPEVAYGDGDGDINMVSLVALEKEWSGVEGQVLTVVRLPGVRPDGFFSVGFALEKVVAEILEAAGTIELHPKIGRVQIDAGPVWKEDRCRVPEGLYNASSNAFLEVL

SEQ ID NO: 119859 - protein, 78 aa, Triticum aestivum
  Clone ID: PAT_TA_14277.pep
STCNSSECFLGSVELYKAHVVVAVNILSPTPTSGKPKEIKTSVCSCKTPRYYTNNLAEGQALHRRVSSVPKIFLQVKP

SEQ ID NO: 119860 - protein, 629 aa, Triticum aestivum
  Clone ID: PAT_TA_14278.pep
HASAGKTLAFGIPMIKQIIEQDEGRTPGRGRIPRALVLAPTRELAKQVEKEIMESAPKLSTVCVYGDVSYNTQQNALSRGVDVVVGTPGRLIDLINGGSLQLGEVRYLVLDEADQMLAVGFEEDVETLLQQLPAERQSMLFSATMPSWVKKLSRRYLNNPLTIDLVGDQDEELAEGIKLFAIPLTTTSKRTILSDLITVYAKGGKTIVFTRTKRDADEVSLALTTSIASEALHGDISQHQRERTLNGFRQGKFTVLVATDVASRGLDIPNVDLIIHYELPNDPETFVHRSGRTGRAGKAGNAICGFTTNQRRTVKSLERDVGCKFEFIGPPTMEEVLDSSAEHVIATLRGVHPESIQYFVPAAERLSQELGPTALASALAHLSGFSQPPSSRSLISHEQGAVTLQLTRDPAYARGFFSPRSVTGFLSDVSPSAADAVGKIYLIADERVQGAVFDLPEEIAKDLLTMELPEGNTLSKVTKLPVLQDDGPATDSYGRFSNSDRGSRNRRGSSRGGMGGGSRGRGSWDSDEGFRRGGRSSSRPDNDIWSDDDFSGGGARRSNRSSSPGGGRSSYGGRGGSSSLGDRSSSFGERSSSYGGRGGSSFGSRDRSFSGACFTCGQSGHRASGCPNK

SEQ ID NO: 119861 - protein, 94 aa, Triticum aestivum
  Clone ID: PAT_TA_14279.pep
SSSRPDNDIWSDDDFSGGGARRSNRSSSPGGGRSSYGGRGGSSSLGDRSSSFGERSSSYGGRGGSSFGSRDRSFSGACFTCGQSGHRASDCPNK

SEQ ID NO: 119862 - protein, 94 aa, Triticum aestivum
  Clone ID: PAT_TA_14280.pep
FPRLLQQGGAVELASAWWCKEIKPVRHPPGGGHSSYGGRGGSSSFGDRSSSFGERSSSYGGRGGSSFGSRDRSFSGACFTCGQSGHRASDCPNK

SEQ ID NO: 119863 - protein, 259 aa, Triticum aestivum
  Clone ID: PAT_TA_14281.pep
ARAKDRAGTPDDGPPILQAVDPATLEMITKNFEDYPEHRLKFFSLLRAIGTHCFKALIQLSSQQLKLVIDSINWAFRHTERNIAETGLSLLLEILKNFQASEFTNQFYKTYFLTIEQEIFAVLTDSFHKPGFKLHVLVLQHLFCVVDGLTEPLWDASTASYPSNAMFVRDYTIKLLGASFPNMTAAEVTKFVDGLLGSRHDLPSFKNHIRDFLVQSKEFSAQDNKDLYAEEAAVQREKERQRMLAIPGLIAPSELQDER

SEQ ID NO: 119864 - protein, 66 aa, Triticum aestivum
  unsure (1)..(66): unsure at all Xaa locations
  Clone ID: PAT_TA_14282.pep
ASRVGGFPPCQSRQCFACHRIMLDEGFFRWXRYKDWFWGRDKVRSLVFKNYGGLFGAQCEMLPSVD

SEQ ID NO: 119865 - protein, 258 aa, Triticum aestivum
  Clone ID: PAT_TA_14283.pep
MYVIAACRPRAGFFGDVFRGIWNGTDVAIKVFLEQDLTTENMEDFCNEIYILSRLRHPNVILFLGACMVPPHLSMVTEYMEMGSLYYLIHMSGHKKKLSWRRRLKIIRDICRGLMCIHRMKIVHRDLKSANCLVNKYWTVKICDFGLSRAITDSPMTDNSSAGTPEWMAPELIRNGPFSEKCDIFSLGVIMWELCTLSRPWDGIGPVKVVYAVTEGSLLEIPEGPLGKLIADCWAEPQDRPSCQEILARLLDCEYADS

SEQ ID NO: 119866 - protein, 161 aa, Triticum aestivum
  Clone ID: PAT_TA_14284.pep
PKRAAARSPSLLPRSSSLRKPPARFDADLQQVDGRGAGADCVYALSAPHQQPLSLVFHVMYLRRKRAATPPRRELVTGEKDPNRDDKHLVRSACTGSVVPPRGMSQGIPTAVSSPLRQPRICIHDSLHARFHPHASTIDKKKTWIAIRSPSCNRAKRATTC

SEQ ID NO: 119867 - protein, 168 aa, Triticum aestivum
  unsure (1)..(168): unsure at all Xaa locations
  Clone ID: PAT_TA_14285.pep
RHEGNPTAKTFLRMFIKSGQEEKKYPSLLLEFMGSYLTELSLLDYGCVRFLPSAAAASAVFVARLTLNPDSNPWSKKLQSVTGYRASELKDCITAIHDLQLSRKGQSWNAIRDKYKQHRFKGVSALLPPVGIPASYFEDLKEXGVPWCCCSEIKSTPSEVSSSVVHDE

SEQ ID NO: 119868 - protein, 66 aa, Triticum aestivum
  Clone ID: PAT_TA_14286.pep
CTSKHFHGCLFGSRERENNTSLQRKKIDSSITKILVVLILTTPVWTCRKNHLTTLLLNQICKGRFV

SEQ ID NO: 119869 - protein, 130 aa, Triticum aestivum
  unsure (1)..(130): unsure at all Xaa locations
  Clone ID: PAT_TA_14287.pep
MQIRDGLRRQAPSVTGAMRSPMSAMMLAMFATMASFYVAGRLWQDAQNRVYMIKELDRRTGQGRSAISVDDTLKVVPCRXKQGNRLASLQMELAAAKHEGFVGKYTPGTNPTLSRNHPRVGIGLLASFGR

SEQ ID NO: 119870 - protein, 213 aa, Triticum aestivum
  Clone ID: PAT_TA_14288.pep
MSVRLVPVVGRPILCGLENYAMVPLETRTVPHQAAAMKALKDSLKIPARMGWNGDPCAPRTWDAWEGVTCHPGNKGLVITQLDLASQGLKGFIADEISYLTDLVSLNLSSNSLTGSLPPGLGQPSLATLDLSSNQFTGSIPGTIGSSKLQTVLLNGNQLDGQVPERLYSVGVHGGVIDLSGNKGLCGVPTLPACALFWEKGGLNKTGKIALGA

SEQ ID NO: 119871 - protein, 156 aa, Triticum aestivum
  Clone ID: PAT_TA_14289.pep
AQGGCLLACRSRARKEQWGSGRRPRSCTSPPPTPPPGAPSSCRSPPSPSSAPPPTSWAPGTTAAASPLPPPPAPSPLPPTSSAPPPPSPPPPPPPPPPPLSPSTSPRTTRRRSTPWRPGPRPPRSRRRGGPGVPGRVLGVHAVRGREAVRCGTRGT

SEQ ID NO: 119872 - protein, 226 aa, Triticum aestivum
  unsure (1)..(226): unsure at all Xaa locations
  Clone ID: PAT_TA_14290.pep
MKRMGSKQVLVPTVSCLLLLFCLGCKCLALELEATQTATLKVDASRQRARKIPDTLFGMFFEEINHAGAGGIWAELVSNRGFEAGGLHTPSNIDPWSIIGNDSSIFVATDRTSCFSRNIIALRMEVLCDECPAGVGIYNPGFWGMNIEDGKTYNLVMYVKSAEAADXTVSLASSDGLQKLASVTVPVAGTSNWTKVEQKLIAKGTNRDLKXLEITSNKKGSCMGFD

SEQ ID NO: 119873 - protein, 614 aa, Triticum aestivum
  unsure (1)..(614): unsure at all Xaa locations
  Clone ID: PAT_TA_14291.pep
MRSPPRAKLETTQPSPPELEAYAFHYKRQLVPLLRSAYCFASARCANVQCQHVSSPNRQALVFMPPSTFLQQLPILRDESSLCKATDQAFGFHGPNVFLILVLIPDNRPGGQIGSYNLGFWGMNIADGSTHNHVMHAKSPEMXSMTVSLTSSDGLPVLASGAIRAHSRVYWMMLDNKTVLYGPGSTSKHRIXSRNIGDCCLINFYFGNPVTVKGDSSRVXTHTWLLNKNPIWLLCLEHXNVEGPTVSLAISDRXAEAPFSYCTSCWHFQLAQNWVFNNGIIHNDEGRPTAIAPLVIALLDSLEFARGSANSTWGSVRAAMGHPEPFPVKYVAIGNEDCGKKYYLGNYLKFYNAIRESYPDIQMISNCDGSSKPLDHPADLYDFHVYTDSKTLFNMKGTFDKTSRTGPKAFVSEYAVWRTDAGRGSLLGSLAEAAFLTGLEKNSDIVQMASYAPLFVNDNDQTWNPDAIVFNSWQQYGTPSYWMQKFFRESSGAMIHPITISSSYSGSLAASAITWQDSGNSFLKVKIVNFGSDTVSLTISVSGLQASINALGSNATVLTSSNVKDENSFSNPNKVVPVTSQLRNAAEQMQVTLAAHSFSSFDLALAQSELVAEM

SEQ ID NO: 119874 - protein, 312 aa, Triticum aestivum
  Clone ID: PAT_TA_14292.pep
MKKCASELELEAFIRGRGLAAEQKPGSAAAGANGPYGLFSAADLSSAFGFADSALNGTIQNHLWPQSPNLGARHPAVSTTIESQSSFYAAASPTSATNLSIKESQAFGGTSGSDSDSESMFDDGGLCDNGTNPTDVKRMRRMVSNRESARRSRKRKQAHLVELETQVDQLRGDNASIFKQLTDANQQFTTAVTDNRILKSDVEALRVKVKLAEDMVARGAMSCGLGHLGLSPAALNPCRVPDVLAGLDFLPGGADDACFGSLSPAEQVQSSPMQSMASLESLEHSSRMQHGGGADAVDVWGWDSSSNGAMSK

SEQ ID NO: 119875 - protein, 131 aa, Triticum aestivum
  unsure (1)..(131): unsure at all Xaa locations
  Clone ID: PAT_TA_14293.pep
IRHEEEAKKKREEEFDAFTSTKAQDLAQPLVGAQIPFKIHIVKDHDMKERLCLEAERLGLSAMIMGSRGXFGASRRAXKGRLGSVSDYCVHHCVCPVVVVRYPDDAFGDELRTVPENEPVYHEAPEAQKEK

SEQ ID NO: 119876 - protein, 57 aa, Triticum aestivum
  Clone ID: PAT_TA_14294.pep
ERRLLERPLCCMHQRAALESRNGRCGAHVWLRNKPCVHVSSVIGRASRVCVCVCVCV

SEQ ID NO: 119877 - protein, 99 aa, Triticum aestivum
  Clone ID: PAT_TA_14295.pep
QQNSTLQSESRSSQYKFRNTIRTYTLSYLTDPGARPVQPGTDPLYLFLITEAALLPSLFRDFSVAVADRTKVRWGDADWGFWFEMEESREGRRQLSCVT

SEQ ID NO: 119878 - protein, 155 aa, Triticum aestivum
  Clone ID: PAT_TA_14296.pep
VADCTTKEYAENTFDVIYSRDTILHIQDKPALFRNFFKWLKPGGKVLISDYCRSPGTPSEEFAAYIKQRGYDLHDVKTYGKMLEDAGFHDVVAEDRTDQFLRVLERELGETEKNKEAFLADFTQEDYDDIVNGWSAKLKRSSAGEQKWGLFIATK

SEQ ID NO: 119879 - protein, 176 aa, Triticum aestivum
  Clone ID: PAT_TA_14297.pep
INMVSFAIERAIGRSCSVEFEVADCTTKEYAENTFDVIYSRDTILHIQDKPALFRNFFKWLKPGGKVLISDYCRSPGTPSEEFAAYIKQRGYDLHDVKTYGKMLEDAGFHDVVAEDRTDQFLRVLERELGETEKNKEAFLADFTQEDYDDIVNGWSAKLKRSSAGEQKWGLFIATK

SEQ ID NO: 119880 - protein, 292 aa, Triticum aestivum
  unsure (1)..(292): unsure at all Xaa locations
  Clone ID: PAT_TA_14298.pep
MATGSEAGKPAEVVLEWPKQDKKRMLHAVYRVGDLDRTIKCYTECFGMKLLRKRDVPEEKYTNAFLGFGPEDTNFALELTYKYXGVDKYDIGAGFGHFAIANXDVYKLAETIKSSSCCKITREPGPVKGGSTVIAFAQDPDGYMFELIRMGPTPEPLCQVCFVFGDLDRSIMFYEKALGMKLLRKKDVPQYKYTIAMMGYAEEDKTTVLELTYNYGVTEYNKGNAYAQVAIGTDDVYKSAEAVELVTKELGGKILRQPGPLPGLNTKITSFLDPDGWKVVLVDHADFLKELH

SEQ ID NO: 119881 - protein, 95 aa, Triticum aestivum
  Clone ID: PAT_TA_14299.pep
LDVATEVFARKQGQKQVLKLRSPVKTPSTQRRASSPTKKVLLLGDKKTNSGTKGKTTAQKKRASSNTDDDEDDDFVETNSSHKGKNHSTKEKEGI

SEQ ID NO: 119882 - protein, 264 aa, Triticum aestivum
  unsure (1)..(264): unsure at all Xaa locations
  Clone ID: PAT_TA_14300.pep
MAANSSSPSAGGDAPAPALPPVRLAAGQAATIQPSSPRYFFSSLAGKDASSHRRIAIAVDLSDESAFAVRWAVQNYLRPGDAVXVLLHVRPTSVLYGADWGSIPVSVSDDDADDAAVAVAAEGSDPAASAEELQKKREEDFDAFTSTKSQDLAQPLVAAQIPFKIHVVKDHDMKERLCLEAERLGLSAMIMGSRGFGASRRAGNGRLGSVSDYCVHHCVCPVVLVRYPDDAGAAGGAESAGDELRTVPENEVVFHEAPEGQKEN

SEQ ID NO: 119883 - protein, 127 aa, Triticum aestivum
  Clone ID: PAT_TA_14301.pep
PTRTTTRTPPSREDLAQPLVAAQIPFKIHIVKDHDMKERLCLEAERLGLSAMIMGSRGFGASRRAGNGRLGSVSDYCVHHCVCPVVVVRYPDDAGAAGGAESVGDELRTVPENEVVFHEAPEGQKEN

SEQ ID NO: 119884 - protein, 140 aa, Triticum aestivum
  Clone ID: PAT_TA_14302.pep
MAANSSSPSAGGDAPAPALPPVRLAAGQAATIQPSSPRYFFSSLAGKDASSHRRIAIAVDLSDESAFAVRWAVQNYLRPGDAVVLLHVRPTSVLYGADWGSIPVSVSDDDADDAAVAAAAEGSDPAAASAEELQKNGRIA

SEQ ID NO: 119885 - protein, 268 aa, Triticum aestivum
  Clone ID: PAT_TA_14303.pep
MATHHPASPTGAGAGGKSPSSSPSPPPAVRLAASQAAAVAAIQPSSPRYFFSSLAASSSPHRRIAIAVDLSDESAFAVKGAVQNYLRPGDAVVLLHVRPTSVLYGADWGSIPVTVDDGDEKGGGGAAPASGDPEEDARKKREEDFDAFTSTKSQDLAQPLVAAQIPFKIHIVKDHDMKERLCLEAERLGLSAMIMGSRGFGASRRAGNGRLGSVSDYCVHHCVCPVVVVRYPDDAGASGGAESVGDELRTVPENEVVFHEAPEGQKEN

SEQ ID NO: 119886 - protein, 332 aa, Triticum aestivum
  Clone ID: PAT_TA_14304.pep
KASAASATKVKKEEDDDDNIPLARRAKKASNGGAKKEKKEEYEEEEEEYEEEEEEDDDDEDFADEYTPVSRGKKGNEKEKSTSNSKVKASKVKKEETGSDDECKPKSQKRSPAAGKPKISKIKKPKDEYDDTKEEKKIKKEVGIKKDEKKAAGVKKEGAAGVKKERKVYELPGQKHDPPPERDPLRIFYESLYEQVPDSEMAAFWLMEWGLLPLDVATEVFAKKQGQKQVLKLRSPVKAPSTQRRASSPTKKVLLLGDKKTNSGTKGKTTAQKKRASSDTDDDEDDDFVKTNSATKGKTTSQKKRKASSDTDDDDDDDFVMPKKSKKQKISS

SEQ ID NO: 119887 - protein, 250 aa, Triticum aestivum
  Clone ID: PAT_TA_14305.pep
MAGEDAALQNPPKKEKYDEDDEDDVPLAFSRGKKKASAASAAKVKKEEEEEDDEDNIPLARSRAKKTSNGGAKEKKEEYEEEEEEYEEEEEDDDDDEDFANEYTPVSRGKKGNEKEKSTSNSKVKASKVKKEETGSDDECKPKSQKRSPAAGKPKISKIKKPKDEYDTKEEKKIKKEVGIKKDEKKAAGVEGAIVVKKERKLYELPGQKHDPPPERDPLRIFYESLYGQVPDSEMAAFWLMEWGLLPLDV

SEQ ID NO: 119888 - protein, 241 aa, Triticum aestivum
  unsure (1)..(241): unsure at all Xaa locations
  Clone ID: PAT_TA_14306.pep
PRVRSEKAVHAAAAPSSIPRPRRPTPSASHARRRPPRPCCLHPVRNLSPLGFEGNMARLVSSSLVRGLVRSCRAPSTATVSRPAFQQFMTYSSGISGDSNVNGGTSATRVTADTDTHQDFQPTSKGSDMSLQDIVAQDIKENPVIIFMKGYPEAPRCGFSALXAVKVLQQYGVSITARDILTNMKLKESVKAYSNWPTFPQIFINGEFVGGSDIILSMHQKGELKGLLGDSAQKGEQDSAQ

SEQ ID NO: 119889 - protein, 244 aa, Triticum aestivum
  Clone ID: PAT_TA_14307.pep
MSEQGAGQGTKEQSVPATVGSREISLSGQGAGQGSKEERLAELEELELQTDHQGVLAILPSYAGKTVLELGAGIGRFTGELAKEAGHVIALDFIDSVIKKNEEINGDIYKNITFMCADVTSPELKIEDNSVDIVFSNWLLMYLNDEEVEKLIGRIVKWLKPGGHIFIRESCFHQSGDSKRKVNPTHYREPRFYTKVFKECHSYDQEGNSFELSLVTSKCIGAYVKSKKNQNQICWLWEKVKCTE

SEQ ID NO: 119890 - protein, 97 aa, Triticum aestivum
  Clone ID: PAT_TA_14308.pep
KDHDMKERLCLEAERLGLSAMIMGSRGFGASRKGGKGRLGSVSDYCVHHCVCPVVVVRYPDDAAGVPGEAAAATDELHTVPEDEPVYHDAPDAHKEN

SEQ ID NO: 119891 - protein, 85 aa, Triticum aestivum
  Clone ID: PAT_TA_14309.pep
AERLGLSAMIMGSRGFGASRKGGKGRLGSVSDYCVHHCVCPVVVVRYPDDAAGIPGEAAAATDELHTVPEDEPVYHDAPDAHKEN

SEQ ID NO: 119892 - protein, 222 aa, Triticum aestivum
  Clone ID: PAT_TA_14310.pep
PLPRRPTPSASRARRRPPRPCRLDPVRNLSPLGFEGNMARLVSSSLLRGLARSCRAPSTATVSRPAFQQFMNYSSGISGDSNVNGGTSATRVTADTDTHQDFQPTSKGSDMSLQDIVAQDIKENPVVIFMKGYPEAPRCGFSALAVKVLQQYGVSITARDILSNMKLKESVKAYSNWPTFPQIFINGEFVGGSDIILSMHQKGELKDLLGDSAQKGEQDSAQ

SEQ ID NO: 119893 - protein, 292 aa, Triticum aestivum
  unsure (1)..(292): unsure at all Xaa locations
  Clone ID: PAT_TA_14311.pep
MATGSEAGKSAEAVFEWPKQDKKRMLHAVYXRVGDLDRTIKCYTECFGMKLLRKRDVPEEKYTNAFLGYGPEDTNFALELTYNYGVDKYDIGAGFGHFAITHEDVYKLAETIKSSSCCKITREPGPVKGGSTVIAFAPDPDGYMFELIQRGPTPEPLCQVMLRVGDLDRSIMFYEKALGMKLLRKKDVPQYKYTIAMMGYAEEDKTTVLELTYNYGVTEYNKGNAYAQVAIGTDDVYKSAEAVELVTKELGGKILRQPGPLPGLNTKITSFLDPDGWKVVLVDHADFLKELH

SEQ ID NO: 119894 - protein, 267 aa, Triticum aestivum
  unsure (1)..(267): unsure at all Xaa locations
  Clone ID: PAT_TA_14312.pep
MAANSSSPLAGGDAPAPALPPVRLAAGQAATIQPSSPRYFFSSLAGKDASSHRRIAIAVDLSDESAFAVRWAVQNYLRPGDAVVLLHVRPTSVLYGXADWGSIPVSVSDDDADDAAVAAAAEGSEPHAASSAEELQKKREEDFDAFTSTKSQDLAQPLVAAQIPFKIHVVKDHDMKERLCLEAERLGLSAMIMGSRGFGASRKGGKGRLGSVSDYCVHHCVCPVVVVRYPDDAAGIPGEAAAATDELHTVPEDEPVYHDAPDAHKEN

SEQ ID NO: 119895 - protein, 228 aa, Triticum aestivum
  Clone ID: PAT_TA_14313.pep
SVVAAEVRTHLSYLTDPGAQPVNAATATSKQSHPTPHGRSTVELSETIKSSDCCKITREPGPVKGGSTVIAFAQDPDGYMFELIQRGPTPEPLCQVMLRVGDLDRAIMFYEKALGMKLLRKKDVPQYKYTIAMMGYAEEDKTTVLELTYNYGVTEYNKGNAYAQVAIGTDDVYKSAEAVELVTKELGGKILRQPGPLPGLNTKITSFLDPDGWKVVLVDHADFLKELH

SEQ ID NO: 119896 - protein, 235 aa, Triticum aestivum
  unsure (1)..(235): unsure at all Xaa locations
  Clone ID: PAT_TA_14314.pep
MDTITVVENVFGEVERKVQKSYWEEHSKDLTVESMMLDSRAKDLDKEERPEVLAILPSYAGKTVLELGAGIGRFTGELAKEAGHVIALDFIDSVIKKNEEINGDIYKNITFMCADVTSPELKIEDNSIDIVFSNWLLMYLNDEEVEKLIGRIVKWLKPGGHIFIRESCFHQSGDSKRKVNPTHYREPRFYTKVFKECHSYDQDGNSFXLSLVTXKCIGAYVKSKKNQNQICWLWE

SEQ ID NO: 119897 - protein, 501 aa, Triticum aestivum
  Clone ID: PAT_TA_14315.pep
MSEQGAGQGTKEQSVPAAVGSREMSLSGQGAGQGSKEERLAELEELELQTDHQGVLAILPSYAGKTVLELGAGIGRFTGELAKEAGHVIALDFIDSVIKKNEEINGDIYKNITFMCADVTSPELKIEDNSIDIVFSNWLLMYLNDEEVKKLIGRIVKWLKPGGHIFIRESCFHQSGDSKRKVNPTHYREPRFYTKVFKECHSYDQEGNSFELSLVTSKCIGAYVKSKKNQNQICWLWEKVKCTEDKGFQRFLDNVQYKSTGILRYERVFGEGYVSTGGFETTKEFVDKLDLKAGQKVLDVGCGIGGGDFYMAETYDVHVLGIDLSINMVSFAIERAIGRSCSVEFEVADCTTKEYAENTFDVIYSRDTILHIQDKSALFRNFFKWLKPGGKVLISDYCRSPGTPSEEFAAYIKQRGYDLHDVKTYGKMLEDAGFHDVVAEDRTDQFLRVLERELGETEKNKEAFLADFTQEDYDDIVNGWSAKLKRSSAGEQKWGLFIATK

SEQ ID NO: 119898 - protein, 291 aa, Triticum aestivum
  Clone ID: PAT_TA_14316.pep
MATGSDAGKSAEAVLEWPKQDKKRMLHAVYRVGDLDRTIKCYTECFGMKLLRKRDVPEEKYTNAFLGYGPEDTNFALELTYNYGVDKYDIGAGFGHFAIANEDVYKLSETIKSSDCCKITREPGPVKGGSTVIAFAQDPDGYMFELIQRGPTPEPLCQVMLRVGDLDRAIMFYEKALGMKLLRKKDVPQYKYTIAMMGYAEEDKTTVLELTYNYGVTEYNKGNAYAQVAIGTDDVYKSAEAVELVTKELGGKILRQPGPLPGLNTKITSFLDPDGWKVVLVDHADFLKELH

SEQ ID NO: 119899 - protein, 501 aa, Triticum aestivum
  Clone ID: PAT_TA_14317.pep
MSEQGAGQGTKEQSVPATVRSREISLSGQGAGQGTKEERLAEVEELELQTDHQGVLAILPSYAGKTVLELGAGIGRFTGELAKEAGHVIALDFIDSVIKKNEEINGDIYKNITFMCADVTSPELKIEDNSIDIVFSNWLLMYLNDGEVEKLIGRIVKWLKPGGHIFIRESCFHQSGDSKRKVNPTHYREPRFYTKVFKECHSYDQDGNSFELSLVTSKCIGAYVKSKKNQNQICWLWEKVKCTEDKGFQRFLDNVQYKSTGILRYERVFGEGYVSTGGFETTKEFVDKLDLKAGQKVLDVGCGIGGGDFYMAETYDVHVLGIDLSINMVSFAIERAIGRSCSVEFEVADCTTKEYAENTFDVIYSRDTILHIQDKPALFRNFFKWLKPGGKVLISDYCRSPGTPSEEFAAYIKQRGYDLHDVKTYGKMLEDAGFHDVVAEDRTDQFLRVLERELGETEKNKEAFLADFTQEDYDDIVNGWSAKLKRSSAGEQKWGLFIATK

SEQ ID NO: 119900 - protein, 291 aa, Triticum aestivum; identical to SEQ ID NO: 119898
  Clone ID: PAT_TA_14318.pep

SEQ ID NO: 119901 - protein, 498 aa, Triticum aestivum
  Clone ID: PAT_TA_14319.pep
MDTITVVENVFGEVERKVQKSYWEEHSKDLTVESMMLDSRAKDLDKEERPEVLAILPSYAGKTVLELGAGIGRFTGELAKEAGHVIALDFIDSVIKKNEEINGDIYKNITFMCADVTSPELKIEDNSVDIVFSNWLLMYLNDEEVEKLIGRIVKWLKPGGHIFIRESCFHQSGDSKRKVNPTHYREPRFYTKVFKECHSYDQEGNSFELSLVTSKCIGAYVKSKKNQNQICWLWEKVKCTEDKGFQRFLDNVQYKSTGILRYERVFGEGYVSTGGFETTKEFVDKLDLKAGQKVLDVGCGIGGGDFYMAETYDVHVLGIDLSINMVSFAIERAIGRSCSVEFEVADCTTKEYAENTFDVIYSRDTILHIQDKPALFRNFFKWLKPGGKVLISDYCRSPGTPSEEFAAYIKQRGYDLHDVKTYGKMLEDAGFHDVVAEDRTDQFLRVLERELGETEKNKEAFLADFTQEDYDDIVNGWSAKLKRSSAGEQKWGLFIATK

SEQ ID NO: 119902 - protein, 64 aa, Triticum aestivum
  Clone ID: PAT_TA_14320.pep
FLYKKGKKVGKAPQIQGFVTPLPPPRGGARIAAQKKRVAQKKSRGWGAPKLVAPRFKDPRAPRS

SEQ ID NO: 119903 - protein, 157 aa, Triticum aestivum
  Clone ID: PAT_TA_14321.pep
DLLISSFACRFLLPPADSKTYDLAGYPSSSARPPRVQSAVSTKRHASASYQLTTRPGPVLLLFTATAVSAALSCPPPLVPRLVSAVAAPLPAGMGPPHTGLCGPTSASIPPRARQTYPPFVDVTAADNLMSLFACCLPMSVIILISNGKLNLKQIIS

SEQ ID NO: 119904 - protein, 186 aa, Triticum aestivum
  unsure (1)..(186): unsure at all Xaa locations
  Clone ID: PAT_TA_14322.pep
IKSPNILLDQSMHARVADFGLSREEMLTRNGANIRGTYGYLDPEYVSSRSFTKKSDVYSYGVLLFELIAGRNPQQGLMEYVELAAINADGKTGWEEIADSRLEGAFDVEELNDMAAAAYKCVSRVSRKRPSMRDVVQALIRVVKHSHSSRNHHGRRLPPGRTDDESVDLEASEGQSSASGHXRQES

SEQ ID NO: 119905 - protein, 191 aa, Triticum aestivum
  unsure (1)..(191): unsure at all Xaa locations
  Clone ID: PAT_TA_14323.pep
VISVVAAEVRLEAYSNNLVDYHLILASCTYLMHMSTSQEKLPVTLHGAQASVLFCMGLQDKDIGATKEELGIEREQVLSNFIKTMKKLYGYLNNTAGNEIEATLPRLKEIEAPLSRSMDEDLDEAAQEREGKKKSRXEATVDPKLLQKYAIXSDGHEIEKALQNEKLSASGVISVKPSKSSADKKEKHREN

SEQ ID NO: 119906 - protein, 228 aa, Triticum aestivum
  Clone ID: PAT_TA_14324.pep
MHALPPSVIFSGVLPPSLPASYSSGQQLNTSLTSHRTASHRPASPSEESSRASPPVRARAMRGGGGGGGGEDTRRTAAGQAMVELQANGATATSASGAMVVGLSPLSETLWRDSKAMPGAGAAALIGEVSARLTWKDLSVTVALGPGKTQTVLDELTGFAEPGSLTALMGPSGSGKSTLLDALAGRLAANAFLSGSVLLNGRKAKLSFGAAAYVTQDDNLIGTLTVRE

SEQ ID NO: 119907 - protein, 267 aa, Triticum aestivum
  Clone ID: PAT_TA_14325.pep
MSIRSLIAASRSGHALAAATISQAASRAHQHAAGVPPLLPRLGPLARAFSSSPETADVDSGVPVMEVQKRRVGKKAKGAKSGKAMMFPLHFHYVDVLREDLLLKLNHTNTMEVPGLFEIRLVPKSTTGAKIQFGKLAMEILCGQRCIQAELPAHLKGKATNAYLGSQKDAVSLRQSIIRGHGMYNFLVRVLTVMSMLDSKVAIEQGNCVKFFMATEFCEFSPEIEDHFEIFETIGGFNVTIVTTACSKEETSLLWSGFLLKDEGEIS

SEQ ID NO: 119908 - protein, 93 aa, Triticum aestivum
  Clone ID: PAT_TA_14326.pep
FLQMDLTADRCMLHRESICSSNIENSRAYSQNPFLHFSHQNVTCGANNIISQKNLHHSCMKIHCSYSHNFVRHKTVNIISTIVEIVSKSFKGE

SEQ ID NO: 119909 - protein, 171 aa, Triticum aestivum
  Clone ID: PAT_TA_14327.pep
ERPPGQVHVEKELKLLRDRSILYCICRKPYDNRAVIACDQCDEWYHFDCINLCGPPPKTFYCPACSPNNGEGFISLPRSAREEDRSSAEAGPHTPPASGDEPETVEDNKCSSNTREKSQVRVDLVKLLRQDSEIDNTWRDSKRIPHRTARRRSDFMGHSQDISSPFKGPNL

SEQ ID NO: 119910 - protein, 175 aa, Triticum aestivum
  Clone ID: PAT_TA_14328.pep
MATAEAGEKKMIMLKSADGEEFEVEEAVTMESQTIRHMIEDDCADKGIPIPNINSKVLSKVIEYCNKHVLAKTVDVSSGATCATASDTMAPAALAEDLKIWDAEFINVDPDTLFDLIKAASYLNIKGLLDLTCQTAADMISGKPPEEIRNFFNTENDYLPEDEEKIRRENPWAFQ

SEQ ID NO: 119911 - protein, 128 aa, Triticum aestivum
  Clone ID: PAT_TA_14329.pep
LHRKVIRDVHYNGYDIPSGWKILPVLAAVHLDSSLYEDPSSFNPWRWKGNASGVAQNSNFMPYGGGTRLCAGSELAKLEMAIFLHHLVLNFRWELAEPDQAFVYPFVDFPKGLPIRVHRIAQEEEGEE

SEQ ID NO: 119912 - protein, 137 aa, Triticum aestivum
  Clone ID: PAT_TA_14330.pep
YAISFWLCSVTSMMLDLHLQYEIVIYDWECYLPRKITVVYYSFAIYFLSKYGIFFSLQCCHWAHSFEFPPGPPKLQDRRWACTRMAGNSDPSSYPTSSSWSPLVPPVAASRSPDRARRPAPRRSPLLLRCCTPGPCP

SEQ ID NO: 119913 - protein, 77 aa, Triticum aestivum
  Clone ID: PAT_TA_14331.pep
RLESREFIHALTKQKTRGNYTLVLHDRRCIILVVLLSRGKVTSTTNRTCGTAGATGTQQSDTTQRALPWSCCCRGSC

SEQ ID NO: 119914 - protein, 292 aa, Triticum aestivum
  Clone ID: PAT_TA_14332.pep
TRRTSSPAPSSSAAASGSATAAAMARCSNGRRGLLTAAVLVLALVLLGGGIWLSHRASTTDCERFLDRPVIALGALLFALSLVGLAGSLCRASCLLWLYLVALFLLIALLLVFTVFAFVVTNRGAGSVVSGRGYKEYRLGEYSTWLQRRVESADNWAKIRSCLRDGGVCQRFGARGESLQQFVTNNLSPIQSGCCKPPTGCNFTYQSETVWAKPTGLNSTNDPDCNTWSNDQRALCYDCQSCKAGVLANLKNDWKKIATVNIIFLIFLIIVYSVGCCAFRNNRRDNSYPAWK

SEQ ID NO: 119915 - protein, 276 aa, Triticum aestivum
  Clone ID: PAT_TA_14333.pep
FGTRQDPSVFLSSKQKRYGEIFKTHLLGCPCVMLASPEAARFVLVSRANLFKPTYPRSKERLIGPSALFFHQGDYHLRLRRLVQGPLGPEALRKLVPDIEAAVRATLAAWADGDVASTFHAMKRLSFDVGIVTIFGGRLDERRKEELRRNYADVEKGYNSFPNSFPGTLYYKAIQARRRLNGVLSDILHERRERGEPGDDLLGCLMRSRAGGDDGDEGALLTDEQVADNVIGVLFAAQDTTASVLTWIVKYLHDRPKLLEAVRAEHAQIHEANDGG

SEQ ID NO: 119916 - protein, 168 aa, Triticum aestivum
  Clone ID: PAT_TA_14334.pep
MAALPLATAEACDANSHMITSGELRALQPVFRVYGGRRLFAGPVVTVKVFEDNVLLRGILEEEGQGRVLVVDGGGSLRRALLGGNIAMLAQNNGWAGIVINGCVRDVDEINGCDIGVRALGSHPMKSDKRGVGEKHAPVTVAGARICDGECLYANADGILVSKTELSV

SEQ ID NO: 119917 - protein, 63 aa, Triticum aestivum
  unsure (1)..(63): unsure at all Xaa locations
  Clone ID: PAT_TA_14335.pep
MNRTRAWAIVSFCVGRAILRRTKILVLDEATASXDSATNNLIQNTPQHHFSGSTVITTVHRIT

SEQ ID NO: 119918 - protein, 71 aa, Triticum aestivum
  Clone ID: PAT_TA_14336.pep
LKDMASSSYFYQTMQAERMAHSSSMNGRNSHSRQVHGSFARASANGHQSMRSMSDGPRASPFRYSPKPNVK

SEQ ID NO: 119919 - protein, 106 aa, Triticum aestivum
  Clone ID: PAT_TA_14337.pep
MDLANDPRRRATSDDPAWKYGFWPDLERKDLLQCTLCGKIVHGGVRRLKQHFSGGSSDADKCPEASMEIRIEMHNSLNTRKFKAMERYIDEDEAELQRRRSVIYTR

SEQ ID NO: 119920 - protein, 318 aa, Triticum aestivum
  Clone ID: PAT_TA_14338.pep
FCCFKVKVSPLSPTFKYLGRDHATTATTITTSAATTPSTTTTAFPSFSLQASTPAPGSTSAAQSTLLGGSSAAASTLATIATTSQATSSAIQPSSTGASTSAITPAAPQAAKLPSEIVGKCVEEIIRDWNNGLQDRTAKFRKHATAISEWDRRILQNRNVLIRLEADVAKVVETQTSLERQLELIETHQKEVDKALQSMEEEAERIFQDERVLLREDEAASARDIMYEQGEVVENELQHMTEQVKSIIQTMNSTQGGELEATDTMAPFDVAVRILDNQLRSLMWIDEKANEFSNRIQRLPNNSTAAERDSGIPRFWLS

SEQ ID NO: 119921 - protein, 177 aa, Triticum aestivum
  Clone ID: PAT_TA_14339.pep
MGNSIAASSAPALLGDTHNPCFKWKVHNFSNLLQRGEVSVNSAPFFYSGYKWFLQLTPLTKSYSAKPCVALSLGITRGSLGLEPGSVMAVVFELSIYNHSDHVHWGSKATFNFDDEHINSKKECLIPLKELLVSTDFLADDCCVFGVDILKIDALFPEKEEIAIQKAAPIQSLFIQE

SEQ ID NO: 119922 - protein, 81 aa, Triticum aestivum
  Clone ID: PAT_TA_14340.pep
KQHHHPLSRFSFQQPLQQNPLGQGSFRPFQQNPQAQGFVHPQQLPQFEEIRTPGVQTVPAMCKVYTPPNCPLAPFGILGAN

SEQ ID NO: 119923 - protein, 163 aa, Triticum aestivum
  Clone ID: PAT_TA_14341.pep
AAPAPRPPRRAPAARAPAARTGCRAPRARPRRTARGAAAPAPSTRPGARRRRRRPPPPPPPALPLPRPPPRGCAAAARPCPRPPSGRPTASPRAPTRRRPQTRGRGPLCSQLRHDDERRTEPSPWRRRREMTTGGRAGRRARAVRCSKRRGLFLPPPEPCALL

SEQ ID NO: 119924 - protein, 343 aa, Triticum aestivum
  Clone ID: PAT_TA_14342.pep
NTEWGLLMASISEDNNEETPLQVRLNGVPTFIGIVGLVVAAMVLVVLFARYFTVHTTNPDGTVQFVKGHTGVKSTIFGVIKILTVAVTIVVVAVPEGLPLAVTLTLAYSMRKMMAGQALVRRLSACETMGSATTICSDNTGTLTLNQMTVVRSIVGAIELQPQATIEKLSPTVTSLVLEAIAQNTSGSVFEPEDGSTVEVTGSPTEKAILSWGLELHMKFALERSKSAIIHVSPFNSEKKRGGVAVIGRDSNVHVHWKGAAEIVLALCTNWLDVDGSTHEMTPDKANHFRKYIEDMAEQSLRCVAFAYRNLDPKDIPYEEQRINWELPDNDLTLIGIVGMKDP

SEQ ID NO: 119925 - protein, 216 aa, Triticum aestivum
  unsure (1)..(216): unsure at all Xaa locations
  Clone ID: PAT_TA_14343.pep
FGTRLFPGEVFVFESVRPEKVQAVLLLLGGRELGPGMGVGPSSSASYSKRLNSHRMASLMRFREKRKERNFDKKIRYSVRKEVAHSVRRHKGQFTSSKAKAEEAAAAANSDWGAVEGRPLXHLCQHCGISSNNTPMMRRGPDGPRTLCNACGLAWANKGMMREVKGHTPLKVVLPATDDAQNGVAEAPTAEQQHLALEAAPEAPVAPAPAANGHDS

SEQ ID NO: 119926 - protein, 137 aa, Triticum aestivum
  Clone ID: PAT_TA_14344.pep
CPFAHGTFELWLHPSRYRTRPCRAGPACRRRVCFFAHAAGELRLASHHKGPDSPLALSPKSTLTALWESPPVSPVEGRMRWLDGIDDAADAEVEEIMLAMQQLSFANAAAPSAPSGTLPAVTEDDAPGPGGCPELVM

SEQ ID NO: 119927 - protein, 208 aa, Triticum aestivum
  Clone ID: PAT_TA_14345.pep
IIDGMAVSTVDLIGMVRNKSLSMDHCTFDLYDGTGSVNVYFWFDGRQDSKDAWSFNEGMYVRVVGRATSLEQFFQIKAYMVRTVKNFNDITHHFIYCIKAHIDISKQSRLKLQENSVATPSASTVMPRYQIAPSQIPEDCSFEDKIFSILRDPAYRSVCSDMDHGVSLKLLRSALGASQDDIMKVIIEQIRLGEMYTTIGERHFKSSN

SEQ ID NO: 119928 - protein, 74 aa, Triticum aestivum
  unsure (1)..(74): unsure at all Xaa locations
  Clone ID: PAT_TA_14346.pep
PPAGGSRGGGAAGGGXGGEGGSAGGSGGXSGAVAGSGVGDGAAAGSRVEGGATAGFRAGAARLGGGSGWRKKVD

SEQ ID NO: 119929 - protein, 232 aa, Triticum aestivum
  Clone ID: PAT_TA_14347.pep
ETNLYIGYPPPRFDDSGLINLFSQFGEIVMAKVIKDRNTGQSKGYGFVKYSDVSQANAAIAAMSGYHLEGRTIAVRVAGKPPQPAAPPGPPAAPAPQMYHSADPSAGGYNSQPYMGGHPPPPAPPGSYAPVPWGQPPPYASYPPPPPPGMYNPAPGQTAPHSYGMQYPPPPAPVPPPGTTSNDGAQNYPPGVTPPSSGAPTQPVPAPAYGASGAQNMPHMYPPPPYGYAPYY

SEQ ID NO: 119930 - protein, 250 aa, Triticum aestivum
  Clone ID: PAT_TA_14348.pep
MAPRLRARPLPLWWPSAAGRPQCRFSGVSRGPLTVVHVTVVIISSFEELKTIITRGSERRHTAGTNMNDESSRSHLILSIIIESTNLQTQSYARGKLSFVDLAGSERVKKSGSAGKQLKEAQSINKSLSALADVIGALSSDGQHIPYRNHKLTMLMSDSLGGNAKTLMFVNVSPAESNLEETHNSLMYASRVRCIVNDTSKHVSPKEIMRLKKLISYWKEQAGKRSEGDELEEIQEERTSKEKADTRLTA

SEQ ID NO: 119931 - protein, 320 aa, Triticum aestivum
  Clone ID: PAT_TA_14349.pep
MEEEFLRFEEDKAMGCGNLSSTLQKLYMWERKLLQEVKAEEEERLKYDRKRQDLQILDEKGAETEKIVAAEKEIRNASTRISIAIQVVNTISGKISKLRDDELWPQTCELIQGLMRMWDVMLECHQIQLHAISQAKNIDSMIDAARFGDDHMDLIKHLELQLLDWTTCFAGWVTAQKNYVSTLNDWLRKGVEYVPEETDDGVPPFSPGRLGAPPIFVICNNWAAGVARISEKEVVKAMQAFCANVLHLWEKHRSQQRQGMMANKGMDRDLRVMEKDEQKMRKALEAKNKKLVLVSDQTGVSLSAQVLQGAGPQAENSSLQ

SEQ ID NO: 119932 - protein, 155 aa, Triticum aestivum
  unsure (1)..(155): unsure at all Xaa locations
  Clone ID: PAT_TA_14350.pep
TAPXERGXXARILHERLXXTAXTFPNGRNTXXXLVAXSRRHLHLXGNRTAGRTSGGIAPFAGLLLRGGDTLHLQHGEEPRRRRLSRTNLALDTNCWRCLLAALASSSTSCCLSQLDLYLSQVSLNKNNTTQKTHTYTHTLSPRKRNALALPKETS

SEQ ID NO: 119933 - protein, 205 aa, Triticum aestivum
  Clone ID: PAT_TA_14351.pep
MHVVECCCHDLMTSSESGASAALVAAFKEAQKYSPSIILLRHFDAIGNTSSNEGPQSEQSGIAANVESVIKQYTGQRWVVKDSLPARDVIGNSYLVERECVSSVQVILVATADSAEGMQQSIRRCFRHEVNMKTINEDQRKNLISETLHGVSAVADESIDDKFVKDISVQTSGFMPRDILALVADAGVSFAHKVAVEKSSNDELE

SEQ ID NO: 119934 - protein, 226 aa, Triticum aestivum
  unsure (1)..(226): unsure at all Xaa locations
  Clone ID: PAT_TA_14352.pep
MKTFLILALLAIAATTATTAVRVPVPQLXPQNPSQQRPQXNXPLVQQQQFPGQQQPFPPQQPYPQPQPFLSQQPYSQPXPFPPQLPYPQAQPFPTQQPYPQPQPQYPQPQQPISQQQQQQQQQQQQQQQQILQQILQQQMIPCRDVVLQQHNIAYASSQVLAQSRYQLGAQIMCQQLWQIPEQSRRQAIHSVVHAIIFHHHQQQQPSSQVSYQQPQQQYPSSQGSF

SEQ ID NO: 119935 - protein, 131 aa, Triticum aestivum
  Clone ID: PAT_TA_14353.pep
NKNVTTDNIYCSCSSSLFSSQPRGEDDQSPRIKGWFSRSTRSLPYRFLDRLGAASSSLSLSSSRKALLPNLSPDWDLFPSAPEFPALLSWPLLPWSDPVSYLSPRLLSPPGLLWSRFAGRGGGGGMKGAMP

SEQ ID NO: 119936 - protein, 294 aa, Triticum aestivum
  Clone ID: PAT_TA_14354.pep
MKTLLILTILAMAITIGTANIQVDPSGQVQWLQQQLVPQLQQPLSQQPQQTFPQPQQTFPHQPQQQVPQPQQPQQPFLQPQQPFPQQPQQPFPQTQQPQQPFPQQPQQPFPQTQQPQQPFPQQPQQPFPQTQQPQQPFPQLQQPQQPFPQPQQQLPQPQQPQQSFPQQQRSFIQPSLQQQLNPCKNILLQQCKPASLVSSLWSIIWPQSDCQVMRQQCCQQLAQIPQQLQCAAIHSVLHSIIMQQQQQQQQQQGCNLFAQIPPPRPVGPVIPPAGAPSNQLNLRWGKSVFPFYK

SEQ ID NO: 119937 - protein, 123 aa, Triticum aestivum
  Clone ID: PAT_TA_14355.pep
FLLQSASSIYEFGVSGLMALSHEEVEQEEEEDDDLDDGPLSPEDVLRSVESVGSVEPAKRKLLMKDTMGVPPEPYDWPNICPLPGSSRDRSSACDLYWHQAYQMNQASAACLPSMRYTRCCNE

SEQ ID NO: 119938 - protein, 131 aa, Triticum aestivum
  Clone ID: PAT_TA_14356.pep
GIDNPSLTSGCKYLFFVCRSCLCGVVWFFYWFDNLGLITEGNTYRCCDASSLPLWGNTDVVQANIKRNFWCRCRGDIINIYQVPNHKSHLLAIHIISHLPLIFLPPLHKNLLFYSPPFSFAVFSSDLFLSA

SEQ ID NO: 119939 - protein, 134 aa, Triticum aestivum
  Clone ID: PAT_TA_14357.pep
MDTGADPPRHRRLRKASDLRTAPAAYPPPKRIRPGEEHNSCREDKISSLPDEMLILIIDKLDARTATATTILSKRWRDLYTHSHTGYDLTVDDILPPRYHRLKQIVVEAEAGYEAENNALKSDGSDASRDWLYS

SEQ ID NO: 119940 - protein, 161 aa, Triticum aestivum
  Clone ID: PAT_TA_14358.pep
PFPEPQICAPVLGQAYGSVRGRGHGPPPNRRAYSSASSSTQHVVGELASTKEIVATQQTPIEAPQSHLEAQQKKIDWLQSVVSNLVGISPPMDGTSATGLGFTTERPMPSNGIGSLISNTVERMSSFPRSFASLRPGYRPAPTSSSDGNGSLVSDGGSRYS

SEQ ID NO: 119941 - protein, 110 aa, Triticum aestivum
  Clone ID: PAT_TA_14359.pep
LPQKCAVQCASRRPIYVEAFEGEEYDDALEELNLYAYQRVPNPTYARDKDKVRAEIPTFNGNVDIEGCRDWLYEVETFFEVMEIPEDRRVSLVAYKPQGGASAWWHRLQE

SEQ ID NO: 119942 - protein, 144 aa, Triticum aestivum
  Clone ID: PAT_TA_14360.pep
MASGETGKLGRELSRGVASKSKSPKKKDKKKEKKEKKKAVVVNPSLPREPEPEIDDSDDSEFWVPPVGSRWDDDDGKDRWESSPGKDDIAEDEGASDDEDDDEMADKDDEVSEELASSRTKRLSVEAVGPSSFATRKKKPRKDE

SEQ ID NO: 119943 - protein, 279 aa, Triticum aestivum
  unsure (1)..(279): unsure at all Xaa locations
  Clone ID: PAT_TA_14361.pep
ARGVFTSTMWREILNAAGTKLLYSTAYYPQTDGQTERVNQCLEIYLRCSVHDTPXAMAPXLSAAEFWYNSSHHASLNCFPFKALYGREPNLGGMPAGNTNLPADAPLVEIDWATHTELLRAQLARAQARFKKQADRHRAERAFDVGEQVSSSFNAYAQTSVANRPCRKLAYKFFGPFTVTEHVGTLAYRLNLPPDSRIHPVFHVSQLKPFVPDYTPVFAKLPKIPDLTATERVPVAILDRHMMKKGDAPVVQVQVQWSSMPPSTATXEDYYVLRQHYPD

SEQ ID NO: 119944 - protein, 107 aa, Triticum aestivum
  Clone ID: PAT_TA_14362.pep
GRRKSGDGGARPSVPPSRRPRQDPAVLRSPGVRRRSRAAAGRRRVRSRPDLGRKRPALRGGGAGSRSAGPPAALESGSALAGEWRRAWRSRCAPATELCTVSLRTRG

SEQ ID NO: 119945 - protein, 252 aa, Triticum aestivum
  Clone ID: PAT_TA_14363.pep
MEAAMDLMRRMPPGSTETALNALLSLLPDHSLDLLSQVDLPLQVCMDKENNKEYILCEYNRDADSYRSPWSNIYEPPLEDGTVPSEEMRNLEVEANEVFSVYRDQYYEGGISSVYIWEDEDESFIACFLIKKDGQGKRGYMQIGSWDAIHVIQVGPEEEGAAHYCLNSTVMLSLTTDNKQSGTFNLSGSIRRQMSMTLAVADGHLVNMGKMIEEMEGKLRNSLDQVYFGKTREMVCTLRPPPEVLNMRLPDS

SEQ ID NO: 119946 - protein, 181 aa, Triticum aestivum
  unsure (1)..(181): unsure at all Xaa locations
  Clone ID: PAT_TA_14364.pep
MDGRAGGGGSGDYISSLLTSSPMLDFGVLDGAVAAGGDCLEKFCGDPGFAERAARLSSFNGQHFXQGLFGMPPPAPGAGNGEFGGSREASSVSDPASAMKDANAKKRKAPAGKGKAKEPSLSTSCQVGEQKESDGKRCRTGDAEKKVKPKAEQAGSDSSVEDGEQRKGGKGKNAKPVEPPK

SEQ ID NO: 119947 - protein, 191 aa, Triticum aestivum
  unsure (1)..(191): unsure at all Xaa locations
  Clone ID: PAT_TA_14365.pep
YRLRIATGGLRSTLGVHDPGPQLXLVEVEGTHTVQNTYTSLDXVHAGQSLSVLFTADRPAGGYHIAVSSRFTNQTLNSTAVLRYAGSTGPVSGPPRAGNQSDVDFSLNQARSIRTNLTASGPRPNPQGSYHYGSINVSRTIRLANSAGQVGGKPRYGVNGVSYVDADTPLKLADYYNISGVYRMGAIPDAP

SEQ ID NO: 119948 - protein, 109 aa, Triticum aestivum
  Clone ID: PAT_TA_14366.pep
VMFVLHPRCCWYILMHACVWPLMFLSLYAIVLKDYDLLLSVVLDDMAIDASACSASKDQILIKKKMEVQSLEDNDLKEYDLKLLVVLDETATVRSSFPKGNDRRRITER

SEQ ID NO: 119949 - protein, 180 aa, Triticum aestivum
  Clone ID: PAT_TA_14367.pep
VRGRVGDHRAVRIGGQRRMLVSAGVHYPRATPEMWPSIIAKCKEGGADVIETYVFWNGHEPAKGQYYFEDRFDLVRFVKLVAAEGLFFLLRIGPYACAEWNFGGFPVWLRDIPGIEFRTDNEPYKAEMETFVTKIVDMMKAEKLYSWQGGPIILQQIENEYGNIQSKYGQAGKRYMQWAA

SEQ ID NO: 119950 - protein, 98 aa, Triticum aestivum
  unsure (1)..(98): unsure at all Xaa locations
  Clone ID: PAT_TA_14368.pep
MNSKQWKTMLTEATFVGHGFTRKPVEYEKXSHGTHPELKSVFNLGIIXVTKTPSGPIFCLFSACCFWFVITEFTTYYSCISFILFWWVLNYEIRTIVY

SEQ ID NO: 119951 - protein, 220 aa, Triticum aestivum
  Clone ID: PAT_TA_14369.pep
RESGSGGEMKKRKTAAGVGSKKAAAAAEDPVEESDIQEGPVESISTAKSNLARTKKILNAKIAKLVGVESGEGPHYKTKTMTEEDVAAAAMYRAKGEEAHRNQDRKGELDAVIKWIATGDPEAIRISDQWMAENVEAMKLEPKDPTDWLDEQAKDYREFWDLHWAGSFGKWEDITLIQPMLYTDGKPPQDVYPIRTLQVFSVQVAAITEELGWPLDVFGI

SEQ ID NO: 119952 - protein, 154 aa, Triticum aestivum
  Clone ID: PAT_TA_14370.pep
MSPQAAAALGFLLPTCWEIEVTCAAAMLIVALYAAYELLGPRAPPAGADDLALARDLDGADKYSTGPSAYVVKLELLAAKNLIAANLNGTSDPYALITCGEEKRFSSMVPGSRNPMWGEEFNFVVDSLPVKIQVKIYDWDIVWKSTTLGSVTVP

SEQ ID NO: 119953 - protein, 194 aa, Triticum aestivum
  unsure (1)..(194): unsure at all Xaa locations
  Clone ID: PAT_TA_14371.pep
ASSLCAWNAPRALTGALASTTQCSSCSHAEAVGGGRRRGRPRQSNNNTLLHITWAEDINKGVRPRVRSASFVXLGKKNRYWSTPVKSMWRVSCYSSGPFDLVSPETLWESLRPAISYLQPEELNFVHDALELAYEAHNGQKRRSGEPFIIHPVEVARILGEHELDWESIAAGLLHDTVEDTDMVTFETXQNEFG

SEQ ID NO: 119954 - protein, 102 aa, Triticum aestivum
  Clone ID: PAT_TA_14372.pep
GYEWGRSNKDNGSNPHGYLPTHYEKVQMLLSDRFLGFYMVPDNAPWNYNFMGVKHDPLMKYSMKLGTPRDFYHEDHRPTHFLEFSNIEEGEVAEGDREDTFS

SEQ ID NO: 119955 - protein, 892 aa, Triticum aestivum
  unsure (1)..(892): unsure at all Xaa locations
  Clone ID: PAT_TA_14373.pep
ALKRQEAQSHNRRLTLEDLEDSWDRDITLFQKDRHTLAYDFKQYEVLKQNPLWXHDGKLWSLNNYRTDIIQTLGGVEGILEHTLFKGTYYCXFPTWEGLFWEKASGFEESIKYKKLTNAQRSGPNQIPNRRFTLWWAPTMXINRAHVYVGFHFPGSARILTGSLAGQRVCSAAXLAACPAADSVMCVMRPSGAAAPWSLGRTCTPTTTETPSQHRRQSSPLRTVKSTXPIHDLKRISLQRQVEPQPWALLASYLTEHEXFYGLRADGLHAYPPEVSPSSIPPGLEAMNKIMKPNPALYVLRERQRKGHQLYSTEPAEPHQSAPNXVGIFPSQLIGFVHHTNVHRFTIHKTFEGNLPPIPINVATFVLNSVAMQLHRNLARPTVWAGQKSLGQLAKCKTAGALAALLRGVHVEEEPWQIIVGKKGMLDVVEVNLLDFPNIVFNGSELKLPFQACLKIDKDXIFDAKASVSQMVPHDIYDDWXDTFSHGTAFSRLVLILRALHVNNEKAKMLLKPDKTIVTEPHHIWPSLTDEQWLKVECALRDLILSDYAKKNNVNTSALTQSEIRDIILGAEIAPPSQQRQQIAEIEKQSRETNQLNAQTTRTTNVHGDELIVTTTSPYEQAAFASKTDWRVRAISATNLYLRVNHIYVNSDDIKETGYTYIMPKNILKKFICIADLRTQVAGFLYGLSPQDNPQVKEIRCISIPPQHGTHQMVTLPANLPEHEFLADLEPLGWMHTQPNEAPQLSPQDLTSHAKILENNKQWDGEKCIILTCSFTPGSCSLTAYKLTPSGYEWARGNKDNGSNPQGYLPTHYEKVQMLLSDRFLGFYMVPDNAPWNYNFMGVKHDPLMKYSMKLGTPRDFYHEDHRPTHFLEFSNIEEGEVAEGDREDTFS

SEQ ID NO: 119956 - protein, 410 aa, Triticum aestivum
  Clone ID: PAT_TA_14374.pep
RPVIDGLGVAGWGVGGIEAEATMLGQPMSMVLPGVVGFKLTGKLRNGVTATDLVLTVTQMLRKHGVVGKFVEFHGEGMGKLSLADRATIANMSPEYGATMGFFPVDHVTLDYLRLTGRSDETVSMIEAYLRANNMFVDYNEPQLERVYSSYLALDLDEVEPCISGPKRPHDRVTLKDMKSDWHACLDNKVGFKGFAVPKEQQDKVVKFDFNGQPAELKHGSVVIAAITSCTNTSNPSVMLGAALVAKKACELGLEVKPWVKTSLAPGSGVVTKYLLKSGLQEYFNKQGFHLVGYGCTTCIGNSGELHESVSAAITENDVVAAAVLSGNRNFEGRVHPLTRANYLASPPLVVAYALAGTVDIDFERTILEGWKFSGYMALRTKCHQCRIQTNQAQKDHWTLKHNNLAQRKH

SEQ ID NO: 119957 - protein, 145 aa, Triticum aestivum
  unsure (1)..(145): unsure at all Xaa locations
  Clone ID: PAT_TA_14375.pep
KDPASAPPPPPPQAPSPDKEKARRPTDGGAGGGSPQRPPQPPRILRARRAPTAAPGPGRPAAAAAAPPELPPPRPALPDQRGVSIVLPREEIAQDFAFFRGTRPPRRPXKRSRPVQRQLDLLCPXGLSLEDLTPDSYQDRRRGEC

SEQ ID NO: 119958 - protein, 368 aa, Triticum aestivum
  Clone ID: PAT_TA_14376.pep
NSARGELEDYLQRLSNLPKLFDRNPISMTDKLVELYLELLCQYEPRSVLKFLETFDSYRLERCLLLCLDYGVTDAAAFLQERVGDVASALELVLAGLDEKVNQFIASVENAFSRTSSKSISEIEQPDIVLNMSEAHPVLDVLRSSIGLCQRNSQRLDPEESQLLWFQLVDSFSDPLKKLYGSKVVNGKGCWSVGGETTNGHQTGKGFSQKMVNSAYQRCLNTLRRVFSQFVGEIIEAMAGYIPLPAIMAKLLSDNGSQEFGDFKLVIHRMLSMYLYEKRILFEILNNLQKGQKSFHIETVPPLKLSPPAIYHEKIQKRVSLVGESSRHSVRSEKPQKIWHMKEPKSKKSGNWLPPKSSIFSSDKNQVR

SEQ ID NO: 119959 - protein, 305 aa, Triticum aestivum
  Clone ID: PAT_TA_14377.pep
AVRTKFISSPGPHTNRLSFTYEELNAATLGFPRDHFLGEGGFGKVYKGVLDGNEVAIKILNPNGLQGNREFCTEVMVLSRMHHPNLVKLVGFCADDERRLLVYEYMPLGSLETHIFDLPPDKKPIDWNTRIKILVGAAQGLKHLHVNCNPPIINRDVKCANILLGEEYHPKLADFGLAKLGPTGDDTHVSTRVMGTPGYCAPEYLESGQLTIKSDVYSFGVVILEVITGRKALDQSRIKAERSLAEWATPLINRRDFALLADPALGNQYSMTSLYQVLSVARMCLNKTASQRPQITDVAAALAHI

SEQ ID NO: 119960 - protein, 285 aa, Triticum aestivum
  unsure (1)..(285): unsure at all Xaa locations
  Clone ID: PAT_TA_14378.pep
AGGRPSSPPSSPPPADALRAAAXAEXLEGLSEMVDKVWSDDTATQLEATVQFRKLLSDGKNSTMIKIIRADVLPRFAEFLSRQRPPQLQMEAAWVLTNIAASDYTLLVAECGAVPRLVELLESPDANIRHQAIWALGNIAADMPSCRETVLDHGAVTPLLAQFKEGMKVSVLRTATWALSNLCFGKLPAEVQVKPILEIISLLIHSADEKILADACWALYYICDGVEGGIQDALDAGVCPQLIKLLMHASANILLPVITSLARISAGDDTQVQLTATTRSEEPTM

SEQ ID NO: 119961 - protein, 177 aa, Triticum aestivum
  unsure (1)..(177): unsure at all Xaa locations
  Clone ID: PAT_TA_14379.pep
MGRQPCCDKVGLKKGPWTAEEDQKLVGFLLTHGHYCWRVVPKLAGLLRCGKSCRLRWTNYLRPDLKRGLLSDEEQQLVIDLHAQLGNKWSKIAAQLXPGRTDNEIKNHWDTHIKKKLRKXMGIEPVTHRPLGQKAPPPPQQPPPPPPTTTAWQQLDGAERSQQAEDEDVKAVPLIQP

SEQ ID NO: 119962 - protein, 234 aa, Triticum aestivum
  unsure (1)..(234): unsure at all Xaa locations
  Clone ID: PAT_TA_14380.pep
PRVRIHITEVLEEDCSEHPFTKLKIGQKVHARIVAQAEHSAKTGRNLKWELSIKPSLLKADLEELTASEAELNHSINDIVRAYVVKVDTEWIWLTVSRKFMAHLFILDSSVEPSELKEFQQRYSVGQAVKGHIIGVNREKRLLRLKAFDNQCMLEDIDDTQKTASSIAEHTKEGDIIGGRIQRILPGVGGLVIQIGPHLHGRVHYTEIVDSWGTXNPILGSMESQXVKXKXLGC

SEQ ID NO: 119963 - protein, 232 aa, Triticum aestivum
  Clone ID: PAT_TA_14381.pep
MEPAVERKVPEQEEQLQPSHARAEDAPPAAVEEEDEAEAEESERRNRELKAGLHPLRRKLVLWYTRRTPGTRSQSYEDNIKKIVDFSTVESFWVCYCHLARPSSLPSPTDLHLFKEGVRPLWEDPANRNGGKWIIRFKKAVSGRFWEDLVLVLAGDQLDYSDDVCGIVLSCRFNEDILSVWNRNASDHQAVMTLRDSIKRHLKLPHTYLMEYKPHDASLRDNSSYRNTWLRG

SEQ ID NO: 119964 - protein, 228 aa, Triticum aestivum
  Clone ID: PAT_TA_14382.pep
SDEDSSLVELLFQYGRYLLISCSRPGTQISNLQGIWNQDLGPGWDCAPHLNINLQMNYWPTLPCNLTECQEPLLDFIASLAVNGTKTAKINYQASGWVTHHVSDIWAKSSAYNEDARFSVWPMGGAWLCTHLWEHYQYLLDKDFLKNTAYPLLEGCALFLTDWLIEGPRGLLETNPSTSPEHVFIAPGSGGQQASVSYSTTMDIAIIREIFSAVISSAEILGKSDTPL

SEQ ID NO: 119965 - protein, 148 aa, Triticum aestivum
  Clone ID: PAT_TA_14383.pep
SFGVLLLEIVSGRGHTDPRLPLQDQFLLETAWTLYESGDLGSIIDRTLKDGFSTDEAHKFLKIGLLCTQDSPKVRPSMSTVAKMLKGECAVSDKIMRPGLITDVMDLKVRTIEPALQLSVSPPMSPLDNHSLVSNLAFAGSTVIRDSP

SEQ ID NO: 119966 - protein, 128 aa, Triticum aestivum
  Clone ID: PAT_TA_14384.pep
PKGSSAPPKEPTARSGQTKSGHHGHSRGAPHSPPHHIQTQPREWNTHEPPPLSRAATSRRTPARANLRQPRGENAPPPPTPTGLCPAKASGRGGRRGRDRRRWGGPPYRLREGKGEFFSWSPLPTLSR

SEQ ID NO: 119967 - protein, 260 aa, Triticum aestivum
  Clone ID: PAT_TA_14385.pep
MWRRAGPILGLCGIAGRRVRRPPQPPAPTATCSTSAFASSSFHHNLGTFRDSIGVPPSRSLSNQAGGDGGIGGECWSCGAKGAFLSCGSCRSVQPVDPAVDYFRIFGLDRGYDVKDTNLEGKYKDWQKKLHPDLVHSKSEKERDFAAGQSALVIEAYRTLSKPLPRALYLLQLEGIHVDEEKTINDPELLMEMMEIREAVSEAGDSETLKKIQSQMKRKLETWSKAFQEAFDKRDFDGAVEATQRMRYYERAMEETVKKL

SEQ ID NO: 119968 - protein, 181 aa, Triticum aestivum
  Clone ID: PAT_TA_14386.pep
MAAVESKSRRFALACSVLSQYVKAEQKMSSAVAVAPRAPPATTLSLMPGADVDQAAAAADEAGPATATPLTIFYGGRVVVFEDFPADKAAEVMRMAATAGVERAAVTPAPAQAALADLPIMRKASLQRFFEKRKDRLGARAPYARPAAPAANKESEDKSASASASSSSWLGLASTDGAFAL

SEQ ID NO: 119969 - protein, 173 aa, Triticum aestivum
  Clone ID: PAT_TA_14387.pep
MAAMESKSRRFALACGVLSQYVKAEQKMSSSAVVAPPPRAPPATTLSLMPGADVGQDHAAAAAEEAGPATPLTIFYGGRVVVFEDFPADKAAEVMRMATTAGVERAAATPAPDLPIMRKASLQRFFEKRKDRLGARAPYARPAAPAANKGSEDKSASSSSWLGLASADGAFAL

SEQ ID NO: 119970 - protein, 196 aa, Triticum aestivum
  unsure (1)..(196): unsure at all Xaa locations
  Clone ID: PAT_TA_14388.pep
RRQRAKAQLLMSGPRFRAFVTRCSRRKVERDLLPLLAHVAGGGTGVCDLQDVFLRLTFDTTTTLVFGVDPGXCLAIGFPGGXRSLXAMDDAXDVXPRPQRCVPPXVCGKLVRWLGGGXERRGAEGRRERARTIGGTNAGRREAVKARGGIEDSADLLSSYIDDDDEASTVVDAFLRDTTMNLTLAGRDTTGSGLSW

SEQ ID NO: 119971 - protein, 83 aa, Triticum aestivum
  Clone ID: PAT_TA_14389.pep
RGQEGATSLCDWVVICLSASLTSIIYPVKTDLRVTQHPSALHWRSSKQTEAVASSGGHACINVHFILLPAACYPFLLVSARFR

SEQ ID NO: 119972 - protein, 248 aa, Triticum aestivum
  unsure (1)..(248): unsure at all Xaa locations
  Clone ID: PAT_TA_14390.pep
MGSDSKELLGIEPLELRFPFEFMKQISCSMELTNRTDDYLAFKVKTTSPKKYCVRPNSGIVPPRSTSSVVVTMQALKQAPPDMQCKDKFLVQSDVVTEGTAVKDITGQMFKKESGNVVDEVRLKVVYVQPPRPPSPVREGSEEGSSPRPSWSDGANINXSRYATRESDEPPLSSAHKEPSGIPTETSPLISRLTEERNSAIQQNNKLREELDLVRREISKQNGNGGFPLVFVVAVALLGILLGYLMKR

SEQ ID NO: 119973 - protein, 235 aa, Triticum aestivum
  unsure (1)..(235): unsure at all Xaa locations
  Clone ID: PAT_TA_14391.pep
MMRSCLSLALLVALSAAGCAAAQAADYDFFYLVLQWPGSYCDTKQSCCYPRSGKPAADFGIHGLWPNRDDGSYPQNCNPANAFDPSKNASDTPRVSDILSSLRRQWRTLPCPTNDGPRFWAHEXEKHGPCARTLFHEHGFAPTAXAPPRPAPXLDALAAAGVSPHRAAAEVGAEVGWCGEGTGFAPHVDCNRDESGNSQLFQLYFCVHADASRFVECPVQPGGRPCGNRIEFPAF

SEQ ID NO: 119974 - protein, 311 aa, Triticum aestivum
  Clone ID: PAT_TA_14392.pep
MPELRSGVRQSRLKSRKAEDLDVQDPAENLAVAAPTVAGKRGRGRGGRGGGRGRGRAGGRGRGVPVIDLDPDQPFEVLPGAGVGGGAVGGPQRIEEFADKAVKMDGASPDKIGGGEDDASPVPEKVQVGHSPQYKVERKLGKGGFGQVYVGRRVSGGTERTGPDAYEVALKFEHRNSKGCNYGPPYEWQVYSSLNGCYGIPWVHYKGRQGDYYVLVMDILGPSLWDVWNSLGQTMTPSMGGCIGGEAISILEKLHAKGFGHGDVKPENFLLGQPGSPGEEKLFLIGLGLASRWEETSSGQHGDYDQRPDIF

SEQ ID NO: 119975 - protein, 409 aa, Triticum aestivum
  Clone ID: PAT_TA_14393.pep
APRLRPAPSCRPPPPALSPPLPSQAQPSPSYSPTSPHTTSGGPSPDYSPTSRQEGMMSPLLSPNFRASPSSNAQFSPYVGGMAFSPIPSNYSPSSGGGYSPSSPVFSPGPGHGYSPTSPSYSPASPSYSPTSPSYTPGSPSYSPTSPSYSPTSPSYSPTSPSYSPTSPSYSPTSPSYSPTSPSYSPTSPSYSPTSPVYSPTSPAYSPTSPAYSPTSPSYSPTSPSYSPTSPSYSPTSPSYSPTSPSYSPTSPSYSPTSPSYSPTSPSYSPTSPAYSPTSPGYSPTSPSYSPTSPNYSPTSPSYNPSSAKYSPSHAYSPSSPRMMSPYSQTSPNYSPTSPTYSPTSPSYAQPSPSYSPTSPHTTSGGPSPDYSPTSPNYSPSASYSPTAPGYSPSSTGPQTTDKDDETVD

SEQ ID NO: 119976 - protein, 242 aa, Triticum aestivum
  Clone ID: PAT_TA_14394.pep
RAGLTMAEAPDAVRFVGCDVQCVRHAAWSEWACSLRASDDIPMCWPWHAPHPSMLTVRPRLLEAVAPDHGHSRMQDPASHIAALRLLPRNKACCEQACESAACRCGCSPLSRPGAAPCRSPSYGPVCARAATLGAAALLLPGTTPGASAARRSGGRPPAACSSTKTNSPVVWPLHFTGEPLAAGAARTCSLLFVFWPRMQCLYFLQSFTCVPWGSLVIISLKTQNSPYFVSKKEVHFALVIR

SEQ ID NO: 119977 - protein, 216 aa, Triticum aestivum
  Clone ID: PAT_TA_14395.pep
MAEAAVGGPHLPEEIVTWEILIRLPPKPLVRCRAVCRSWHRRLTSDAKFLFAHHRRQPSLPLVTTEDTHERRIDALDHSTGERRPVARAARTAADEHFDVLASCDGLLILVAYGGVYICNPATRQHAPLPLLHVYCIAGLYFHRPSGSYRVLCCLKTTEDGQFRAVYQVYTLGSGDLRCIGKALEPWTSGDLARAMPMMVSFQPHGLAGGRLYWQP

SEQ ID NO: 119978 - protein, 190 aa, Triticum aestivum
  Clone ID: PAT_TA_14396.pep
PGLPLQPPSAFLSVLDRRPEREELAPEPAHSSAPHRALPRRRNPALFPPAPPASSASRPPTRPPTRPRPARVAAAVPEMSVPRPSLLPSSILLPLPHISLPLSARTRELQRLEATAPPSSRHCLELSPRPLTAPDRRPLSCVAPRQNTTRLRPFSPPSGLAPRPHYITARVGPSLSCLRCGPPAPASPRS

SEQ ID NO: 119979 - protein, 106 aa, Triticum aestivum
  unsure (1)..(106): unsure at all Xaa locations
  Clone ID: PAT_TA_14397.pep
LRLAAAARPPPAPAPPRARRPPQGPLAAAPAPFRRPPCPPPAPPGPPPPPXPPPRPRARAPPPRLPPATPPPALPLLVQVPVNVGGRALALASSGAPLPPPPLAYY

SEQ ID NO: 119980 - protein, 128 aa, Triticum aestivum
  unsure (1)..(128): unsure at all Xaa locations
  Clone ID: PAT_TA_14398.pep
PDDVAGPGSDPSGLHLQLVLRAGSLAHQCIQRQVRMPRHREPERHLGTGTSGAEXRASRGDGSDPPPATARAERRCPVQRSAARGRPRPPRRPAGAAPPGRRCRAGEGRGGGRTPGKPRPLGGGSGSG

SEQ ID NO: 119981 - protein, 96 aa, Triticum aestivum
  Clone ID: PAT_TA_14399.pep
FQLTAYFHSSKHVRRLVDMTVHCPGAELNCEEIGHYDSWLEDLHAVKTNYFPGLKNLSTQNVRPIVFVLNYGHIYLGKMVTFLIFVLGASFAYIIF

SEQ ID NO: 119982 - protein, 231 aa, Triticum aestivum
  unsure (1)..(231): unsure at all Xaa locations
  Clone ID: PAT_TA_14400.pep
MDSGDAWGRSSSSSSAAAAARRLQSRYDLYMGFDDADAGGDEVEARGAEAYNCPFCGEDFDFVGLCCHIDDKHAVEPKSGVCPICATRVGVDLICHMTMQHGSFFKMQRRRRVRKVSSGSLSLLSXLLRKDLRNGSLQSFLGGSSYVSNPPAAAPDPFLQSLICSLPVAEPSKDFRSDSSDKTFLLNKFPDEKIVERAETSLSEKDQKERAQRSAFARGLVLSTIFDDDTM

SEQ ID NO: 119983 - protein, 185 aa, Triticum aestivum
  Clone ID: PAT_TA_14401.pep
PAAMRASSGSPPIPTSKGEGVMEVESDQDQDDCDVMIEPAAALRGLYAMMVSWCDQFLDIDIDIEEEGDRSVPPLLMIHFPRLFERAWGNNRLYPQALDDCCPYRAYLQKFCDHNAPRYHDPDAYKLCMDQEIRLKSEWLYKHTHVPHDEISLSDNIQNCAYELIRSNSGEGDSPISMIAATCVA

SEQ ID NO: 119984 - protein, 192 aa, Triticum aestivum
  unsure (1)..(192): unsure at all Xaa locations
  Clone ID: PAT_TA_14402.pep
MEMGGDEMMMTSGATGRIVPVFRSVLSRRALLRLAVALHSLFLWLLLLVGRRRRPDAASPAEPGRLGKARSRRRAAEEEDVRRRRALAEEVPMVEDDADADGRTCGTFVIAGARRNALFCRVWAPAAGAETRGILLIVHGLNEHSGRYLHFAEQLTSCGFGVYAMDWIGHGGSDGLHXYVPSLDYVIEDMEV

SEQ ID NO: 119985 - protein, 176 aa, Triticum aestivum
  Clone ID: PAT_TA_14403.pep
QNSLVEMASLYAHIRTRLEGIILTSPAVRVKPAHPIVGAVAPIFSLIAPKFQFKGANKRGIPVSRDPAALLAKYSDPLVYTGPIRVRTGHEILRISSYLLHNLKKATVPFMVLHGTADRVTDPLASQELYTEAASRHKDLRLYEGFLHDLLFEPERDEIAADIIGWMDRTLGLQAV

SEQ ID NO: 119986 - protein, 292 aa, Triticum aestivum
  unsure (1)..(292): unsure at all Xaa locations
  Clone ID: PAT_TA_14404.pep
LSTYYQHVSRYDYSPPSGFPRAHGVKPCSAPAVPAALVRVVPSAGWQIHRRFDLKGSSYGRTADKFEEEIDETTTLKDLDLNFVFRLRRSWYRDLHEQLQRDCEFLESEGIMDYSFLVGVHFCDDVSASKMGLSTFTASPKLSMKCETFQVGGGGMPELCFSDNDYDRIPDCRKPLIRLGAHMPARAEQASRRSEFDPFLLSGGGFLAPNQTGEVHDVILYFGIIDILQDYDITKRLEHVYKSLQTDPNSISXVDPXLLPRRFKDFIGRNFCKMAKFWGKESTRKFHWEPPD

SEQ ID NO: 119987 - protein, 145 aa, Triticum aestivum
  Clone ID: PAT_TA_14405.pep
NVIAVIKESVKTFTYETLNNIARLINGISALLLTLLPGKANILEGVSGWELRPAFRGPRLPRWMESGVSSFNEFIHELSADSESESIAGSVPGDDDNEEFVCPPSPLSQSSRLSHTSSFGRHDRRLRRPIKYAVSWINWAVKNFP

SEQ ID NO: 119988 - protein, 93 aa, Triticum aestivum
  unsure (1)..(93): unsure at all Xaa locations
  Clone ID: PAT_TA_14406.pep
KLXEMFDIQGELCSTLKKWQVVYADEEDDMMLVGDDPWDEFCSMAKRIYIYTYEEAKQLAPKATKLSRVNSSHESVTPQSGSEYPASFANADC

SEQ ID NO: 119989 - protein, 116 aa, Triticum aestivum
  Clone ID: PAT_TA_14407.pep
PHHSETCSREEMEVNSRTRASERFGARASVASTEAGDLQLDFLFGFSPSRFLNLSSPLLSSHPGHSCTLAGSRRRRRRAGPSVSGTACSELWIGGWAWKEEKKCRWFCAWRGREAI

SEQ ID NO: 119990 - protein, 71 aa, Triticum aestivum
  Clone ID: PAT_TA_14408.pep
AANIECCFGRSKEEAGRRKKFRLKTWSKEEAGQRKKFRLKWREEFYSCVYPAGCDGQGGLYLGRDHARMPR

SEQ ID NO: 119991 - protein, 160 aa, Triticum aestivum
  Clone ID: PAT_TA_14409.pep
MEHGQATIRVDEYGNPVAGHGVGTGMGAHGGSGTGAATGGHFQPTREEHKAGGILQRSGSSSSSSSEDDGMGGRRKKGIKDKIKEKLPGGHGDQQHADGTYGQQGTGMAGTGAHGSAATGGTYGQPGHTGMTGTGTHVTDGAGEKKGIMDKIKEKLPGQH

SEQ ID NO: 119992 - protein, 170 aa, Triticum aestivum
  Clone ID: PAT_TA_14410.pep
MEQGRTTEHGQATNRADADGSPVAGQGVRTGMGARGGGGTRAAPAGQVQPTREEQKAGGSVQRSGSSEDYSSSEDGEMGGRGKKGIKDKIEQHHQQHAAGTYGPPGTAGMHGPGGHGAAAARGTHGPQGHTGVTGTRTQITEGTRRNDGPGGKNEGMADRTEKRPARHSS

SEQ ID NO: 119993 - protein, 390 aa, Triticum aestivum
  unsure (1)..(390): unsure at all Xaa locations
  Clone ID: PAT_TA_14411.pep
MPTTPTGRRPPPAAVLLRCCCCLILLMLLPACRAFPLCTDARAPLPLNGTLAFCGNAPGATCCDAADDKALRGQLQAANVSDAACAAVLKSLLCAKCNPYSAELFDAGPKIRTIPFLCSSASSATSAHQSKESTVQDYCKLVWDTCKDATILNSPFQPPLQGGGRLPSSSSKLTDAWQSESDFCTSFGGAPGDRSGGVSGGPGSFRASHXXXXVRPKGVXXEGIDNRXYAXLNMVPHPXGXXGVXLGTAXGXXXXATVXDQGSGGXWGFSEXGLXGDXXDQXXXXSTWGLMGXAFXXHFAXXGXFFASXNXXRXXSXRFXXRXSCNSDVGCXPSXLXTXNXPQPXQYQXVVSXYSXKGSXSXVSHXTSXDPTGVKRIFTXGVPYTNNHGG

SEQ ID NO: 119994 - protein, 231 aa, Triticum aestivum
  Clone ID: PAT_TA_14412.pep
SPQQSGQWQQPGQGQSGYYPTSPQQSGQKQPGYYPTSPWQPEQLQQPTRGQQRQQPGQGQQLRQGQQGQQSGQGQPRYYPTSSQQPGQLQQLAQGQQGQQPERGQQGQQSGQGQQLGQGQQGQQPGQKQQSGQGQQGYYPISPQQLGQGQQSGQGQLGYYPTSPQQSGQGQSGYYPTSAQQPGQLQQSTQEQQLGQEQQDQQSGQGRQGQQSGQRQQDQQSGQGQQPGQRQ

SEQ ID NO: 119995 - protein, 144 aa, Triticum aestivum
  Clone ID: PAT_TA_14413.pep
QRRARDLGWCLLLAPMAMLPPLIRSGWHALRQEKEEMMPYHTVKRSDLEIWPKSLVIRAVGSNQVRDREDQQRRQAPHQQGQGAVARRVAVAAQGQRFGMVLAPRAHGHAAAAHPLRLARAWAGRCSGPEISSDDDGEGDALSD

SEQ ID NO: 119996 - protein, 248 aa, Triticum aestivum
  unsure (1)..(248): unsure at all Xaa locations
  Clone ID: PAT_TA_14414.pep
SADTWRRFSSYEDMSISGTVVRNQTEEAETPRSSRSRLGTQEKTSNASLEDSATNLAEAKAALQAGFRKGNARERPATNKHEKESHEPRFSGVNSHEVRSENVDSQKGRKSRQPSDGQSAPRASAASPALSSLIIPSLKEASGDKFEGPVVHAVLSSLMDLEQEIPGSCGVVXGRILHPPHFPKDPPLQSLHETAISIFTKKPEPPSEAGSNKKQASTPPLAAPTVSPLARVLLTRWKNQVSQDLNSV

SEQ ID NO: 119997 - protein, 246 aa, Triticum aestivum
  Clone ID: PAT_TA_14415.pep
VVRANSFDPTAAFLSSAAHHRMLSASGRLNGMLSDTLRSYGAPGGGVGMGLGGHHHHLHGAQPFGLGSRFMPKLPAKRSMRAPRMRWTSTLHARFVHAVELLGGHERATPKSVLELMDVKDLTLAHVKSHLQMYRTVKSTDKPAASGPTDGGSGDDDFPSAGGQAGSGGDNNMCPRPFPEHRSTSEGAASSVGGGGGDMDQSSAGNASTRWSNSSSRDPWLSSNSCNMDAHRSIGLSSPMENMEPC

SEQ ID NO: 119998 - protein, 334 aa, Triticum aestivum
  Clone ID: PAT_TA_14416.pep
SAEREILEMLDHPFLPTLYAHFTTDNLSCLVMEYCPGGDLHVLRQRQPGRSFPEPSARFYVAEVLLALEYLHMLGVIYRDLKPENILVRDDGHIMLSDFDLSLRCSVSAVLLRSSSVAANHQPKKLTSPCAESYCINSSCLQPSCAQTSCFRPRPWVPKPRKPKSSLKRLPQLVVEPTEARSNSFVGTHEYLAPEIIKGDGHGSAVDWWTFGVFLYELLYGRTPFRGPGNDETLANVVSQNLRFPDNPVVSSNAKDLIRGLLVKEPENRLGTLRGAAEIKQHPFFEGLNWALIRSAAPPETRPCDVVTLATVRKKKEGKCLDFRSPEELEFEVF

SEQ ID NO: 119999 - protein, 281 aa, Triticum aestivum
  Clone ID: PAT_TA_14417.pep
MATPGMAFAAAEGRFCTPRAAVQQLENWGDSLSGIVVTSPLTETSTDLDDSGDKHHALMGGGGAGGGAHSQRRVGCVDSSERTGDEKTARRLAQNREAARKSRIRKKAYLAQLESSRSKLTHLEQELQRARQQGIFIAGGGSGDCSSRGALAFDLEYARWLDDHQRHINNLRVAVIADMGDDELRILVESVLLHYDEFFMLKNLATKSDVFHVLSGMWMSPAERFLMWLGGFRSSEILKVLASHLEPLTDQQLMGIFNLQQSSQQAEDALSQGMEALQQAL

SEQ ID NO: 120000 - protein, 129 aa, Triticum aestivum
  Clone ID: PAT_TA_14418.pep
PTERWATSYALPCGRKAHLVAIYSSCDLIHHPHSLLPHHSRHTFCCHSLATSPPLLPAMDLSTPPQQLSCHRSSSQPAPLAASASAAAAARRQGRSSSSEAAQQQQQHGGGRVLQIQRCLEVVRPKNRD

SEQ ID NO: 120001 - protein, 268 aa, Triticum aestivum
  unsure (1)..(268): unsure at all Xaa locations
  Clone ID: PAT_TA_14419.pep
LKPGPSYFVRSLKAQSRHTPTIPRTPWRHGQARRRPSPRRFPTDDLLREIFLRLPPEPIHLFRASFVCKHWRGLVHDARFLRRFRDFHGGTPPVLGFFNQEGPPFFVPTSGGFAPSAATVSPGDWWALDCRHGRALLDSCRTGTLLVWDPVTGDKRYLPPPAQVSPGCFGAVPAAPGPAGHPDHGDCHSCPFLVAFVFSDDKDFITYACVFSSEXSVWGEIASIVIPDALVQRXXTALVGNTIYFVLDDDVIIKFDLDKXGLTFPSDT

SEQ ID NO: 120002 - protein, 210 aa, Triticum aestivum
  Clone ID: PAT_TA_14420.pep
NIDRQSPPRHIYNRGRNRPLGQRRFAGRALRTRPLLFPSTYNSKMRRGVSEAAVSSYATVFRTHTQLVLHAVPLLPQVVRAACGVDRLPAVIVYAHPRDRPLLLRGLPLRGKLRHCLPQSRLLCLGPEDHLAPRGCRGQRCFTCKRRFTWRQGTPHSWCVGTVVMLGWVWIISFPCWRMHKLILVPQCFPSTIWCHCPHFLKAYFAAAYV

SEQ ID NO: 120003 - protein, 113 aa, Triticum aestivum
  Clone ID: PAT_TA_14421.pep
MRAAGGMMEAGGGGGGFRDERVPQWGVQETRELIAARGDLEREAAAAGRSAKTLWEAVADALRARGYRRTVDQCKCKWKNLVNRYKGKETSDPENGRQCPFFEELHAVFTERA

SEQ ID NO: 120004 - protein, 220 aa, Triticum aestivum
  Clone ID: PAT_TA_14422.pep
LAQFCDATSAKNMLKTKIKHESFSSETLDVRPASLASDPRKLPYSGSSSLARTLKDHLYQCPSKISEEMVRCMASIYCLLRTESPEKPEKVRSPFLSRSSTSVILPRRGNSEETNTSSNKCIVEVCSISVEKNQTPDVSCAITHYRLLVEQLERVDLSMSETSIKLAFWINVYNSLVMHAYLAYGIPNSSLKRMALFHKAAYNVGGYAVTANSIEHSLLC

SEQ ID NO: 120005 - protein, 180 aa, Triticum aestivum
  unsure (1)..(180): unsure at all Xaa locations
  Clone ID: PAT_TA_14423.pep
PPRAVSPAAPQPPVPSASRPSPPAQARNPPHSQRPPAGPTPSPPRRPARPPWPXPPFRAPRPRWPRAPPPRRPPGRGTAPPPPRAARRGPWSRRPRRGRRGPSARRRRRGSATTSPRSPPRTSPPAAPGSAAAAPPPAAAPTCAPPPSPPPPPCAPPPPLPTPPPVGYGGGRGQKDGNSG

SEQ ID NO: 120006 - protein, 182 aa, Triticum aestivum
  unsure (1)..(182): unsure at all Xaa locations
  Clone ID: PAT_TA_14424.pep
FFFFQVRLLNNIRLQDLSNLNITCTTRLQFQKIQRLEGEREIAAARLRREHQQREVEREXSRGCWRRRSSRGCSNREAARGRXREEEAQGERXEQQQRQVEEVERRRSSSRDEGRSSSEGVERERETAGGWSSEQQQRGELREQQQRNRRRSSSLGARRAAGRIGRRSSSRLHGRRSSSRGR

SEQ ID NO: 120007 - protein, 203 aa, Triticum aestivum
  Clone ID: PAT_TA_14425.pep
VLSDSDEENDTVVGPPTVYNNTTVNGGGFPFATSGAGFTGRYQEDAGVGTSGLGLLSNNADDFEMTNWQMPYSQPEQGYQFFGDGTADTYVGSHNSFSITPNDYSLDCNVGIEEASVAHDLPVYRSNNEMHGSLVDNPLAFGGDDPSLQLFLPSQPSSAPLQEEPSERVNASNGVQSDDWSPYARSCGMKAATQWLNFKTIRQ

SEQ ID NO: 120008 - protein, 200 aa, Triticum aestivum
  unsure (1)..(200): unsure at all Xaa locations
  Clone ID: PAT_TA_14426.pep
MSTATGAAASNSLSPTTSRRSSPSSRILTTPRGSLSCRLLSSSPSQSPLVPVSAMASPGAAGEAASRKKLLIFDAEKDLAASLAEHAAGLSEKFAAERSAFTVVLSGGSLIKALRKLAEPPYLEAVDWSRWHVFWADEKVGPKXHADSNYKLAMDEFPPKGPVPANQVYAMNDALSVEGAADDYENCLKQLIKNGVIAVS

SEQ ID NO: 120009 - protein, 114 aa, Triticum aestivum
  Clone ID: PAT_TA_14427.pep
PPGPLLRLLQATPIYNSKCLEQDDQVLVGGHQQGGLSARCSSWSVVVHLRHVWINTLGGSVEAQSIQVGAFATVVNTRLLAWALLHPCITGCFCCPSTFLPVPTFPHRVLGPLK

SEQ ID NO: 120010 - protein, 201 aa, Triticum aestivum
  Clone ID: PAT_TA_14428.pep
HDSALAAGAAFVSGNPAAVQSVTLIDATATLPAFPAAVLGVPALGRLVLRVPALFKGLMRLSCSRGVDAEEADALRAAMRGQGKRDAVFEAWKAMNHSFDLAEWRSSSEEVKRLPMMVLWSGSWSDMWIDEGKKVTKALPDAKFIYHYGGRWPQVDAYDEISNLIADFVTMLPTTATEHRSKNMDQSSGESVDAHSDHPVS

SEQ ID NO: 120011 - protein, 128 aa, Triticum aestivum
  unsure (1)..(128): unsure at all Xaa locations
  Clone ID: PAT_TA_14429.pep
MGAAVDETAAAAAAAAVAAEGGAAAAAAEADSKDLQQQSKALDKLTDHVEDRQLDSSRVQSAMAALASSKEADWNAMRLREKELAAVKINPTDVEIIANELELDKXIAERTLREHKGDAVAAVRFLLR

SEQ ID NO: 120012 - protein, 181 aa, Triticum aestivum
  Clone ID: PAT_TA_14430.pep
MVSASTSRGGSGRAARRGGGGGGALPGSPRVSAAAAAQRRWWGASGPSLERVALAFCVASVALALSCALYLYVLRYLGRGQAVAGFVGEDLGACDVFDGNWVPDATYPLYNSSECPFAEKGFNCLANGREDTGYLKWRWRPRRCDVPRFTAGAALERLRGKRVVFVGDSMSRTQWESFICM

SEQ ID NO: 120013 - protein, 186 aa, Triticum aestivum
  Clone ID: PAT_TA_14431.pep
GLPVPYLVTAVKVDIAPRDGRRVSSGNLIDVARQWVDKQGLLPSSEELPLVDSFPGNSGLLTAAKEARYDKEAVVKFFRMLIRRRYFSNELPAPSPWSLTPRGDTILPVETTNDEELFKRKSYGGQRYKYNGVAPLSAQQNVTLPLTPSPQQPMSSSAENYRYHRFSSSAIPDKNSSRTSRLDINL

SEQ ID NO: 120014 - protein, 130 aa, Triticum aestivum
  Clone ID: PAT_TA_14432.pep
GTSAPLSLVSPSPPHHFSPPPPPTAPDPARFQRPPARPAHHRAPLSTLLPPIGPDPARASSSGQARPCPAARVWASTSPAWLPPPAGAFRLPLLSSSSRRLLALAHRAHRNPSAGERGAAPSIGRHGSLS

SEQ ID NO: 120015 - protein, 169 aa, Triticum aestivum
  unsure (1)..(169): unsure at all Xaa locations
  Clone ID: PAT_TA_14433.pep
MAAPVTVYGPAISPAVARVAACLLEKDVPFQLEAVDMSKGEHKSPSFLKLQPFCQVPAFXDHLTTVFESRAICRSICGQYFERGDQASPPPEKRXALGCHAIEQWVESEAWPFTWPRLTSTFRRMFGPXQGCVETHMAVVDQNEAELAKXLFVYDPRLTDIQDFAGNQV

SEQ ID NO: 120016 - protein, 240 aa, Triticum aestivum
  unsure (1)..(240): unsure at all Xaa locations
  Clone ID: PAT_TA_14434.pep
NQPFYCQTQQPFPQTQQSFPLQPQQPFPXQAQQPFPQPQLPFPQQPEQIIPQQPEQIITQQPFPLQPQQAFPQQPQQPFPQPQQPIPVQPQQPFPQQSQQSQQPFPRPQQLFPELQQPIPQQAQQPFPQQSQQPFPQQPQQPFPLQPQQSFPQQPQQPFPQQPQQPFPLQPQQPFPLRPQQPFSQQPSILQPQQPQQPFLQPQQQLSQQLGQTISQQPQQPFPQQPHQPQQPYPQQQPSG

SEQ ID NO: 120017 - protein, 175 aa, Triticum aestivum
  Clone ID: PAT_TA_14435.pep
YLSEDYCVRVCKVRNSFPEHTYCMRVMMEKVPDGDWFCEECQTEVEFEKEKLEKPQVKLVTSKEESVQGKISKPFNDANSRSPCENEVEDETVGRKERNEANQGIDMVEDAKIPPVAKQNIPEPGGLSMESYSRKGIPLLCESSFKLDMEKGKQPTSQVPPYWGLMLARIRHHHL

SEQ ID NO: 120018 - protein, 181 aa, Triticum aestivum
  Clone ID: PAT_TA_14436.pep
SAHASGEECQTEVEYEKEKLEKPQVKLVTSKEESVQGKISKPYNDANSRSPCENEVEDETVGRKERNEANQGIDMVEDAKIPPVAKQNIPEPGGLSMESYSRKGIPLPRESSFRLDIEKGKQPTPQVPILLGSNASKNQAPPLTGQLSKSTSFNSSKVPKVKQLVNEVPQEDQNFEGSVVL

SEQ ID NO: 120019 - protein, 146 aa, Triticum aestivum
  Clone ID: PAT_TA_14437.pep
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKSPAAAGVAWKSPKKTASTKSPKKKVAAKE

SEQ ID NO: 120020 - protein, 281 aa, Triticum aestivum
  Clone ID: PAT_TA_14438.pep
RRRSAPAAGRSPREGPSRRRRGEEGASLSGSLVESDSSSTTSSAPPSGSFDKPAGRTSSAPPSGSLDEPPVAWPARQSRYHEILASRLVRLQLQAGVAIDSPNLPSDQIVQVLARSNFYDDELRAALVEYQVQKFLSVPHGPDVEDTYFGEESGDDITAEEFVKYSGQLKTRRPAEIDTETGLDQEQLDSLLAKYKRYRFKAYLLLLGKPVDELEEAALESKYPMELALENDFFYPCHHDSAFGWYFDSDLCLLANLSDYQRLVLPNRGGNEYEYDRWSQY

SEQ ID NO: 120021 - protein, 125 aa, Triticum aestivum
  Clone ID: PAT_TA_14439.pep
MLFAAAAADLGLRTLIAADKDVNRNHNVATRTIAASRRAVCSPGGGERDPEVFQGEDGWDEPERGGPRVLGDVRVAPASPPPPPAADPIAAPAGQLAVGADAHAHRGRACRGPAGVRPAPGPHRR

SEQ ID NO: 120022 - protein, 168 aa, Triticum aestivum
  Clone ID: PAT_TA_14440.pep
ELEMIWSSGPGTVSSATARVRGSSSPPMCRSRCAATAQVRGGPASLLRPALSTCRYWSTTREELVDGGRRRSRLPCDHGGQQRRPRGTASASPAGPTPSSAAAAKLLWFGLNDSAWDDCDDRNPSSSAPTTAMYCTRPQRWLPSLQVAIRLTPFRQFIGGEAQHSCNG

SEQ ID NO: 120023 - protein, 121 aa, Triticum aestivum
  Clone ID: PAT_TA_14441.pep
RPPYTAPTRIALPCPARSTPATSLHSPWPGKRLGQVTSYHIFVIQLNVPMDKYVPSYRYCFHCTSIKSTTKKLEFTKSTPNALVHDGDVCVCFANVQVKDSAQYRLLWNPNKTALPDFCHL

SEQ ID NO: 120024 - protein, 210 aa, Triticum aestivum
  Clone ID: PAT_TA_14442.pep
LQIRHEGRDGRLVVEAVPVLSNTLFRSQRRGGRLLLSFADTAAPAEDEGKNHAQEADQQQADEQTHEEEEDDDGEEEVQVVDRGTVVEVKVSTQPQAHNSGARVHRSSLVINKFVGAEPVNASEINDTAAAPQQPPKPPSSSEAGAPAVSATATLPDPEDDGTAATPCEGKVLMTMRRRRSKQELLNHMRRCGQLSGQLFIWEPRVATSS

SEQ ID NO: 120025 - protein, 171 aa, Triticum aestivum
  Clone ID: PAT_TA_14443.pep
MEEPHWERERLLDLAVDYGFDRDFAVAALSRLVHLYGEDGQDFITVENCGDDFIAALADATQLTDDWDDLNAIETEACGNLNEMMRKGVNDEKGGVVLDTPLFKRADSSSQHNPRGLKSPSSPSVDSDFGIFDETNTHRDNNVGTQKKPQTRNSKAQRSSTKSTVTKRYES

SEQ ID NO: 120026 - protein, 201 aa, Triticum aestivum
  Clone ID: PAT_TA_14444.pep
ATPPTPRVGVKQGKGRVMWRRCICCQAAEFDENENGRAKAKAPTNNVDGMKKGLKDSATVKAEPQDSAPSINIPVLSLDELIEKTDDFGAKALIGEGSYGRVYYAVLDDGTKMAVKKLDATENEPISEFSTQVSLVSRLKHENFVDILGYCMERNLRIVAYEFATMGSLHDVLHGRKGVQGAQPGPPLNWMQRMKIAVDAA

SEQ ID NO: 120027 - protein, 292 aa, Triticum aestivum
  Clone ID: PAT_TA_14445.pep
IRHEGCDRNRNNSPFINFQGLLVSSGLTNDHEDMIGMFESWWHHGLISDETRDSGLKVCPGTSFMHPTPECTEVWNKALAEQGNINPYTIYTPTCDREPSPYQRRFWAPHGRAAPPPLMLPPYDPCAVFNSINYLNLPEVQTALHANVSGIVEYPWTVCSNTIFDQWGQAADDLLPVYRELIQAGLRVWVYSGDTDSVVPVSSTRRSLAALELPVKTSWYPWYMAPTEREVGGWSVQYEGLTYVTVRGAGHLVPVHRPAQAFLLFKQFLKGEPMPAEEKNDILLPSEKAPFY

SEQ ID NO: 120028 - protein, 275 aa, Triticum aestivum
  Clone ID: PAT_TA_14446.pep
KSHPVDPLNSENHAGEKDALVTVPENEGCADGGDNHKGVQVLSIVKKDESEEIVDSINPVTVAEYREEKGTAGSTSAITAVRAPGSRSSCFHGVTRHRWSGKYEAHLWDSTCRVEGRRRKGKQVYLGSYDTEQKAARAYDVAALKFFGLNTKLNFSISEYEKELADIQDMSPEECVTYLRRRSSCFSRGASIYRGVTRRQKDGRWQARIGLIAGTRDIYLGTFKTEEEAAEAYDIAAIEIRGKNAVTNFDRSNYMDRGMHCIEGAGLKLLATKPE

SEQ ID NO: 120029 - protein, 192 aa, Triticum aestivum
  Clone ID: PAT_TA_14447.pep
LALTVENFLQRRLQTIVFKNGMAKSIHHARVLIRQRHIRVGRQLVNIPSFMVRVESEKHIDFSLTSPLGAGPCRTGAAPAPATRPRGPAARGRPRSQRAASGGRRPRVVDVGCGHVGSCACVWLFCVMDSLGLLAVFLWASPLLSLLGRQFCTALLTLLISSIGIVSGHHELCILVSVAICSFGILCLKLNV

SEQ ID NO: 120030 - protein, 120 aa, Triticum aestivum
  Clone ID: PAT_TA_14448.pep
MGGGHDMHGHNGGVKGYVSNLVHGGGGGGHGHGYGGGHGHGYGGHGQGYGHAYPPPAAAGAYPPPHGGYPPAAAYPAHSAHYGHMGSYHSSHSHGGGHHGGYGGKHKGGMFGGGKFRKWK

SEQ ID NO: 120031 - protein, 74 aa, Triticum aestivum
  Clone ID: PAT_TA_14449.pep
RAEFGTSKSVDFGWGEAVYGGPAKGGDGPSPGVTNYFSRSKNRKGEESTVVPISLPKDAMDKFQLEVEGLTAEI

SEQ ID NO: 120032 - protein, 103 aa, Triticum aestivum
  Clone ID: PAT_TA_14450.pep
NPLQIMGTRNSSNKPPLLEPVSNPFTDRTCIEFPPGRILQERGEEAPRSPLAARKANGGEPAQCFVHRGRRKKGRDRRRSTSSGSGGREGGDFHLTHNRRSSE

SEQ ID NO: 120033 - protein, 74 aa, Triticum aestivum
  Clone ID: PAT_TA_14451.pep
FVKTLTGKTITLEVESSDTIDNVKAKIQDKEGIPPDQQRLIFAGKQLEDGRTLADYNIQKESTLHLVLRLRGGQ

SEQ ID NO: 120034 - protein, 152 aa, Triticum aestivum
  Clone ID: PAT_TA_14452.pep
MGWATRFLAAVCFFAAGVLFVPEAIGSPSGAGAVTAAKLAHVLSFATSWGAALWATFIGGIIMFKNLPRHMFGNLQSKMFPAYFTLISACAAISVAAFAYLHPWKTASTVQRYQLGFLLSALGCNLSNLLVFTPMTIEMMKKRHKIQRGLRG

SEQ ID NO: 120035 - protein, 67 aa, Triticum aestivum
  Clone ID: PAT_TA_14453.pep
YTAYLNILKQIKNNDWLKDDLELDIAKSELSELKKECVDAMETQLKREEFQDEEMPDVRKLDIRNFL

SEQ ID NO: 120036 - protein, 152 aa, Triticum aestivum
  Clone ID: PAT_TA_14454.pep
MEYGQQGQHGHGTTGRVDQYGNPVGAGTGGMGTGTGGMGQLGEHGGAGMGGGQFQPAREEHKTGGILHRSGSSSSSSSEDDGMGGRRKKGIKEKIKEKLPGGHKDNQHATATGGGAAYGQQEHTGAGTYGTEGTGEKKGIMDKIKEKLPGQH

SEQ ID NO: 120037 - protein, 133 aa, Triticum aestivum
  unsure (1)..(133): unsure at all Xaa locations
  Clone ID: PAT_TA_14455.pep
WHEAITAFSXMVGYALQAADILAKEGISAEVINLRSIRPLDRAAINASVRKTNRLVTVEEGFPQHGIGAEICMSVVEDSFEYLDAPVERIAGADVPMPYAANLERMAVPQVDDIVRAAKRACYRAAVPMAATA

SEQ ID NO: 120038 - protein, 264 aa, Triticum aestivum
  unsure (1)..(264): unsure at all Xaa locations
  Clone ID: PAT_TA_14456.pep
TELASLLQPIPVLECLHSSSFLLGLTETCAGSFVSLPNQMSMIGTVGPPVPNIDVRLESVPEMDYDALASTPRGEICIRGETLFSGYYKREDLTKEVLIDGWFHTGDIGEWQPDGCMKIIDRKKNIFKLSQGEYVAVENLENVYGLVSASDSIWVYGNSFESFLVAVVNPNKEALESWAAANGISGDFESLCKNPRAKEYILGELSRIGKEKRLKGLNSVKDVHLXPIPFDMDRDLITPTYKKKRPQLLKXYQGVIDNMXKSAK

SEQ ID NO: 120039 - protein, 236 aa, Triticum aestivum
  unsure (1)..(236): unsure at all Xaa locations
  Clone ID: PAT_TA_14457.pep
MEEGRDEKEATSENSEDRGNTSDSSRCDGSGLMSVQFMQKILAEILGTYFMILAGCGAVVVNQSTGGAVTFPGICVVWGLVVMVMVYSVGHVSGAHFNPPLAIAFATCRRFPWKQVPSYVLAQVLGSTLASLTLRLTFGGAHGHSLGTTPSGSSTQAVALEFIISFYLMFVVSGVATDDRAVGELAGLAVGATVVLNVLFAGPITGASMNPARSLGPAIVACQFXAVWVYIVGPVC

SEQ ID NO: 120040 - protein, 102 aa, Triticum aestivum
  Clone ID: PAT_TA_14458.pep
TSSTPIRPAGRSPSPSSAEPRSRTTTPAAAPGSSGRRSWYYGFYSQLPPATGADGQRERALELVASKEEEKERQERGTNNNKLVAIIWWVAWLAIMRDVASS

SEQ ID NO: 120041 - protein, 241 aa, Triticum aestivum
  Clone ID: PAT_TA_14459.pep
EVIMNSNGYSLSVDIWSLGCTILEMATAKPPWSQYEGVAAIFKIGNSKDIPDIPNNLSSEAKSFLKLCLQRDPAARPTAAQLMDHPFVKDQATVRSSRSSITRDMFPNSTDGKNSRVKIETSSYRSLSPLRDPDILGRNLPGPTSPIPSTSSRRIAALNTSNVRMNMSLPVSPCSSPLRQYRQSNRSCLPSPPHPAYSAGAANYSPINNALYPMRPSSGLTDPWLEISQPKTQTFDSPRRL

SEQ ID NO: 120042 - protein, 78 aa, Triticum aestivum
  Clone ID: PAT_TA_14460.pep
KQRSILQWSFKEVNKILNAGVITEPVFFFDGAVLPETEVPYHLKFYLFPTGVILFNVFLELYKSSVYPGELAAGQRSV

SEQ ID NO: 120043 - protein, 201 aa, Triticum aestivum
  unsure (1)..(201): unsure at all Xaa locations
  Clone ID: PAT_TA_14461.pep
MEEPMLTCHAKHETNSRTLNVTNESSEAPTGAWQGTHEPRTGLGKAEEGGQRPKQACGRGRAGDGGNRPGKEGXTAAKTNAGTRGPGCQRHEGAPGARHESHTEQRGRQGSRRGRGTQAAQSPPXPTQAVTGRENPQPAGSTGARHAAGRRLPRIGHSTTARGSPSSPRTSGDHDCLGGAAEPQGPPVAGDGRVEPEGADR

SEQ ID NO: 120044 - protein, 173 aa, Triticum aestivum
  unsure (1)..(173): unsure at all Xaa locations
  Clone ID: PAT_TA_14462.pep
VERRKETMELFPQSVGFSIKDAAAPPREEQGDKEKPKQLTIFYGGKVLVFDDFPADKAKDLMQLASKGSPVVQNVALPQPSAAAAVTTDKAVLDPVISLAAXTKKPARTNASDMPIMRKASLHRFLEKRKDRLNAKTPYQTSPSDAAPVKKEPESQAWLGLGPNAVKSNLSLS

SEQ ID NO: 120045 - protein, 271 aa, Triticum aestivum
  Clone ID: PAT_TA_14463.pep
KLQHRNLVRIVGVCLEEGEHLLVYDYMPNKSLDTIIFDPDKSRQLDWGARFKIINGIARGMQYLHEHSQLKIVHRDLKASNVLLDADMRPKISDFGLAKIFEDDQTRHVTSRIIGTRGYMSPEYAMRGQYSAKLDIFSFGVLVLEIVTGRRNNYAVAPGHSPNLFCLVWKHWVEGTIAQIADPSLGRHYPMAEVLKCINIGLLCVQQSPTDRPSMSAIVVMLSSDTVAVEAPYRPAYVDRSRSYTEMTVELIKEKEELCSPQSSITELMPR

SEQ ID NO: 120046 - protein, 84 aa, Triticum aestivum
  Clone ID: PAT_TA_14464.pep
SFTAAITRQGQGVQIRCLLFRTFSYVKLLFQILDIKKKVQFGEGLLTNFFFDQFGGELLTNLRCFRFLLRNSMETATFYYETQA

SEQ ID NO: 120047 - protein, 186 aa, Triticum aestivum
  Clone ID: PAT_TA_14465.pep
LYRWTFEDVQVNDISLNDYLAVSATKHATFLPHTAGRYSKKRFRKAQCPIVERLTNSLMMHGRNNGKKVMAVRIIKHTLGTSHLLTDANPIQVVVDAIINSGPREDATRIGSAGVVRRQAVDISPLRRVNQAIYLLTTGARESAFRNIKTIAECLADELINAAKGSSNSYAIKKKDEIERVAKANR

SEQ ID NO: 120048 - protein, 74 aa, Triticum aestivum
  Clone ID: PAT_TA_14466.pep
MSSTAAAAPECGGAKTSWPEVVGKSVEEAKKVILKDKPDADIVVLPVGSPVTMDYRTNRVRIFVDTVAQTPHVG

SEQ ID NO: 120049 - protein, 89 aa, Triticum aestivum
  Clone ID: PAT_TA_14467.pep
GGTKIELAVGYIINLALICLPSRKGLSPQPSTPTTLTGLTLDFGLLALNKVIIDSPDVHRKSDGYTCLPWRKPSPNKAHYPHQGHVTIV

SEQ ID NO: 120050 - protein, 83 aa, Triticum aestivum
  Clone ID: PAT_TA_14468.pep
ARGVFVAEGMKLGVVMEGYDEAMVKAEEVEAKVRLVMESQQGKELRDRVAVAKDEAAAALETAGSSKAALGDFIIDMEISTRQ

SEQ ID NO: 120051 - protein, 159 aa, Triticum aestivum
  Clone ID: PAT_TA_14469.pep
MAKLHFFLLLLLAAAQATHGEDGAYIGVNIGTAMSSVPAATQITTLLRSQNIRHIRLYDADPGMLSALPNTGRRVIISVPNEQLNTIINSNATAAKWVARNVAAHYPSAAISAAPVGAALLPSLPIAAPPVGPAVRSPLPAPAPLIMPAMRYLQNALVA

SEQ ID NO: 120052 - protein, 139 aa, Triticum aestivum
  Clone ID: PAT_TA_14470.pep
KRKRKKGRYKERKEKERDHREKEREKEKGKDRSRRDEMDLDGADRHAHGSKDKKRDKEKKHKRRHHDTDDVSSERDDKDDSKKSRRHSSDRKKSRKHAHGSDSDSENRHKRHKKDRDSSRRNGGHELEDGELGEDGEVN

SEQ ID NO: 120053 - protein, 166 aa, Triticum aestivum
  Clone ID: PAT_TA_14471.pep
MVFPVVDEPPFSDTPTLYGLILRDHLLVLLRKKDFIHSCSASTLKASNHFSHAEFAKRGSGKHDRIEDIELCPEELEMFVDLHPFTNTSPYTVLETMSLAKALILFREVGLRHLLVLPKSSKRAPVVGILTRHDFMPEHILGLHPFLFKSRWKKVRLGKVKVADIF

SEQ ID NO: 120054 - protein, 200 aa, Triticum aestivum
  Clone ID: PAT_TA_14472.pep
EFGTRQKISDPKSIQDILKQVYADHSTNVDKVFSRIVEITQHPAAAASFASIMFAPRGQISFQEAISRCQSQGVPLSLMYGREDPWIRPFWGIKVKQQVPEAPYYEISPAGHCPHDEVPEVVNYLLRGWLKNLESEGSIDLPFLEEPSYAEHGVSRELEFVREGSRKSVSVRLYGTKISLWSQLSSFLNTRVPNSRVVLR

SEQ ID NO: 120055 - protein, 112 aa, Triticum aestivum
  Clone ID: PAT_TA_14473.pep
PPFRLSPLSPSFAAAAAPSAGPPAPRAVRPVRPPLFPPFAAMGVAVGICGFQLFRNITGNPEVRVNKAGRAAGVLENHEEGRRYAMHGLRSFVHEKTPEIMPAINKFFTDPK

SEQ ID NO: 120056 - protein, 226 aa, Triticum aestivum
  unsure (1)..(226): unsure at all Xaa locations
  Clone ID: PAT_TA_14474.pep
RRESPSKRSGERTGEGRGGGGWVRIAPMKLXGAVTLRNVTRCATALEEAGSDYEIVPINFATAEHKSPEHLVRNPFGQVPALQDGDLYLFXESRAICKYAAPQNQAKAVRGNGNLQGGXMVDVLVLVVXANQYTGALNPILLQSPHHSGCLEATTDKKLWHENLEKLKKXARVVEDPDEILPLLEFLNSLTDPAAIPPASAALCLFAPPYASGSVPYPHEAAKGPP

SEQ ID NO: 120057 - protein, 215 aa, Triticum aestivum
  unsure (1)..(215): unsure at all Xaa locations
  Clone ID: PAT_TA_14475.pep
IRTRRLPAHTSDVNTGAFADETGHLIYSGSDDTLCKVWDRRCLSTGQAAGVLTGHLHGVTHIDSRGDGRSFISNGKDQAIKLWDVRKMTSNADRRSXSWDYRYSRYPQQHKQLKHPHDQSLATYRGHAVLRTLIRCYFSPAYSTGQKYIYTGSYDSCVYIYDXVSGSQVAKLKWHQMAIRDCSWHPFEPTLVSSSWDGQVAKWTSARDQQASDID

SEQ ID NO: 120058 - protein, 112 aa, Triticum aestivum
  Clone ID: PAT_TA_14476.pep
MRPQVVLLVSLAVFVVLVALPPGKANEEKEAAAEGVDARRWRWPCCDECGVCTRSQPPICQCLDTSTSGCNPGCKACVKSISDGLYECKDRIVNFCKRRCTRPPAAAAAADA

SEQ ID NO: 120059 - protein, 139 aa, Triticum aestivum
  unsure (1)..(139): unsure at all Xaa locations
  Clone ID: PAT_TA_14477.pep
MDSADSDLNNRNDEASEQLIADLKAQKEELEATLSREQLQTVQLKEDIAQAETRNAELTKELQAVRGQLASEQSRCFKLEVDVAELRQKLQSMDALEKEVELLRRQKAASEQAALDAKQRQSSGGIVXGWLAGSPPPTV

SEQ ID NO: 120060 - protein, 232 aa, Triticum aestivum
  unsure (1)..(232): unsure at all Xaa locations
  Clone ID: PAT_TA_14478.pep
MISSPWDAAKHMESAAALAKDLGRWNEVSDFYHRASELYRECGRSQPASDALAKGASALEEKSPEEAIKMYDEACSVLEEDGKEQMAFDLYRAAAALYIKMEKYSDAAAFFLRLGSAADKCNAINSQCKGXYLSAIIIYLYAHDFQQAQKCYNDCSEVQAFLNSDQNRCATKLLSAYEEGDAEEIKRIAQSSAFNHLDHVVIRLARKLPTGDLQAIKKADDGEESLDEDDLT

SEQ ID NO: 120061 - protein, 116 aa, Triticum aestivum
  unsure (1)..(116): unsure at all Xaa locations
  Clone ID: PAT_TA_14479.pep
RHEGKVQKQVVELFPSSRGLEXTWSSVVKIGQSLYREAPGSDPFRPDQKTPVKNFFLSGSYTKQDYIDSMEGATLSGRRTAAYICGAGEELLALRKKLVIDDSEKALGNVQVLQTS

SEQ ID NO: 120062 - protein, 170 aa, Triticum aestivum
  Clone ID: PAT_TA_14480.pep
MATTLAKVGPFGAGGTPVDIDHTLPPDHLKSIKIWYDEDGINGLKFSYLHAANKRKLTTTRVWGDDSGSSDEINIEDDDDYVNKLEGRTDGRTKIKSLRITTKNNNNPDWLGDKTKEGDYFSVPVEDGQIVAFFGRTNQYINALGVYILGTPYQQSTPLDRSIHPSTHIY

SEQ ID NO: 120063 - protein, 232 aa, Triticum aestivum
  Clone ID: PAT_TA_14481.pep
MKFLVVLVAVIAAVSAATPKEAVKAFPYSGFPANQAYYPGQQAYYPGYQGYQGYQGYNFGFRNGYYPGQQSYYPGYQGYQGYYPGYQSGYQGYYPGYQGYNNRGFYPGAPAVYPTVSAVTPAPIIAPVPVAPKVVPQVFKTVDNKLPAIVRQSQEVNVDGNFKYGFETENGIAAQAAGYVKNAGSENAAQVIEGSYAYIGDDGAPVEVKYYADETGYHAAGNVVPTIPSEIA

SEQ ID NO: 120064 - protein, 89 aa, Triticum aestivum
  Clone ID: PAT_TA_14482.pep
DPHERTSASPPIHPSLPSLPPSRSMFPVLLYDSRNYIQYTRSIVVPRLQCANWLTPHALRVHITLEIGWGNAMDLVGNFVFISSTLIME

SEQ ID NO: 120065 - protein, 158 aa, Triticum aestivum
  Clone ID: PAT_TA_14483.pep
MAGRNIGVAVDFSSCSKAALRWASTNLARNGDKLILIHVNNSYQNEQGAVHLWEQSGSPLIPLAEFSDVTRTYGVSPDKETIEILTQVANQRGIEVFAKIFYGDPAKKLYEAVDLVSLSCMVIGSRGLSTLKRALMGSVSTYIVNYAACPVTVVKEHM

SEQ ID NO: 120066 - protein, 293 aa, Triticum aestivum
  Clone ID: PAT_TA_14484.pep
MAVLQVAAAAPPPVSAIGFEGYEKRLEISFSEAPVFADPNGRGLRALSRDQIDSVLDLARCTIVSELSNEDFDSYVLSESSLFVYPYKMVIKTCGTTKLLLAIPRILELAKELSLPLSAVKYSRGTFIFPDAQPSPHKNFADEVAFLNRFFGGLRSGGNAYVIGDSAKPGQKWHVYYASEHPEEPVVTLEMCMTGLDKKKASVFFKTSADGYTSCAKEMTKLSGISDIIPEMEICDFDFEPCGYSMNAVHGPAFSTIHVTPEDGFSYASYEVMGFNPGSSSYGDLTKRVLRCF

SEQ ID NO: 120067 - protein, 188 aa, Triticum aestivum
  Clone ID: PAT_TA_14485.pep
YCTLLVWYSSRSIGTIPIRTCGQRPGSPETPARQRSKTDLGEERTEDWIGGGHARPASLHLHLGPQSSRCITLAVLPWPWTWSSRSRPPRHPAGCRFDGSLPPAAPADADMPTRGSCSCSAASRASARRVASSGHLLLVVLSRPVLMAAAAAAAPYAVALAHTHARTHASNDSLGYLLCCCCRTTPRA

SEQ ID NO: 120068 - protein, 61 aa, Triticum aestivum
  Clone ID: PAT_TA_14486.pep
KSFAMSSNASQFCALASCLSSLNGNASCDGQFIWMQCNAREEKGMVWHERLPCPRARGQAS

SEQ ID NO: 120069 - protein, 67 aa, Triticum aestivum
  Clone ID: PAT_TA_14487.pep
RCGVLTALLPIYLTTEGLQLQKANLDRRPFQAQKWSMFIEYAGAFIRCSFYRAEPARRRLVAFEVAT

SEQ ID NO: 120070 - protein, 102 aa, Triticum aestivum
  Clone ID: PAT_TA_14488.pep
DSLQDELGKSHKGHQSKAAPHRRTIQQGLSTGEPKHRVLNEAAKQDQRTTRPASGRLPHREVETGRMAHPPDDCWPELLRPEGRGYPLLIVLALSSLVTHTH

SEQ ID NO: 120071 - protein, 60 aa, Triticum aestivum
  Clone ID: PAT_TA_14489.pep
QLLPVAPPPRQPASPPPPSSPPPLPSSPLPPASLPAPARPPRRQPARPPPSSPPRRLPGR

SEQ ID NO: 120072 - protein, 129 aa, Triticum aestivum
  Clone ID: PAT_TA_14490.pep
MSHRSSGLRLGSGSSLTASSPRAEFGTRSNAGSYAGSNGGGAGSYAGSNAGSYAGSNGGGSGSYAGSDAGSYAGSGAGPHWGGSGAGSYAGSEAGSYAGSGAGPYGGGSGAGSYAGSRAGSYAGSGHGK

SEQ ID NO: 120073 - protein, 71 aa, Triticum aestivum
  Clone ID: PAT_TA_14491.pep
PNSKLKTSINCDEVLKIRKHSVQCKRIKWESFEKLLTRYNRVTQFQLETSIDCEASKIREHNIIEDLGVYT

SEQ ID NO: 120074 - protein, 174 aa, Triticum aestivum
  unsure (1)..(174): unsure at all Xaa locations
  Clone ID: PAT_TA_14492.pep
METHPNFHASPFDGSVENTEFKFSSLYLHHIFSGSNPTQANIIVGDATTKLGRTSVHDWAIYXGVGTDAKLVGRAQGLHINAGSWHNTFTIRFEIERFKKSTLQVMGESVAQEGEWAIAGGTGELAMACGVIHKTWHQEXDGGTIIQLNIHGFCRMKLPILTKSGPWGGKEGSA

SEQ ID NO: 120075 - protein, 509 aa, Triticum aestivum
  unsure (1)..(509): unsure at all Xaa locations
  Clone ID: PAT_TA_14493.pep
SVTIARSAGTVSQSERGGDGLGERALNIRSKPVGWDMLPEDQRHSRDSRDRVDSSNLCVLGTLEAAEACESFRPMGLPNRDVQSRLDRPRSFDRPHRNEHCRSDDGYGSGSKAERSVDRPHGRGGASRHIQANIRGEQWAENSNSSRSSQRRSPDYNNYGPAGPRNAAEAAVAKMESSGFVVAADGTLVRAVDAANTSTMSRRMRNKSSFYHPLSRRCSPVDRDGSRGLSREPAHAREAPPERCFGASGNRSGRYGPQMDKDHAIDENLSSVHSSLSNRQRRFPAHRASLDLSRAHSRSPSGSRSRSPHAWTSNGGSSIRRHSRSPNYMTGVRIGRMTSPQRQHRFNDRVMRGSPSRNSTYSQHDSTWVEGRSCSTLDISYHKKRYSRRSPPLRITSRNDMFDLMDSQGRSGSREFHRPTRDFKRGNKHDGNGDDKRCNDRYGTVKPYEHNGAVKQFRNHAGDKLHPHTSAPRSPEPQRGSPRRXFDEDFQRKLVVYLPCFGTKADKNP

SEQ ID NO: 120076 - protein, 170 aa, Triticum aestivum
  Clone ID: PAT_TA_14494.pep
RLAGTGVMLCIRPGEHGSTFGGNPLASAVAVASLKVVRDEGLVERAAKLGQEFRDQLQKVQQKFPQIIREVRGRGLLNAVDLNNDALSPASAYDICIKLKERGILAKPTHDTIIRLAPPLSISPEELAEASKALSDVLEHDLPQLQKQIKKPESEAEKPVCDRCGRDLYG

SEQ ID NO: 120077 - protein, 148 aa, Triticum aestivum
  unsure (1)..(148): unsure at all Xaa locations
  Clone ID: PAT_TA_14495.pep
MEQTFIMIKPDGVQRGLIGDIISRFEKKGFYLKGMKFMNVERSFAQQHYADLSDKPFFPGLVEYIISGPVVAMLREGKXDIVLTGRTLIGAPRPWEAAPGTIPGDYAVEVGKNVIHGTDSVENGKKEIALWFPECVAQWKTNLLRRIG

SEQ ID NO: 120078 - protein, 118 aa, Triticum aestivum
  unsure (1)..(118): unsure at all Xaa locations
  Clone ID: PAT_TA_14496.pep
MSDLDVQLPSAFDPFAEANAEDSSAGAGSKDYVHVRIQQRNGRKSLTTVQGLKKEYSYNKILKDLKKEFCCNGTGIQGSXELGQXVIQLQGDQXRKNVATFLVQAGFLKKDXIKLHGF

SEQ ID NO: 120079 - protein, 73 aa, Triticum aestivum
  Clone ID: PAT_TA_14497.pep
SARGEAAGTEDAEADAEYDAALKEAIQGVQEAVTSINEHMEEVRYEIDGLEADTIGSKWSEVEEAFPGTLSIK

SEQ ID NO: 120080 - protein, 112 aa, Triticum aestivum
  Clone ID: PAT_TA_14498.pep
PVTTLPRYPEARNRLFRLCHVCQQEECPISSSSNRTLIIINMATRAYIQSSPHVERFSLLKDSHRFHLFMLPATLPNHQLAVAMKPCTIRKMSKACFCNLHFICSFVFDYLV

SEQ ID NO: 120081 - protein, 88 aa, Triticum aestivum
  Clone ID: PAT_TA_14499.pep
KLSHYPSSEGVSCEGWGCCNPSSGISNSTNGFNCSLTASRWSFISSMTILSATLQDCSSLKARVHLPSTRYFFVFALCFSVSKKGTKP

SEQ ID NO: 120082 - protein, 145 aa, Triticum aestivum
  Clone ID: PAT_TA_14500.pep
MAAAALREQLNALLSSMFSSGLVDDQFQQLQMLQEDGGTPGFVAEVVTLFCDDADRIISELAALLEQPIVDFDKVDAYVHQLKGSSASVGAQKVKFTCMQFRQLCQDKNRDGCIMALAVVRNEFYDLRNKFQTMLQLEQQIQAQQ

SEQ ID NO: 120083 - protein, 518 aa, Triticum aestivum
  unsure (1)..(518): unsure at all Xaa locations
  Clone ID: PAT_TA_14501.pep
MVEAAAGRRSGTSPRRPSGGGEHQLPLVAVALATRVVMVTSAPAAGGGVGGGGAAAGGRCLDDLLGCLLGVLRVLGFPWAASPQRQPRPVPPRGAIPSTADGRRFAAELXRIPGRIAGNGACAVASLYTMQGKKGVNQDAMIVWENFCSRDDTIFCGVFDGHGPYGHLVAKRVRDLLPVKLGADMGTDKGRETPASNMEGNTNEVGLPVNPERKETTTSVAAEQDREYPEIFTTFRTSFLRAFHIMDRDLKLHKNIDCFFSGTTAVAVLKQGHNLIIGNLGDSRAILGTRNEDGQLIAVQLTVDLKPNIPSEAQRIRQRRGRIFALPEEPEVARVWLPKYNSPGLAMARAFGDFCLKEYGLISMPEVSCHRVTEKDEFIVLATDGVWDVLSNTEVVSIISRATSRASAARFLVESANRAWRTRYPTSKIDDCAVVCLFLNTHEADQPSSSAANNLANALEVSGDKHSTVVQLSTGVSADVVNALVKDTNELSLVDAVAKPVTVSDLTKDGSGTKQSII

SEQ ID NO: 120084 - protein, 508 aa, Triticum aestivum
  Clone ID: PAT_TA_14502.pep
SAPGTACADTLEFVDVSANLLIGARPACMRSNSSARTVLDAGNCFRDAKLQRPSTYCSPGALAALLPPPQGSGAEQGGGKGGGVGMVLGIVGGVVAGALLIALVMVVVLRRARRQHPGVTVMALPKSPLIAPAKKAVGAKATAKLAQKIATPADKRHASQAAMVNTLEVPAYRVYTTEELQEATDNFASSNLIKKSALAQHYNGQLQDGTRVLVKCLRLKPKYSPQSLSHYMEIISKFRHRHLVSIIGHCVVSDQENPTIASSVYLISECVTNGSLRSHLTEWRKREMLKWPQRVSAAIGIARGIQFLHNATAPDIVQNDLNIENILLDKTLTSKISGFSLPMISTSKNGKLFSENPFAVQEENDHYSAQSAEQGDKDDIYQFGQILLEVITGKPTASQSELESLRAQLSEALAEDPDMLKDMADPTIRGTFAVDSLSKVTEVALNCTAGDPSERPSVDAVLSNLQYSMRVQDGWASSESLSLSVKSQGVSQCNALFVAVHPYGWPFA

SEQ ID NO: 120085 - protein, 134 aa, Triticum aestivum
  unsure (1)..(134): unsure at all Xaa locations
  Clone ID: PAT_TA_14503.pep
GFAARWTAGLSRSSSXRRPTPLPLPLPPPPQQPTPPPPPQTQTPRVSSPAAGGPRRHDAAARLRRDAAGLRERHARDAARLQPHGVARRLAAGIEARGHAAARHVPARFHPAGHAAVRRRRRWRPGGQRQRQRQ

SEQ ID NO: 120086 - protein, 133 aa, Triticum aestivum
  Clone ID: PAT_TA_14504.pep
AGMQSQIVCHRCRRVLAYPSGAPSVCCAMCRAITAVPPPAPAVEMAQLICGGCRTLLMYTRNADTVRCSCCSTVNLVRPVNNIAHVNCGRCRTTLMYPHGAPSVKCAICDYITNHKYWNKYHVTSAMSKAYIK

SEQ ID NO: 120087 - protein, 179 aa, Triticum aestivum
  unsure (1)..(179): unsure at all Xaa locations
  Clone ID: PAT_TA_14505.pep
MQSQIVCHRCRRVAGWPIGRAHPACAXTMAEPSPPCHPQRPPGEMAXVICGGCRTXLMYTRNADTVRCSCCSTVNLVRPVNNIAHVNCGRXRTTFMYPHGAPSVEXATFDYITNTVINTXKHTPCPRPTSNESAYNASSASVPTPQPQTXPVVVENPMTVDEKGKLVSNVVVGITPGKN

SEQ ID NO: 120088 - protein, 152 aa, Triticum aestivum
  Clone ID: PAT_TA_14506.pep
MGKLVAAIGKLLCCVQVDQSTVAIKERFGKFEDVLDPGCHCVPWIIGSRVSGKLTLRLRQMDVRCETKTKDNVFVTIVASIQYRAMEDKANDAYYKLSNPKSQIQSYVFDVIRASIPKLQLDDVFEQKNDIAKSVEQELEKAMFAYGMNVRH

SEQ ID NO: 120089 - protein, 144 aa, Triticum aestivum
  Clone ID: PAT_TA_14507.pep
GTRVYAYVLMNEFGTQPNDFFADATVQINAYVHVRGANVDGVITDFPGTAHRYKLNSCTSMGKNAPPFMSPPKPGDLLTTMPPFAQPPAAAPMPLLTDADVAEPALPPVSNTTTPASPSDAALMMRTDVSILITLLMLCASLLI

SEQ ID NO: 120090 - protein, 191 aa, Triticum aestivum
  Clone ID: PAT_TA_14508.pep
GGPHMPNYFVPVVQQGQQGPRPGMRRGAGAQGQPPVPPFQQQIVPRGRMYRYPTGRNMPEAPAMPGVAGGMIQAYDMGGFPVRDAAVSPAAQIGTLTSALANANPEQQRTILGENLYPLVEQLEPNQAAKVTGMLLEMDQTEVLHLLESPDALKSKVAEAMDVLRNVAHQQNPNTPTNQLAALSLTEGIIS

SEQ ID NO: 120091 - protein, 85 aa, Triticum aestivum
  Clone ID: PAT_TA_14509.pep
ENILSCPHGKLYQDYTCLILDSITRHHARDVYLSICDSTCLFWILNFHLVLQFMARVFVCSSSPVFPLRVSHTMSCHAGSFGLTM

SEQ ID NO: 120092 - protein, 311 aa, Triticum aestivum
  unsure (1)..(311): unsure at all Xaa locations
  Clone ID: PAT_TA_14510.pep
LANFLPNVRSGGWSDIGSRQYMEXDTHVCXTRPAKNFGYPTVDKEVVSFYGVFDGHGGKDAAHFVRDNLPRVIVEDADFPLELEKVVSRSFVQIDSQFADKCSHQRTLSSGTTALTAMIFGRSLLVANAGDCRAVLSRCGIAMEMSMDHRPCSLSEKLRVESLGGYVDDGYLNGLLGVTRALGDWHLEGMKEASRPGGGPLSAEPEIKLTTLTKDDEFLVIGSDGLWDVFSNQNAVDFARRRLQEHNDVKRCCREIVEEAIRRGATDNLTAVLVSFHLVAPPQIRVNQPRRVARSISADGLNSLRILLGSQ

SEQ ID NO: 120093 - protein, 170 aa, Triticum aestivum
  Clone ID: PAT_TA_14511.pep
MAAADVEYRCFVGGLAWATNNETLEQAFANFGQVIDSKVITDRETGRSRGFGFVTFSSEQSMLDAIENMNGKELDGRNITVNQAQSRGGGGGGGGYGGGGGGYGGRREGGGYGGGGGGYGGRREGGGGYGGGGYGGGGGGYGGRREGGGGYGGGGGYGGNRGDSGGNWRN

SEQ ID NO: 120094 - protein, 80 aa, Triticum aestivum
  Clone ID: PAT_TA_14512.pep
TVHISTFWASLRTQKQIWSDGSFSTQAWKKPSQTDHHRFQCRLNIAIQELSFSINHGSRSQVTRIQLARPFGNLSKKNIW

SEQ ID NO: 120095 - protein, 464 aa, Triticum aestivum
  unsure (1)..(464): unsure at all Xaa locations
  Clone ID: PAT_TA_14513.pep
GRKPSIWETFTHKGYSIDGATGDVTADQYHKYKEDVKLLHELGVDAYRMSIAWPRLIPDGRGAVNPKGLEYYNNLIDELLSYGIQPHVTIYHFDFPQALQDEYKGLLSPRFIEDYTAYADVCFKNFGDRVKYWSTVNEPNIETIXGFDQGILPPQRCSAPFGFGCDEGNSTTEPYIAAHHLVLAHASAVSLYREKYQAEQGGRIGLTLLGWWYEPATETPDDIAAAARMNDFHVGWFMHPMVYGDYPPVMRKNVGSRLPSFTNEEAKRVKGSFDFVGFNHYVAVYVKADLSRLDEKVRDYMADAAVAYDMPFLKSRNQFPFGLGLTADFTTPTPWALKKMLKHLQVKYKNPAVMIHENGAAGQPDPSGVNTYDDEFRSQYLQDYIEATLQSIRNGSNVQGYFVWSFLDVFEYLFGYRLRFGVCGVEFNSTARTRYQRHSAKWYSSFLRGGELRPVALPEGAYSQ

SEQ ID NO: 120096 - protein, 268 aa, Triticum aestivum
  Clone ID: PAT_TA_14514.pep
MSLSALSRALARSSRSRQGYLLGGHGVLRAPLPSPSPPPSPLLPGGEGAGLRLVRRYLTSALGSRAAAANAAGKVRDGRSLLANSQSRRLLSDQSKKNFPKEKEVPQGDGSNKSESKKESNSGGQPNVQEKLLKLFQDSIGPVFLLGLLLATLSGSSEKEISFQEFKNKLLEPGLVDRIVVINKTVAKVHVRSSPSTKQNQHSDTSITTSHLPGQEAPSKYKYYFNIGSVDSFEEKLEEAQEALGIDRHDYIPVIYADKISWFQEIMK

SEQ ID NO: 120097 - protein, 61 aa, Triticum aestivum
  Clone ID: PAT_TA_14515.pep
GTRLDDLVRKRYQSFDSEIGALIEAGKGDFETLEKKVLEWGEPTVPSGKQELAEILFQSAL

SEQ ID NO: 120098 - protein, 227 aa, Triticum aestivum
  Clone ID: PAT_TA_14516.pep
ETLYPGISRGESALRWGFLRKVYGILAAQLLLTTAVSALTVLHPTLNATLSDSAGLALVLAVLPFILMIPLYHYQHKHPHNFVFLGLFTLCLSFSIGVACANTQGKIVLEALVLTAGVVVSLTAYAFWASKKGKEFGYLGPILSSALTILVLTSFLQIFFPLGPVSVGLFGGLGALVFAGFILYDTENLIRRHTYDEYIWASVGLYLDILNLFLSILNMLRSMQSDN

SEQ ID NO: 120099 - protein, 132 aa, Triticum aestivum
  Clone ID: PAT_TA_14517.pep
MAASMISSSALVAPPSRAQGLPSLGRRASSFAVVCGTGKKIKTDKPFGIGGGLTVDKDASGRKVKGKGVYQFVDKYGANVDGYSPIYNENEWSPSGNVYVGGTTGLLIWAITLAGLLGGGALLVYNTSALSG

SEQ ID NO: 120100 - protein, 97 aa, Triticum aestivum
  Clone ID: PAT_TA_14518.pep
FFRRSSTTGFRMPRLGDPEASSVLRIAAEFGYLASIAAGCWFDNNLYRYGMSYMPTFLYWSRTMRCIGDPFMAWNLLWLVLDEIDSPMARPFTWGRI

SEQ ID NO: 120101 - protein, 198 aa, Triticum aestivum
  unsure (1)..(198): unsure at all Xaa locations
  Clone ID: PAT_TA_14519.pep
ARGILGDCRQKLFHVRSKRPRPHLDDKVIVSWNGLAISAFARASQILKSGPSGTLFNFPVTGCHPVEYLEVAENAANFIKEKLYDASSKRLHHSYRNGPSKAPGFLDDYAFLISGLLDLYEFGGKTEWLLWAVQLQVTQDELFLDKQGSGYFNTPGEDPSVLLRVKEDYDGAEPSXGNSVAAINLIRLSSNILMCQNL

SEQ ID NO: 120102 - protein, 259 aa, Triticum aestivum
  unsure (1)..(259): unsure at all Xaa locations
  Clone ID: PAT_TA_14520.pep
TFLPKSYFGSILSELFSISTLSKGLDLSYNQLSGNIPTRIGSLMNLNSLSISNNQLSGEIPSTLGQCLLLESLSLEANLLRGKIPXVSWDFXGINMLDLSQNNLSGEIPDFLESFTSLFILNLSFIDFEGSSPXGGVFANSSAVFVQGNKKLCASSPMQQVPLCTTLASRRKNTAHVVTILVPLTTIVVIALACLVFILLKNKGTKTEGHVTQFFREHNRYSYMDLYKATDGFCASSIXGSGSFGSGYTKAIKNSIQCH

SEQ ID NO: 120103 - protein, 79 aa, Triticum aestivum
  Clone ID: PAT_TA_14521.pep
LTAGMEWRLIYVLFFGFPLMVHASVLVIVDCLFPLFLHSSVYGVSYVLNGASALWRGYAAVRRFWSLGPFPCVVLMWLK

SEQ ID NO: 120104 - protein, 167 aa, Triticum aestivum
  Clone ID: PAT_TA_14522.pep
QRIGVGLGTVAFSAAAPAAARRRRPALSAAGRPLSVLWIAPQFLVFGLSEMFTAVGLIEFFYKQACAGMQSFLTALTYCSYAFGFYLSSVLVPPVNRVTARHGGAGWLGDNDLNKDRLDLFYWMLAALSVLNFFCYLVCARWYNSGADGSDAASAQIAAEGDAKEIS

SEQ ID NO: 120105 - protein, 86 aa, Triticum aestivum
  Clone ID: PAT_TA_14523.pep
FFSLSRPPAPAPSYFSSGGYLGELEIWSHGDFDWEFSFDARLRAWWSGSRSSSLPVAASLLCCYFPFGSLLLRSVGCSGVMICRVM

SEQ ID NO: 120106 - protein, 186 aa, Triticum aestivum
  Clone ID: PAT_TA_14524.pep
MADYYHGGRASMYDDCYDAGRHGGGSMKAYSRTDEYYDNVQDDRIRMRPVYADDDCTGYNGGGYGAGRQTAVYTTDEYSRGGGYGGYGGEQEHFKREEREHKHKERLGEVGALAGGAFALYEGHRATKDPANAQRHKIEAGVAAAAALGAGGYAYHEHREQKAAHYETKQQAPEHSHRVPHGYYCN

SEQ ID NO: 120107 - protein, 259 aa, Triticum aestivum
  unsure (1)..(259): unsure at all Xaa locations
  Clone ID: PAT_TA_14525.pep
SPTRSRDGDHAAADEEEDDDDVQWQTDTSIEAAKQRMQEQLSAATAEMVMLSTEETEKKKKQATHANGSAKEIPVEKPAVPHPGPYEELVGDIKASLGSAPTPTQLKAVLASSTLPPQDVMNALLEALFDGVGKGFAKEVVKNKKYLAVAVPDEAAQVLLVQAIEAFGGKCNPEALKEVPVVLKALYDGDILEEETIVDWYNAAVAAGKDSQVVKNAKPFXVEWLQSAESEEEDDEVKGGQLCSTAALNSIIYFNLVSF

SEQ ID NO: 120108 - protein, 167 aa, Triticum aestivum
  Clone ID: PAT_TA_14526.pep
GRGPLHLVLRLRGGMQIFVKTLTGKTITLEVESSDTIDNVKAKIQDKEGIPPDQQRLIFAGKQLEDGRTLADYNIQKESTLHLVLRLRGGIRTWVKTLTGKTITLEVESSDTIDNVKAKIQDKEGIPPDQQRLIFAGKQLEDGRTLADYNIQKESTLHLVLRLRGGQ

SEQ ID NO: 120109 - protein, 197 aa, Triticum aestivum
  Clone ID: PAT_TA_14527.pep
METEFQDGKQEVIEAWYMDDSEEDQRLPHHRDPKEFIPLDKLSELGIISWRLNPDNWENDENLKKIREARGYSYMDICDVCPEKLPNYEIKIKNFFEEHLHTDEEIRYCLEGSGYFDVRDENDQWIRVAVKKGGMIVLPAGMYHRFTLDNENYIKAMRLFVGEPVWTPYNRPHDHLPARKEYLDKLLKPEGQAVEAR

SEQ ID NO: 120110 - protein, 140 aa, Triticum aestivum
  unsure (1)..(140): unsure at all Xaa locations
  Clone ID: PAT_TA_14528.pep
MAEEKHHHHLFHHKKDDEPATGVDSXYGEGVYTSETVTTEVVAGGQDEYERYKKEEKQHKHKQHXLGEAGALAAGAFALYEKHEAKKDPENAHRHKXTEEIAATAAVGAGGYAFHEHHEKKKDHKSAEESTGEKKHHLFG

SEQ ID NO: 120111 - protein, 184 aa, Triticum aestivum
  unsure (1)..(184): unsure at all Xaa locations
  Clone ID: PAT_TA_14529.pep
IRTIGRIGYRAPPAVAFGCGDTNEGDGFTQGAGLVGLGRGPLSLVSQLGLKKFSYCLTSLDDTSKSPLLLGSLASISESAAAASSVQTTPLIKNPSQPSFYYVNLKGLTVGSTHIALPSSAFAVQDDGTGGVIVDSGTSITYLELQGYRALNXAFAGADEAXPAAGRGRGIGLDMCFEAPASGV

SEQ ID NO: 120112 - protein, 205 aa, Triticum aestivum
  unsure (1)..(205): unsure at all Xaa locations
  Clone ID: PAT_TA_14530.pep
SNGALLQLLVGSYFSEKIPKANAIVSFNNRPASEAVPYFEQIGPLFSQLMPMMEASPVYSVARNASGDAWKALFDLAGGLIREYDREAMVSVSKFVDQLPSVMNQVTEGVSEFKPTPPENREFCKNSYSVANTLLVKFSVDAIDDTDIIEDILRPRVDSIGGQIKKVVLSGTHLTPCIQGCXWXVGSEXTPADALGAGLKIIGSP

SEQ ID NO: 120113 - protein, 117 aa, Triticum aestivum
  unsure (1)..(117): unsure at all Xaa locations
  Clone ID: PAT_TA_14531.pep
MASSSSRLSCCLLVLAAAAMAATAQNSAQDFVDPHNAARADVGVGPVSWDDTVAAYAESYAAQRQGDCKLEHSDSGGKYGENIFWGSAGGDWTAASAVXAWVSEKQWYDHGSNSCSA

SEQ ID NO: 120114 - protein, 304 aa, Triticum aestivum
  unsure (1)..(304): unsure at all Xaa locations
  Clone ID: PAT_TA_14532.pep
MTGWGRAATGRPAGGRLRLSARHAETARAPMPPPRRAGAGDTSAFFAATLVLWAVSVGFEIGARGRRELAAVAAGFAFFQAANTAVRAAVSRDPLFVNTAVSLLHSSLTSASVIFVLLCQXRTKGLENMFQHEELVGSSWIGAYSALCFSCGYFAYDQLDMLRYRGWLAIPGILLHHLILLICFTLALHRNVTINYLILTLLCEYHSIFLHVRKLRRMAGFRDFNRKLVKLEWVLNWTTFVTARVICHILITYKLITDAHKFDKGIELPLALSGMAGMNVLNVSLGLDLFKAFARERNQQTHQD

SEQ ID NO: 120115 - protein, 129 aa, Triticum aestivum
  unsure (1)..(129): unsure at all Xaa locations
  Clone ID: PAT_TA_14533.pep
HEAPHDRATVVGTLARAQLVLVAVGAALLLAPPHAAGAIPCGQLCSAPPPSPPCPRPAAGPSPPCCPGGTTPTAAPGRTXHRRPPGNCLGDAARGLKGLNPGNAPSIPSKCRVSVPYTIRASIDCPGGS

SEQ ID NO: 120116 - protein, 107 aa, Triticum aestivum
  unsure (1)..(107): unsure at all Xaa locations
  Clone ID: PAT_TA_14534.pep
THCGWGSTVESFAFGHPLVMLPFVVDQPLVARATAEKGVGVEVARDXTDGPSDRDGVAAAVRRVMVDDEGKVLASNAKKLQEVLADQERQERYIDDVVEHLIRYKDE

SEQ ID NO: 120117 - protein, 124 aa, Triticum aestivum
  Clone ID: PAT_TA_14535.pep
PSSSSYVVAFLYAIGSPAIGCGERMGNQLWNTAIENGWEPIGNINDQHIQELGRWAVLEFGKHVNCVLKFNKVVSGRQQLVSGMNYELIIEASDIGGKEDKYKAEVYEQTWTHKRQLLSFAKVK

SEQ ID NO: 120118 - protein, 101 aa, Triticum aestivum
  Clone ID: PAT_TA_14536.pep
MSGIIHKIEETLHMGGDHKKDDEHKKEEHKKAEEHHKKDGEHKEGIVEKIKDKITGEHGEKSGEHKDKDHKEKKDKKKKKEKKHGEGHDHDGHSSSSSDSD

SEQ ID NO: 120119 - protein, 216 aa, Triticum aestivum
  Clone ID: PAT_TA_14537.pep
ILLDDKLVAKVSDFGLSKTSPNVDNTHVSTVVKGSFGYLDPEYFRRQQLTEKSDVYSFGVVLFEVLCARPALSPSLPKEQVSLADWALHSQKKGILGQIIDPYLQGKISPQCFMKFAETAEKCVADHSIDRPSMADVLWNLEFALQLQESAEDSSSVTDGTSSNTSPLTILRLHSDEPTTDTTTTTSTSMSMTGRSLASVDSDGLTPSSVFSQLMH

SEQ ID NO: 120120 - protein, 122 aa, Triticum aestivum
  Clone ID: PAT_TA_14538.pep
IKNCKSLSSFSTDSKRGRKKKYRTTKLKDKDQRIILVAATPKLYQSLSRRRRHGLLAKAFFSSLLWSSQSLIKHTSRSRSRSSSSNACSRYQQSQRKIQHGDTQSSSCPIWLPNLKRMPCRT

SEQ ID NO: 120121 - protein, 112 aa, Triticum aestivum
  Clone ID: PAT_TA_14539.pep
RETYASVCTVSELAGHCCAREAHQRPDMGHAVNVLSTLSEVWKPTDPDSDDSYGIDLNMTLPQALKRWQAFEDSSHFDGATSSFVASLDNTQTSIPTRPPGFAESFTSADGR

SEQ ID NO: 120122 - protein, 103 aa, Triticum aestivum
  Clone ID: PAT_TA_14540.pep
AVLQQRQLHEKKTVLSIDKYIQEKTRETSAHRLTALAKWQIRTTSAEFVKIWCSFYLLVALLISEEDAALANHTEEDVSRHRCRQYLAHRRTSSQGVPRNLHL

SEQ ID NO: 120123 - protein, 65 aa, Triticum aestivum
  Clone ID: PAT_TA_14541.pep
NRGDRTDGSFSRCTSPHLANDQIFLALSTLRLLFGKCKIFPMEVWMLSHNGLKNLSSWCFQRTEH

SEQ ID NO: 120124 - protein, 122 aa, Triticum aestivum
  Clone ID: PAT_TA_14542.pep
MEKDEVIRRLEREIGEKSAEISREREAHQRLRQQLELKDKDLLLEQNKFNHATTQYKHLKSEHNYLLGKIAEMEGSKIDQNEGSKIDQNEGSKIDQNEGSRIDLNEGSKSPCEPEGLWKSSK

SEQ ID NO: 120125 - protein, 77 aa, Triticum aestivum
  Clone ID: PAT_TA_14543.pep
FGRGAVHLSPACLGAISPSLASYYLYDRGAVITAATALRRLAAGTPAGGASGVAITGGVTRHVFESAVWSMCTWQCG

SEQ ID NO: 120126 - protein, 95 aa, Triticum aestivum
  Clone ID: PAT_TA_14544.pep
GMKSLEHSTEAYPREPCVHYRRLPVHGSSASQQLELQISSKPPLLEFSQSKPLLVHPEIPANTEHVLRKSSYAQIFNSHHAFLAIGSCVLAAIIT

SEQ ID NO: 120127 - protein, 198 aa, Triticum aestivum
  Clone ID: PAT_TA_14545.pep
MGELKKLVGEGKIKYVGLSEASASTIRRAHAVHPITAVQLEWSLWTRDSEEEIIPTCRELGIGIVAYSPLGRGFFGSGAKSADNFSERDIRKNLPRFQAENLEHNQRIFERVNEMATRKGCTPSQLALAWVHHQGPDVCPIPGTTKMDNFDSNLAALALRLTPEEMAELESYAAADAVKGFRTYNAANTWMSSDTPPL

SEQ ID NO: 120128 - protein, 269 aa, Triticum aestivum
  unsure (1)..(269): unsure at all Xaa locations
  Clone ID: PAT_TA_14546.pep
MRSLFDALPGIALNDPFVKRASWGGHRVGVEATASFSPKAATGASPRGGGKXGVLSAPRNDAPLFVGGVNVDCYTSEINFHSNASHXTNCLAPLAMVFHDSFGFFKGLMTTVHAITTTHKAVDGTXAKDWRGGRAASFNIIPSSTGAAKAVGKVLPDLNGKLTXMSFRVPTVDVSVVDLTVRIEKGASYEDIKKAIKAASEGPLKGIMGYVEEDLVSTDFVGDSRSSIFDAKAGIALNDNFIKLVSWYDNEWGYSNRVVDLIRHMFKTQ

SEQ ID NO: 120129 - protein, 106 aa, Triticum aestivum
  Clone ID: PAT_TA_14547.pep
ENRLGSRQELDPIRPAKMHGSPEYILYIQCDPISSSRNAVLASSLHVLLPHHNCCCSLRTQDLLPHLPKCMVLLNTFYISSVTQFPHHEFTITLSSVHCRIGYLRS

SEQ ID NO: 120130 - protein, 146 aa, Triticum aestivum
  unsure (1)..(146): unsure at all Xaa locations
  Clone ID: PAT_TA_14548.pep
SNKRSCVSASTSWHNIYYMKVPSKGIQIYRATRLMLAAHDQLHKRLGQQVDNIGMAIKFTLVIAKFLFKKFQQVCSFLPFMPHRIAPIWLRHRPAVWGRDLGKSAVPFXXKFPKXXKLYPVXXGVLPXHXXHAISPIKTXRGPIPX

SEQ ID NO: 120131 - protein, 113 aa, Triticum aestivum
  Clone ID: PAT_TA_14549.pep
KLNLHLKKEHPNHYQDGGPRGAAPSKRNISKSSHRSKPDVTPRMPTAKIPKHKGGYVAPLPAVNLPEEQQWPRKGMYEVDSEETEEEGDNNVEDRWNYNRAVSSDDEETEDEE

SEQ ID NO: 120132 - protein, 58 aa, Triticum aestivum
  unsure (1)..(58): unsure at all Xaa locations
  Clone ID: PAT_TA_14550.pep
FVFRRKQSDLYKLVSPFQITVLKCIAKPIYLEXAKRLIIKNRGSMNGTGRPTPYFGAF

SEQ ID NO: 120133 - protein, 107 aa, Triticum aestivum
  Clone ID: PAT_TA_14551.pep
GRHRPRKRSFPELNGTNSSSKSAEAMVKNVSKESLQWGLAAGVHSGLTYGLTEVRGAHDWRNSAVAGAITGAAVALTSEHASHEQVVQCAITGAALSTAANVLSGIL

SEQ ID NO: 120134 - protein, 133 aa, Triticum aestivum
  Clone ID: PAT_TA_14552.pep
EMITKQEQAQLAASSIDSIVNGGDGGKGPVIAASVNVAVPQVAHEAIVVQPMLVAETSEAAAVIPKAKEGPDRCAACRKRVGLTGFSCRCGNMYCSVHRYSDKHDCQFDYRTAARDAIAKANPVVKAEKLDKI

SEQ ID NO: 120135 - protein, 158 aa, Triticum aestivum
  Clone ID: PAT_TA_14553.pep
RPPPVPYLFAPQVPAAPRHRPTEFSPVFNHSPTNGTSESTNHHSQEKGIPTLVTWSQGGNEVFLEGSWDNWTSRRALERSGKDHAILLVLPSGVYHYRIIVDGELRYIPELPHATDERGQVANLLDVHDYVPESLDSVAEFEAPPSPEHSYDLQYPGG

SEQ ID NO: 120136 - protein, 224 aa, Triticum aestivum
  unsure (1)..(224): unsure at all Xaa locations
  Clone ID: PAT_TA_14554.pep
RSTQGFQSVPYVVALFSAMLWIYYALLKSDELLLITINSAGCLIETIYIVMYLAYAPKQAKLFTAKILLLLNVGVFGLILLLTLLLAGGEKRVXMLGWVCVGFSVSVFVAPLSVIRLVVRTRXSVEFMPFSLSLSLTVSAVVWFLYGLLIKDKYVALXXILGFAFXVIKXGSTPPQPSRRKRSGRTLDTYVLTRPVHQLASASARQGFVETTKRNIIQQGNSMV

SEQ ID NO: 120137 - protein, 271 aa, Triticum aestivum
  Clone ID: PAT_TA_14555.pep
MGNASGREEDAAAPGEADAADVDVEDGGDDSSARGFPPYGGGANHVRRACSVGVVGASGGPGSPPGSPGRSLSPRMFVPQTPVPPLQRPADVTPVFNEILMNEQEEEFDGPPQKEIPALIVWTLGGKNVSVEGSWDNWKSRKPMQKSGKDHSLLLILPSGVYRYRFVVDGERRCFPDLPCETDAMGNAVNLLDVHDFVPESVESVSEFEAPPSPESSYSFQAPEEKDFANEPPALPSQLHLGVLNSQNSEEICARPQHIVLNHLSFHILTI

SEQ ID NO: 120138 - protein, 319 aa, Triticum aestivum
  unsure (1)..(319): unsure at all Xaa locations
  Clone ID: PAT_TA_14556.pep
ARGAAMVASDLESKAKEAFVHNYFQLAGXLYTQAICAGPCTGDLYADRAQAHIKLGSYTEAGADANKAIELDPTMHKAYYREGAACIKLEEYQTAEAALELGSSYASGDSRFTRLLKECEERIAEESSQAPAKNVEPPVAAAAATVEDKEDVANMENTPPVVEPPSKPKYRHDYYNSATEVVLTIFAKGVPADSVVIDFGEQMLSVSIEVPGEEPYHFQPRLFAKIIPEKCKYQVLSTKVEIRLAKAEQVTWTTLDYRGRPKAVPQKISTPAETAPRPSYPSSKAKKDWDKLEAEVKKEEKEEKLDGDAALNKFFRDIY

SEQ ID NO: 120139 - protein, 181 aa, Triticum aestivum
  unsure (1)..(181): unsure at all Xaa locations
  Clone ID: PAT_TA_14557.pep
MDPSYCRRSKSEDEFALFVLPTLGEHSYSSRRPMHTSILTGARRVNEILNGHEDLCKRHFRMETVIFQALVQKLRENDRLVDGRDVSVEEQVAIFLYALSKNATNDTLXDWFQHSGQTISYYFXGEVLSAITELYSVYIRPPSLHPHPILSKEKFYPFFMDCIDAIDGTHIPLKLPADEQE

SEQ ID NO: 120140 - protein, 68 aa, Triticum aestivum
  Clone ID: PAT_TA_14558.pep
VGRLAAALLRCHPLYCVVSCMYLGTEECASLPGASCSSWRSGFLLFLALLSDSVCSLDNLEVYRHRFI

SEQ ID NO: 120141 - protein, 295 aa, Triticum aestivum
  unsure (1)..(295): unsure at all Xaa locations
  Clone ID: PAT_TA_14559.pep
NSARAKLQQAVNENMKLKVKQTEDSKLWQGLDSKVSSTKMLCDQLTETLQQLASQAERAEEDKKFFEGMLGKNSKALDELNCLLHDSSAKLECAEQSIMSGKQEILRIKQEKEEMDQSYKEQLYANDTTIKEKDSLIKQLEGSVEENKSRLLCADSRLQCMEQELKLKQDVCICLKENLASAEKEKNDLELRNQRYSLEVERLYKDNKDANELLSSFVAKVAELDKEHASMSSHVARLLSSFDKYYGMVQEEKLLITRSAKDKLEHLQNQFVDLTSEXNSGLNSEIGELKSRITE

SEQ ID NO: 120142 - protein, 74 aa, Triticum aestivum
  Clone ID: PAT_TA_14560.pep
ASMDADDGGELSQSILQLILSIIFIRYNIVTFGICANLFLSSPDLHLFSSTGPQFKRVKVCNPESCWMHAGKVT

SEQ ID NO: 120143 - protein, 172 aa, Triticum aestivum
  unsure (1)..(172): unsure at all Xaa locations
  Clone ID: PAT_TA_14561.pep
DSDEDDLNLSWNQLSGKIPDRIGAMESLESLDLSRNNLSGEIPTSLTDLTYLSSLDLSYNNLTGRIPPGRQLDTLYLENQSIYTGNVGLCGPPLERNCSRNNAPEHDNQQKIKKVSEPVLFFYLWDLGSGXVLGLWVVFCTLLFKKVWRLAYFRLFHKLYDKGMYSCYLGAR

SEQ ID NO: 120144 - protein, 265 aa, Triticum aestivum
  unsure (1)..(265): unsure at all Xaa locations
  Clone ID: PAT_TA_14562.pep
TAPPPAVVVGGGRVGQALRSMGPCSRRDLLLRRGEALPPAAPAGPILVCTRNDDLDGVLDATPKSRWPDLVFFQNGMLEPXLESKGLAGANQVLAYFAVSKLGEPPVDGITDANPEGLTAALGNWAPAVAARLQNGGLTCKVLDKDAFEKQMLEKLIWISAFMLVGARHPGATVGAVEKEYRSEVSSLIAELASAAAAERGLTFDEGMEERLCAYSRAVAHFPTAVKEFKWRNGWFYSLTEKALAEGKPDPCPLHTAWLKEIKVI

SEQ ID NO: 120145 - protein, 128 aa, Triticum aestivum
  unsure (1)..(128): unsure at all Xaa locations
  Clone ID: PAT_TA_14563.pep
DSDEGCPCPCFCRGHAARRRQADGAGAVPGRRLLRRPPLLPRPHHVCAARERARRRQLQVPMTKLSLIDVCVVRMRAGAGRGRWLWLSNVDVPAPALFXVVWWPLVSADVPVQVPRPRTTTATASLQK

SEQ ID NO: 120146 - protein, 195 aa, Triticum aestivum
  unsure (1)..(195): unsure at all Xaa locations
  Clone ID: PAT_TA_14564.pep
RGAAGRNTPFSERRVAEITSNVLPGISSIVEGVKVHRKFYTEEQEVSSGVLAIAVSXPSSQPCRTMTDLLAGLGYDGLGXLLGLAQTAGTVPDGLPPPRSALXIFLYETTPTNSCSLTDAARALSNHLHRSRNGWWGSFNGSDSSKLLVAAETAGSVSGGLSSPSAPLSPPYRPPFEIPLQPDSGAGWSHGGSKV

SEQ ID NO: 120147 - protein, 222 aa, Triticum aestivum
  unsure (1)..(222): unsure at all Xaa locations
  Clone ID: PAT_TA_14565.pep
MALAAATLASSPCVSISVSAAGMNSSGLSVSLGARRVPGISVQIHSQRRRMVAAAAAARGDEGAGKTFVEEMRAAAMRMHTKDQASEGEKELEGPSLNELEPNLEAYLRFLVDSKLIFQTLENIVDRAAVXXYAEFQNTGXLERSEALKKDLKWFSEQGHTIPEPSASDTKYASYLEELSEKDQQAFFCHFYNMYFGQSAGGRLTGKKVPLFSTKPYTKTFM

SEQ ID NO: 120148 - protein, 205 aa, Triticum aestivum
  Clone ID: PAT_TA_14566.pep
GVSKVLLLLSAYLDHKVQENEELLDSSKTKAARGIFHGQRVPELSIKLYAERIFKYAKCSPSCFVLGLIYIERYLQQPNIYMTSFSVHRLLIASVVVAAKFIDDAFFNNAYYGRVGGITTREMNMLELDLLFSLDFRLKVDIETFGSYCLQLEKEALVLVLERPIQVQAANVTKHLICNSSADETCKHELVRERYSSQAVHGCSW

SEQ ID NO: 120149 - protein, 123 aa, Triticum aestivum
  Clone ID: PAT_TA_14567.pep
SDEGDNSCFPWPTVLGFLILSFNAAMAIIRSQGDVMAIAFVGFAYAILVALFVCLRMYERARAGSSKREWLKIAVWILTTLLTFSFSYKVAAIMPAPMAVVVWLMAFATVAGGFVAFFVYKEK

SEQ ID NO: 120150 - protein, 99 aa, Triticum aestivum
  Clone ID: PAT_TA_14568.pep
SDEARFRVYAAKAETVSKVMDIVKQQLALAADVGLTAESKFADLGADSLDTVEIVMALEEEFKITVEEDNAQSITTIQEAADLIDKLVDQNPAAAAPPA

SEQ ID NO: 120151 - protein, 212 aa, Triticum aestivum
  Clone ID: PAT_TA_14569.pep
CLNDNNSERASKDMDLVHIMDNQQKHNTQREVDTMRTTSRGNDEKGSIPAHQLELSLRRTDYGKLENHDKNDRRTLNHSTSSAFSLYNCRAVSTSGNAGDGQLCSTSETLMDVENKNGDSAAPSQDMTETNRPPIRVVPFPVPVQGLTFDGQPFWNGTPMASLFYPQSAPPIWNSKTSMWQESTQATSLPQKSQQNEPNEMGAKPVENAEEQ

SEQ ID NO: 120152 - protein, 56 aa, Triticum aestivum
  Clone ID: PAT_TA_14570.pep
PSFKSSNSELTLLSTQPEPSSVAHRGGGHRRQKGVCWRQTTMPLVSHQSRLGFDCI

SEQ ID NO: 120153 - protein, 161 aa, Triticum aestivum
  Clone ID: PAT_TA_14571.pep
MSDSEEHHFESKADAGASKTYPQQAGTIRKNGYIVIKNRPCKVVEVSTSKTGKHGHAKCHFVGIDIFTGKKLEDIVPSSHNCDVPHVNRVEYQLIDISEDGFVSLLTESGNTKDDTKLPSDEALQAQIKSGYDEGKDILLTVMSAMGEEQICAVKEIGGKN

SEQ ID NO: 120154 - protein, 274 aa, Triticum aestivum
  Clone ID: PAT_TA_14572.pep
FLLWLTGGDHCSVLSGLAFEIGPFKFVVEPYNGTIPSLEINPNSWTKVAHILFVDSPAGAGFSFSKQPKGYHVGEISTSLQLHEFLIKWLTDHPKFLSKGESYAGKITTVSVHNLPQAMDQGSRTRLHLKGHLLGNPATGERIDESSKVPFAHGFGIISDQLYETILGHCQGQDYKNPTNVLCAKALGTFHSLLSEVMSPHILLIKCVYSSAGPHAEMDDSAGADRKILSEEAAGIKMGKRLEHPPVRPPLDCVDYAHYLSYFWANDERTRDAL

SEQ ID NO: 120155 - protein, 114 aa, Triticum aestivum
  Clone ID: PAT_TA_14573.pep
NKLQRQAGRRPGAALGSRGGPGQGARGAIATARSGGRRAPCTETTGRGTERRGGAGRAAAMVNAPGSGQLGSSGSATGAAAVFGRAVHAERRAAPAGGRRYRARSASVRRSGTA

SEQ ID NO: 120156 - protein, 239 aa, Triticum aestivum
  Clone ID: PAT_TA_14574.pep
MASSQCCDNPPALNPACGEGKVVDSFGGLKAYVAGPEDSKAAVVLVADVFGFEAPILRKIADKVASSRYFVVVPDFFHGDPYVPENGKPIPEWLKSHTPEKGFEEAKPVIATLKEKGVSAVGAAGYCWGAKVVVELAKAHEIQAAVLLHPSFVTIDDIKEVKCPISILGAEIDKMSPPELVKQFEQVLSVNSGVGHFVKIFPGVAHGWSVRYSHDDAAAVKSAEEAFADMLDWFNKNLK

SEQ ID NO: 120157 - protein, 205 aa, Triticum aestivum
  unsure (1)..(205): unsure at all Xaa locations
  Clone ID: PAT_TA_14575.pep
RVTLKKSGVVLDLVPPLTKVNNLIFGRTWVDTPGEMVMTNLTTGDKVVLYFQPCGWFGAGRMXDGYVYSAAEEPKIMITGKWNKSLSYQPCDQEGDPLPGTELKEIWRVAPAPQGDGYQYTHFAHKINSFGTAPKKLLASDSRLRPDRYALEKGDMSKSGPEKSRLXEEQQRPEKRXQEAKGEQFTPRWFNMTXXPLHPWGDLDL

SEQ ID NO: 120158 - protein, 200 aa, Triticum aestivum
  unsure (1)..(200): unsure at all Xaa locations
  Clone ID: PAT_TA_14576.pep
MSDSSSLSTVSITTPPSENKRSITAPAGDPSDGSAAPPADSETGQKQPEPEYPLRPGKSDCSYYVKFGSCRYGMNCWFNHPLYMRGGRGLQRDNWVGRNSSRASNSSEYNQYIFDKACTYNRHEGKTKVKQVKLNFLGLPXRPGTIPCSYYMNXGTCKFGTXCKFHHPDPVSRRRDLECFAAYYSRIISNELSTKHSNEH

SEQ ID NO: 120159 - protein, 326 aa, Triticum aestivum
  Clone ID: PAT_TA_14577.pep
MINDMDRILEVIKQAAKEGALVLYTLADPSMAESAKNACDFWGVPSTDVLRPTVEAIASHMGVAPSGIPRSSPSRPCQLTEDYFRRIDAIDVAVGQDDDDDVCEAERDDAAGKAIYIVSDGTGWTAEHSVNAALGQFENCIADRGCAVNTHLIPLIDSMDQLLDVIKQAAKEGALVLYTLADPSMAEAAKKACDFWGVPSTDVLRPTVEAIASHIGVAPSGIPRSSPSRKGQLTEDYFQRIDAIDFTIKQDDGAQPQNLKRADIVLAGVSRTGKTPLSMYLAQKGYKVANVPIVMGVKLPKSLFEINQDKIFGLTINPVVLQAIRK

SEQ ID NO: 120160 - protein, 128 aa, Triticum aestivum
  Clone ID: PAT_TA_14578.pep
IRHEADIVNALMENRNCITLDVCASLLCLTASLLESTYDRHMSIALGMILSLVESFGSTISSALSATPPVGVDLEAEQRLERCNLCFQELKNVSTSLKFLTRRQGEVGRSAQELNLFLQDIFQLSSSV

SEQ ID NO: 120161 - protein, 127 aa, Triticum aestivum
  Clone ID: PAT_TA_14579.pep
EDWADSYTLFVFNMALMGFAEHRRLQDWYNPGSMGKQYFLGLEKFLAGSGDPSYPGGPLFNPLGFGKTEKEMNELKLKEIKNGRLAMLAILGYFIQGLVTGVGPFQNLLDHLSDPVNNNVLTSLKFH

SEQ ID NO: 120162 - protein, 456 aa, Triticum aestivum
  unsure (1)..(456): unsure at all Xaa locations
  Clone ID: PAT_TA_14580.pep
MDAAISAAHEAPPAVVLVSAGASHSVALLAGNVLCTWGRGEDGQLGHGDAEDRLVPTVISGFDAPGITSCHXGPDHTSGYSAGRGSRTTSWGWGYLPRTNRGQWSSSSRPSPDSPSPSLQAMWSARRAQATRLCEETGVSTIALGPANAPAXGGMDNARHGSGVLPEDLLLGRGDASLLGDSSVKRMAGSAVXEGRWLHTGEIYGWGXGRYRKLGSMVIRNDRLXVPEKVSSLEGKKMVLVACGWRHTITVSSSGSLYTYGWSKYGQLGHGDFEDHLVPHKVEALXDSSTSQKSGGWRHTMALTSDGKLYGWGWNKFGQVGAGDNADHCSPAQVNFPEEQKVAQVACGWRHTLAFTEKKNVFAWGRGTSGQLGHGEIVDRNTPVMIDALSPDGPGCKKLESSAAIPFAAKIWVSPSERYALVPDEKVAKPGDVSARGNGADASVPENDVKRMRVSS

SEQ ID NO: 120163 - protein, 80 aa, Triticum aestivum
  Clone ID: PAT_TA_14581.pep
MEAVALENFRARAFSLLSIAGLSGFCQLSIPLGVRGGVPVSVSLVACHGADRFLLSGAQELYETLKEETKKGWSSPDSSL

SEQ ID NO: 120164 - protein, 184 aa, Triticum aestivum
  Clone ID: PAT_TA_14582.pep
SHPVLAKMMISGVVYSLGDWIAQCYEGKPIFDFDRARMFRSGLVGFTLHGSLSHYYYHICEARFPFKDWWVVPAKVAFDQTIWSAIWNSIYFGGLGFLRVESPTTIYGELKSTFWPMLTAGWKLWPFAHLVTYGVVPVEQRLLWVDCVELVWVTILSTYSNEKSEARNSDSTSTPAASSKDNSR

SEQ ID NO: 120165 - protein, 104 aa, Triticum aestivum
  unsure (1)..(104): unsure at all Xaa locations
  Clone ID: PAT_TA_14583.pep
MAKPSQVLVSALAAWAVVLLLLCAAAPRGADAATACDAAQLTPCAGAIIXGARPPTAACCSRLTGATALACARXARDPKLQRYVSSXPNXKNAMAAFKLPVPSC

SEQ ID NO: 120166 - protein, 125 aa, Triticum aestivum
  Clone ID: PAT_TA_14584.pep
YYIVITVELFNCSRINYMKILHFPQKSVMSNHTTITTTDTRAQLANFSGAMHGLEQKLGPNKCNEDDTSHPIQSSTEQRCYLKSSRDSYISNVSLLHCPFEVSRTSGMGHVKVYITAAGLPSCYQ

SEQ ID NO: 120167 - protein, 260 aa, Triticum aestivum
  unsure (1)..(260): unsure at all Xaa locations
  Clone ID: PAT_TA_14585.pep
EVLFPSEEQSLRLQRVCSSPGPYFAKDAGLAGDSNPRSVSFKVAGDGSKPKKRAKSPIPTRVISDVFREAKAASKRFSSPQRQRKSSSVRLLDDSPPFAFSSTRAATKLVTKRASSWPRNSEARVAKVAALDVLEKWTVDRSQLLIGHRFASGAYSRLFHGIYKEQPVAVKFIXLPDDXEDXXXAXXLEKXFXSEDTILARLXHXNXIELVVAXXXAPVFCVITEFLPGXXLKAXXXXLEGTFILTFTWFGNTFFLSNFT

SEQ ID NO: 120168 - protein, 108 aa, Triticum aestivum
  Clone ID: PAT_TA_14586.pep
VRPAQTSPNPRGKNHPLAPRGRNPRARRSSHLSRATEAAARRRRGRVDGGGATYPEEEDALLLRRPATKPAGTLASDCPISPAAPLPRPEPASSGEVVAAGEEISDIG

SEQ ID NO: 120169 - protein, 74 aa, Triticum aestivum
  Clone ID: PAT_TA_14587.pep
NTRTIECKHTTTSVQEIHQQIKKDSCIGNAAAQTNLNDLANTTACLTGTLFTTLLWHRLNINRMLVDYILLKLS

SEQ ID NO: 120170 - protein, 213 aa, Triticum aestivum
  unsure (1)..(213): unsure at all Xaa locations
  Clone ID: PAT_TA_14588.pep
DSDEVEIARDKQPRSRRANGIFWILLLNFGIYVADHLLQIRQIKSLYLYHAFPTWFQFVTSTFCHANWNHLSSNLFFVYIFGKLVEEEEGNFALWMSYILTGAGANLISWLVLPTSSVSLGASGAVFGLFTISVLVKMSWDWRKILEVLILGQFVVDKVMEAARATTITGQSFQVNNIAHVSGALIGACVXVFLVSRIPFSSNDDNPKATKRE

SEQ ID NO: 120171 - protein, 208 aa, Triticum aestivum
  unsure (1)..(208): unsure at all Xaa locations
  Clone ID: PAT_TA_14589.pep
DSDEAPIVWGRQLRPALLLPAALLPSSQPAKKHNLRPAAAAAESAGEAKGFLEKYPALVTGFFFFMWYFLNVIFNILNKKIYNYFPYPYFVSLIHLVVGVAYCLVGWSVGLPKRAPINANLLKLLFPVALCHGIGHVTSNVSFAAVAVSFAHTIKALEPFFSAAATQFILGQQVPLSLWMSLAPVVIGVXMASLTELSFNWTGFHHAM

SEQ ID NO: 120172 - protein, 276 aa, Triticum aestivum
  unsure (1)..(276): unsure at all Xaa locations
  Clone ID: PAT_TA_14590.pep
RCSVRARLKPTSLQCETALHIPQLTREYAFHPAGFNANNPDSSDLFFAEIEFSESQHXPSAQFGLNSLPHVRLIRPEHSRLADSEQMDQSHFSRLADSMVEFVEARTGLEVGPIVRPPLVSRNQMILLVLLFLISIPFGIKRIMEGDTLLHDRKLWMAGALFVYFFSVSGGMYGIIRHTPMFITDREDPNKLVFFYQGSGMQLGAEGFAVGFLYTLVGLMIAVVTHLLVKVESLQTQRFAMLAVMAIGWWAVRKVIYLDNWKTGYGIHTFWPSSWR

SEQ ID NO: 120173 - protein, 145 aa, Triticum aestivum
  Clone ID: PAT_TA_14591.pep
CLSQCSGLPPMSEAEAHAFEVSSFGLYNELSGLVGLGGVDNNSNVETTDYQLPPDRGLSADDYMELTDLLAPDPSFPTEFPAEDSQYMQYPLAHFNGHYDVPTMSGPLEPTMPSIFDAFPPSNNGVLATDVVANYMDPTMQFPFS

SEQ ID NO: 120174 - protein, 154 aa, Triticum aestivum
  unsure (1)..(154): unsure at all Xaa locations
  Clone ID: PAT_TA_14592.pep
LDNNKREPWRTSTAAAATAGPAPATTTTAATTASPALMTTAVAKVATTSRAAMTTTAAAAAMGTAGPAATTTAVAPAAVATTSPAPPTTTAXAATTTPAARAAAAATRPPAXTATPAATARTPAAPGTPATPLPTTPPPPASGTTASPLATTHT

SEQ ID NO: 120175 - protein, 375 aa, Triticum aestivum
  Clone ID: PAT_TA_14593.pep
MKEAVDEARLQDLRNKHRPSVLSSMENRAKGLLAWRSTNGLASKLYNFKRDTEPLVSISTEQLNDSTDGDANQETSSGNIDDMYHGLTVNTEIDSMPDPKDQVIWLKVELCRLLEERRSAVLRADELETALMEMVKQDNRRELSAKVEQLEQELSELRQSLSDKEEQEQAMLQVLMRVEQEQKVTEDARIFAEQDAAAQKFASHVLQEKYDEAMASLTQMENRAVMAETMLEATLQYQSSHQKAQLPSPSPSPRTPTRDTSPGQVNQDSSQEFQPRKISLLAPFSLSWRDKNKGKQDESTNGKLNNNTEQSVETPKTDHANQEATPKEGEQRVETPKRDEPTLETAKMDGDVPTVETTTDKMNGQEEHLEEVKLD

SEQ ID NO: 120176 - protein, 190 aa, Triticum aestivum
  Clone ID: PAT_TA_14594.pep
MAAAGGETMMTREQLLHLFSRFSFLTSLPEVKQRIADAVRDKQEAVAVTTEIQEEILREMGVDPSFGIGCLGKVNVVYKNDKDLMIKFYQFVAKEEMAIDEAELEPRELAAKLHAQQIMQEQQLNMLVEMRKYSPESQSVILGTLHRELEEANFHLNTSVLTPQQSQRLFPRGVFPPALGAPCLLFKSPQ

SEQ ID NO: 120177 - protein, 120 aa, Triticum aestivum
  Clone ID: PAT_TA_14595.pep
IRTRFPFFGPINSAVGALLVSFTVYIIPALAHILTYRTASARMNAAEKPPFFLPSWTGMFVLNMFIVVWVLVVGFGLGGWASMVNFIRQIDTFGLFAKCYQCPKPPVPAAAQSPAPLPHH

SEQ ID NO: 120178 - protein, 227 aa, Triticum aestivum
  unsure (1)..(227): unsure at all Xaa locations
  Clone ID: PAT_TA_14596.pep
FGRGLNLDSCKIGDEGLFHLKGLIQLKSLELSDTEVGSNGLRHLSGLRNLQSINLSFTLVTDIGLKKISGLSSLKSLNLDNRQITDTGLASLTNLTGLTHLDLFGARITDSGMNCFRFFKNLQSLEVCXGLITDAGVKNIKDLKALTLLNLSQNGNLTDKTLELISGLTALVSLNVSNSRVSNSGLHHLKPLLNLRSLSLESCRVTASEIDKLRLVALPNLISVRPE

SEQ ID NO: 120179 - protein, 61 aa, Triticum aestivum
  Clone ID: PAT_TA_14597.pep
DSARGASAGFVPVQASTFAESQAEALLKRMALMGFRVEKRGGALCLYWQRGELVSVSAWRC

SEQ ID NO: 120180 - protein, 199 aa, Triticum aestivum
  Clone ID: PAT_TA_14598.pep
MVLATRASVSTPPRPTEIQKSGSHVPANTRFAVPDPRKAFATNVSTISSRIPAVPQAPTHSRSAPSGYQNYTPAPTTSSVAPSSVVPPVSRASSAQRPMQQASSVAVAEPIRPIAVRQSRKASLARFLEKRKERVSSATPYQLSKSPLESSGSLGSASTPSRLSSADNAPPNNNCQESMSYVSNDAMLAIPHRVVIELE

SEQ ID NO: 120181 - protein, 184 aa, Triticum aestivum
  Clone ID: PAT_TA_14599.pep
EGAVVCFLGVLSAALGFAAEATRVKVSDVQISSTPGECIYPRTPALALGLISAVSLMLAQSIINTVAGCICCKRHPVPSDTNWSVALISFIISWCTFIIAFLLLLTGAALNDQRGEENMYFGSFCYVVKPGVFSGGAVLALASVALAIVYYVALSSSKGPPPTFATPQNHGIAMGQPCDPAAEQ

SEQ ID NO: 120182 - protein, 105 aa, Triticum aestivum
  Clone ID: PAT_TA_14600.pep
MAKLHTLVAALLLVMAVSLAALEGVHGVCGMSNDEFKLCQPAAAVNNPTDSPSAECCAALEKANLSCICRYKGIAGIWLRMYHIDANRAMALPGKCGLTMPNNCS

SEQ ID NO: 120183 - protein, 97 aa, Triticum aestivum
  Clone ID: PAT_TA_14601.pep
GLARRAIVQVSYAIGVPEPLSVFVDTYGTGTIPDKEILKIVKENFDFRPGMIIINLDLKKGGNGRYLKTAAYGHFGRDDPDFTWEVVKPLKAEKPSA

SEQ ID NO: 120184 - protein, 146 aa, Triticum aestivum
  Clone ID: PAT_TA_14602.pep
MASSGDAAGVVVPRNFRLLEELERGEKGIGDGTVSYGMDDADDIYMRSWTGTIIGPHNTVHEGRIYQLKLFCDKDYPDRPPTVRFHSRINMTCVNAETGLVDQRKFSLLSNWRREYTMENILIQLKKEMATSHNRKLVQPPEGTFY

SEQ ID NO: 120185 - protein, 115 aa, Triticum aestivum
  Clone ID: PAT_TA_14603.pep
RDKTHKNHVKHTATVIHNAFAPSVAILCGVPAGDRGGSGGRTGATGQGGARGRGHGARGAIRSGRGWTSIGPGHLRRVPRAPATRSPELYTLALGRAEALLLRPGERHAMEKLYE

SEQ ID NO: 120186 - protein, 125 aa, Triticum aestivum
  Clone ID: PAT_TA_14604.pep
SQVAEKFSQLSERGNFDKSVFYPSVVLMLPRVRVPCIFETVRRGRTMEQSICPRGDLLGQRGRRQQDGGGAGSGPPLGAIAQLGTGSGPPPPSASSLSPSYAGVEGFGAGCVSGKEERTRGRTRG

SEQ ID NO: 120187 - protein, 147 aa, Triticum aestivum
  Clone ID: PAT_TA_14605.pep
YFSQTINQQYLSEKKRKTFDIFSPISNCPSDHQESGAGRYSFSITTHHSLRATSVQCSFQVALPLTPAPPAVAVQQARRRDGAGDAAETKARARAPASAIAHSHCRMPYSRHLLPLLFLMTHGLPCGARRWTGQPVKCQCTLGFRRR

SEQ ID NO: 120188 - protein, 175 aa, Triticum aestivum
  Clone ID: PAT_TA_14606.pep
PVAEKKKRVTDEDLEALLSDEIFQPFGHEALADVQATCGTLGLSTATVKLIAPDGEEKIGCSVGTGPVDAAYKAVDQIIQIPTVLREYGMTSVTEGIDAIATTRVVVTGDVTNNSKHALTGQSFNRSFSGSGAAMDIVVSSVRAYLSALNKMCSFAGAAKASSEVPESASVQRTE

SEQ ID NO: 120189 - protein, 60 aa, Triticum aestivum
  Clone ID: PAT_TA_14607.pep
MAATLKLRILAAAAVVASSVVGMAMAAEAPAPSPDTGAATTTPAFAVGTLVAAAVGYLFC

SEQ ID NO: 120190 - protein, 132 aa, Triticum aestivum
  Clone ID: PAT_TA_14608.pep
RPGRDFRVGEGEKETLGSPAAVLEFVLVQICLVGGGMAMRTMAANLKQKLPVAVQRVFASSRAPATSNNTAAAIDSLDPELRRRVLNDVDKLIRRNRRNDLLVAGAGLSFGGIVMSYLAHRLTSRSDDWLTK

SEQ ID NO: 120191 - protein, 175 aa, Triticum aestivum
  Clone ID: PAT_TA_14609.pep
MAAALRRAVAQRFAAAPQQAYGMPRRFMQERPAFRPAVPPDVGFMPLADRIRDHLGVSFPRINLDGLVPPAPARPQTQPTREAAAVVGSLTVEEARKVLRATQMEAARARVRASREGTVPYAEFLRLCCDAAGADDGPSVARALDESGSVIVLGRTVFLRPEMEMNQRNGGVLKQ

SEQ ID NO: 120192 - protein, 90 aa, Triticum aestivum
  Clone ID: PAT_TA_14610.pep
RTRLFAVPLVAHTFDLVDGDRDSFRFLWLVLPLAFAQEFDKRYGVGWQCVVGASFGCFFTHTSGTFIYFSLERLSFLLFKAAAAVAVAAS

SEQ ID NO: 120193 - protein, 97 aa, Triticum aestivum
  Clone ID: PAT_TA_14611.pep
MASRSFLIRSPKEEESNAAVREAVLLGAKNGAIAGTVVAVPTLVGCRVLPWAKANLNYTAQALIISAACISGFFITADKTILRNARQNTIGKLDKST

SEQ ID NO: 120194 - protein, 82 aa, Triticum aestivum
  Clone ID: PAT_TA_14612.pep
GVINGTAPNPVRLSELCERLGRIVGRPSWLPVPEFALKAVLGEGASVVLEGQKVLPAKAKHLGFSYRYPYVEDALKAIARDL

SEQ ID NO: 120195 - protein, 43 aa, Triticum aestivum
  Clone ID: PAT_TA_14613.pep
VGYAVINVLAMPLGHDKHGKHSRHHSINLLSASMYKLIYVPLT

SEQ ID NO: 120196 - protein, 206 aa, Triticum aestivum
  Clone ID: PAT_TA_14614.pep
DPHEGRPGVAVVELQTVDVVVEHVLKQILSQETQYLPITRGCNAVLLVNGLGATPIMELMIAARKAVPELQLVYGIAVDRVYTGTLMTSLDMAGLSITIMKSDESVLKRLDAPTKAPAWPVGSEGKRPPAKFPVPLPPSPSMKDDEILAPSQELSKQRCILEAAIEASATAIINVKDSLNEWDSKVGDGDCGTTVSQIVFTNSMLI

SEQ ID NO: 120197 - protein, 96 aa, Triticum aestivum
  Clone ID: PAT_TA_14615.pep
FGRARYGGCCRRRIWCHEHHHLSPVAGRPAGRPCPWRPPASAGQARARRRLPLHPALRHISLVLTFRTLPLRLSRSEVNKRLVDTEVDCLQCCEQI

SEQ ID NO: 120198 - protein, 163 aa, Triticum aestivum
  Clone ID: PAT_TA_14616.pep
GTRDAATGARSPTSGGQMLVFVPPHPLIKHWVSVLRNEQTPCAIFKSAMAELGRLLIYEASRDWLPTITGEIETPVAVASVEFIDPREPVLVVPILRAGLALAELASSVLPATKTYHLGLRRDEETLQPSIYLNNLPDKIPEGTRVLVVDPMLATGGTMVAAI

SEQ ID NO: 120199 - protein, 147 aa, Triticum aestivum
  Clone ID: PAT_TA_14617.pep
SNALLKLVEDLNGLPFVDVLTFHAFPYCLQAPDSVPSTGRDEEEGSSHHGNGSGAARENPENPLPDLALAKSESDRIKAFYQTVLSAIVVFIVAALSGCNGHEAALLDRKSQESSPQQPPCHRGVLHDCYLHMRGCFDDVRVLHVPP

SEQ ID NO: 120200 - protein, 60 aa, Triticum aestivum
  Clone ID: PAT_TA_14618.pep
DIEIHAYEVTCSLLTGMLAMPVSCVAYVIHSEVTSDVLNGHLSELMKDETNTTYVEQEYS

SEQ ID NO: 120201 - protein, 84 aa, Triticum aestivum
  Clone ID: PAT_TA_14619.pep
KKETGLELQPESPLFKCMPTTLTTHTYTHARVYEIPILEPGEAWVPLHCLMDSMYRKLKGQYFQSACTCLPQDCVGLAAARTES

SEQ ID NO: 120202 - protein, 166 aa, Triticum aestivum
  Clone ID: PAT_TA_14620.pep
SARGFRNPGSSTPRKLQEGPSLRKSASVGDWSVNDKTTSTNHQRKELCNSSVSTSILIPHLQNLVKQTAFQQDLITNLLSSLQQNERVDAQSRVQSTGSDTVVEAATAEREHSLLVKIFELQSRMISLTDELIATKLKHRHLREELNALYCQEEIVDMREDENEEA

SEQ ID NO: 120203 - protein, 146 aa, Triticum aestivum
  Clone ID: PAT_TA_14621.pep
RVGGALVAVSVWLYKLYDRLVEDEDLPQLASVVVLRGEMEKSTITRGLPTAKVVYSFLNDTLSASFHFPKWNKGRIICLKSQLKKLQSAVDSSNGSPAAGFVPMTNSHLPSPDSKIYTREDQLGNGTGHLPDEPLVEEKESELLAL

SEQ ID NO: 120204 - protein, 168 aa, Triticum aestivum
  Clone ID: PAT_TA_14622.pep
LRPSLRPSSTGQVPIAAALAPPLPRPVVASPPLPRWGSCPSSGGCSSSPLSSSPPTRSLMNSVLMVDQAAKALRPKFNVFVKNVSAHLAVPVPHVELCRAVCCCMWVLRHLGFSLLVVSLFSRAPLSGLLSCALTLPCSLLSFISATATVWSTRSLPSSSRGSPWLGP

SEQ ID NO: 120205 - protein, 92 aa, Triticum aestivum
  Clone ID: PAT_TA_14623.pep
MAKQQQQAMALLMMLVLAAETASAASCNAGQLTVCASAMLSGAAPSAACCSNLKAQQGCLCQFAKNPAYARYVNSPNARKTVASCGVALPRC

SEQ ID NO: 120206 - protein, 195 aa, Triticum aestivum
  Clone ID: PAT_TA_14624.pep
MSVPDERADGMLSLHESPTRNVQPAQEHLSLEEVSTESSIRPFFVEFDNNIFSSSRRRCSNTRAERQLLVLETNLFFGAFASYDRHRDMRMDIDNMSYEELLALEERIGSVSTALSEEQFTKCLRRSIYSQVASEVSKSTVDDMKCSICQEEYMEGEEVGRLPCEHWYHVCCIGQWLRQKNWCPVCKASAVPSKG

SEQ ID NO: 120207 - protein, 257 aa, Triticum aestivum
  unsure (1)..(257): unsure at all Xaa locations
  Clone ID: PAT_TA_14625.pep
SARGVKEHELTEDFPDVSYLYKESLVKKLAEKGCWDIAETRAKKETKLLEYLVYLAMEAGYMEKVDELCQRYSLESYVDSLVPEKVFCVSDYLDLKKLDVEEIVWVDEINGLLSATSNIEACKIIGMDCEWRPNFEKNTKPSKVSIIQIASDKVAFIFDLIKLYEDDPKTLDSCLRRIMCSSKILKLGYDIQCDLHQLTQSYGELDCFQSYEMLLDMQKLFKGVTGGLSGLSKEILXAGLNKSRRNSNWEQRPLTQN

SEQ ID NO: 120208 - protein, 265 aa, Triticum aestivum
  Clone ID: PAT_TA_14626.pep
LREGEAAGMLADMVGSRGHSFVRRWGYFVRQCGYWRGELYICCENFFVMRISLSNNTYQAIRMPTEDEFYLGKSINGIYCASLFQGSQLQVWFLNDQCVHGQTEWVLKHGRDIFPFLPNLNYDEQCDGPWILQDFYYCRQEEHNACGEAYDVVYNNEAILEEKFVWDSDNDNVLEPGSRCKDSYIYFLGFHPYKEVVFLSDKFDRVLAYNWSSSRVQDLGKVFPKFYIDWNLHFHHTLVAASFPYTPCWLGELPEKLNLEAQLED

SEQ ID NO: 120209 - protein, 178 aa, Triticum aestivum
  Clone ID: PAT_TA_14627.pep
PSARPSSPSKVLLVFLLLSLPLAAPLLAGALGDAYLLTSRLAGGAAALPAALPAPPLVPADGPPFAPPAPPPPPAPPPPPRHRPRERPRAPPASPPAPPAPPPAPPRHHARPPAHPAGLPASRPALLPAIGGVATMLQTTPAYGLFFPVNLVEIVSFRVNFALFIVAHASFQLKTTLP

SEQ ID NO: 120210 - protein, 86 aa, Triticum aestivum
  Clone ID: PAT_TA_14628.pep
METAAPKEAPPPQPQPGVEEDGTLSATAAMARDAAVLFQSRRYAECADVLAQLLLKKEGDPKVLHNMAIAESFVDGCPDPKKLLEI

SEQ ID NO: 120211 - protein, 60 aa, Triticum aestivum
  Clone ID: PAT_TA_14629.pep
MAKSKNHTAHNQSYKAHKNGIKKPKRHRQTSTKGMDPKFLRNLRYSRKGNKKSGEAEAEE

SEQ ID NO: 120212 - protein, 82 aa, Triticum aestivum
  Clone ID: PAT_TA_14630.pep
MSCCSGNCGCGSGCQCGSGCGGCKMSPDMETTATVGMKPMVLAAPTTKASAGGFEAAVEGGGCDCNTCKCGSSCGCSCCSCN

SEQ ID NO: 120213 - protein, 208 aa, Triticum aestivum
  unsure (1)..(208): unsure at all Xaa locations
  Clone ID: PAT_TA_14631.pep
MASLSPSLHLPCNSRTGFLGKTHGIRPRVLPAGRVGFVRTVVECKESRIGKQPIEVPSNVTLTLEEQFVKAKGPLGELSLSFPGDVKIVKEESGMLRVYKTAETKRANQXMHGLFRTLTDHIIVGVSKGFDKKLQLVGVGYRAAVEGNDLVMNLGFSHPVRMAIPEGLAVKVEENTRITVSGYDKSAIGQFAATIKKWRPPEPYKGKG

SEQ ID NO: 120214 - protein, 73 aa, Triticum aestivum
  Clone ID: PAT_TA_14632.pep
SPEHVYYTSLAGYINIKLCVRSTAFIYLRHDICKLGSGCHTSIYIMHNISMLGSGCFRQPLAICPYVIPLIYT

SEQ ID NO: 120215 - protein, 170 aa, Triticum aestivum
  unsure (1)..(170): unsure at all Xaa locations
  Clone ID: PAT_TA_14633.pep
GTSFVGARRAIEWDEEEDHIEITFDGEPINIDTSNNARWVSRTLAGLSVKRTDAVNSVKVDLAGVFSISASAVPITDEDSKIHSYGKTMKDSLVHLDLRFKFHSLTDVVDGVLGQXTYRLDYVNKMNVTAKMPIMGGAPKYLSSGLFSTDCAVSKFHRSGGANHVRALAA

SEQ ID NO: 120216 - protein, 118 aa, Triticum aestivum
  Clone ID: PAT_TA_14634.pep
MASEEGVVIACHTKAEFDAQMAKAKEAGKLVVIDFTASWCGPCRAIAPLFVEHAKKYTQAVFLKVDVDELKEVTAEYKIEAMPTFHFIKNGETVETIVGARKDELLALIQKHTASASA

SEQ ID NO: 120217 - protein, 87 aa, Triticum aestivum
  Clone ID: PAT_TA_14635.pep
FGRGLTAVPSFACMSEVRCLEDLRKKETPYKKMKPSRSYVALDEEQDCHVPRPDRRGSCANLVARKNSKNMLYRPPAIPVNKSGYHQ

SEQ ID NO: 120218 - protein, 196 aa, Triticum aestivum
  Clone ID: PAT_TA_14636.pep
ASGVETVVVFPKNAGKIVPARHEAELLVGLQNDGESTLNVVAVHSTLHLPFDHRMYGQNLTVQNFFNASVPVSVQATFPYKFVVSKFLQPGAYDLVGYIVYEIDQHPYQNVFYNGTVEVVEAGGLLSVESVFLITLGIALLGLFGLWAYGQVQQFSKKTKKAPKVELGTGTTDANIDEWLEGTSFVQRSKSKKKQT

SEQ ID NO: 120219 - protein, 356 aa, Triticum aestivum
  unsure (1)..(356): unsure at all Xaa locations
  Clone ID: PAT_TA_14637.pep
MAISQAARLATMLMLLPLLLISCGVGSILCSSMTTVHDNSTDMISLLDFKRAITNDSRQALTSWHASVPLCSWEGVHCSSGRVTKLYLSQRGLLGRISPSLGNLTFLRTLDLSKNGFTGELPPLNRLHRLEYLDLGKNSLRGTIPDTLTNCSKLWSLDLSANLLMGEIPLGIGRLSNLRKVWLSSNNLTGTIPPSLRNNSQLEDIVLTDNRFMGTIPDEMGSFPSLVYLGLAGNMLSGGIPETLYKYNQSSLQYLYLYSNMLGXTLPSXLGDTFPDLKHLCLGXNNFEGHLPASLGNISGLRLLNFPSNNFXGQVPGSLGNPEQLEYLIPQRNNFGGFIPIELGGLKQLTHLDLSD

SEQ ID NO: 120220 - protein, 165 aa, Triticum aestivum
  Clone ID: PAT_TA_14638.pep
LFLQPVLLHVQLGQLSAKLPPLQHCLLVPNSARGRELVSEKEAALAAVPNDSPTIFDGTSQKEIPSTVVYEDEKVLAFRDINPQAPTHILIIPKVKDGLTGLSKAEERHIEILGYLLYVAKVVAKQEGLEDGYRVVINDGPSGCQSVYHIHVHLLGGRQMNWPPG

SEQ ID NO: 120221 - protein, 283 aa, Triticum aestivum
  unsure (1)..(283): unsure at all Xaa locations
  Clone ID: PAT_TA_14639.pep
TRRELVSLAKGIEASLDPMPRIITPTQMIANATGVPLENILYLGGPNIASEIYNKEYANARICGADKWRKPLSTFLRQPHFIVWDNSDLITHEVMGGLKNIYAIGAGMVAALTNESATSKAVYFSLCTSEMIYITHLLAEEPERLSGPLLADTYVTLLKGRNAWYGHKLAKAELTLEMGDSIKGKGTIQGVSAVNAFYELLSQGSISVTHPETKKHVAPVELCPILKTLYKILIKRELXPSSILEGDTPMNQCPDPRDRIEMAQRQSLYRPSLLGLPKGDIKL

SEQ ID NO: 120222 - protein, 174 aa, Triticum aestivum
  Clone ID: PAT_TA_14640.pep
AAANDKDEAKKSDKPKDGAGKQAEPAAVTTTERSLPSPPAPAPKRAYEQEYRQPYYAPQPVVSYHASHPSSSVSYTYFAPQAQPAYSMQQAHPQQAYYSTHQPQPSYSYSVQPQPQPEKQWSPSYLYMPYPHSAAPEPYYQQQDHYSPPGMHASPMHDSYRIFDDENPNSCSVM

SEQ ID NO: 120223 - protein, 145 aa, Triticum aestivum
  Clone ID: PAT_TA_14641.pep
FLPCCQLDISQAFKVEKEAFCSIMALPTPAPVLFNENLQINGGKRADGLRAKGLKPSENPGKQGRRALQNLSNISRGTGLKDTSTLKEKSKQKPRSNVTNTIKGTALKDKPILKEKSTQKQRSEALKNPLKILTDEEIKMCHEWA

SEQ ID NO: 120224 - protein, 72 aa, Triticum aestivum
  Clone ID: PAT_TA_14642.pep
KQHKRALVKLWYHATTWKPKRSCHTLDMKHLHMKHMYMKVLIIYEQAIEVELIFDSSRNMLMNNIEFAFSGT

SEQ ID NO: 120225 - protein, 111 aa, Triticum aestivum
  Clone ID: PAT_TA_14643.pep
GTRVSSAAAAAASVVSARRSHAVPQDVPDQEEAGQEDAPEPPHPLLDPHAHRQHHQVQRQAQALAPHQARLLSGRRDASQRCLGRIRALQARKLLFKILLVLLKGSYQLCL

SEQ ID NO: 120226 - protein, 115 aa, Triticum aestivum
  Clone ID: PAT_TA_14644.pep
RPPANVGTMRPGLVGYSGPLVSRRPMPNVSTHVSPPSHTASPLPRPPAAMTRSYSIPSNSQRTPIITVDKLLEARHSRESSEVSSPPVTPISLADVSRRSTTETVVDKKRIKESL

SEQ ID NO: 120227 - protein, 108 aa, Triticum aestivum
  unsure (1)..(108): unsure at all Xaa locations
  Clone ID: PAT_TA_14645.pep
MSFVQLSGAGVAAVAFTNKSLVSRHAALRVCSSRRSIRSLVVKAATVVTPKYTSLKPLGDRVLVKLXAAEEKTVGGILLPSTAQTKPQGGEVVAVGARRTSGDKKYLV

SEQ ID NO: 120228 - protein, 236 aa, Triticum aestivum
  Clone ID: PAT_TA_14646.pep
AQSAINDLNGKWLGNRQIRCNWATKGANAGEEKQIVDSKVDLTNGTSESGKENPNEDGPESNPQFTTVYVGNLPHEATNNDVHLFFHSLGAGSIEEVRVTRDKGFGFVRYSTHEEAAQAIQMANGQLIGGRQIKCSWGSKPTPPGTASSPLPPPAPAPFSTGVSPTDFLAYQRMALNKMATNPSLMGQHALNQVALGMGGRASQSIYDGGFQGISTAAATTSAQQQQQQQQQLMYY

SEQ ID NO: 120229 - protein, 140 aa, Triticum aestivum
  unsure (1)..(140): unsure at all Xaa locations
  Clone ID: PAT_TA_14647.pep
GAPPCLSWGVLWSFPETQSHLLVTTLGLSCSASPFIRASVFGWMGAPGFAPSSFVCLWSSALALLFPAPGSPHVGRFFLALPYMAPSEAYAPWWPRACNGSGGLVLPAGRPLLFXVPGSPHMYRYMLSQRKKALSKAKAA

SEQ ID NO: 120230 - protein, 144 aa, Triticum aestivum
  unsure (1)..(144): unsure at all Xaa locations
  Clone ID: PAT_TA_14648.pep
MADDDYNDVDMGYEDEPPPPEIEEGAEEEPENNEDAPDDVIGGEGEEKEQEKTKRERKTSKYMTKYERARILGTRALQISMNAPVMVELEGETDPLEXIAMKELRARKIPFTIXRRYLPDGSYEDWGVDELMVEDSWKRQVGGD

SEQ ID NO: 120231 - protein, 90 aa, Triticum aestivum
  Clone ID: PAT_TA_14649.pep
KPTAPFHLSSLTSPRHSGFTAPLTSAPERPVFAWQQQLVPRGGRSLEASSAASWPARPPPRGTETTGHKRVSVLPSDYGFLFTCYCYYCV

SEQ ID NO: 120232 - protein, 351 aa, Triticum aestivum
  Clone ID: PAT_TA_14650.pep
MAVASASPLPSAPSAKPATAPSPLAPSSGFLALRARRCGAPRLRPAAAAWRRLRVEAIRTQQEKQRTEVPVEESAPVRGAAAPLDGVGADDPMVASSDESWVVRLEQSFNIFATESMIMILDGVYRDRNYARFFVLETIARVPYFGFISVLHLYETFGWWRRADYIKVHFAQSWNEFHHLLIMEELGGNALWIDRFLARFMAFFYYFVTVAMYMLSPRMAYHFSECVERHAYSTYDKFLKLHEEELKRLPAPEAALNYYLNEDLYLFDEFQTAGVPCSRRPKIDNLYDVFVNVRDDEAEHCKTMKACQTHGNLRSPHSMLDCLEVDSECVIPEPEDDCEGFVDSVKKSLTK

SEQ ID NO: 120233 - protein, 281 aa, Triticum aestivum
  Clone ID: PAT_TA_14651.pep
VHSPDNTPGDLPLTVRPSKIPAAGLNIMPNNSHAKSAPRELFTVATKEDISPCSSSTVGCVEKIDQSEISEPNPPACLISSHTSSVPDAAAVPEDNGLTAIPRSEINTEKSQRSAVSNDSSLSSALGPSIPSFEQEFVCKDDVQSSKHGQNMATFQSGEDKFTVQELLSSMLPYDPSVSTPEDTMLDKGPNSVQSVNILTSMKGPAGPHLNPLVDDAMRQINFNVSNEQPISENVQGETQNMDVSKLLNVVREDLEVRSSSCSLNSLPSTPLPSVASEQHA

SEQ ID NO: 120234 - protein, 144 aa, Triticum aestivum
  Clone ID: PAT_TA_14652.pep
MAPKAAEKKPVATAEKTTAGKKPKAEKRAPATKEAGGEGKTRGRKKGSKAKKGVETYKIYIFKVLKQVHPDIGISSKAMSIMNSFINDIFEKLAGESAKLARYNKKPTITSREIQTSVRLVLPGELAKHAVSEGTKAVTKFTSS

SEQ ID NO: 120235 - protein, 93 aa, Triticum aestivum
  Clone ID: PAT_TA_14653.pep
VMLWGFWELFMSRDSAHLVNAEGDINEAGRRLLQLKKEWLTHAHGHADENGEFKFRGHHGAYHVDVVTPTGCKITQEFTVDKDDSPMVLNINV

SEQ ID NO: 120236 - protein, 137 aa, Triticum aestivum
  Clone ID: PAT_TA_14654.pep
MQAAATAVGFSAVLPVKARPAARSTAVARVPATRRSVRTAAAAVVVAEPAEVDYSSSFSVFPMEACDLLGGDACIGKMFPEAKLAAAAPEASRRVDAVERDYLSYDGPKTVFPGEACDDLGGEFCEAPYMDGVSRDA

SEQ ID NO: 120237 - protein, 89 aa, Triticum aestivum
  unsure (1)..(89): unsure at all Xaa locations
  Clone ID: PAT_TA_14655.pep
IRHEERWRGKTRFXPAGSKTYVREYSHSPPSTLLEGRGTQSGAHVDIMGNFALIEDIIRIAAGATGEEIGGDQVYSDIFKWSEKIKLKL

SEQ ID NO: 120238 - protein, 144 aa, Triticum aestivum
  unsure (1)..(144): unsure at all Xaa locations
  Clone ID: PAT_TA_14656.pep
MSKRGRGGSAGNKFRMSLGLPVAATVNCADNTGAKNLYIISVKGIKGRLNRLPSACVGDMVMATVKKGKPDLRKKVMPAVIVRQRKPWRRKDGVYMYFEDNAGVIVNPKGEMKGSXITGPIGKECADLWPRIAARQMRFQWKML

SEQ ID NO: 120239 - protein, 91 aa, Triticum aestivum
  unsure (1)..(91): unsure at all Xaa locations
  Clone ID: PAT_TA_14657.pep
MATARRAEWRTSGRSRCRRPRXDAGDAVVFVPDDGDDDDAAGQQRVEERVPPGEQXLATKSLGANLFDRPQPNSPTVYHWLYSDETWSSHR

SEQ ID NO: 120240 - protein, 113 aa, Triticum aestivum
  Clone ID: PAT_TA_14658.pep
RYIRTGLTSVHASKVVQIKNQNQSYTSVGFPWNLPPSSPAPPCLPWLLCFLALTKQKHAQQGHWNRSFMPMIRRRRRTVQWRTTQLADLCLGGLSLTHSPKQNYECGWILVPN

SEQ ID NO: 120241 - protein, 52 aa, Triticum aestivum
  Clone ID: PAT_TA_14659.pep
FLINVGRPVKSDIHRPPRPVSFVRLSPLLIPVFLNLPDFIWVPRQLKKKKKK

SEQ ID NO: 120242 - protein, 72 aa, Triticum aestivum
  Clone ID: PAT_TA_14660.pep
YFLTFPFEAYKALILVSYPSYILMHRPSRGNRSGHSIKSMVAQYSIASSPMQLSKCSWHQPDCLIYGNQYSR

SEQ ID NO: 120243 - protein, 112 aa, Triticum aestivum
  Clone ID: PAT_TA_14661.pep
APSTPSASPSCPRTSSSHAASAASARRRVRYHQRRPEGGGEEGGDQFGTVWLVDLRPAFSGSDDEELSSLKSVLASSVGLVSCVKIDLQVYFVPWLFCLGRFVLKPSCYKDY

SEQ ID NO: 120244 - protein, 283 aa, Triticum aestivum
  Clone ID: PAT_TA_14662.pep
FGRGGVNFAQAGCSITPAKPTSVSPFSFGLQIKQFFAFKDKVTKLLSKGDMYRKYIPQEDYFSEGLYMFDIGQNDLAGQFYSKTEDQVIASIPTILLEFENGLKKLYDQGARKFWIHNTGPLGCLPQNIALFGKDPSQLDELHCVAKHNRAAKLFNIQLHALCTKLRGEFAGASITYVDIHTIKYNLIANYSRYGFEHATQACCGYGGPPLNYDGNVPCGQTVSVNGKLVTAKGCSDTTEFVNWDGIHYTEAANFHIASQILTGKYSDPPFVDKMPFVLKPRF

SEQ ID NO: 120245 - protein, 86 aa, Triticum aestivum
  unsure (1)..(86): unsure at all Xaa locations
  Clone ID: PAT_TA_14663.pep
LSRDTDHLFLELPXLKEKLEKYIDEASATGSWSPNVLRTTTDAXLKEGLEPRCITRDLKWDVPVPHEKYKDKGMLSYTWSIYLLSS

SEQ ID NO: 120246 - protein, 131 aa, Triticum aestivum
  Clone ID: PAT_TA_14664.pep
FDLFLLSIVRMMRNRSLTREEVDAFWRRQQRKQPPSSSTSSEPNATTSPLASPRAAANVVSPLASPRAAGDISPFAASPGRAQQEMSSSRCTLALRRLERMNSMPSPLARTVMTRADDHPYQSYSHSEPPS

SEQ ID NO: 120247 - protein, 117 aa, Triticum aestivum
  Clone ID: PAT_TA_14665.pep
NEQQTGGTQLKQSNSRRPSASPEEEEEEEYVPVKSVVYRRPSSSSVLPATATATEAVSSYEPFELCQGCRCCSSSNASSCVDTSCCYAIDCDLPGKPFGTCAFTPHTCGCGTGTGNC

SEQ ID NO: 120248 - protein, 64 aa, Triticum aestivum
  Clone ID: PAT_TA_14666.pep
FFFFFFFFFFLLEISNNLAEPFQLSVFTNEVLKHLQSTCELLPTWLGPKESTVLVSYLTLSPNV

SEQ ID NO: 120249 - protein, 91 aa, Triticum aestivum
  Clone ID: PAT_TA_14667.pep
ARGLRLLLAFSARVGQLHAGFLYLLSRRSTQHVGIFCILYGDLQRSYSENPKVQSLIKLKQSFKSFRVPSIPHEAYVLILRLHVQNMLKQP

SEQ ID NO: 120250 - protein, 305 aa, Triticum aestivum
  unsure (1)..(305): unsure at all Xaa locations
  Clone ID: PAT_TA_14668.pep
VYLDYPFFEHQIHWFSIFNSFMMVIFLTGLVSMILMRTLRNDYAKYARDDDDLESLERDVNEESGWKLVHGDVFRPPRSLTLLSALVGIGTQLAALILLVIVLAIVGMLYVGRGAIITTFIVCYALTSFISGYVSAGLYSRNGGKNWIKAMILTARLFPFLHFAIGFALNTIAIFYGSLAAIPFGTMVVIFVLWAFISFPLVLLGTVVGRNWSGAPNNPCRVKTIPRPIPERKWYLTPSVISLMGGLLPFGSIFIEMYFVFTSFWNYKVYYVYRFNXLVFVILLIVTICVTIVGTLFLLNAENYH

SEQ ID NO: 120251 - protein, 595 aa, Triticum aestivum
  unsure (1)..(595): unsure at all Xaa locations
  Clone ID: PAT_TA_14669.pep
MLPSSRGGGRRRFVLLLSLTAVLAFASPLRAFASESDHKYKAGDSVKLWVNKVGPYNNPQETYNYHSLPFCQPSENPGHKWGGLGEVLGGNELIDSQLDIKFLRNVERGSICTLELDPKKTQQFADAIESSYWFEFFIDDLPLWGFVGETDKNSENKHYLYTHKNILVKYNDNRIIHVNLTQESPKLLDAGKKLDMTYSVKWVPTDVSFARRFEVYLDYPFFEHQIHWFSIFNSFMMVIFLTGLVSMILMRTLRNDYAKYARDDDDLESLERDVNEESGWKLVHGDVFRPPRSLTLLSALVGIGTQLAALILLVIVLAIVGMLYVGWGPSRTPTSHLLPCWPCMQNTWLEIHDKLKKWHGRPYXIIRKKMNEGQXSSRCAGPPFTVPVLYGSVAASPGASLVLFFALWAFTAFPLVLLGTVVGRNWSGAPNNPCRVKTIPRPIPERKWYLTPSVISLMGGLLPFGSIFIEMYFVFTSFWNYKVYYVYGFMLLVFVILLIVTICVTIVGTYFLLNAENYHWQWTSFFSAASTALYVYLYSIYYYHVKTKMSGFFQTSFYFGYTLMFCLGLGILCGAIGYVGSTLFVRRIYRNIKCD

SEQ ID NO: 120252 - protein, 92 aa, Triticum aestivum
  Clone ID: PAT_TA_14670.pep
NFNYINNKVYFSSNLSFKSSIKRLIIRRPRRGPRTGGAWRRRGRRAAAATRTTRTTTSRRPRTRRRTPRRSPDAARGSRAPLHRLMMEQLQY

SEQ ID NO: 120253 - protein, 101 aa, Triticum aestivum
  Clone ID: PAT_TA_14671.pep
IVPFSCVNNISKCTRWPSCSLVSLPEASWKAHQDLSDEQLFVNYASVPRVPEQKPLCIDSPISGTWSCKRSYLIAAIGKATSVEFADFHLLLDCSLTMVYK

SEQ ID NO: 120254 - protein, 171 aa, Triticum aestivum
  unsure (1)..(171): unsure at all Xaa locations
  Clone ID: PAT_TA_14672.pep
MDQLVNFIIRPPRADYSPDDDLLEQEFMLKGRWFQRKDLEVVYGXGLPCCGGSRFTPAAVPDGPAPLVLLSVARYTGGRALPCGPPGRLLPSNXTVFTLDFSGXGLSEGEHVTXGWNEKKDLKAXVVNYLRTDGNIFCIAXGGPLMGGGTSXMXGXXDPSMWKGSWKFLPC

SEQ ID NO: 120255 - protein, 76 aa, Triticum aestivum
  Clone ID: PAT_TA_14673.pep
MSCSCGSSCNCGSSCKCGKKYPDLEEKSTAAQATVVLGVAPEKTAAAEFEAAAESGAETSHGCSCGDSCKCNPCNC

SEQ ID NO: 120256 - protein, 207 aa, Triticum aestivum
  Clone ID: PAT_TA_14674.pep
RHEAGLEKIQPALMDGKPARSVDLADHEKEAIQHLCLLTMKPVIYVANVTESDLAEPGSNPHVKEVAKPASDLQSGMVTISAQVEAELAELPLEERVEYLKSLGVAESGLGNLVKATYDLLGLRTYFTTGDKETKAWTILAGMTAPQAAGVIHSDFQKGFIRAETVSYDDLGAAPSRGVARALGWWGLGGRGVILQARGVMLFRFNV

SEQ ID NO: 120257 - protein, 79 aa, Triticum aestivum
  Clone ID: PAT_TA_14675.pep
SGLFDHLINVWEFKPGPVPGTCDLYFLVDFKFQSPLYRQVASMFFKEVVSRLVSSLNDRCFRIYGPAVPVLENTYGQGR

SEQ ID NO: 120258 - protein, 76 aa, Triticum aestivum
  Clone ID: PAT_TA_14676.pep
RQPFEANTADKAKLQVHLFQDNDPLGGSFCGGREPQRFVSEQKTSEMQASCRITVGPKWMMYYSYCSSQASGSVAQ

SEQ ID NO: 120259 - protein, 111 aa, Triticum aestivum
  Clone ID: PAT_TA_14677.pep
MSAVITKFAVTSMVMWMAPVAIMYGFIYQIFPGVGQLSPSAQTMASGFLAVISVNLVIGFYIYMAMKETPHQEPQPDPTFLANAKASINQPTSSQVSDDSHGKGEVEEALA

SEQ ID NO: 120260 - protein, 177 aa, Triticum aestivum
  Clone ID: PAT_TA_14678.pep
MATKKVLCKFFMHGACLKGEYCEFSHDWSDQANNVCTFYQKGACSYGSRCRYDHVKVSRNPTVPPPPSTSSAARRVTSNSLQLLSYSHAPHTGHQTDSSNQRHQISVDVLAHSASKPAWRNDFQHDIVSDDGIDWSSNRNLLNETSLKPADLPICSFAAAGNCPYGEGCPQMHGDLC

SEQ ID NO: 120261 - protein, 239 aa, Triticum aestivum
  Clone ID: PAT_TA_14679.pep
MLARHSSSPAGFFSNLMVDDGYPGSRGAGVAGGSSGGEAHRHASSSTKMKSQLSFTAGGQQTTAHLSRISEGASLFPSADAVRAAAHSGSEHPVSRSFSASGSSGGFSIVGPWDESREIIGTLDLGGYESQFSGMASSSSLELAGMDKYMQAQQQQDQVAFKVRAKRGCATHPRSIAERERRTRISDKLRKLQDLVPNMDKQTSTSDMLDLAVEHIKGLQSQLQAMKHEQDKCTCCNKP

SEQ ID NO: 120262 - protein, 141 aa, Triticum aestivum
  Clone ID: PAT_TA_14680.pep
YYRGAVGVLLVYDITKRQSFDHVARWLEDRPGHADKHIVIMLIGNKSDLGTLRSVATEDAKEFAERENLFFMETSALEAVNVENAFMTVLTEIYRVVSKKNLVANEESDSSGNSSLLKGTKIVVPGQEPPPTSKATCCMSS

SEQ ID NO: 120263 - protein, 130 aa, Triticum aestivum
  Clone ID: PAT_TA_14681.pep
FGTRLVYIHFGIHLISRDASPLQCVGPQKCLAFSTDGAKFAVGGEDGRLRIFHWPSLNVILDEPKAHKSLLLDSKFLVSSSIDGSARIWNIDEGAPLINLTRSLDEKIEYCRFSRDGAKPFLFCTLVKGH

SEQ ID NO: 120264 - protein, 193 aa, Triticum aestivum
  Clone ID: PAT_TA_14682.pep
MGPVPGPARPKPIVLPCQTGSGKESPNNFRAVPCQPEVSKQLAQPGPKPRRALPWAVPAQAQAVVLIPGAAYGCGSSRASPAKGPMLLGVTSVIPMSLVRLHRSHLVGMGIIPLCFKAGEDADSLGLTGRERYTIHLPTSIAEISPGQDVTVTTHDGRSFICTLRLDTQLEVTYFNHGGILPYMVRNLAAQMK

SEQ ID NO: 120265 - protein, 131 aa, Triticum aestivum
  Clone ID: PAT_TA_14683.pep
LESSRRDVERDRDVTSVGAEAVTGQVTEVNKDTFWPIVEAAGDKVVVLDMYTEWCGPCKVMAPKFQEMSEKNLDVVFLKLDCNQDNKPLAKELGIKVVPTFKILKGGKVVKEVTGAKIEELAHAIDTLKSG

SEQ ID NO: 120266 - protein, 142 aa, Triticum aestivum
  unsure (1)..(142): unsure at all Xaa locations
  Clone ID: PAT_TA_14684.pep
FVGEEXNDLLDYLRSLTPEKVAELSESTCPGVQEAIHSVVHGLLATLSPRLHAKAPPLLDNTSGGVLNLGGEDDDRAELVENASLPFQPLISVPRDYLARLLFWCMLLGHYIRGLEYRLELTQLLRISSDVGSFSGGDDHVV

SEQ ID NO: 120267 - protein, 62 aa, Triticum aestivum
  Clone ID: PAT_TA_14685.pep
RVAPSVYEKLGKIGGDSALNDYLSTHPSSKKRAQLLSRASVMNEALELYREVSAGQGTEGFL

SEQ ID NO: 120268 - protein, 191 aa, Triticum aestivum
  Clone ID: PAT_TA_14686.pep
AGLLHLVVNMLSLLFIGIRLEQQFGFVRIGAIYLLSGFGGSVLSALFLRNNYISVGASGALFGLLGSMLSELLMNWTIYSNKAAAIITLLFIVALNLAIGILPHADNFAHIGGFATGFLLGFVLLARPQFSWMERHELPQTNQPPKYKAYQYILWVVALVLLLVGFVVSLVMLFKGKNGNDGCHWCHYLNC

SEQ ID NO: 120269 - protein, 229 aa, Triticum aestivum
  unsure (1)..(229): unsure at all Xaa locations
  Clone ID: PAT_TA_14687.pep
ACPPPPPPPPAWTRSPPPGPPPPPPPPPPPTINPPPRREAATAGSSGGGGNNGGGRWGGEKRNEQRRGGGGGAPPLAAFANANSRNSGLYPGTQLKKQEDLYKYAKEISKYKEAEAHQNQSNYPPQFPTLGKGGADTTDVPKPHDKEEKRTXQSLNVEYEKKRVEDEKAEKERDAMIQAKKEERERSEAKRKELREKMFKRTRSGQPVMKYRIEHLLDTALESSDQSQG

SEQ ID NO: 120270 - protein, 247 aa, Triticum aestivum
  Clone ID: PAT_TA_14688.pep
MSTAVARPFGGFPGSGRAKGDELLGKKMSDGFFIEEEEEEEAEEVLTESSSIGAPSPSSSSIGEDSSSEVGGEGEDEEVESKLKEEPGLGCLDALEDSLPIKNGLSSFYAGKSKSFTSLAEAAARDAVKELAKPENPFNKRRRILATWSRRASCSSLATATYLPPLLAPDHALPEGDEGEEDDDSDSGSDEQHRGKNGWEAPALPPPRLSVNTQTGASAARRGGSFRSPRSYSLSDLRNGGDASYNQ

SEQ ID NO: 120271 - protein, 113 aa, Triticum aestivum
  Clone ID: PAT_TA_14689.pep
FGRGGAIDDSTMIVTTVHDKQLVDDIPVEKLLVHDVPVDVICTPTQVIFTKTTIPKPQGIYWEKLSPEKLGQIRILRELKQRIEQETGTILPCGPSEKLPPTAQRRQRWRRRR

SEQ ID NO: 120272 - protein, 154 aa, Triticum aestivum
  unsure (1)..(154): unsure at all Xaa locations
  Clone ID: PAT_TA_14690.pep
SSXYXPSKYDLDPDNCWPSSAVAWGGIVPCNAGLMSAESHVVSEMPQQHDGKSSKPPRAKRARVSTGKCSSNLKRTEKNGGSICQSPTVTMMPDPNNSSKVIMDKKLVDSEMVDSVNGSCCFVGEAVPEEEARQRWPHRYEKNHHFVEKDKKSD

SEQ ID NO: 120273 - protein, 75 aa, Triticum aestivum
  Clone ID: PAT_TA_14691.pep
CACRMVTMELQIGGGEGGLRSCSVGWQPRSPNLEDERMLDSAILIEEDKCMSNRGKLSMLDWIISVSVAPNSGTV

SEQ ID NO: 120274 - protein, 185 aa, Triticum aestivum
  unsure (1)..(185): unsure at all Xaa locations
  Clone ID: PAT_TA_14692.pep
MAVHHLLRRGISGGSPFHPLRGLLLVSQELGRRQASSAAAGDAVAELRGAREDVKQLLKEKSCHPILVRLGWHDAGTYDKNISEWPKCGGANGSLRFEIELKHAANAGLVNALKLIQAIKEKYACVTYADLFQLASATAXEEAGGPKIPMIYGRGLDVFLPPEQCPPEGETSLLVVPASPAEHLR

SEQ ID NO: 120275 - protein, 116 aa, Triticum aestivum
  unsure (1)..(116): unsure at all Xaa locations
  Clone ID: PAT_TA_14693.pep
XAHTLGRSRPERSGWGKPETKYTKNGPGAPGGQSWTSQWLKFDNSYFKDVKERRDEDLLVLPTDAVLFEDSSFKIYAEKYAEDQDTFFEDYAEAHAKLSNLGSKFDPPKGVFLHYH

SEQ ID NO: 120276 - protein, 418 aa, Triticum aestivum
  unsure (1)..(418): unsure at all Xaa locations
  Clone ID: PAT_TA_14694.pep
MVESPAAAVQELRARFAAGQTRPAEWRAAQLRGVLRMATEMEAEICDALHADLGKPKTEAHVHELSLIKSSCLFALKNLKKWMKPQKVPAKLMNFPSTARITPEPLGLVLVISAWNYPLLLSLDPVIGAIAAGNAVALKPSEGAPAMSSLLAELLPRFVDGTCIKVIEGGVKETTALLNQKWDKIFYTGNSRVGRVVMAAAAKHLTPAVLELGGKCPVVVDSNVDLHIAAKRIAAGKWGCNNGQACIAPDFIITTQAFAPKLLESLKNVLEKFYGKDPLLSADLSRVVNASHFGRLKGLMDEEMVSDKIVFGGQRDEQQLKIAPTIFLDVPLDSAIMKDEIFGPLLPILTVDKIHESFGLINSMAKPLAAYLFTRDSELQNQFEGAISAGGMLFNDTSIHLTXHXLRFGGVGESSTFA

SEQ ID NO: 120277 - protein, 87 aa, Triticum aestivum
  Clone ID: PAT_TA_14695.pep
REKCDRRTGKTTEANPKAIKSGDAAIINLVPSKPLCVEAFSEFPPLGRFAVRDMRQTVAVGVIKSVNFKDPSAGKVTKAAEKAQKKK

SEQ ID NO: 120278 - protein, 176 aa, Triticum aestivum
  unsure (1)..(176): unsure at all Xaa locations
  Clone ID: PAT_TA_14696.pep
RHEALFYNPAATKMAPNDVFGVAFSGGFNQPIMCGGEPRQMTLQVRGKADPPIYTIRIRVPQHAVSLIFSFTNGAEWDGPYTLKFRVPKPWQNKPLSFFNEGLADELNREGACDRAIYPDENIAITSCAMXATSQEGGDRCKLDIVSGCMDPGSDMFDPLATVDDGSCPLESDSEE

SEQ ID NO: 120279 - protein, 281 aa, Triticum aestivum
  unsure (1)..(281): unsure at all Xaa locations
  Clone ID: PAT_TA_14697.pep
VLSSSYPWIARKVLTDNSPNLRSTLYTLLYKDGTFQIDRLESLLTESLRATTGQPWVRTQQDDGDSSRFAIKQVLSFTLADQGAFVKDLLLQEIAKGLDAXGVATLSSATSAAASRLPFAGVPSPSPSLDDEEATNLRNLYRLLLLVAKAPQKGTPPPCPACNPAVEGDGGATVGLSLARYEGSSLPGWLPRLPGFPELPPGSPPRLRLLPPVFSARVVPRAVACAVRRLAGFSLTSARFPSLPPHFALAILSAPPLEEADHFGLPPLRMVASNLEPKINL

SEQ ID NO: 120280 - protein, 90 aa, Triticum aestivum
  Clone ID: PAT_TA_14698.pep
PKLVGWSPVQTSEKHLVGTLTLGPNDGRNRGTENFRKISGDLPNSDAEKLEDPGSLAAQIGYFACVLCSGSTYQSTLHVDIIILGCFTSG

SEQ ID NO: 120281 - protein, 351 aa, Triticum aestivum
  unsure (1)..(351): unsure at all Xaa locations
  Clone ID: PAT_TA_14699.pep
CRFGTSSHPLADVVSSDYAHMHEEEDELRAHGSGSDTDLDDESPSCHQVFLIPRLGPTGSLLPGRERREDPGNFEAPGDSLPIAGSPMLSSSGHPLHPIRRWWGPRAAVQCSPRVRVFALAIAAGLSRPRGPPLLHPAVVPXHAVHELDIGHAFKERYTRQQRSWSRLNVSELAGPILTERKPDARCICWKMLVLVPPGAMKSQEQQCCLKDGYSKKLMGSGKLKDNGLLPTSXADLLQFWRTWLSSPEXCCLPVGQGQXTNXLLXNEXAGXTNCIYLGXPEXFPGEMXXXHLHVTSILLNCLLLPILMAIYEKIKPPKCHNWVNDEENAHLVQPELKLTKVTNSKVNFPT

SEQ ID NO: 120282 - protein, 91 aa, Triticum aestivum
  Clone ID: PAT_TA_14700.pep
MAIRGVPSQREMTVAEFKEWLKQFDADGDGRISRAELREAIRSRGGWFTTLRAGRAVRRADRDKSGFVDDAEVENLVAFAQKDLGMRISAW

SEQ ID NO: 120283 - protein, 175 aa, Triticum aestivum
  Clone ID: PAT_TA_14701.pep
MAPTVMASSATSVAPFQGLKSTAGLPVSRRSTSAGLGSVSNGGRISCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 120284 - protein, 139 aa, Triticum aestivum
  Clone ID: PAT_TA_14702.pep
KYKVDLVFAGHVHAYERSYRISNVNYNITSGNRYPVPNKSAPVYITVGDGGNQEGLASRFYDPQPDYSAFREASYGHSLLQLKNRTHAVYQWNRNHDGNPVPADTVVFHNQYWTSSTRRRRLKKNHFHLENLEDLISLF

SEQ ID NO: 120285 - protein, 63 aa, Triticum aestivum
  Clone ID: PAT_TA_14703.pep
NHQSSNEKPSADFILFRVPFVDAPPLPFFFFLTDTAIVGVTEINSNSGNYFAPEYMYACLKTC

SEQ ID NO: 120286 - protein, 142 aa, Triticum aestivum
  Clone ID: PAT_TA_14704.pep
ARGRFCTPESCPTMTAGPKYEYRWADGVQIKKPIEVSAPKYVEYLMDWIEGQLDDESIFPQKLGTPFPQNFKEVVKTIFKRLFRVYAHIYHSHFQKIVSLKEEAHLNTCFKHFILFTNEFGLIDKKELAPLQELIESIIVPY

SEQ ID NO: 120287 - protein, 229 aa, Triticum aestivum
  Clone ID: PAT_TA_14705.pep
VALFGVFDGHGGKNAAEFAAENMPKFMAEEFKKVNGGEIEGAVKRGYLKTDEEFLKRDESGGACCVTAVLQKGGLVVSNAGDCRAVLSRAGKAEALTSDHRASREDEKERIENLGGFVVNYRGTWRVQGSLAVSRGIGDGHLKQWVVADPDTRTVLVDQQCEFLILASDGLWDKIDNQEAVDLARPLCINNDKTSRMAACRMLTETSISRGSTDDISVVIVQLQNFSSS

SEQ ID NO: 120288 - protein, 66 aa, Triticum aestivum
  Clone ID: PAT_TA_14706.pep
LGCKAHCRQLSWAVRVSWMLGMVLLLVPHRTLYLWSKYACTLLCGRLELAIYCVRLELDALCKHQT

SEQ ID NO: 120289 - protein, 148 aa, Triticum aestivum
  Clone ID: PAT_TA_14707.pep
GCCRDKEIAAKTVKTIKFLGLHEETQIPKGCSSAFDVICQRKEQRMAYGHNEQDMVLLHHEVEVEYPDGQPTEKHQATLLEFGKVENGRSTTAMALTVGIPAAVGALLLLQNKVQTKGVIRPLQPEIYIPALEILESSGIKLIESVEI

SEQ ID NO: 120290 - protein, 89 aa, Triticum aestivum
  Clone ID: PAT_TA_14708.pep
MEGKSRLPEVTIVPAARPLAGDGTIDAAKAAAAPGKEPISPGTPSSADAGRRGKERRAVEAVPLPGWKLDALCQESCPSPTMRARFPYF

SEQ ID NO: 120291 - protein, 180 aa, Triticum aestivum
  Clone ID: PAT_TA_14709.pep
LQVAITGAEQSGAQNAWDMLSDEQSQKHITTGAGDLNDILGGGIHCKEVTEIGGVPGVGKTQLGIQLAINVQIPVEYGGLGGKAVYIDTEGSFMVERVYQIAEGCIRDILEHFPHSHEKSSSGKKQLQPEHFLADIYYFRICSYTEQIAVINYLEKFLGEHKDVRIVIIDSVTFHFRQDF

SEQ ID NO: 120292 - protein, 117 aa, Triticum aestivum
  Clone ID: PAT_TA_14710.pep
KQFKLVHYNLRRTYHHLLPRITKLKFGGCSYQLFLDDSERNITAGKALGLRTALVGKRVRSKDADYALENIGALRRVIPEIWGVVAGGESERSDHSIDKMPMRSDLDSIIQPTSIQA

SEQ ID NO: 120293 - protein, 221 aa, Triticum aestivum
  unsure (1)..(221): unsure at all Xaa locations
  Clone ID: PAT_TA_14711.pep
WIPRAAGIRPPAAVADALAPLTDVTHVFYVAWDPRPTHAEGREANGAMLRNVLSALVPNCPGLLHVCLQTGRKHYVDPFEPLTDVPLALRPYSEDLPRLDYPDLEDVLLDGLASNNRVTWSVHRPTTIFGFSPRSARNVVASLCVYAAICGKEGLVLRWPGSRVAWEGFSDASDAELVAEHALWAAMXSPMGRNEPFNCSNGDXFKWQQLWPDPRQPIGQI

SEQ ID NO: 120294 - protein, 215 aa, Triticum aestivum
  Clone ID: PAT_TA_14712.pep
MAPMKLYGATVSWNVTRCVVALEEAGAEYQIVPIDFATAEHKSPEHLARNPFGQVPAFQDGDLHLWESRAICKYVARKNKAAELLREGNLQESAMVDVWLEVESNQYTAALNPILYECLVSPMFGGTTDQKVVEENLEKLKKVLEVYEARLAKHKYLAGDFLSLADLNHVSVTLCLLATPHASVLNAYPHVKAWWDGLMARPSVQKVAALMKPSA

SEQ ID NO: 120295 - protein, 242 aa, Triticum aestivum
  unsure (1)..(242): unsure at all Xaa locations
  Clone ID: PAT_TA_14713.pep
GRVGYISTGDDLIAIKSGWDEYGIAYGRPSSDITIRRITGSSPFAGFSVGSETSGGVENVLAEHLNFYSSGFGVHIKTNSGRGGFIRNITVSDVVLDNVRYGLRIAGDVGGHPDERYNHNALPIVDSLTIKNVLGQSVREAGQCRGIPNSAFSRICLSNAPHRGSAPVKEWSRAEVQGGGADQGHPKLGILPDPSVXIKLHGSAPVRPWKCAAVSGGALDVQPSPCTELTSTSGMSFCTNSL

SEQ ID NO: 120296 - protein, 96 aa, Triticum aestivum
  Clone ID: PAT_TA_14714.pep
MAHYQEVDYCSEEVRSVTPTGGFLGRGGVQQHVVKETFQEIDRSGSGRHHHDHNHNHNHNHGNDYLTVRETKVEEDFNTCTGEFRERKQSFLLKSD

SEQ ID NO: 120297 - protein, 96 aa, Triticum aestivum
  Clone ID: PAT_TA_14715.pep
YVIKRPLAIKEGKTKQHFKAPKIQRLITPVRLQRKRHNLALKKKRCLKRKEQATEYAKLLAHRQKEKLAKKRAEQSRKRTMSQSSVSSSGTKSSKK

SEQ ID NO: 120298 - protein, 233 aa, Triticum aestivum
  Clone ID: PAT_TA_14716.pep
MSEADVRVIGLWPSPFVIRVLIALKLKGVEYELVEEVVGKKSELLLRSNPVHKKIPVLLHHGKPISESLIIVQYIDEVWSSDTPAFLLPADPYTRAVHRFWAQYVDDKLPPAIRILRGTDGGGMDQAAGQLSAALQLLEEAFAQLSQGKRYFGGDSVGYLDIALVSHVGWVKAVEKIAGVTLLDKAKVPNLVAWADRLCAHPAVVDAIPDADKFVEFSVTYGSFSKPINAPAK

SEQ ID NO: 120299 - protein, 111 aa, Triticum aestivum
  Clone ID: PAT_TA_14717.pep
TYNICKGPIRKHETSWQNSTTNSMKLVHTVLNFQCICKYMLTLRGSHLPEVPQRQLPVVVVSAGMLPKVTCCSTFVGVPRRKGLAWFKSKLEKRLETVLCSSLCTAASQQG

SEQ ID NO: 120300 - protein, 154 aa, Triticum aestivum
  Clone ID: PAT_TA_14718.pep
VAWSVGRGSGRRLQVRPSRCCSCCISSLLTHGACDVMCCRCGWQRGRSTTPWRRTPSAPSSTTTTGPSSGSSSPSPRPSPSSTSSPTRTTPDPRPSSPRPPRLAAARLDERTIMAGRVSRPTGRRLSPPRRGVPAGLVFIIRIYPPVLDVMGYV

SEQ ID NO: 120301 - protein, 71 aa, Triticum aestivum
  Clone ID: PAT_TA_14719.pep
ENITHYVVFLVQHQPFSTSYFNECSQLKKMSKIVYLYVKTSLSFLLPTNCNNDQNYVSQLSTTFIHHTVYM

SEQ ID NO: 120302 - protein, 78 aa, Triticum aestivum
  Clone ID: PAT_TA_14720.pep
GTRQVLLDAARKVGIEGAEELLEDPSKGVDEVQEELKKYSSGISGVPHFVINNKYQLSGGQPPNVFMRAFEMAAKDGA

SEQ ID NO: 120303 - protein, 184 aa, Triticum aestivum
  unsure (1)..(184): unsure at all Xaa locations
  Clone ID: PAT_TA_14721.pep
EIKAHPWFQEHYVPVLPPYDDDDDHDSVKQIGAGSKTTHHINAFQLIGMASSLDLSGFFEEEDVSQRKIRFTSAQPPEDLFAEIERSATDMGLPCSQEGIVSXKLNAKLRPVEXIKKNPMSSSSSSFLVCTEVFELSPSLXVVELNKSHGDPALYRQLCQRFCGDLVCSWGSCLVQAALSEDLQ

SEQ ID NO: 120304 - protein, 114 aa, Triticum aestivum
  Clone ID: PAT_TA_14722.pep
HEIQYGGDNASASPRSQYPSQSTAPTVHIPNTSSQQPSPSLFAPGNPGLTQSKNSMVFSNALSSPIRRSLQPYHLEQGGDAGYFANGASRDVNPTASNDSSMDMHSDSPAHDSY

SEQ ID NO: 120305 - protein, 229 aa, Triticum aestivum
  unsure (1)..(229): unsure at all Xaa locations
  Clone ID: PAT_TA_14723.pep
ARGKEYSKGTCIGKLRSNXLGTKFTVYDAHPPCTGAVVSKGPSAHMIGSAQVSPGVPAGNYPISHISYEATFGSRYPRKMNCVMDSIPLSAIKEGGTAPTQTEFPSINSNSFASVPFFRKSGRLDSSGVQLATQNEAKMVLKNKSPNWHEPLQCWCLNFHGRVTVASVKNFQLVASGESDLNNQGDDDVILQFGKVGKDLFTMDYRYPISAFQAFAICLSSFDTKITRE

SEQ ID NO: 120306 - protein, 84 aa, Triticum aestivum
  Clone ID: PAT_TA_14724.pep
FLYWFLSYGEENDFLVTHRINGHQEHLHISIHLMLQKSVSSARTTEQMLRTQRPWHARKGGRERRKYYMNSSSGLPCQLTPSCR

SEQ ID NO: 120307 - protein, 72 aa, Triticum aestivum
  Clone ID: PAT_TA_14725.pep
SNQFPSSRFAKGYKENVCKDVSKCIMMHWTAEAFILWRCLPVNKSSSAYAESVRSHSIYTWLHRSLRRALVP

SEQ ID NO: 120308 - protein, 144 aa, Triticum aestivum
  Clone ID: PAT_TA_14726.pep
CRNSARAKLAFCNQEKKQRNEESLSGASHWRSIKQHVLTQASSKPFSRKHSLDASSSDSRETSSSMPAESGAMSANNPRAGEAVEYGRQPPVPSSTLVELTTRLDFFKERRSQLMEQLHSLDLGHGSAPHGFQYKSSSPWNSPR

SEQ ID NO: 120309 - protein, 85 aa, Triticum aestivum
  Clone ID: PAT_TA_14727.pep
GCKVAIMLSIRYILRSMSCQLSRISSAATKLKIMKLEIHPVCILESVYFFSRQSLNPFSSSSLLRFLPMKTILLMRGSFGSHISP

SEQ ID NO: 120310 - protein, 118 aa, Triticum aestivum
  Clone ID: PAT_TA_14728.pep
STLATEVTSKLAALKGPARGLREIRSYLDLVIDGKLPLNHEILYHLQDVFNLLPNLNVNELIKAFAVKTNDMMLVIYLSSLIRSVIALHNLINNKMLNKEHEKAEDSKPTAIPTAAGS

SEQ ID NO: 120311 - protein, 152 aa, Triticum aestivum
  Clone ID: PAT_TA_14729.pep
MSLIAGEDFQHILRLLNTNVDGKQKIMFARSARGGVGRRFSNIVCKKADIDMNKRAGELSSDELERLMTVVANPRQFKVPDWFLNRKKDYKDGRFSQVVSNALDMKLRDDLERLKKIRNHRGLRHYWGLRVRGQHTKTTGRRGKTVGVSKKR

SEQ ID NO: 120312 - protein, 306 aa, Triticum aestivum
  Clone ID: PAT_TA_14730.pep
VALGTPNVTFLVALDTGSDLFWVPCDCINCAPLVSPNYRDLKFDTYSPQKSSTSRKVPCSSNLCDLQSACRSPRGGCPYSIEYLSDNTSSTGVLVEDVLYLITEYGQPKIVTAPITFGCGRIQTGSFLGSAAPNGLLGLGMDSISVPSLLASEGVAANSFSMCFGDDGRGRINFGDTGSSDQQETPLNIYKQNPYYNISITGAMVGSKSFNTNFNAIVDSGTSFTALSDPMYSEITSSFNSQVQDKPTQLDSSLPFEFCYSISPKGSVNPPNISLMAKGGSIFPVNDPIITITDDASNPMAYCLAV

SEQ ID NO: 120313 - protein, 64 aa, Triticum aestivum
  Clone ID: PAT_TA_14731.pep
NIYFLFCLISFCPNLLTVWVKMNPNLFIRLAFDLYLILLRLEVVYFLGMMERKDLVLLLWFMHS

SEQ ID NO: 120314 - protein, 265 aa, Triticum aestivum
  Clone ID: PAT_TA_14732.pep
GAKQFHSLRRTLLQSNHCGKTGKGTEEANSLPRLNGSAQDALQLLKSLQFRLDLLAQQLPTFDEVQSGQATLKSWDEQYKKLRVSLRNANLQAKDNIRQAAQEERALLLGGGEESTIRRRNLQTKAGMTSAAESITESLRRSRQMMVQEVERNASTLATFDESTSVLRKAEGEYQGHRSLLMRTRGLLSTMQRQDVLDRIILTIGFIIFSSAGLYVVSRRIGLLTLQRKLANAITSGSLSAADIVAKAQHVPAPANVPAPIYNEL

SEQ ID NO: 120315 - protein, 171 aa, Triticum aestivum
  unsure (1)..(171): unsure at all Xaa locations
  Clone ID: PAT_TA_14733.pep
VVYLIHEDRVEEVEDVXQKYNDFISVRKGRIWRVNNWGLRRLAYKIKKATHANYILMNFEIQAQSINEFKTLLDKDERIIRHLVMKRDEAITEDCPPPPEFHAMRSQQLDGEYIDEEYGRVDDLDDEAELESSGNVDDDVEDGDEPEIILVDEVDDDNAEDLRRRNRKVKL

SEQ ID NO: 120316 - protein, 236 aa, Triticum aestivum
  Clone ID: PAT_TA_14734.pep
MSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDTLAEESYTEGTPFVQPRGVYWTLPSSAE

SEQ ID NO: 120317 - protein, 261 aa, Triticum aestivum
  unsure (1)..(261): unsure at all Xaa locations
  Clone ID: PAT_TA_14735.pep
MASSRIPLLCLLGLLLVASPAIADDSSGIYYQLALLWPGAYCEQTNAGCCKPTTGVSPARDFYITGLTVYNATTNAALTECSNQAPYNPNLITGIGLEQYWINIKCPANNGQRSWKNAWKKAGACSGLDEKAYFEKALSFRSKINPLVRLKQNGIEDDFELYGLKAIKKVFKSGINAEPVIQCSKGPFDKYMLYQLYFCANGNGTFIDCPAPAKYTCSNSVLFHPYKKWMLKQQLNDESADFYDSADPFVLPGLAXWTTDL

SEQ ID NO: 120318 - protein, 128 aa, Triticum aestivum
  Clone ID: PAT_TA_14736.pep
MPNFQLFAGDNEDALVGPDDGNGRLGSRIIHRVVEDAERADGEVTVTRHEEAMVSGTEFGNNATPAHQSEILQIAVWTHGYVVEEVGSDFPVPEYDTYDEADVEGNHNISVQHDIIEAPLNDKLRCLQ

SEQ ID NO: 120319 - protein, 326 aa, Triticum aestivum
  unsure (1)..(326): unsure at all Xaa locations
  Clone ID: PAT_TA_14737.pep
MLRRVAPPLRRALASSAVPHRGGARLPDPGLSSPHALPPQWRRWASAAAASSLPPPPPSPPQGPPRHAGGGSAPPALNPAAVAKFAAIAETWWDSQGPFKPLHLMNPTRLSFIRSTLCRHFRRDPXQAKPLRGLKVIDVGCGGGILSEPLVRMGATVTGIDAVDKNIKIAHIHAASDPTTASIEYCCTTAEDLVKENKQFDAVISLEVIEHVANPLEFCQSLSALTVPNGATVISTINRSMRAYAAAIVGAEYILRWLPIGTHEWSKLVTPEELVLALQRASISVEEXAGFFYNPLTRGWSLSDDTSINYIAYGIKKSEAPSATPQ

SEQ ID NO: 120320 - protein, 209 aa, Triticum aestivum
  Clone ID: PAT_TA_14738.pep
MAVTAEAAAEMGLERRAYARVGLLGNPSDVYGGRALSFAIADFSATVRLRPSPELLIQPHPHHDLVAFPSLPQLVSRLQSEGYYGGVRLLMAICKVFYNHCVQNNISLKAENFTLSYDTNIPRQAGLSGSSAIVCAAPSCLLDFYDVRHLIKVEMRPNLILNAEKELGIVPALHDRVAQVYGGLVYMDFSQEHMGKLGHGIYMPLDVNL

SEQ ID NO: 120321 - protein, 262 aa, Triticum aestivum
  unsure (1)..(262): unsure at all Xaa locations
  Clone ID: PAT_TA_14739.pep
SARETLQPFTLWLSDLSSLTKSVINCPNLSELSLIFSQQDNDSTDLISMMDSLGRTCSNLRKLHISSIHLCNEAVFALGSANLRGLCMLSLLLGKKITDAAVASIVRSFTSLELLDLSGSCITDNGLGMVSKAFPDTLTRLLLAMCPNITSYGVQVATAQLPLLQLMDCGKSLCANVQPEAPRSYFGDLNGGIRFCSKLQITRKQQPTYQKLIIKHANLXKKLSLWGCSGIDALCVNCPELNDLNLNSCINLNPERXLLVKA

SEQ ID NO: 120322 - protein, 142 aa, Triticum aestivum
  Clone ID: PAT_TA_14740.pep
RARARGARVIGLLVSVRAPRSGSAWACSGGVPDRLWLLARSFVIGFLDVVHEGGLFARFADLGGCIAFAPLPGSPVAPLLVCDVAAHRGRSRGCSGCLPGRPLELFFSFFNGYVQVVPGGQFLLVVKLVVLLDSISSFTVFD

SEQ ID NO: 120323 - protein, 322 aa, Triticum aestivum
  Clone ID: PAT_TA_14741.pep
VVVDERVASHVDPFLVEALDNPRHRLRLLRMELDIQNFMQNPQLQEFEFQNYPTSYLRCAAHRVAQHYGLETIVADSLVEGSVSRIVARKTPESRYPAIALSEVPSRQARNDHEAAEKLKFVIYQRPKAFQNGSADSRNMNGAPKTVEERIEEYNKARARIFNGSISADSDAASVLGTLSTGRDEAVNVEPSVDEIKISTMNSRSRVAVFKDTEKDRSDPDYDRNYTRYVRNPVPDFNLSPGAFNFVVPQFMQYGVGYMQSPGMSTNQPTVYFGQPDLAMGSSSGATVYPHWPTPAMMYPHCYDNVGPMISQVPLYQSFNHG

SEQ ID NO: 120324 - protein, 140 aa, Triticum aestivum
  Clone ID: PAT_TA_14742.pep
VLESAYIHRSARASRNINKQQQQQRRRRLLGDGVDGVDDAGEVAEEGEEEADPELVPAPKLEEHTQRWQDDGDQDVHAVGRPLRHGCLPSRSALLASVKLDRWTDAVLRPMILPVVLLLLGLDSWMDRILPDFLLPLVRI

SEQ ID NO: 120325 - protein, 145 aa, Triticum aestivum
  unsure (1)..(145): unsure at all Xaa locations
  Clone ID: PAT_TA_14743.pep
GVKFGEVVWFXAGSQIFSEGGLDYLGNPSLIHAQSILAIWAAGGELEGAAGGARQAGGRLGEVVDPLYPXGGSFDPLGLADDPEAFAELKVKELKNGRLAMFSMFGFFVQAIVTGKGPLENLADHLADPVNNNAWAYATNFVPGN

SEQ ID NO: 120326 - protein, 222 aa, Triticum aestivum
  Clone ID: PAT_TA_14744.pep
RGAVLADSLRPRTGLTRESSPFELALDKYGLHGEKASGELLSFSDSNGSPQVSIFVLPDYKPPLAACVVNEVLELISSEATSTERILIVPFITRSSSYHRGMEHATKASPVLHGAEIGATTDYTHLFVGGTTKPPTFLQIRSEPILCLLEMVRVLRMPTVLLVTSGGQQQGKSSTVSDLEVLQCLGEHLAKHMALEFSKETVLKRGIEKSPIDQEPWRELYG

SEQ ID NO: 120327 - protein, 135 aa, Triticum aestivum
  unsure (1)..(135): unsure at all Xaa locations
  Clone ID: PAT_TA_14745.pep
MTFKRRNGGRNKHGRGHVKYIRCSNCAKCCPKDKAIKRFQVRNIVEQAAIRDVQEACVYDGYVLPKLYAKVHHCVSCAIHAHIVRVRSREKRKDRKPPERFRRREDXPAGGQGGPRPGPGAAATAPSPTPVAARP

SEQ ID NO: 120328 - protein, 67 aa, Triticum aestivum
  unsure (1)..(67): unsure at all Xaa locations
  Clone ID: PAT_TA_14746.pep
SHGNAEKKRVLSGHVIQSQFSTSTWYDDMIITAETGLMNIFXMCMFSLTADDAEDDGDDDDQDEQRQ

SEQ ID NO: 120329 - protein, 313 aa, Triticum aestivum
  Clone ID: PAT_TA_14747.pep
MGDDGLDEEEDGFDCEIGTLENFEKAKGTVNISATYNTRPARGESSVVARGDLWRLESSRGNLNSGNDSSPLFLVQLGPLLFVRDSTLLLPVHLSKQHLLWYGYDRKNGMHSLCPAIWSKHRKWMLMSMMCLNPVACSFMDVQFPNGQLTYVAGEGITASGLIPLFGGLLQAHGKCPGDTRVSFSFKNKQGTRFTPTFQWPDNSVSLGVAQAVAWKRSGLMVRPSIQISVCPTFGGSDPGIRTEFVHSLKDELSVMCGFSCSRHPSAFTSLSLGRSKWNGQVGSSGLVITLETPLDNMARPSLSVQLNGGFEF

SEQ ID NO: 120330 - protein, 141 aa, Triticum aestivum
  Clone ID: PAT_TA_14748.pep
MDPSPLAVLPLTSTATRLSPPSRYSGSICDSHRRPPSISPAVSRRSISTPVRRPGPPPSAHRVPPHPQQYRHVRVACNPSSLLQIRISSCGASSKPLPPPLTWQPSPPPLLVQASCSILLCSTNLMYHRIIVEDAAHLYSL

SEQ ID NO: 120331 - protein, 97 aa, Triticum aestivum
  Clone ID: PAT_TA_14749.pep
PHDPILFLKIYLGAYLPISITENITYLKFVPLQGYLKTSVTKPHTPALLPNWTQNLNNEHPNVLIISNKTIVLYYSWPCMTRYCTARVILIACDLVP

SEQ ID NO: 120332 - protein, 74 aa, Triticum aestivum
  Clone ID: PAT_TA_14750.pep
MAEPAKPEVTEEAKMDLLEDDDEFEEFEIDQEWDDKEEGNEALQQWEDAGDDDDVNDDFSLQLRKELESNAPKN

SEQ ID NO: 120333 - protein, 154 aa, Triticum aestivum
  Clone ID: PAT_TA_14751.pep
ARGFLSSREGKSARGAQRSARERVTSSSSRVSRSAAMATRAAARFLQRRLLSSGGKVLSEEEKAAENVYIKKMEQEKLEKLARKGPSSGQQASSTTGSAANDVKVGAGPTESASASVSSDKNRNYAVLAGTVAALSGLGWYLLSKPKKSEEVVD

SEQ ID NO: 120334 - protein, 103 aa, Triticum aestivum
  Clone ID: PAT_TA_14752.pep
SQRFELLVQGRSREDRHAFSMTSFKEGLYTVEFRSSIALLQAFAMCIVMLHGRYPSRMQVGSQAAQEHDLLAGHELKAMAASQGRAPTSYVPHRPPLSPVGRA

SEQ ID NO: 120335 - protein, 72 aa, Triticum aestivum
  Clone ID: PAT_TA_14753.pep
MDNPGTRRFLLQEQQKAMMNEMVGKLTSVCWDKCITSAPGSKFSSGESTCLTNCAQRFLDMSVLIAKRFEMQ

SEQ ID NO: 120336 - protein, 142 aa, Triticum aestivum
  unsure (1)..(142): unsure at all Xaa locations
  Clone ID: PAT_TA_14754.pep
RFPFPPRPPPPPAPAAPPIQAAMDGGKKSRNPHKAPADYRSDRKSASGMXATPRRAAAAASSPGRAPTATPTRTSASSPPRTPTPTAPPRVEAPPAPRRTTTTTSRPASRRLGPPSPRRSPARTNESFLPTSLIPVSVRFSC

SEQ ID NO: 120337 - protein, 103 aa, Triticum aestivum
  Clone ID: PAT_TA_14755.pep
PRRPPLRRLRRSDAVAQDLPDQEEAGEEDAPEPPHPLLDPHAHGQHHQVQRQAQALAPHQARLLSARIGRLLRRNSRVSTFPLVLSMSLVFLQAGKQCHEGFC

SEQ ID NO: 120338 - protein, 262 aa, Triticum aestivum
  Clone ID: PAT_TA_14756.pep
SNAVQSIPYFASGLKGVARSMPTSAALDVDAKNLNLKFFEVPTGWKFCPKFFGNLMDAGMCSVCGEESFGTGSDHIREKDGIWAVLAWLSILAYKNKDNLGGDKLVTVEDIVLQHWATYGRHYYTRYDYENVDAEAAKELMANLVKMQSSLSDVNKSIKEIQPTVADVVSADEFEYKDPVDGSVSKHQGIRYLFGDGSRLVFRLSGTGSVGATIRIYIEQYEKDSSKTGRASSDALSPLVDVALKFSKIKEYTGRSAPTVIT

SEQ ID NO: 120339 - protein, 392 aa, Triticum aestivum
  unsure (1)..(392): unsure at all Xaa locations
  Clone ID: PAT_TA_14757.pep
MIPLCASSSPSTPAIIAPRPRRLRHRTTTPSLPHSRSPHRHLVLASSSPAPTPRPLARAHRPGAVATAAEMVFSVTKKETKPYEGQKPGTSGLRKKVTVFQQPHYLANFVQSTFNALPADQVKGATIVVSGDGRYFSKDAVQIIAKMAAANGVRRVWVGQDSLLSTPAVSAIIRERISADGAKATGAFILTASHNPGGPTEDFGIKYNMGNGGPAPESVTDKIFSNTKTITEYLIAEDLPNVDISVIGVTSFTGPEGPFDVDVFDSATDYIKLMKTIFDFESIKKLLASPKFSFCFDGLHGVAGAYAKRMFVDELGASESSLLNCVPKEDFGGGHPDPNLTYAKELVDRMGLGKTSNVEPPEFGAAADGDADRNMVLGKRFFVTPSDSVAFX

SEQ ID NO: 120340 - protein, 254 aa, Triticum aestivum
  Clone ID: PAT_TA_14758.pep
QIGNSTKQNQTQSREPEEERSHSGGGFRSFLKETVRDAFESHSRHGGEDQDEQPTGDGLTKNRSLPLSTLIEMLKEQTGKDDIEEGSIRLTLFNVFGDDASPKIKKFMKVMLDKFHEGGSGEQGGVMGMVGSLAHQFLKACLEGTEGETFKPAIEQDMGSAEEAYAGTKSWAPNNGILISGCQTSQTSADATIPGGTSFGAMSNAIQAILASDDGKITNKDLVMKARAALSKQGYTQQPGLYCSDEHVHVAFIC

SEQ ID NO: 120341 - protein, 424 aa, Triticum aestivum
  unsure (1)..(424): unsure at all Xaa locations
  Clone ID: PAT_TA_14759.pep
MPMPPHFSTAPLAGNSLTMTFMNFVIDVLAFVPDDVKLXRTIFDFVTVNILLVFPKFLYXFYRVAGVRFLVVLPMFGHLLLVMDSFAANGISRVNCGPNEEGPEPHPGTRPTYSEEXVRRLGLGKPSNADPPELGAAPDVDPDRRVVLGKXYFVAPSASDAIKSSTAVQFIXWVASGSVVTGASLLCPPIMLPPSVRLVAECRSQIRKLLXAASCSICWEDLLGTWSDRSLGEGRIWAGLGRLSILAXRNNGHLGGXDILSTVEDNVLHHGATYGRHYYTRYDYEXNVDAEAAKELMANLVKMQSSXLSDVNKSIKEIQPTVADVVSADEFEYKDPVDGSVSKHQGIRYLFGDGSRLVFRLSGTGSVGATIRIYIEQYEKDSSKTGRASSDALSPLVNVVSEVFKDLREYXTGRSAPGRDDIKF

SEQ ID NO: 120342 - protein, 286 aa, Triticum aestivum
  Clone ID: PAT_TA_14760.pep
PDVRGLIHAALRLGYRHLDCAADYQNEAEVGDALAEAFQTGLVKREDLFITTKLWNSDHGHVLEACKDSLKKLQLDYLDLYLIHFPVATRHTGVGTTSSALGDDGVLDIDTTISLETTWHAMEELVSMGLVRSIGISNYDIFLTRDCLAYAKIKPAVNQIEVHPYFQRDSLVKFCQKHGICVTAHTPLGGSTANTEWFGSVSCLDDPVIKSLAEKYGKTPAQLVLRWGLQRNTVVIPKTSKLERLQENFEVFDFDISGEDMEKMKAVDRKYRTNQPAKFWGIDLFA

SEQ ID NO: 120343 - protein, 83 aa, Triticum aestivum
  Clone ID: PAT_TA_14761.pep
LFALFCISCCCDLRLTSVEKYLYIRASCLLVVCKSECVSMNLCSVCCHEHVYMSSEHASVILKWVNAFLVVWESPFQSFNLNT

SEQ ID NO: 120344 - protein, 257 aa, Triticum aestivum
  Clone ID: PAT_TA_14762.pep
DSDEAEAEIGHRVEDLWEVAEPQLSPSEKLNSCFEDIPVASFPRTHPSQVIEIPSDAGLAETVEILSKNKILSAPIRNVEAPEDASWMDKYIGIVEFAGIAMWLLSQSDAAVNGTVGSGAGSPVSNLVSRLGSFTFSRTSSGRVETATDSESDEAASVGGSFFETLTSSEFYKNTKVGDISGSFRWAPFLALQTSDTFLTMLLLLSKYRMKSLPVVEVGGDKIENIITQSSVVHMLAECVGLSWFESWGTKKLSELG

SEQ ID NO: 120345 - protein, 131 aa, Triticum aestivum
  Clone ID: PAT_TA_14763.pep
NATEMFRNLITSLDTEGRYLLLNAIANQLRYPNSHTHYFSFIILYLFAEATQEIIQEQITRVLLERLIVNRPHPWGLLITFIELIKNPRYNFWNRSFTHCAPEIEKLFESVARSCGAKAVDEGISVHDGSH

SEQ ID NO: 120346 - protein, 236 aa, Triticum aestivum
  Clone ID: PAT_TA_14764.pep
MERARAMGPWEWAEAALPCLAWMRSYRWKEDFQADLAAGITVGVMLVPQAMSYAKLAGLHPIYGLYTGFVPLFVYAIFGSSRQLAVGPVALVSLLVSNVLGGIVNSSSELYTELAILLAFMVGILECLMALLRLGWLIRFISHSVISGFTTASAIVIGLSQIKYFLGYSVTRSSKIIPLIESIIAGIDQFSWPPFVMGSAFLVILLIMKKLGKTNKKLRFLRASGPLTAVVLGTLF

SEQ ID NO: 120347 - protein, 122 aa, Triticum aestivum
  unsure (1)..(122): unsure at all Xaa locations
  Clone ID: PAT_TA_14765.pep
MSRGGSAGGGQSSLGYLFGSGEPPKPAVAPAASAPPVEKPSAAKTDAAKQVAAGVTRXTNNYHRADGQXNTGNFLTDRPSTKVHAAPGXGGSSLGYLFRWQLMPVLGALNKSYPPLPAACYV

SEQ ID NO: 120348 - protein, 75 aa, Triticum aestivum
  unsure (1)..(75): unsure at all Xaa locations
  Clone ID: PAT_TA_14766.pep
FFFFFFFFFXXDFFLFRQLTRKKKKEKRKEIVFLSSRKWLVVTCYLVGLFGTLTLWSTTFDKVSYIEVIWGLLYT

SEQ ID NO: 120349 - protein, 104 aa, Triticum aestivum
  Clone ID: PAT_TA_14767.pep
MVILNHTTSATRTFKRVLTNVAGSAAKYSMSVTAPAGMKVTVTPSALSFGGKGSKQGFSVTVQVSQVKRAVDDYSYIGNHGFLTWNEVGGKHAVRSPIVSAFAQ

SEQ ID NO: 120350 - protein, 128 aa, Triticum aestivum
  Clone ID: PAT_TA_14768.pep
SVVAAEVPPNSQSWVLRSTTEYASKVIESMGPRKPSADALAKVAEDRSRGFQATGLNIPQPIFMKAHRWGGAFPAISIGGDDKCVWEKNMKLAICGDFCASPSVEGAVLSGMSGASKILGCLNLPSGL

SEQ ID NO: 120351 - protein, 70 aa, Triticum aestivum
  Clone ID: PAT_TA_14769.pep
SKVVRSQHQKAKTAILKHSLTSGERLTKIHVQAVPNKTATKHTEWYAYVCLACVKKNAIVLPRVQAHRLQ

SEQ ID NO: 120352 - protein, 103 aa, Triticum aestivum
  Clone ID: PAT_TA_14770.pep
FWLPSCPGMGSVHAAAARLPAQFYCVAGGEARRGGRGIPPRRRRRMICDLQVDTRTPMSLYYSYMCRVTVGVHPCNKSSACISSPSLFINIHFYIFQQKKKKK

SEQ ID NO: 120353 - protein, 113 aa, Triticum aestivum
  Clone ID: PAT_TA_14771.pep
SSIKSVQNHTNQENCRYSKHHRPESQTVFSGKGSTTVMSRSTKLRQTYTTSHDNLLLFVVPPAQDVSCVGKTSRVHTPTSILRTTRQGKEILMFLLISCVGLMGQQISLQLDR

SEQ ID NO: 120354 - protein, 217 aa, Triticum aestivum
  Clone ID: PAT_TA_14772.pep
MACINSTFQSCSIARGAKISTRASRGSSGGKGSPTFQCRPAAFVNAASLRLELDENPEAIISRVWPENVSLLSYDDLRAYLESQETVQVEDDQHVALLGEAMSTPVLMATADQTLEEVECHFEAVSGLPVVDSSLRCVGVVVKNDRARASHGSKTKVSEVMTSPAITLSSDKTVMDAAVLMLKMKIHRLPVVNQDEQVIGIVTRADVLRVLEGMLKV

SEQ ID NO: 120355 - protein, 147 aa, Triticum aestivum
  Clone ID: PAT_TA_14773.pep
HFKNTRETAFAIRKLQLSKAKRYLEDVIAHKQAIPFRRYCGGVGRTAQAKSRHSNGQGRWPAKSAKFILDLLKNAESNAEVKGLDVDTLYVSHIQVNQAQKQRRRTYRAHGRINPYMSSPCHIELMLSEKEEPVKKEAETQIAPRKA

SEQ ID NO: 120356 - protein, 265 aa, Triticum aestivum
  unsure (1)..(265): unsure at all Xaa locations
  Clone ID: PAT_TA_14774.pep
PRRHGGSEDFQEVITAMMEGLGTPNVSDFFPVLAPADLQGMRRRLARIFARLHAVFDAEVDKRLRGRHAGQPRKNDYLDVLLDVAARDKGKDLLDRDTLRSQFTDLFAAGSDTSSSTVEWAMAELLRNPSSMAKVCDELAQVIGSRRNIEEADIVRLPYLQAVIKETFRLHPPAPLLLPRQPETTVKIAGYTIPKGSRVFINVWAIGRDKDVWTEPEKFMPERFLGSAIDFKGVDFELLPFGAGRRIRPGMXLAIKMVHVMLAPC

SEQ ID NO: 120357 - protein, 239 aa, Triticum aestivum
  unsure (1)..(239): unsure at all Xaa locations
  Clone ID: PAT_TA_14775.pep
FDLLSLNDSSSYESKPTNLHNSFIHAKRIVVFGSLLRKEMEPDTSGGIMRMKSYLDRSPPLXGRFRIPVEAERLRDNDLVLEQYPLANSPGXIAGSRLDPSSVXRPRVTHSPSSSXELGMRKFPLTRMGDSFVPPAGLSAQVSGPGESGKVPVPDYPSPHVDPISPRCPVFPVLRLRPPCVSSRSLGDLPAGGVDISVPANLNVRTLPLASGLSLSNKIKLYYYADTYEMGKIGSLSAV

SEQ ID NO: 120358 - protein, 86 aa, Triticum aestivum
  Clone ID: PAT_TA_14776.pep
GSHLRVRIAASSAQATTMPKQIHEIKDFLLTARPRDARSVRIKRAKDAVKFKVRCSKYLYTLCVHDADKANKLKQSLPPGLTVQEI

SEQ ID NO: 120359 - protein, 50 aa, Triticum aestivum
  Clone ID: PAT_TA_14777.pep
MAVGDLAFKALTAGLGVATLYLAATFSVNVYRGLSWHSEQSKLEKAKNED

SEQ ID NO: 120360 - protein, 236 aa, Triticum aestivum
  unsure (1)..(236): unsure at all Xaa locations
  Clone ID: PAT_TA_14778.pep
LGESVIKWADMKCGISSGVYTALAFAVAFSSDYDMXLVKPRGEAMQDASDAAXSAMVSVIGLDSEKVQQLXCDAANEDVDEKERVQIANFLCPGXNYAVSXGGVKGIEAVEAKAQSFKARMTVQXLLLLDAFHTSFMQPAVSEIGSLHWLLHEIRSPRIPVISNVDAQPHXADSVDKSKKILGXQQSKLLLLQWETTETTLFXEALRSAMQLGPXKVIAGIMKRINKGACIENIGA

SEQ ID NO: 120361 - protein, 75 aa, Triticum aestivum
  Clone ID: PAT_TA_14779.pep
WLGVLGDTYGMEVASLSNHSILRTCMTDLGWYQGKQKQSFSNSRWQLAPNARESEKVASFIQHMLHERNMKIMLI

SEQ ID NO: 120362 - protein, 173 aa, Triticum aestivum
  Clone ID: PAT_TA_14780.pep
SARGGHVCYHIIAAGLNGYMATVTNLKSPVNKWKCGAAPITSMMTVKRWSRGPATSQIGKPAVHMASVDLKGKAYELLRQNSSSFMMEDIYRNPGPLQFEGPGADTKPISLCVEDRDYMGRIKQLQEYLEKVKSIVKPGCSQDVLKAALSAMASVTEMLTILSSPSFSSQATI

SEQ ID NO: 120363 - protein, 166 aa, Triticum aestivum
  Clone ID: PAT_TA_14781.pep
SDGPFCASAFAVSFYVPAKNQADPPPAEGLRVDRWAGARYAAVRRFGGFVADADVGEQAARLEASLQGTRWAAAVNDARRADPASPYTVAQYNSPFEFSGRVNEIWMLFDAAAAAGTRRGCERAPGAQGLRGAARSGRAKRPCASQNTAQCAAPAPRPFGKQRGAC

SEQ ID NO: 120364 - protein, 210 aa, Triticum aestivum
  Clone ID: PAT_TA_14782.pep
MAVTFTDLHTADGLKALEQHLSGKTYVSGNAISKDDIKVFAAVPSKPGAEFPNAARWYDTVAAALASRFPGKAVGVNLPGGGAASSAAAAAPAAKDADEDDDDLDLFGDETEEDKKAADERAASKASSKKKESGKSSVLLDVKPWDDETDMKKLEEAVRSVQMEGLTWGASKLVPVGYGIKKLQIMLTIVDDLVSVDSLIEEHLTEEPIN

SEQ ID NO: 120365 - protein, 180 aa, Triticum aestivum
  Clone ID: PAT_TA_14783.pep
FGRARRALPLAPIAGLGRGEAAAVPVADGDVQRWEEGIARGRDLADVLKLLPVNSLSCKQIERRSCISLEAFIRDYFLCESPVILSGCIEHWPARTKWKDIKYLQSIAGDRTIPVQVGKNYACTELKQELITFSQFLERMWSSDSANLACLAQHQLFDQIKELHEDISVPEYWLAGGGKL

SEQ ID NO: 120366 - protein, 172 aa, Triticum aestivum
  Clone ID: PAT_TA_14784.pep
MAAAAKSVCVTGAGGFIASWLVKLLLSRGQYTVRGTVRDPGASKNAHLKALEGAMERLQLLKVDLLDYSSVASAIAGCEGVFHVASPVPSGRSSNPEVEVIGPAVLGTTNVLKACYEAKVKRVVVVSSVAAIFSNPYWPKGKAFDEDCWSDEDYCRKNEVIQLFLSKAMVLA

SEQ ID NO: 120367 - protein, 161 aa, Triticum aestivum
  Clone ID: PAT_TA_14785.pep
MRPGAGFNATAAATKAAVAPLAAGAAHSAWHSPVPYLFGGLAPMLGLIAFALLILACSYWKLSGYLEGSAGRGDEEGSATDGAKPVASDLPPAAWEEKVLVVMAGDVEPTYLATPMSSRDRSSKGEEEEKKVSMAAMASTKDAGNSEHSQNRRERDDHHLP

SEQ ID NO: 120368 - protein, 217 aa, Triticum aestivum
  Clone ID: PAT_TA_14786.pep
SFSDQTAGVLALGGGAGSLLAQTAETFGNAFSYCVPHPSSDGFLSLGGPVGNSSQFTSTPLIKNQHAPTFYIVRLEAITVAGRRLDVPPATFAGGAVMDSGAVVTQLPPSAYAALRAAFRSAMTAYGPLADPVRNLDTCYDLTRFPEVNVPKVSLVFVGGATLELEPASIMLDGCLAFTASPGGHGSIGFIGNVQQQTYEVLYDVGSGSVGFRSGAC

SEQ ID NO: 120369 - protein, 240 aa, Triticum aestivum
  Clone ID: PAT_TA_14787.pep
LQGDQPMGFALFSSAHQAIAAKAALQDMVFDAETQVALHTEMAKKNLFVKRGVGIDANAVDQSKRLRTGGDYTHSPYAPPFHPPPPAVSMWGTPGYITAPPPYNPYAAYPHEAVAMTSPSPVTGPTAYAPVQNTKDNPPCNTLFIGNLGDTVVEEELRSLFSVQPGYKQMKVLRQDRNTVCFIEFEDVNAATSVHQTLQGAVISSSGRGGMRIQFSKNPFGRRKDSAGGLASVLNGAPVN

SEQ ID NO: 120370 - protein, 165 aa, Triticum aestivum
  Clone ID: PAT_TA_14788.pep
SGGHDPGSKAQTGAPKNFCAKRTVPRRKLPPRLTTKGEEPFPAGKEGGEKQRGGTHPTGGLGGPRPRLRTGGCRRKMLACDGVFLQLSGAPEATECTAEDAILALICPRLGRHRRRSRPDPSPFPHGAADAPPRLAIFFRRTESGQALQRSAQYFDVLCWSLALW

SEQ ID NO: 120371 - protein, 190 aa, Triticum aestivum
  Clone ID: PAT_TA_14789.pep
MSILQVIGMYVGIATVGVFIIWYTHGSFLGIDLAGDGHSLVSYSQLSNWGQCSSWEGFKVSPFTAGARTFNFDVNPCDYFQGGKIKATTLSLSVLVAIEMFNSLNALSEDGSLLSMPPWVNPWLLLAMSVSFGLHFLILYVPFLAQVFGIVPLSFNEWLLVIAVAFPVVLIDEVLKFVGRCLTARARKQS

SEQ ID NO: 120372 - protein, 162 aa, Triticum aestivum
  Clone ID: PAT_TA_14790.pep
RHEGGISRHFVTTRTPTQVASHAQKYFLRQNSLTQKKRRSSLFDAVEGANKAALRRTASVSELQFPSLSPVAVDARTTKGAVPLPPCLNLMMSSASQCAGSDSGSSDASQTQNPSSLYLMAKPHQAQLQMPDLELKMSTSRLSEQPGGASRGTPLFGTIRVT

SEQ ID NO: 120373 - protein, 203 aa, Triticum aestivum
  Clone ID: PAT_TA_14791.pep
EGGIRCASARSPPRCVDHRRAGGRTFPRSGGIDLLSGLLSLCGGCSPWRWVTTAPIWCSSRSPSTGCSLSALDLCRGAAVRGCHGGGGGLVDAFVPVLFPRFTGARSGADEELCGWLYKGGFRYFFLSFVGEGEDEVVPVMPAGCLSSGVLVRKDLCLTTSCLQKIRPRIRRSRRPWKGAAVVAAVRHQLAPECGCGRLGTRV

SEQ ID NO: 120374 - protein, 98 aa, Triticum aestivum
  Clone ID: PAT_TA_14792.pep
MAKRLLPSLNRVLVEKLVQPKKTAGGILLPETSKQLNAAKVVAVGPGERDKAGNLIPVALKEGDTVLLPEYGGSEVKLAADKEYLLFREDDILGTLVD

SEQ ID NO: 120375 - protein, 121 aa, Triticum aestivum
  unsure (1)..(121): unsure at all Xaa locations
  Clone ID: PAT_TA_14793.pep
MVVATEEMVVYCFDTLXVAYFTGERPPPPAFEDGNHPLFVTWKKAANGSKPRLRGCIGTLESRSXLSSGFRDYALTNALRDRRFPPXQSKELPTLECTVSIPTDYEMQRTTPLGVGNMLND

SEQ ID NO: 120376 - protein, 330 aa, Triticum aestivum
  Clone ID: PAT_TA_14794.pep
MVVRLLFLLLPLACSLLFLELPSVSGKPTVHDDLDPAQVTNPTTPITVPSTNPAPTIITVPSTNPTITIPSLNPLPTPITTPSNDPSTTLPLPTPSTSAPNTPVTIPVTTPSTFPPSAPLTNPATNPMVPTVGTTPPTAPTTTPVTAPVVSGQQAWCVAKAGSSETALQDALDYACGIGGADCSPIQPSGSCYYPNTLEAHASYAFNSYYQKNPAPSSCDFRGAAVLANANPSSGTCILASSMSSPTSSTAGSTAPTTSSTSPVTSSSGSDPGSSVLNSSGSGISGSSDFGSDFPGEANTGNGWHSILPSGWSWAGLFSTLALPYVGGIF

SEQ ID NO: 120377 - protein, 108 aa, Triticum aestivum
  Clone ID: PAT_TA_14795.pep
GTRPPAGYLKRALDTGIFERVHVRIYDDADCEAYWHLAWDRWTAAYPATRFYVGMTASETTHGWVHPKNVYYDVAPSVQKADNYGGFMIWERYADTLSNYTSMVKYYA

SEQ ID NO: 120378 - protein, 75 aa, Triticum aestivum
  Clone ID: PAT_TA_14796.pep
TMFCLFSCLMQTPRHKLLGALYGNIGIAKQKSEQLFSTIRHPELGTICTTSESCLWSIVGLPGSYVCYLTFRLFG

SEQ ID NO: 120379 - protein, 86 aa, Triticum aestivum
  Clone ID: PAT_TA_14797.pep
PVTRVHTNSSRLSGTVSAFCDDHHKAIVSYHFTTIGCKLQKELETQGLRQDSHHPRAAQHNVARAISALELAPCILGVQYRAARQH

SEQ ID NO: 120380 - protein, 182 aa, Triticum aestivum
  unsure (1)..(182): unsure at all Xaa locations
  Clone ID: PAT_TA_14798.pep
LTRVCPVGGVGGSRCSPPGGDAFHAERRRRTTLLCAADKPPEESLKKTVEVDRLIDMLRNANPRELDQIVVENVLSFDAGFWVRLAARIDLCKSDDDKAWFHICRQFCFLWMLLSSTSVNLTLXIGFSVLCSQKDYEELAENVMNIVDRLVHKTNQKIDQSTDVLKAIISPVMHEGDVQWPP

SEQ ID NO: 120381 - protein, 174 aa, Triticum aestivum
  Clone ID: PAT_TA_14799.pep
PANVMLHYETTGPEICEDTLGQVDIFVMGIGSGGTVTGVGKYLKEKNPNAKIYGVEPAEANVLNGGKPGPHLITGNGVGFKPDILDMDVMEKVLEVKGEDAVKMARELALKEGLLVGISSGANTVAALELAKKPENKGKLIVTVLPSLGERYLSSALFDELRKEAEAMEPVPVD

SEQ ID NO: 120382 - protein, 240 aa, Triticum aestivum
  Clone ID: PAT_TA_14800.pep
LNDKRNNIQVLMDSHLEGNYSTDEATTLVDLASQCLQYEPRDRPNTIKLVSVLEPLQIKSEVPSYEMLGIPRYEEEASPPPQPQHPLSPMGEACSRMDLTAIHQILVSTHYRDDEGSNELSFQEWTQQMRDMLEARKRGDFAFRDKDFKAAIDCYTQFVDVGTMISPTVYARRSLCHLMCDQPDAALRDAMQAQCVYPDWPTAFYMQAVALSKLNMQSDATDMLNEASQLEEKRQKNTKP

SEQ ID NO: 120383 - protein, 275 aa, Triticum aestivum
  Clone ID: PAT_TA_14801.pep
GNAWESAEQRPPTRPEQGDASNAPGPAPLPRPGMPLPRPPQPLSLVNVPRFTPNPMPYHVQPPHHMQGVPPHMMSNMHQPLPPGQQHMIRMSGPMGHMPSNIPPPPPGHNTQFMPGPPRFAMPPPPHMQNMPTMVNPIGIPQPPPPLPPQPPAEEQPPLPEEPEPKRQRTDDASLIPAEQFLAQHPGPARISVSVPNLDEGNLRGQVLEISVQSLSDTVGSLKEQIAGELQLPANKQKLSVRTSFLKDNLSLAYYNVGPGVVINLALRERGGRKK

SEQ ID NO: 120384 - protein, 245 aa, Triticum aestivum
  Clone ID: PAT_TA_14802.pep
ARGPRVRSPCAFYPRPLAPTAAQIHCLQFLICELVSGGNLRKPGGLFGNSSSGIPVEDLKQLETFFYKLSFFLHILDFTATIGTLTDLGFLWFREFYLESSRVIQFPIECSLPWMLVDHVIESQDAGLLESILIPLDLYNDSAQHALTYLKQRFLYDEIEAEVDLSFDLLVQKLNEVIFTYYKSCAASTLLDSSFTYACDDGEKYFVKPLRFDAIFKLRRVMILGRTIDLRSLITQRMNKLFREN

SEQ ID NO: 120385 - protein, 145 aa, Triticum aestivum
  Clone ID: PAT_TA_14803.pep
MQRDPTSLAGNSSFAYGYEADNCMANGLLGGQCNHSVPVSPALAVPSGITSPHIRSPLDAFELQPSKVCPRNFIIFDHTDEKGCIMYHPALVNNLNPANIDLLQCHGEVVCRSSGQDNGNLEEQSSSFQEDTEEIDALLSSNDDS

SEQ ID NO: 120386 - protein, 98 aa, Triticum aestivum
  Clone ID: PAT_TA_14804.pep
FSDTVTAVVVPPYIDSAEIVKHASARGNLSLGLGLNKVAGKVFRIGHLGNLNELQLLGCLSGVEMVLKDVGYPVKLGSGVAAAAAYLSNSTPLIPSRI

SEQ ID NO: 120387 - protein, 165 aa, Triticum aestivum
  Clone ID: PAT_TA_14805.pep
SARGEIEKPDRRNRWDSPLFELFPSRDEIVETAPVIAEAVSYLTKKVDSKTRDVKVLQPTIATQTVRTTEANSLYEMDKATQEVVNAIVEAQSCGLGLAVNKISIGPNLPTINLQRSVGLPELRSLRRTFIKLAGQYSLSGPPPPTDADSAKRMFVDYLNREVGA

SEQ ID NO: 120388 - protein, 141 aa, Triticum aestivum
  Clone ID: PAT_TA_14806.pep
GPAGAGCGHEFPFTRARPRTLRAQPAPTIKAFRRLSYHGEHHTPAPSLRTPPSCKTRDFAISNAWMQDFLGRPLAASPWPPSRVLAFPPLRACRRGLLPCLGGGFPGSPLAGGPCSSKFQALHCKINVLLGDNSCGRNSDL

SEQ ID NO: 120389 - protein, 84 aa, Triticum aestivum
  Clone ID: PAT_TA_14807.pep
MSCCGGNCGCGSGCKCGSGCGGCKMYPDMAEQQVTTTAKTLVMGVAPSSKGHAEGGFEAAAGAGAENDGCKCGPNCSCNPCTCK

SEQ ID NO: 120390 - protein, 84 aa, Triticum aestivum
  Clone ID: PAT_TA_14808.pep
MADIALLVTEQFETARGRGAGAGGDNGSGSGGERRNFGAVAKVWSSWVESATTAASGVRVSVAAVHLEPKTALALAAADGLFSA

SEQ ID NO: 120391 - protein, 157 aa, Triticum aestivum
  unsure (1)..(157): unsure at all Xaa locations
  Clone ID: PAT_TA_14809.pep
MESTALMTARLPLPTSGSRSKPLSPASFTRVARLLASVPFCSGSGSVVLLSRRSRDYAGVGPLVSAAAAPGDTADAGSESILLSVQGMMCDGCAASVKRILESQPEVTSATVDFKEASAVVWTTDEAKGTQGWQKQYGEKLAKHLXGTCGFESRLQE

SEQ ID NO: 120392 - protein, 215 aa, Triticum aestivum
  Clone ID: PAT_TA_14810.pep
ASRAFERPLLRALASHQDKASYQAGETKARTEEKTGQAMGATKDTAQHAKETTKQKASDSDTGSYLGQKTEEAKHKAGQTTESTKQKAGQTTEAAKQKAAETTEATKQKAGETTEATKQKTAETTEATKQKAAEAMEATKQKAAEAGQYAKETVVSGKDKSAGVIQQATEQVKSAAAGAKDAVMNTLGMGGDNNSKQSDTNTDSSKDSSTITRDH

SEQ ID NO: 120393 - protein, 208 aa, Triticum aestivum
  Clone ID: PAT_TA_14811.pep
IYVSTGDWAEHLLRQGPSSFKQYVEECKALGFDTIELNPGSLNLPEEALLRLVRLIKSSGLRAKPMFSVKFDSSDIPASGDRAFGAYIAPVKEKTSERVEDVDLLIRRAERCLEAGADMIMIDADDVCQHAESLRTDIIAKIVGRLGLDKTMFEASNPKTSEWFVRRYGPRVNLFVDHSDVMNLERLRGFNMLRSNLGSHVASPFFLM

SEQ ID NO: 120394 - protein, 217 aa, Triticum aestivum
  Clone ID: PAT_TA_14812.pep
SARLSSSSGKNCSPKDSVGSGGGSVSQQLGSNFDGQNSSAGNDASTKELECQRIKTTAINDDSASQHGIPSTSIMHYPFISVDHQQLDMTNESYVLPTSSNSSSGSASLHLKNDRTEKELPLLVPFDNHIAQMNYSKTVISTLNAPKTSTDLPVKLHYDEQTSFEASDFQEYESHSVTGGTVAETANRVDESTVGGPDKAAEAASPKKTRTTRKKKK

SEQ ID NO: 120395 - protein, 55 aa, Triticum aestivum
  Clone ID: PAT_TA_14813.pep
TNIIMKIFLRNEPKTSRYLHIHKCCDDLLHINTMPCFYSRGGVVLCINQSCHIKK

SEQ ID NO: 120396 - protein, 278 aa, Triticum aestivum
  Clone ID: PAT_TA_14814.pep
YDGCCQLDIQYSNLSELQVHYNNDRSRDFTNPSLPTEQRPRAPQQGYPDPANLYAFQQAGASFAQMGRAAMIAAAFGGSLPHGVTGANERCTLIVSNLNTDKIDEDKLFNLFSLYGNIVRIKILRNKPDHALVEMADGLQAELAVHYLKGAILFGKKLEVNYSKYPNITPAPDAHDYLNSSLNRFNSNVVKNYRHCCSPTKMIHISALPQEISEEAILNHVSEHGNVLNTKLFEVNGKRQALVLFETEEEATEALVSKHASTLEGNTIRISFSQMQSI

SEQ ID NO: 120397 - protein, 416 aa, Triticum aestivum
  unsure (1)..(416): unsure at all Xaa locations
  Clone ID: PAT_TA_14815.pep
MPASDFESDEVKACIVSCGGLCPGLNTVIRELVCGLAHMYNVNNIFGIQNGYKGFYSSNYVAITPKTVNDIHKRGGTVLGTSRGGHDTKKIVDNIQDRGINQVYIIGGDGTXKGAYEIYKEIRKRGXLKVGIAAVPXTIVNDIPSIDNSLDVGFGPRIDXTSPVFRPRMEACRPESGIGLLKLLGRXSASVAMXGTLPSRDLDCGLIPXSRSSCLGNGGKLPMVLVGLKENKHMVIVVAEGAGQDIIAKSIPASDQLDASGNKLLLDIGLWLTHKIKDHFKSKKMEMTIKYIDPTYMIRAIPSNAADNVYCTLLAHSAIHGAMAGYSFTVGMVNGRHAYIPFYRVTSTRNKVKITDRMWARLLSSTNQPSFLRQKDIDEAREADRLTNKPPLPPVANQNVAKAFDQSASASSNGEI

SEQ ID NO: 120398 - protein, 91 aa, Triticum aestivum
  Clone ID: PAT_TA_14816.pep
IRPRVSSAIAPCLSYARGQGSAPSAGCCSGVRSLNSAARTTADRRAACNCLKNAARGISGLNAGNAASIPSKCGVSVPYTISTSTDCSRVN

SEQ ID NO: 120399 - protein, 252 aa, Triticum aestivum
  Clone ID: PAT_TA_14817.pep
MEQRKFLLCLILGLLAASGPAKTVNADSPFDFYYLILMWPGAYCTDSEYGCCVPKYGYPSEDFFVKSFMTFDSSENTAVVRCNSDNPFDINKLDSIENNLNHYWSNIKCPRTDGVNSWKSEWNSYGVCSGLKELDYFKAGLQLRKNADVLSALAEQGIKPDYQLYNTAFIKWAVNQKLGVTPGVQCRDGPFGKKQLYEIYLCVDKDAKSFIDCPVLPNLSCPAEVLFHPFHTWMLNTTSAANIVMPTETVLA

SEQ ID NO: 120400 - protein, 58 aa, Triticum aestivum
  Clone ID: PAT_TA_14818.pep
CTILPLGLGSMPRSYFVFFTLLSCKSISPREYISRVFFFGFAMPQCYQQYSNLTAVGS

SEQ ID NO: 120401 - protein, 92 aa, Triticum aestivum
  Clone ID: PAT_TA_14819.pep
LLHRWFVLLWLVLPLWFGHDYTTFLSSCATNEIRPASYTAIVYFWYLLIERQINLFSSLFFCCFCRACASTIRSKFPMVTYNICSPSHFGRM

SEQ ID NO: 120402 - protein, 63 aa, Triticum aestivum
  Clone ID: PAT_TA_14820.pep
NAGPNTNGSQFFICTVPTPWLDGKHVVFGQVVEGMDVVKAIEKVGSRSGSTAKEVKIANCGQI

SEQ ID NO: 120403 - protein, 161 aa, Triticum aestivum
  Clone ID: PAT_TA_14821.pep
RLLPSVTPEAATLSRWIVQSYRFHFGAELIKAADASSGESALKALWQHTSAILCCSLKAMPVLTFANQSGLDMLETTLAALREITMDKVLDYDQGRKSLLCADLMASVAEQGYACVEGGTCASSMGRPASYGKAVAWKVLDDGGAGAAHCVCFAFMDWSFV

SEQ ID NO: 120404 - protein, 180 aa, Triticum aestivum
  Clone ID: PAT_TA_14822.pep
HAQLETLAIYPRRRRSPPATMAGMASRCEGKTTGDKGYCSVIYSPYPQSSPLPPRLTDLFQHFGLDKIRAIMNSSDGKTFEQKIDKLREEMSAFERARDVFYIVEGEDGDEDDEGDEDDDVDVDESDRKLLDDEKKPDITKRPHTPIGDEVECKKPKIAEGSRCQGEEPEAGGIKNSSWV

SEQ ID NO: 120405 - protein, 152 aa, Triticum aestivum
  unsure (1)..(152): unsure at all Xaa locations
  Clone ID: PAT_TA_14823.pep
MSTSTFATSCTLLGNVRTTQASQTAVKSPSSLSFFSQVTKVPSLKTSKKLDVSAMAVYKVKLVGPESEEHXFDAPDDTYILDAPRPPGVEFXYTRAVLGCSTRPGNKQPGVVGXSHGSFLHDEGQEEGYVLTCVSYPKSDCVIHTHQEGDLY

SEQ ID NO: 120406 - protein, 180 aa, Triticum aestivum
  Clone ID: PAT_TA_14824.pep
GFARGNGFGGVVLSPVGTQCVSKEDHPIVQRKGLAVVDCSWARLSDVPFVKLRCGAPRLLPWLVAANPVNYGRPCELSCVEALSAALIICGEEDTAHLLLGKFKWGHAFLSLNRDLLKAYSQCENGSEIINVQNSWLSSNSSVPKPPVNGTEEARQSTEEGSEGDSDDDLPPLEKNLNHL

SEQ ID NO: 120407 - protein, 97 aa, Triticum aestivum
  Clone ID: PAT_TA_14825.pep
GWFFLFYLLHILFCVWSAVAPPFPFKGKSLAGILPAIDIIGRSAIVGIFYFIGFGMFCLESLLSIVVIQQVYMYFRGSGKAAEMKREAARGAMRNAF

SEQ ID NO: 120408 - protein, 226 aa, Triticum aestivum
  unsure (1)..(226): unsure at all Xaa locations
  Clone ID: PAT_TA_14826.pep
SGRGKALHQYDCLRANKATSAWGLEARVPFLDKDFINEAMSIDPEWKMVRPDLGRIEKWVLRKAFDDEEQPFLPKHILYRQKEQFSDGVGYSWIDGLQAHAASNVADKXCLSNAKFIFPHNTPTTKEAYYYRMIFERFFPTEXAILTVPGGPSVACSTAKAIEWDAQWSENLDPSGRAALGVHLAAYEHEQDPKHVPDTIAAGGSKKPRTIRVAAAPPPPGVAIEG

SEQ ID NO: 120409 - protein, 188 aa, Triticum aestivum
  unsure (1)..(188): unsure at all Xaa locations
  Clone ID: PAT_TA_14827.pep
RGGLNFYVTLQEAIGKIKQQCSDFIMTRNIQCREMIEDVQRKLAGFSFSSSSGHASLQRNASVPPDQSSPSPPPPAPPPPPAPPPDGVPPGGDSKTRVLSSPEQRPAYSQHTRPNGAPTATPPXYGAPSATPPYGAPHXGHYQXPPDQNXXNHXXGPTTYPXGCPGXXHPHXQTXAKRPFPTNVARVY

SEQ ID NO: 120410 - protein, 58 aa, Triticum aestivum
  Clone ID: PAT_TA_14828.pep
LSAVLRGLNLLHLRIIHHRNHSIYLPVPGSVIAERASSREGGRLRGPVRGEQSPRLVR

SEQ ID NO: 120411 - protein, 388 aa, Triticum aestivum
  Clone ID: PAT_TA_14829.pep
MASADEANAAAEGTEGKNWQRKGKHKKEKPWDDDPNIDRWTVEKFDPSWNEGGLLEVSSFSTLFPQYREKYLQETWPIVKGALKEFGVSCELNLVEGSMTVSTTRKTRDPYIILKARDLIKLLSRSVPAPQAIKVLNDEMNCDIVKIGSIIRNKERFVKRRERLLGPNLSTLKAIEILTGCYILVQGNTVAAMGSFKGLKQVRKIVEDCIKNIKHPVYHIKELLIKRELAKNPALATESWDRFLPNFKKKNVKQKKPNTKEKKQYTPFPPPQQPSKIDLELESGEYFMSDKKKSAKKWQEKLDKQSEKSEEKKRKREAAFVPPKENTAGLSESAKSTNDNEIADITKSLKKKAKKFRNSEAEENVKIESYVASNEESRSKKKRRSSSK

SEQ ID NO: 120412 - protein, 329 aa, Triticum aestivum
  Clone ID: PAT_TA_14830.pep
ATRDSSNASCLLKSKDDFVRLCIIINSALAGEEAEKAPFGFFDRDGKYIECLLSVNRKVNADGVVTGVFCFIHVPSDDLQHALHVQQASEQTALRRLKAFSYMRHAIDKPLSGMLYSRETLKGTGLDEEQMRQVRVADSCHRQLNKILADLDQDNITDKSSCLDLDMAEFVLEDVVVSAVSQVLIGCQGKGIRVACNLPERFMKQKVYGDGIRLQQILSDFLFVSVKFSPVGGSVDISSKLTKNSIGENLHLIDFELRIKHQGAGVPAEILSQMYEEDNKEPSEEGLSLLVSRNLLRLMNGNIRHIREAGMSTFILTAELAAAPSAVGQ

SEQ ID NO: 120413 - protein, 155 aa, Triticum aestivum
  unsure (1)..(155): unsure at all Xaa locations
  Clone ID: PAT_TA_14831.pep
MASKRILKELKDLQKDPPTSCSAGPVGEDMFQXGQATIMGPVRTAHPAGWPFAGVKILLPIQYYPFYPSKGLFAALRFNTFNTKLDTGGIFRLDFLKEKLSPGLTISKVLLSICSLLSDPNHDDPLLPEIAHMYKTDRAKYESTARSWTQKYAMG

SEQ ID NO: 120414 - protein, 93 aa, Triticum aestivum
  Clone ID: PAT_TA_14832.pep
GFCAIVSYPADNLVSFLNNAKGATVGDAVKKLGLWGLFTRGLPLRIVMIGTLTGAQWGIYDAFKVMVGLPTTGGPAPAAVAAPAAEAESKASA

SEQ ID NO: 120415 - protein, 210 aa, Triticum aestivum
  unsure (1)..(210): unsure at all Xaa locations
  Clone ID: PAT_TA_14833.pep
MESLASQARPAAVLWLAGFFQAARLHRVVSFCASSRALSIRIAQCFLLNGLIFLGSLLTLKSVVIPTLLWILPDQCNQTGGHLCEHTAAISIYSFLRSGLVEIFYVLWFYPLYVFSFILSTIWYNDIAKHALDVVKSKRLVLTRALDDHNTTETEEQPEGFDRVALGIGEQVYSILLLTIFFVXVIGYIPYFGKAMNFLLLSLMYAYYCF

SEQ ID NO: 120416 - protein, 104 aa, Triticum aestivum
  Clone ID: PAT_TA_14834.pep
SHVDNSVELIGSLLFGSEDGPRVLKAVRAAGEPLVDDWSCLKSMVRTFEAQCGSLAQYGMKHMRSFANICNAGILPEAVSKVAAQACTSIPSNPWSSIDKGFSA

SEQ ID NO: 120417 - protein, 87 aa, Triticum aestivum
  Clone ID: PAT_TA_14835.pep
DDGQEAARLHLLRQPRPRRRQRLQDAAHSERVPPVGGAGRVAACERALQCDCRNAVIVPRGSLNCFSFLCFFLLVLRVIFFTGAFSL

SEQ ID NO: 120418 - protein, 112 aa, Triticum aestivum
  Clone ID: PAT_TA_14836.pep
RRLPPGLFLARKLSLTRAVFYIIMQCLGAICGAGVVKGFQQGLYMGNGGGANVVAPGYTKGDGLGAEIVGTFVLVYTVFSATDAKRNARDSHVPILAPLPIAALRWLPSTTR

SEQ ID NO: 120419 - protein, 210 aa, Triticum aestivum
  Clone ID: PAT_TA_14837.pep
FGTRLHSQNLQPRGAEEQQVDQEWQRQAPWDFSSAPSFAAAKCQPVASRASARRAPRALFAVRASAADAANKDAVLKAFRENRALKIISGLQNFDRSSVASVVTAADKGGATHVDIACDKDLVKLAMDLTNLPICVSSVDPSAFHSAVEAGAKMVEIGNYDSFYEMGIEFSSEQVLKLTRETRKMLPEITLSVTVPHTLSLPDQMRLAEL

SEQ ID NO: 120420 - protein, 154 aa, Triticum aestivum
  Clone ID: PAT_TA_14838.pep
MQLQLVIFEYLSPMRAGFFLSSVVAVVPATWIGFHFVCLIQALDTFNTAVVSPIYYAMFTTLTILASAIMFKDWSGQRASNIASEICGFLTVLAGTVVLHSTREPDQTVSADLYAPLPPKIYWHIQGNGDVGKQREDDPLTCQFITVVRQDYFV

SEQ ID NO: 120421 - protein, 33 aa, Triticum aestivum
  Clone ID: PAT_TA_14839.pep
TSTYFVMLLNISLRFCCIRTCFQAMNLKLQLLV

SEQ ID NO: 120422 - protein, 129 aa, Triticum aestivum
  unsure (1)..(129): unsure at all Xaa locations
  Clone ID: PAT_TA_14840.pep
KSSVVLRLMSQARPIVAAFSKLKSGVWXKESFKGNEVTNKTLAKLGSGXIGREVTCRMQAFNMXKNGYSPFVSPEVARLFAVKYMALEGLNSGQVAGAALNVYEEEPCKFTELLEHPKVVCAPHLGEKL

SEQ ID NO: 120423 - protein, 92 aa, Triticum aestivum
  Clone ID: PAT_TA_14841.pep
RACGSTCWGRSAPGAAPTTPGRRGPRAPGPDQANEAKSQTRQGDAVQRLVEIIQQQQDVAALRVTSARPSRGSPVLSLVLCICNVSCTVMRP

SEQ ID NO: 120424 - protein, 75 aa, Triticum aestivum
  Clone ID: PAT_TA_14842.pep
GTRQIHHPKSSSSSYIIGVFWFAPFSFSFTLISSYYILVSREYPSTYVLYAAVDLWPRRRVASRVLLLCSTATYY

SEQ ID NO: 120425 - protein, 119 aa, Triticum aestivum
  Clone ID: PAT_TA_14843.pep
METNQSFQYVSALVEGLMKLMEGDHVGPFNLGNPGEFTMLELAKVVQDTIDPNARIEFRQNTQDDPHKRKPDIGRAKELLGWEPKIPLREGLPLMVTDFRKRIFGDQDTAAATTGNQQG

SEQ ID NO: 120426 - protein, 123 aa, Triticum aestivum
  Clone ID: PAT_TA_14844.pep
KFLLTTQLSIEGPIRMKEEYVEGLIEIPRINEESLPEQLKALLGQTAGALQQLPSPIRDAVSEGLKVPLGGAFQRLFMISYLDEEILIIRDAAGAPDVLTRLEGPQPNPGDGTADAVISEYES

SEQ ID NO: 120427 - protein, 159 aa, Triticum aestivum
  unsure (1)..(159): unsure at all Xaa locations
  Clone ID: PAT_TA_14845.pep
WNIVGIEDEGERDPYILVRVHGLHGPLKVRCSTVERVTYGFAAGDWVRLREEDKKRSQVGILHSIGRDGAVTVGLIGMDTLWKGNYSDLQMAQAYCVGQFVRLKAHISNPRFEWQRKRGGGXSQGRISHIHPNGCLVVRFPGKFNLGEVCRCLADPYEV

SEQ ID NO: 120428 - protein, 84 aa, Triticum aestivum
  Clone ID: PAT_TA_14846.pep
MPLAKDLLHPTAIEERRKHKLKRLVQHPNSFFMDVKCPGCYKITTVFSHAQSVVICTGCSTILCQPTGGRARLTEGCSFRKKAY

SEQ ID NO: 120429 - protein, 167 aa, Triticum aestivum
  Clone ID: PAT_TA_14847.pep
MLVYQDLLSGDELLSDSFQYKEIFDGVLWEVEGKWVVKGAVDVDIGANPSAEGGEDEGVDDQTERVVDIVDTFRLQEQPTFDKKTFVTNIKRYIKNLTGKLEPEKADEFKKGIEGATKFLLSKLKDLQFFVGESMHDDGSLVFAYYKEGATDPTFLYFAHGLKEIKC

SEQ ID NO: 120430 - protein, 48 aa, Triticum aestivum
  Clone ID: PAT_TA_14848.pep
KLELWLRVLNCDYVYELEPTRLLSIELVFFGAVARPGEGAGLINQLFG

SEQ ID NO: 120431 - protein, 184 aa, Triticum aestivum
  Clone ID: PAT_TA_14849.pep
MAVATLNGCRDEDDSSCSSESSESECEGQLVRMSRCTTITTPEMPSPSTGLPIIVPQIPAPLAPEPSQPLEPVTVVQATRVSSVAVAETSTTSRIEVCMGGKCKKAGALALLQEFEKTVGTEGAVVGCKCLGKCGLGPNVRLRSDISAEGSAKGSPLCIGVGFEDVSTIVAGLFGDADLGMTPT

SEQ ID NO: 120432 - protein, 215 aa, Triticum aestivum
  Clone ID: PAT_TA_14850.pep
HEARSARATRLVARAGGVDDLPLVGNKAPDFEAEAVFDQEFINVKLSDYIGKKYVILFFYPLDFTFVCPTEITAFSDRYEEFEKLNTEVLGVSIDSVFSHLAWVQTDRKSGGLGDLKYPLISDATKSISKAFGVLIPSQGIALRGLFIIDKEGVIQHSTINNLAIGRSVDETMRTLQALQYVQENPDEVCPAGWKPGEKSMKPDPKGSKEYFAAI

SEQ ID NO: 120433 - protein, 183 aa, Triticum aestivum
  Clone ID: PAT_TA_14851.pep
IRTRGVWHPDEHEPLLRRLRAASCEAAPRLRGASRNSARDLLEWTRRGSGLRAILVISVGTITLIALTGLLIFMFFLLVATANAVIVSVLMSLAAAGGFLAIFFACLVAVYIGAVSAAIFAISATVISAVVGVMIATGWVGFFWMIWFAARKSMDLTKHSIGVTSSAIQSYSASRHVNQKPVD

SEQ ID NO: 120434 - protein, 63 aa, Triticum aestivum
  Clone ID: PAT_TA_14852.pep
DSDEGGPPPLAGAEDALAGRRGKPLTRPWCSGSLSVGVGSYGSGKDGETVDPFNAVAAVILLP

SEQ ID NO: 120435 - protein, 141 aa, Triticum aestivum
  Clone ID: PAT_TA_14853.pep
PQVQKITNNIQFILETVMLSNVVEVQGDKLRRRGAWENWLLPKQNYSAGSSSGSLSPVTSNIDSLASQFRSVGFEGATYHANMPGMHGEALLTRSAASVSLGYHASTFGGLQSNGSGPLFGPKSARNLLRSDTFGGYIFKK

SEQ ID NO: 120436 - protein, 195 aa, Triticum aestivum
  Clone ID: PAT_TA_14854.pep
MVHVSFYRNYGKTFKKPRRPYEKERLDAELKLVGEYGLRCKRELWRVQYALSRIRNAARHLLTLDEKNPRRIFEGEALLRRMNRYGLLAEGQNKLDYVLALTAENFLARRLQTLVFKAGMANSIHHARVLIKQRHIRVGRQIVNVPSFMVRVESEKHIDFSLSSPFGGGPPGRVKRKNLKKASGGGGDGGDEDEE

SEQ ID NO: 120437 - protein, 167 aa, Triticum aestivum
  Clone ID: PAT_TA_14855.pep
ARIERVIFACRFMTFLGIGGLLLGSVPCFLKGSVHVMNAFVDYYLHGGGKLILMLLEAIEMFLIGTVTFVLGIGLYELFISTIDSSYGSNLFGLFSLPDRPKWVEIKSLDDLKTKLGHVIVLVLLVGIFEKSKRVTITSCTDLLCFAGSIFLCSVCLYLLSRLNTSK

SEQ ID NO: 120438 - protein, 78 aa, Triticum aestivum
  Clone ID: PAT_TA_14856.pep
GYAGLNWKDHVVIDKKYFRPSEVDCLQGDSSKSRRVLGWKPKVGFQQLVEMMVDNDIELAKKEKVLVDAGYRDPKQHP

SEQ ID NO: 120439 - protein, 170 aa, Triticum aestivum
  Clone ID: PAT_TA_14857.pep
ADAEAVPRSLAPPRRVALVTGITGQDGSYLTELLLSKGYEVHGLIRRSSNFNTQRLDHIYHDPHATPSAALRPPMRLHYADLSDSSSLRRALDHVLPDEVYNLAAQSHVAVSFEVPDYTADVTATGALRLLEAVRLSAKTKPMRYYQAGSSEMFGSTPPPQSEATPFHPR

SEQ ID NO: 120440 - protein, 666 aa, Triticum aestivum
  unsure (1)..(666): unsure at all Xaa locations
  Clone ID: PAT_TA_14858.pep
QPAGIPATACNTTSGDNKSHHDLLPGSKPYRLPTPAYRTPVQRRDHKRRNEARKGSCLADAXLVAVSFAQSSVSLSVVFPKQQPALKAIYNAGKRDPQASDPSVDHAKNPHFLVLLSGGLALRRPRGAEHLRGPGLVLANGQRAGAPADTVEQAERACDCDVGGVVGDTANEDGDLRVAGNFXTMVSAPAFSHMTPISNVASKSVSSMQTSXTIDISQEAKAAGVVVDVGQSXMSXKLEEVRPGGPTYVSILKNISXKVAPFLPSDAXLPAPPSATPIGVHLCNMISSGMTSTPAVISSISGTVQPIGAQQLVQNTALGSFGSNTSTVSGNSNIAVSSSLANIQSNMAMGQSVPSMAQGGLMAGPQSGQGGIGTNQNTINNLGTTAISSTPTMMPTPGMVQQTGVNALSANNSSAMNMPLAQHPNGQQPSKYVKIWEGTLSGQRQGQPVFICKLEGYRSGTASDTLASDWPETMQIVRLIAQEHMNNKQYVGKADFLVFRTLNQHGFLGQLQEKKLCAVIQLPSQTLLLSVSDKAGRLIGMLFPGDMVVFKPQVSTQQPQMQPQQQQQQQQLQQQQHQIQQQQQQLQQLQQQQLQQHQMQMQPQGQQLQQQQQMQQMQQQQQQMQQMQHQQQQQQQQIQQQQHIPRRQQQIQQQQQMQQQQQQQQQ

SEQ ID NO: 120441 - protein, 158 aa, Triticum aestivum
  Clone ID: PAT_TA_14859.pep
QFAALAALSQNPGQVRDDALLDFYNKWQHEYLVVSKWFALQATSEIPGNVANVQKLLSHPAFDLRNPNKVYSLIGGFCGSPVNFHAKDGSGYKFLGEIVLQLDKINPQVASRMVSAFSRWRRYDKTRQDLAKAQLEMIVSANGLSENVYEIASKSLAG

SEQ ID NO: 120442 - protein, 166 aa, Triticum aestivum
  unsure (1)..(166): unsure at all Xaa locations
  Clone ID: PAT_TA_14860.pep
FGTRDVYKALXNLRSGNQNLKVGLLNFNSTEYGSWTQLLSDSHVSIIRLEHAKDSITWQTLYPEWIDEEEETEIPSCPSLPEPDVRRDVRFDVIAVKLPCTHVAGWSRDVARLHLQLSAAKLAVTSSKRNHKVHVLFVTECFPIPNLFPCKNLVRHEGNAWLYSPD

SEQ ID NO: 120443 - protein, 160 aa, Triticum aestivum
  Clone ID: PAT_TA_14861.pep
FGRGGVALPRNEAFVVVCESSRFRCMKVWLKGEKAGKAETFVDLPGCPDNIRLGSDGHFWIALIQLRSPWLDFITRWTFTKRVVASFPGLIEWSKGTAKGAMVAQVTEDGNIVRILDDSEGKVINFLTSVTEFNGDIFLGSLATNFVGKLSLAQVIQQEQ

SEQ ID NO: 120444 - protein, 176 aa, Triticum aestivum
  Clone ID: PAT_TA_14862.pep
SAPASSPAAGAAMGRGKFKGKPTGLRNFSTPEEIAAGTSGRPRTFKKKEEEEEEEHEEREESEEEESEDESDDKPKHKGTEGIIQIENPNLVKAKNIKAKEVDLGKTTELSRREREELEKQKAHERYMKLQEQGKTEQARKDLERLALIRQQRADAAKKREEEKAAKEQRKSEARK

SEQ ID NO: 120445 - protein, 120 aa, Triticum aestivum
  Clone ID: PAT_TA_14863.pep
RGPRQCRRGGLPQQIERRHRPRRQRGLGYILGGGSSAHQCSSSLSDSGNNWIRRPLHRPPGRPPSASASSNRRRQPRRRRGRGATTSSRACDPPPPDPGVAAGMVEAARRSWYRWWWTRS

SEQ ID NO: 120446 - protein, 349 aa, Triticum aestivum
  Clone ID: PAT_TA_14864.pep
RPEISKIPARRFTQVVTKSVEKLYGRQVLSHVNLGNYLASKIPSLRNYSNGQKNGDSKFSSLQALSSAMQLLHKHEFRDQHNEWINSAKSAVDASIVGNLSDDGDSTINIVQDARKEVRLALNTLLKDDGILVIPTALGCPPKLNARELSSTSYNAETLCLQSLSSMSGCCQVTVPIGTHDKCPISVSFIARHGGDRFLLDTTQAIYATIQEQVEILAKSNPSSKEAMNEEAAEAAKEKGNSAFKEKQWQKAINLYTEAIKLNGKVATYYSNRAAAFLELANYRQAETDCTSAIDIDPKIVKAYLRRRTAREMLGYYKEAVDDFSHALVLEPMNKTAGVAINRLKKLFP

SEQ ID NO: 120447 - protein, 138 aa, Triticum aestivum
  Clone ID: PAT_TA_14865.pep
LQGKHPWSTVRLTPISCHCCCVSAGVVAAMAASKPILYSAWISSCSFRVRIALNLKGVDYEYRAVTRNDLDYEKINPIKYVPALVDGDFVVSDSLAIILYLEDKYPQHPLLPQDLKKKAINLQIANIVCSSIQPLQCY

SEQ ID NO: 120448 - protein, 88 aa, Triticum aestivum
  Clone ID: PAT_TA_14866.pep
LALRHGPCFVLPCSGGCTAPRRDPIRGLFPCTRIIQFHSHIVMFYLYFCRAITDSAPRWRHRRVVLPLVLVCLCVATLAQPAEAPACT

SEQ ID NO: 120449 - protein, 184 aa, Triticum aestivum
  Clone ID: PAT_TA_14867.pep
MQRFNFATVMEAPVIFFCRNNGWAISTPTTEQFRSNKTWSSYSSMAATSEQCNAMLKFASSGGRPVLVAAPTLRGALLSASVASTLFRPVGAVQPARAAAVPVARPSLGVQRTDRGAHPAASELSTRVRPVLLQAIQVAERMPKPPVADLFTDVYDKIPSNLCEQEQLLRDTIMKHPADYPTDV

SEQ ID NO: 120450 - protein, 169 aa, Triticum aestivum
  Clone ID: PAT_TA_14868.pep
MAPTVMASSATAVAPFQGLKSTATLPVARRSTTSFAKVSNGGRIRCMQVWPADGNKKFETLSYLPPLTEEQLLKQVDYLLRNNWVPCLEFSKEGFVYRENSTSPCYYDGRYWTMWKLPMFGCTDASQVYKELQEAIASYPDAYVRILGFDNIKQTQCVSFIAYKPAGSE

SEQ ID NO: 120451 - protein, 124 aa, Triticum aestivum
  Clone ID: PAT_TA_14869.pep
NKQMHQQYRRSIKAKSLPEWAPHEATEGPGERALFNNQQWRHSHLAAQSCEALHACLRFLFYRFRLIFSFTWSAGFHSTKQTKKKRRAVCSSDTAAVSDVLTWKHLACKLSHALRGKFSRLARV

SEQ ID NO: 120452 - protein, 184 aa, Triticum aestivum
  Clone ID: PAT_TA_14870.pep
NPRRQGSLLAALPFPAQKPVRTDASPTAWTGTEPPYFSLSRRLALSSLLVPGPQLSTPSHLLPPPSPGLARTLLDRRLPSTYHTYHHTYRPSPPLPLSPAPSNPPASAIEPCPPIRIRSRRATPSAEAKRAASGSPPPRPPPSALRRWCWIGVEIHPDLFLLLLISARLISGHIEYKAFSYGFC

SEQ ID NO: 120453 - protein, 59 aa, Triticum aestivum
  Clone ID: PAT_TA_14871.pep
RALVEELSRVGKREEADRLAREMEQKGIVSARELRALLSSIRNDDDDNLDVDDSGRNTW

SEQ ID NO: 120454 - protein, 140 aa, Triticum aestivum
  Clone ID: PAT_TA_14872.pep
MANPRVFFDMTVGGAPAGRIVMELYANEVPRTAENFRALCTGEKGVGKSGKPLHYKGSTFHRVIPDFMCQGGDFTRGNGTGGESIYGEKFPDEKFVRKHTGPGVLSMANAGPNTNGSQFFICTVPTPWLDGKHVVFGQVV

SEQ ID NO: 120455 - protein, 167 aa, Triticum aestivum
  Clone ID: PAT_TA_14873.pep
KGLELLKKNRDMTFGEVKLTIMIEDPRDIERKRTLGIEDPDEITRDDLADALAEVNEGRIPENRVALQLLAKEMSEWPDIEIEAPKKKSKPGKSVYAKATDTGIDPETAAKRLNLDWDSAADIDGEQEDDDETEVPSAVGYGALYLLTAFPVIIGISGGLILFYNSL

SEQ ID NO: 120456 - protein, 197 aa, Triticum aestivum
  Clone ID: PAT_TA_14874.pep
HTFERRLRLGGPLLKNNIATMVLESPYYGQRRPSMQRGAKLQCVSDLLLLGKATIDEARSLLYWLQTEAGYSKMGVCGLSMGGVHAAMVGSLHPTPIATLPFLAPHSAVVPFCEGVYKYATAWDVLREDAAALTQDVTSLAEDAAQKTGITIEQVRDRLRSVLSLTDVTRFPVPKNPQAVIFVGATDDGYIPRHSVM

SEQ ID NO: 120457 - protein, 56 aa, Triticum aestivum
  Clone ID: PAT_TA_14875.pep
ACCTTLLCSSAHTLSSTDFHRCFFADSAAQRYCALLLILLSALIVSQHSFVDYLKD

SEQ ID NO: 120458 - protein, 65 aa, Triticum aestivum
  Clone ID: PAT_TA_14876.pep
RGPNRCSTCRKRVGLTGFNCRCGNLYCALHRYSDKHDCGFDYRTAARDAIAKANPVVKADKLDKI

SEQ ID NO: 120459 - protein, 69 aa, Triticum aestivum
  Clone ID: PAT_TA_14877.pep
MDAVDSVVDPLREFAKDSVRLVKRCHKPDRKEFTKVAIRTAIGFVVMGFVGFFVKLIFIPINNIIVGSG

SEQ ID NO: 120460 - protein, 69 aa, Triticum aestivum; identical to SEQ ID NO: 120459
  Clone ID: PAT_TA_14878.pep

SEQ ID NO: 120461 - protein, 69 aa, Triticum aestivum
  Clone ID: PAT_TA_14879.pep
MDAVDSVVDPLREFAKDSVRLVKRCHKPDRKEFTKVAARTAIGFVVMGFVGFFVKLIFIPINNIIVGSG

SEQ ID NO: 120462 - protein, 87 aa, Triticum aestivum
  Clone ID: PAT_TA_14880.pep
MAMRALYNEIRAMKVRDVPAYLKPRLTWENVKKSTDQAVDRYIEKYIETSSVDPLFHVCFGGMAFAYLVGLPQERRHLEHLEKHGGH

SEQ ID NO: 120463 - protein, 112 aa, Triticum aestivum
  Clone ID: PAT_TA_14881.pep
GYEMAQADTKATGASGGSPELCLLDTSGCSGPPPGRCRSFRFGPVWGGLRSAGTPRALQSRDARWSRPRAAGAATSATPSSLCLVGVGGLRVRAGEGLGGGGGGGRRQCVAM

SEQ ID NO: 120464 - protein, 155 aa, Triticum aestivum
  Clone ID: PAT_TA_14882.pep
SDEGTLSDLGGGKGTAGSDENSEDDDEWAPPPEYFTGGETSGMVVRDRSKRKNNTDEVFKQAKRKGAKQGPFEARRRSSSRNFTGTGRLLTGETVERDAPQPPEEIVHNIYFWRNGFTVNDGPLRSFDDPANASFLKSIKDSVCPTELDPADGKS

SEQ ID NO: 120465 - protein, 145 aa, Triticum aestivum
  Clone ID: PAT_TA_14883.pep
MVYAVVTDAPKKQPLYWPTTVASKNQQINIFHLSCLTYHLFCISYLNNCLYSNLQCNSNRGSIVVMAMVMLATTTCNSNRRMKVMADRCNEMAILNMYRTHTTAVWNKVNKLCSMPQSIPVFLFVHVTEPVDNVQVKLVFFNEVG

SEQ ID NO: 120466 - protein, 95 aa, Triticum aestivum
  Clone ID: PAT_TA_14884.pep
MEGFKGRRNKPNDTCYAFWVGGVLKILGAYHLIDRCALRGFLLTCQSPYGGFTKFPDDRIPDIYHSYYGLAALSLLEEDGLEPLHVDLGILSAAL

SEQ ID NO: 120467 - protein, 83 aa, Triticum aestivum
  Clone ID: PAT_TA_14885.pep
EASRGGGLLSQAGSGSGLTWFAASAPVLSVASLVPLLKGDSAEARSGAVMSADAELWNGRFAMLGLVALAFTEYLTGAPFINA

SEQ ID NO: 120468 - protein, 130 aa, Triticum aestivum
  Clone ID: PAT_TA_14886.pep
MVRVSVLNDALKSMYNAEKRGKRQVMIRPSSKVIIKFLTVMQRHGYIGEFEYVDDHRSGKIVVELNGRLNKCGVISPRFDVGVKEIEGWTARLLPSRQFGYIVLTTSAGIMDHEEARRKNVGGKVLGFFY

SEQ ID NO: 120469 - protein, 118 aa, Triticum aestivum
  unsure (1)..(118): unsure at all Xaa locations
  Clone ID: PAT_TA_14887.pep
PGCRGQIEEAVERKVPEYRAQMEAEFQKEVAESSGASAAHVTRLXEETAAKNEQQTQQATSISPEDTHMLLWHVPTGKNCGELFPKYTPKFVPSIFFCLSRVRVGRYHVPIIILNSYG

SEQ ID NO: 120470 - protein, 77 aa, Triticum aestivum
  Clone ID: PAT_TA_14888.pep
SDAGGLDFNPLVFDNSYFKELLSGDKEGLLQLPSDKALLSDPAFRPLVDKYAADEKAFFEDYKEAHLKLSELGFADA

SEQ ID NO: 120471 - protein, 81 aa, Triticum aestivum
  Clone ID: PAT_TA_14889.pep
MSRSGQPPDLKKYMDKKLQIKLNANRVVIGTLRGFDQFMNLVVDNTVEVNGNDKTDIGMVVIRGNSVVMIEALEPVAKSQQ

SEQ ID NO: 120472 - protein, 93 aa, Triticum aestivum
  Clone ID: PAT_TA_14890.pep
MHVGCEVYNRGSGAGTSGLVPVAARGKVSGKKIPLVFAGRRPGDAEIVYAATAKAEKDLKWKAKYGIEEMCRDLWNWASKNDSDEAGSQDNGK

SEQ ID NO: 120473 - protein, 205 aa, Triticum aestivum
  Clone ID: PAT_TA_14891.pep
AVPAILTAIKEVQNGTARSSRHAVPYMEGLVGTLVRLTATLYSPEVLKAAMDHNLASVLTDLLDGAAGSDEVQRLAAVGLENLSYLSIKLSQPPPDELQSKKNTILKLLKDSKAHNNNKKSSHHQLNVCPVHRGMCSPATTFCLLEAGAVEGLLGCLENDNIRVVEAALGALSTLLDERVDVVKSVVALAELDAARCVLAALRQH

SEQ ID NO: 120474 - protein, 151 aa, Triticum aestivum
  Clone ID: PAT_TA_14892.pep
AGAQARHRIFHEELVVKAFFEAEKAHHGQTRASGDPFLQHCVETAVLLAKIGASATVVSAGLLHDTIDDSFVDYDHIFHMFGAGVADLVEGVSKLSHLSKLGRDNNTASRTAEADRLHTFLCAMSDARAANKVSASRVHNMDTRSLAFGQT

SEQ ID NO: 120475 - protein, 376 aa, Triticum aestivum
  Clone ID: PAT_TA_14893.pep
MRGGGGLRPAPPQGVARGSEERVVEWARGFGRARRVDVREQVCYGNMHPVAHPARKAQSAGQCDEALIASAVDTLDEGLREAGISYHNLSGRNKNLYSVYSKMQKKNLTMDEVHDIHGLRLVVDKEEDCYRALDVVHKLWPQVTGRFKDYISRPKLNGYRSLHTVVMSDGDHTFEVQIRTKEMHLQAEYGFAAHWRYKEGSCRHSFVLQMVEWARWVLTWQCEALNKEHSSSQVKSDSIKPPCPFPLHSEECPYSYTRQCNHDGPLFVILLEHDKMSVQEFPAGSTVMDLMHRVGANSPRWSPYSIPMKEDLRPKVNHEPISDLGRALSMGDVVELTPALPDKSLTEYREEIQRMYDRGGFALAATRSGSGGSRRR

SEQ ID NO: 120476 - protein, 158 aa, Triticum aestivum
  unsure (1)..(158): unsure at all Xaa locations
  Clone ID: PAT_TA_14894.pep
RHEDLFGMLQGTRSALYANDRESISVTVQEVTPRAVGALVALYERAVGIYASLVNINAYHQPGVEAGKKAAGEVLALQKRGLTVLNEATCENPGEPLSIDEIADRCHCPEEXIEMIYKIIQHMAANDRALIAEGSCGSPRGVKVYLGECDVDEDMQAA

SEQ ID NO: 120477 - protein, 86 aa, Triticum aestivum
  Clone ID: PAT_TA_14895.pep
LQSSVGPSTALSAPSDSNKRGNQQISAPAASGASNYSRQKTGKLVFGSSASNNKEPQKAPVKEEEPAKKDEPRFQAFSGKSYSLKR

SEQ ID NO: 120478 - protein, 84 aa, Triticum aestivum
  Clone ID: PAT_TA_14896.pep
MANARSGVAVNDECMLKFGGAPARRGRPPLPPSMMDDKFKEIVVDQGGGGATSNDDDINSPHAEKTCAMRDIIFASLVQLQSKM

SEQ ID NO: 120479 - protein, 62 aa, Triticum aestivum
  Clone ID: PAT_TA_14897.pep
MSDKCGNCDCADKSQCVKKGTSYGVVIVEAEKSHFEEVAAGEENGGCKCGTSCSCTDCKCGK

SEQ ID NO: 120480 - protein, 185 aa, Triticum aestivum
  Clone ID: PAT_TA_14898.pep
SKTRENLQIIDARNSDLIEVNKTEFMTPSAFIFLYENNLFLTFCNRTVAAWNFRGELVTSFEDHELWHPNCNTNNIYITADQDLIISYCKISKQSTDCADSEAGEVSSMGSINMSNIFTGKCVAKISPSDPTLTIAPRKRGGNSRSTIHSTVPEALEDITALFYDEDRNEIYTGNSKGLVHVWSN

SEQ ID NO: 120481 - protein, 205 aa, Triticum aestivum
  Clone ID: PAT_TA_14899.pep
MREEVRSSSAAPPDPPPGRSASPPPTPVASSAGASSPPAQTNVASIDWLGSDQVPKAGSSHIAPPTSQPALSTNANGAAVDCFQSSCRPWERGDLLRRLATFKPSTWASKPKAASSLACARRGWVNIDMDKIECESCGAHLIFTALTSWSPAEVASAGGAFAEQLDASHPNDCPWRGNSCADSLVQFHLTPSALVGGFKDRCDGL

SEQ ID NO: 120482 - protein, 67 aa, Triticum aestivum
  Clone ID: PAT_TA_14900.pep
GGGAGAVVVLRVRGCGRFGAYCSRRPARCRLDAAEVDFSYDDDTGLVALHIPVPEQEFYRWDLEIDV

SEQ ID NO: 120483 - protein, 146 aa, Triticum aestivum
  Clone ID: PAT_TA_14901.pep
NGEKEKETEVAEKRWKILVWKTAVYLITLGMLIALLMGLNMSWTAITAALVLLALDFTDAQACLEKVSYSLLIFFCGMFITVDGFNKTGIPNTLWELVEPYSRIDSARGVALLAVVILILSNVASNVPTVLLLGTRVAASAAAISH

SEQ ID NO: 120484 - protein, 195 aa, Triticum aestivum
  Clone ID: PAT_TA_14902.pep
MGVEVCVKAAVGHPDTLGDCPFSQRVLLTLEEKKVPYEMKLIDVQNKPDWFLKISPEGKVPVFNGGDGKWIPDSDVITQVIEEKYPTPSLVTPPEYASVGSKIFSCFITVLKSKDPNDGSQKALLTELQALEEHLKAHGPFINGQNISAADLSLAPKLYHLQVALEHFKGWKIPEDLTNVHAYTEALFSRESFIK

SEQ ID NO: 120485 - protein, 152 aa, Triticum aestivum
  Clone ID: PAT_TA_14903.pep
VTVGSVKKNTQGVLPSKWEAKQYISTVHTNRTPAPLNAAACPRHNPPADSAVQGRDQDTWGASNLEGVSMPIMHMSPDIRMMRSTIPTKVPSRSTRLDEALAIAFFALGQAFVPLVLFSARCLPSGRPEGLCNKADGLDSYRNVHLAPDNFR

SEQ ID NO: 120486 - protein, 235 aa, Triticum aestivum
  Clone ID: PAT_TA_14904.pep
EASFEEGRRQVEVSYDPQARFNQIADQIDKDAGMTRLNLFSPCKINVFLRITGKRPDGFHDLASLFHVISLGDTIKFSLSPSKSRDRLSTNVPGVPVDESNLIIKALNLYRQKTGTNNFFWIHLDKKVPTGAGLGGGSSNAATALWAANQFAGCIASEKDLQEWSGEIGSDIPFFFSQGAAYCTGRGEIVQDIPNPLPENLPMVLIKPPEACSTAEVYKRFKLEQTSQADPLTLL

SEQ ID NO: 120487 - protein, 122 aa, Triticum aestivum
  Clone ID: PAT_TA_14905.pep
RQKAKTVLDERTVTDEPDSMSPYEPDSVIEPENISLEDLDDILDDDEESDTDEPDDEYPEPSLEITDVTDTDELHENNSTESSDLTSLKVAELRELAKSRGIKGYSKMKKNELIEVVSSSMA

SEQ ID NO: 120488 - protein, 101 aa, Triticum aestivum
  Clone ID: PAT_TA_14906.pep
MAQYYSEVDHCAEEMNWPPHAGGEHYAVRRESYEEVDEMARAGRGHHHGGGGGGHLGYSGSRHGDAHLGGHREEHLVHGDEHRHGHGGGRQYDSCTGQYYG

SEQ ID NO: 120489 - protein, 203 aa, Triticum aestivum
  Clone ID: PAT_TA_14907.pep
MASSRNPDALAAPALTPAPAAVAQAQNPSIAPGDPPSPEMETTAEALTREEVLRRRRRRAARLAGVYRRLYWAMAEEVRARHRQYVWDLARSPLEAEQPPAPPGVPIPAAGEPPRPAPVPRRKKCGFTGCKVRAMATTRFCHSHVLSDPKQLLYKPCAYITKSGLQGGLVTCGRPIIKSAAPSLCNIHLQRCQKSIAQAYRKV

SEQ ID NO: 120490 - protein, 102 aa, Triticum aestivum
  Clone ID: PAT_TA_14908.pep
SWYAHCPVHSRVQPVPIHPNSYHQNSSRVPLLPMHSSLAQHDWVKCTTRDAVVSQQVELRVQKLPDLVIVLAEWALNDDLLRPCAALLARISNLAARGLVRI

SEQ ID NO: 120491 - protein, 76 aa, Triticum aestivum
  Clone ID: PAT_TA_14909.pep
MGGALDLRRRRRLASRPGGRASGLGGAGEAGGDGGVVHGVVEGLGLRHPRTQLPGLLLRQATHELPAERARPSCRI

SEQ ID NO: 120492 - protein, 91 aa, Triticum aestivum
  Clone ID: PAT_TA_14910.pep
RHEATGCLARSSSIPEKSAGGVLLPKSAVKFERYLVGEILSVGADVSEVEAGKKVLFSDINAYEGDLGTDEKHCFCRESDLSALVEWNFIP

SEQ ID NO: 120493 - protein, 164 aa, Triticum aestivum
  Clone ID: PAT_TA_14911.pep
SDEDGPKVIVSEYAVTGSDAGRGTLIAALAEAAFLIGLERNSDMVEMASCAPLFVNDNDQRWNPDAIVFNSWQHYGCPNYWMLHFFKDSSGAALHPSTIQLPNYDQLVTSAITWNNPHDGNTYLKIKVVNFGSKAVNLNISVTGLEADIQTFGSLKTVLTSGWL

SEQ ID NO: 120494 - protein, 398 aa, Triticum aestivum
  Clone ID: PAT_TA_14912.pep
MEGVEEIVIAGAGLAGLATALGLHRKGVRSVVLESSATLRASGYAFTTWTNAFRALDALGVGDKIREHHLLYERLVAFSASTGEAAAKLSLKMQGKSGPHEIRCVKRNFLLETLENELPEGTIRYSSKIVAIEEEGNVKLLHMADGSTIRANVLVGCDGVNSVVARWLGLPKPILSGRSATRGLAEYPDGHGFGPEMLQFIGQGFRSGVLPCSDTSVYWNYTWYPSPADGDAEESVDKMRQHVLARLRAAKIPAEALDVIERSEMSDVVSSPLRFRSPLALVRGSICRGGVCVAGDAFHPMTPELGQGGCAALEDGVVLARCLGEALGAGGHGSAEAALAKYAGERRWRAVRLVTAAYFVGFVQQSSNPAIKFLREKFLSGLLARVMVDMADYDCGKL

SEQ ID NO: 120495 - protein, 203 aa, Triticum aestivum
  Clone ID: PAT_TA_14913.pep
MEGVVEEIVIAGAGLAGLATALGLHRKGVRCVVLESSATLRASGYAFTTWTNAFRALDALGVGDKIREHHLLYERLVAFSASTGEAAAKVSLKMQGKSGPHEIRCVKRNFLLETLENELPEGTIRYSSKIVAIEEEANVKLLQMADGSIIRANVLVGCDGVNSVVAKWLGLPKPIVSGRSAPRGLAVPGLPMRPKTVERKRVS

SEQ ID NO: 120496 - protein, 176 aa, Triticum aestivum
  unsure (1)..(176): unsure at all Xaa locations
  Clone ID: PAT_TA_14914.pep
ERRLTLSLIDHHNVXISSYCSFVAVAGHNLLVVMPFMPEGSRLHLMMVAYXDGFEDPVIASILNETLKALDYPHSQVHIHRDVKVISLXNPSVVKLGDFGVSACIFDRGDRQRARSTFVGTPCWMAPEVLQPGTGYDFKADLWSFVITALKLAHGHAPFSMYPAMKGLLMTLQNAP

SEQ ID NO: 120497 - protein, 181 aa, Triticum aestivum
  unsure (1)..(181): unsure at all Xaa locations
  Clone ID: PAT_TA_14915.pep
FGTRIVPAAAMATDGAASDAGSKKKLLIFDSEEDLAVSLAKYTAELSEKFAAERGAFTAVLSGGSLIQALRKLTEPPYLDSVDWSKWHVFWVDERVVRKDHVDSNYKLAFDGFLSKVPIPPGQVYAINDALSAEGAADDYEACLKQLVKNGVISMSAATGFPQVDLQLXLGMGPDGHIASL

SEQ ID NO: 120498 - protein, 174 aa, Triticum aestivum
  unsure (1)..(174): unsure at all Xaa locations
  Clone ID: PAT_TA_14916.pep
AETAGLLLRELELQPPSEKWHRRNMFGGPWSEPDDLGXLDNMPHLKIGGHINPHLSDMEEEGKTNFGIQSLWPRKRRLSERDAGIGARATRRMRICRVHRGAYLGVMGSRRDVITAVWKTGLDGEWYKCIRCLRQTCAFAQPGAPNMANEREAWWISRWTQACPMCGGSWVKVV

SEQ ID NO: 120499 - protein, 178 aa, Triticum aestivum
  Clone ID: PAT_TA_14917.pep
VSYLPSTAVSWEFGSFDVCQANSTGGLGTSADAWAATDSKNLKVKLVLLGDSGVGKSCIVLRFVRGRFDPTSKVTIGASFLSQTLALEDSTTVKFEIWDTAGQERYAALAPLYYRGAGAAIVVYDITSAESFNKAQYWVKELQRHGSQDMIMALVGNKADLHEKRTVSSQEAQEHADM

SEQ ID NO: 120500 - protein, 89 aa, Triticum aestivum
  Clone ID: PAT_TA_14918.pep
IRTSAPSSVPRPLPPSPPPSHRPPPHRAPGRAGCGPRVPRRRHAPPPPSPASPRASLPCRSAPAPLLPAAPPLLRCSMPPCRFYLLKTG

SEQ ID NO: 120501 - protein, 243 aa, Triticum aestivum
  Clone ID: PAT_TA_14919.pep
DSARGTDSAFWSAADNVLKVTGPLISVLYKLEKDNCPVSVLYDAMDSAKESIKKNLGHEHGKYWQMIDHIWDNYLHSPIHAAGYILNPGLFYADRYRHDSEISSGITTCIIRVARSHYHALHVAEQIDLYQRRSGLFDSDLAIQEATGTPQDVWWEKHGSGTKELQSFAARILGQTCFGATRYNLDKSLTERLHTEKRSLADQERFRNMEYIHYNLRLVNAVPRLNGPKHGKVTAQLSDWVSA

SEQ ID NO: 120502 - protein, 100 aa, Triticum aestivum
  Clone ID: PAT_TA_14920.pep
SARGQNIDSIAMDPSAIAIVCWKGKTNLCVMVSPLDGKELLERICLRYGLKIPKADDVKPSMKIDGSDEQPDLSTEAVDPEAVPESKASDMEIADAKEVE

SEQ ID NO: 120503 - protein, 198 aa, Triticum aestivum
  Clone ID: PAT_TA_14921.pep
MGGGKDKHDESDKGLFSNMMHGVAGGHGYPHQGYPPQGYPPPQGAYPPPPGAYPPPPPGAYPPPPGAYPPQHGYPQPGGYPPQSGYPPAGYPGSSHQGYGSSHGGSHMGMGTVLAGGAAAAAAAYGAHKLSHGHSGHGGHGVFGGGYGHGGYGHGYGGHGKFKHGHGGHGKFKHGHGKFKHGKHGHGMFGGGKFKKWK

SEQ ID NO: 120504 - protein, 134 aa, Triticum aestivum
  Clone ID: PAT_TA_14922.pep
FGTRQTVRVAVTRPRTSRTRQEKDAEEEVLVVEGIEVADHFSARGKFDVFVNECQGGGGMGAAVAQCAGSVAMTPHLVRPGKGRGSVKTAARFGICDLLDSIGADGDKTIVVSLVPRCAGDMVTVGGVRIEYVK

SEQ ID NO: 120505 - protein, 100 aa, Triticum aestivum
  Clone ID: PAT_TA_14923.pep
RWRILPCRTGSPLLMILIGFQQDGWSIRTHAEQKNPSPTPPADQYSQRTLLLAGNPHRAVATFFVWPSRRNRRFWHADYSYYVQRSSLSLFMSHGLYSTL

SEQ ID NO: 120506 - protein, 185 aa, Triticum aestivum
  Clone ID: PAT_TA_14924.pep
MFAGKRCCTFTWLYILFQIFLHLSNIFRLPSFELIIFLLSDPSHHGIRKEHPVFLRENQCCAGGMDFITMIFTLSAIPFDIMPTTIEQCVSVLKPGGLLLFRDYGLYDMTMLRFLPHQRVGFREYMRSDGTFSYFFSLDTVRELFHAAGLVELELEYCCVKSVNRKKGKTMQRVWVHGKFQKPPT

SEQ ID NO: 120507 - protein, 513 aa, Triticum aestivum
  unsure (1)..(513): unsure at all Xaa locations
  Clone ID: PAT_TA_14925.pep
MEITINSLTYKGSIPDAINQSRRKKKLFVIYISGQDETSSSLEQSTLVDEHVAAVISRCCIFLQLKQGDVDALQFSAIYPQKSVPSISVVGLSGAMLWNHEGYISPEDLKESIDKAWAALQLQETAATLLAASLASRMSEPANTASTTMPGEDGSSTSENHSNSSGQSSESSAVRGFANSTALVAQPPSSTSHAELLKTSKIPKSDSAPCNITAEEKLDSACQALLPDFPASQMWTFHSSKSDRQYTFAKKEEYGXGNSTKVPSKPASSIPTRSTPQLPVEQDKATTSRAIEVTTDSAKTDDIQLAIRMPDGPSLQIKLTKEDVLRKVKTFVDENQDSGIGSYNLAMLYPRKVFTEQDLETTLYELGIETRQALVVVPNRQSVKVARHQSSLPSSDLDRTGATDRSGGWGFLGAALSYVNPLSYLRGNPTPSNPDQLGNEGSQQYRPSSQSQPLRGDGSQQTATHSSGNTLRRRPQQFGGNIHTLSSEEQDPSDNRNVFWNGNSTEFGGDEKK

SEQ ID NO: 120508 - protein, 113 aa, Triticum aestivum
  Clone ID: PAT_TA_14926.pep
YYPLAGSSDLSDDASSLECSTCKKSYPNKQDYWDLTVSVGSIEYSESMPAATELFRTPLVSFLYERGWRQNFIWGGFPGLEREVMLLNYVVFIRMFNCISEISIFQSSLCKFD

SEQ ID NO: 120509 - protein, 155 aa, Triticum aestivum
  Clone ID: PAT_TA_14927.pep
VSSDGIHGEQEEQEQEQGSNANAATGCDEPDGEAKDGALPLAHTPGAEEGEKQFVVWWRLPFKLLHFCAWKVKPVWSFSIAAAFLGLVVLGRRMYRMKRKARGLPQIKIAFDDKRASQFADRAARLNEAFLVARRVPMLRTSSGATLPWSMVQDR

SEQ ID NO: 120510 - protein, 67 aa, Triticum aestivum
  Clone ID: PAT_TA_14928.pep
LSATYLTRPKTDSQINPRPADPTASKLLYQVPTMIVTSHPPCSALIDLHACGAAVPKRSSTQRCTTT

SEQ ID NO: 120511 - protein, 177 aa, Triticum aestivum
  unsure (1)..(177): unsure at all Xaa locations
  Clone ID: PAT_TA_14929.pep
IRTRKPRGRAPAFLFHLDLAAGREDDGRCHRHCAVVVSSLLPFHNFLIMPIIFYFDTTSFHPLQPRERRARRRCSGARTGRRHRVLIVVPTEPNHPKPNPCATRITSTSSSRYXRKPIQWRSDLGDRHRLLQLHSTASIIDSILSVTPLTDRAADVIPGVVPCRHGASPSLWLCRHP

SEQ ID NO: 120512 - protein, 58 aa, Triticum aestivum
  Clone ID: PAT_TA_14930.pep
ITRKIWHLKSLHKSCFTKSRCPRTGISKSNILGARLHEYYMTIQLFGNQQDKCLQALV

SEQ ID NO: 120513 - protein, 160 aa, Triticum aestivum
  Clone ID: PAT_TA_14931.pep
LWIVYKGKLEDGRKVAVKLLKVSKGNGEEFLNEVVSIRRTSHITIVNLVGFCLHGSKRALIYDYMVNGSLDKYIYSEETKMAIGWDKLREIAIGIARGLEYLHRGCNARIIHFDIKPHNVLLDEDFCPKIADFGLAKLCHLKDSALSMAEARGTIGFIAP

SEQ ID NO: 120514 - protein, 147 aa, Triticum aestivum
  unsure (1)..(147): unsure at all Xaa locations
  Clone ID: PAT_TA_14932.pep
MRLGEVLATVYCFGDGAAATVVIDGVPPGFYREGERKEWRRRPELGKKKRLARRGPPCVDSFGILDLQGLMKLVAKWLSLSRTVEAGRRAKAKQRRPERDGVPSXDAVVFPKIGXCDGVEDFSRRRRRWRLRSRRIRGGVPRFLRET

SEQ ID NO: 120515 - protein, 144 aa, Triticum aestivum
  unsure (1)..(144): unsure at all Xaa locations
  Clone ID: PAT_TA_14933.pep
MTNKQDYHFLKPSMAEDAAENLLFSKTATAKVWLXIGEGLDASEQFKAHKGAEFIPYSQFPPRMARKDTCTYSITPAMAVPKTLQNVHSCENWLPRRVMSAWRIAGMVHALEGWNEHECGDIVLDMEKVWSGALLHGFRPVAQV

SEQ ID NO: 120516 - protein, 104 aa, Triticum aestivum
  Clone ID: PAT_TA_14934.pep
MAAASRASLVLFLVVATSAVVASMLAVAPGAGAATTACVPTQLTPCAPAIVGNAAPTAACCARLKAHPASCFCQYKKNPNMQRYVNSPNGKKVFAACKVPLPKC

SEQ ID NO: 120517 - protein, 52 aa, Triticum aestivum
  Clone ID: PAT_TA_14935.pep
GPCTTALRLRNVQNQEIPWGSIGAEYVVESTVIFTHQEKAAAYLKKMHISEA

SEQ ID NO: 120518 - protein, 72 aa, Triticum aestivum
  Clone ID: PAT_TA_14936.pep
ELVLGCSAEGFAPPNSSRLTAAGATVANIEITKSIRIVVILRVLLFDKLRCHTTKKKDEVMKRFVLQKSATL

SEQ ID NO: 120519 - protein, 46 aa, Triticum aestivum
  Clone ID: PAT_TA_14937.pep
LVPFRVGRSEYQGYFFVITGGRSLSNQCLLGVGRILGSQLDASRGF

SEQ ID NO: 120520 - protein, 370 aa, Triticum aestivum
  Clone ID: PAT_TA_14938.pep
MSTPGAAYYASLARKQYFCYQCNRTVLIAASAAAAGELSCPDCRGDFLEEVTVPAPTILPFPFAFPPMMPTASSPSRSSSSSAAAPPSSDLSNFLTSILDLQEGRRVRSRSGSGAASAAGTATPENEPESFDPLVFFQNYIHTLMEGGANIQVLLDDASVNLAPGLGGRAGGTSYGDYFVGPGLEQLIEQLAENDPNRYGTPPAAKSALTTLPDVVVTDAMVAAAEGAECAVCKEDFSPGDGAKQMPCKHIYHADCIVPWLELHNSCPICRFELPTDDPDYEGNKASNPQSAVGIAAAAAASGSSGAAEEGGEESGETARVVERRFNVSLPWPFGGSAGQTPQQDGNNAGAGSSSQDSGSQDGAGGSNKN

SEQ ID NO: 120521 - protein, 182 aa, Triticum aestivum
  Clone ID: PAT_TA_14939.pep
LPIGDSGDSAAEKSSNGVVDTASCSDRDEISDLDLDDDDDFTEEEAAVAKLVISVASDSLVVVKEAIRFITGLLKSSGNKDGANEDKVEPMEKLLSHCKEIADQVNDLGASVYPPQDSSEMKLAIKRLYNGINGMRKEVGNLGGSPESTFAALEGFEKCIGSLQAKLSDDVANEMENLNISY

SEQ ID NO: 120522 - protein, 66 aa, Triticum aestivum
  Clone ID: PAT_TA_14940.pep
FGRGRNLRDIGQLQALLHRGRAAQHAQEYGYFFSLSFSTFLYYVFVLYLGPVASEHWPNKYAYLFH

SEQ ID NO: 120523 - protein, 123 aa, Triticum aestivum
  Clone ID: PAT_TA_14941.pep
LFTEVWMSSKINNHLWSSVSSTICLPKPLPQEVCGSINTLASILSFSLLRIVSVDDFGAVFPALLVYQNHSCREFLYFFFARKESMIESGDASNAYEFGTPSLMGRRRQPPVAERKLLRRDEL

SEQ ID NO: 120524 - protein, 150 aa, Triticum aestivum
  Clone ID: PAT_TA_14942.pep
DSDEAYAGYLPNRPTVSRRRMPEPGSKEYEELERYPERGFIHTITSQIQTIIGISLIEILSKHSSDEVYLGQRDTPEWTSDAKAKAAFKRFSDALVAIEGKVVGENRDPQLKNRNGPAEFPYMLLYPNTSDHSGAAAGLTAKGIPNSISI

SEQ ID NO: 120525 - protein, 135 aa, Triticum aestivum
  Clone ID: PAT_TA_14943.pep
MASTACFVIVSKNDIPIYEAEVGSAPKKEDLAYHHQFILHAALDVVQDLAWTTNAMFLRSVDRFNDLVVSVYVTAGHTRFMLLHDSRSEDGIKSFFQEVHELYIKIFLNPLYLPGSRIASSHFDTKVRALARKYL

SEQ ID NO: 120526 - protein, 150 aa, Triticum aestivum
  Clone ID: PAT_TA_14944.pep
FGTRLGGQAHWTVGLVATLMAISSIIAADTSAFLCGRAFGRTPLTNISPKKTLEGALAGLAGCVLTTVLLSTVFRWPRSLLSATAYGILIFLGSLFGDLVESLIKRDAGVKDSGSLIPGHGGILDRVDSYVFTGALCYSFVRVALPLYGV

SEQ ID NO: 120527 - protein, 219 aa, Triticum aestivum
  Clone ID: PAT_TA_14945.pep
IRHEAPVVNLEMCMTGLDKKKASVFFKTNADGNTTCAKEMTKLSGISEIIPEMEICDFDFEPCGYSMNAIHGSAFSTIHVTPEDGFSYASYEVMGFDATALSYGDLVKRVLRCFGPLEFSVAVTIFGGRGQAGTWGKQLGAEVYDCNNMVEQELPGGGLLIYQSFCAAEDAVATSPKSVLHCFEGVNMENAPVKDRKLANLLCWEEVDAMEEKDGVLDE

SEQ ID NO: 120528 - protein, 246 aa, Triticum aestivum
  Clone ID: PAT_TA_14946.pep
FGRGLIGIDELKILRGDDTPGPYKEHDRVYRYDYYNDLGDPDKGEDNARPILGGSQHPYPRRCRTGRHPTEKDPNSESRLFLLNLNIYVPRDERFGHLKMSDFLGYSLKAIVEAVLPTLGTFVDDTPKEFDSFEDILGLYELGPEAPNNPLVAEVRKRIPSEFLRSILPNGSHDHPLKMPLPNIIKSDVLKKAPEFKFGWRTDEEFARETLAGVNPVIIKRLTEFPAKSTLDPSQYGDHTSQITEA

SEQ ID NO: 120529 - protein, 236 aa, Triticum aestivum
  unsure (1)..(236): unsure at all Xaa locations
  Clone ID: PAT_TA_14947.pep
MDRVQLVLLGLPILLFCSDVVTLFAPLPPPGPGPXRXPHAFXPGAESSAAADASALVEPQVDGPGSGTTVDFKFCASCSYRGTAMTMKRMLETSFPGIHVVLENYPPPFPKRALSKAVPLLQFGAMATLMAGDQIFPRFGMVPPPWYYSPPAIWFGAMAALGLAGNFAHSFLQSSGAFEVYCNGQLVFSKLSEQRFPSELELQELIGSRIPDPPILENLEKDLVLDDADADDAMRD

SEQ ID NO: 120530 - protein, 77 aa, Triticum aestivum
  Clone ID: PAT_TA_14948.pep
FFFFFYRSIHPRIHVSPNQEHRTRVKGKKAGGFSPAVKFNVAAVQWFEDSFCRWVKSNDRPMALPWKTIGERTPGSW

SEQ ID NO: 120531 - protein, 177 aa, Triticum aestivum
  Clone ID: PAT_TA_14949.pep
RQRQGSQIAAAMESPVKEEVGGELAMEIESSVTAEDWRRALSRVVPAVAVLRTTAPRAFDTEVAGASYATGFVVDKARGIILTNRHVVKPGPVVSEAMFVNREEIPVYPLYRDPVHDFGFFRYDPGAIKFLKYEEIPLDPEAASVGLEIRVVGNDSGEKVSILAGTLARLDREAPHY

SEQ ID NO: 120532 - protein, 80 aa, Triticum aestivum
  unsure (1)..(80): unsure at all Xaa locations
  Clone ID: PAT_TA_14950.pep
SMEWSGKEXFVSSSEEPFTVDGKEAGILKSYGPLSFLKVHXAGHMVPMDQPKVAREMLKRWTSGNLSNASSSFQRLDFTM

SEQ ID NO: 120533 - protein, 114 aa, Triticum aestivum
  Clone ID: PAT_TA_14951.pep
MDKVLAFSILSASPADISAGAGSGGSWARLSWRRCADDQQAAAAAVAGRQREEQEEDKDKRGSCSRSRGGGRAAPAAAPRFAPEFDGIDCFGTSVSHCISTNHHYGSGDARTRP

SEQ ID NO: 120534 - protein, 57 aa, Triticum aestivum
  Clone ID: PAT_TA_14952.pep
ARDGPDGGDTAAAAAAEEKKAWVPDPVTGYYRPAGSAAKEVDAAELRAKLLTEAAAN

SEQ ID NO: 120535 - protein, 109 aa, Triticum aestivum
  Clone ID: PAT_TA_14953.pep
SDEGERQTTTANESIAMASRLVAAAAAASSSSSASPLARLISRRGLAGAADGHGPAKVPLWKDPLSPSKWKEEHFVLASLSMWGALIYGGFKLFGGKKEDKTEVAPAKA

SEQ ID NO: 120536 - protein, 197 aa, Triticum aestivum
  Clone ID: PAT_TA_14954.pep
NVSIESVRKELQSMHPEDRHIVVLKHNVWRVKGLIQVCRSIGDAYLKKQEFNREPLYAKFRLREPFNKPILSSEPSICVQPLQPHDQFLIFASDGLWEHLTNQEAVDIVHSSPRSGCARRLIRAALQEAAKKREMRYSDLKKIDRGVRRHFHDDITVIVVFLDSSLVSRASTHRGPTLSLRGGGASAGLRSNTLAPT

SEQ ID NO: 120537 - protein, 217 aa, Triticum aestivum
  Clone ID: PAT_TA_14955.pep
VYTIATDGSPFRPELLTPWMVATLIDFYVNVIAISAWVIYKEANWISSAVWVVLLVCFGSAATCAYIVKKLFEVTSAGSSQDPLDLLFIRQGNLSQRKCSYIVIGRVIFSILGIFMVAVVTYTVITDGLPFRKELLTPWMAATLIDFYINIFAISVWVTHKESSWISTTIWIVLLICFGSITTCGYIVLQLFKVSYQDPIYHVLLNSHSKYGISTSL

SEQ ID NO: 120538 - protein, 193 aa, Triticum aestivum
  Clone ID: PAT_TA_14956.pep
SFNTSSSEYDVDIIDECKGDEAGNQKTGVTDPTAFNLGAAILSDKFLVQTPMKEETADVQFIHKRNAPAAAEPELMLNNRVYTCNNVQCPHSDYSYGFLDRNTRNSHQYTCKYNDPIPQSTENKPPPAPPQSQAFQPAFNQPNQPLNNLDFSLPMDGQRSIAELMNMYDNNFMTNKNMSSDSVTIMERPNAMP

SEQ ID NO: 120539 - protein, 82 aa, Triticum aestivum
  Clone ID: PAT_TA_14957.pep
NANYGYNAAKNCYEDLMAAGILDASKVVRCCIEHAAVVAKSFLTSDVVIVEAKEGKPIRIRPPMPPRNLIPPMPPSISGIRV

SEQ ID NO: 120540 - protein, 192 aa, Triticum aestivum
  Clone ID: PAT_TA_14958.pep
MALASGTSRLLLGRPAGTARLHLAVSSSSPASSIRFRRGAGAGGGRAAVVSLRAPAPPAAAAAATSGSIAPAISLTEKALKHLNKMRAERNEDLCLRIGVKQGGCSGMSYTMEFESRANASPDDSVVEYDGFAIVCDPKSLLFMFGMELDYSDALIGGGFHFQNPNATKTCGCGKSFATGKETEAAATACNN

SEQ ID NO: 120541 - protein, 245 aa, Triticum aestivum
  Clone ID: PAT_TA_14959.pep
ATDLFNMLSMDGTLEPESESSSNDDNAWDGFQSAQPVPSSEKKDSAKPAESKTQSTSGIEDLFKDSPALSISSAPAVSQVNAKNDIMSLFEKSNMVSPFAAHQQQLAFMSQQQALLMAALKAGNAPQMIPGNANQLNANGSNPPLGTLPFQNWTNLGYQNPGLTPAAAQNGATKVANNNQDFSSGTFGFGTPGVYNTSSAVPANGATAAGASNNGTASTASSNLPSQSGKDYDFSSLTQGFFTKR

SEQ ID NO: 120542 - protein, 194 aa, Triticum aestivum
  Clone ID: PAT_TA_14960.pep
DSDEGLFHGECSSDRYSSDWKVNETDEYSRETRPVSGTNRLIDGDKSKFDFNDAETKTDSMIYKLEIMTIELFSMYGKQFMIDPQDFQDSEPDILANSASAIIERIKENSDQCAMALRSLCRRKKGLTVEEASLIGVDSLGIDVRAFSGLEARTVRISFNAQALSERSAEKKIRRMLFPRSQRKNVKTSTEDVS

SEQ ID NO: 120543 - protein, 161 aa, Triticum aestivum
  Clone ID: PAT_TA_14961.pep
IRHEGTLCNACGVRDRQGRLLPEYRPIASPTFEPAEHANRHSQVLQLHRHRKSQSQSQSHHQQHPLPVEHHPPRAMDVLQFPPQRWHVKEEYPPTPVHQPLSLAGGVGGLMVDAAADADAGQGGDRGKGSDLNNAPSSLDSLLLEGPSAPLLVDGDQPLID

SEQ ID NO: 120544 - protein, 55 aa, Triticum aestivum
  Clone ID: PAT_TA_14962.pep
FFFFFFFLTKGIASFPLNQIRSRSTTRLSVLPKPDGNYKQDRGRARKGVLQINGI

SEQ ID NO: 120545 - protein, 146 aa, Triticum aestivum
  Clone ID: PAT_TA_14963.pep
SPSARQHSRRLLCSFISFAEFGEPPARGTRPTAPPFPPTRLRARALLISLCRGPYPPRRQRRLHAPQGGHLGREARPDRRPVQAGEFHHPPCPELTTVQTMIYGSRIYAQEKMVSDEGPGGSVLNNASRRINRKSARLMRRRDAPR

SEQ ID NO: 120546 - protein, 171 aa, Triticum aestivum
  unsure (1)..(171): unsure at all Xaa locations
  Clone ID: PAT_TA_14964.pep
MAEQTEKAFLKQPKVFLSSKKSGKGKKPGKGGNRFWKSIGLGFKXTPGKQLEGTYIXDKKCPFTGSCFYHEARIIXGTCHRSYSGPRNYLLRVNYFHLCERSTSKHANAHXSPCPRLISPGSRSXVGHYIPIAQSVPCHIGEVIPAGSAAPGNKCCKTRLKKTMVLDQGRH

SEQ ID NO: 120547 - protein, 125 aa, Triticum aestivum
  Clone ID: PAT_TA_14965.pep
PPPIYEVVTGTAKKEPKEKTHKSNNKTNKSGSKPSRQAEPNNSRVPKMPPPKDEEESEGEEGEPQEDHETALCGACGLGYDDFWICCDLCETWFHGKCVKITPAKAEHIKQYKCPSCTGSKRAKA

SEQ ID NO: 120548 - protein, 145 aa, Triticum aestivum
  Clone ID: PAT_TA_14966.pep
MAKMLVSDEARKEFNTLRRTFEDVNHQLQTKFSQEPQPIDWEYYRKGIGSKVVDMYKEAYESIEIPKYVDTVTPQYKPKFDALLVELKEAEKESLKESERIEKELAELQEMKKNISTMTADEYFAKHPEVKQKFDDEIRNDNWGY

SEQ ID NO: 120549 - protein, 198 aa, Triticum aestivum
  unsure (1)..(198): unsure at all Xaa locations
  Clone ID: PAT_TA_14967.pep
FSSTLPNSDTNTKISKDQIDSASKSNPGSRIIESYDADFELVYKAITGGVVPAFSTSGAGDETHLPARESSWSLLRHKFISRSLARVYSDSALIRDFDPRVDRVQHLAAEASTSPPFLSPSSFSXSDPSVSSKSPLAHLPSPEAPPAPSAPPAIRSPSKTSACPVTSNNEGKPLAGTITSKLLFKKGVHKVQQRPFAQ

SEQ ID NO: 120550 - protein, 119 aa, Triticum aestivum
  Clone ID: PAT_TA_14968.pep
TGHRIPAIENLGVAGPHDAIDFTDNDIQVLGNFPLSPRITTLLLARNRVSSIQPSLAKAIPNLANLVLSSNNLTELADLDALASFPRLTHLVLSDNPVSKKENYRYWVLWKCPSVRFLD

SEQ ID NO: 120551 - protein, 81 aa, Triticum aestivum
  Clone ID: PAT_TA_14969.pep
MGCDDKCGCAVPCPGGKDCRCTSGSGAGGQREHTTCGCGEHCECSPCTCGRATMPSGRQNRRANCSCGPACNCASCASASA

SEQ ID NO: 120552 - protein, 210 aa, Triticum aestivum
  Clone ID: PAT_TA_14970.pep
MAAPAFGGRRRPASAAALLAVATLVVVFLAGPAMAAGNKTGQVTVFWGRNKAEGTLREACDSGLYTMVIMSFLDVYGPNGKYHLDLSGHPIAGIGDDIKHCQFVGVPVSLSIGGFGSGYSLPSKQAALDLFDYLWNAFFGGSKPGVHRPFGDVWLDGVDLFLEHGTNATDRYDVLALELAKHNIRGGPGKPLHLTATPRCEFPPAGYLKR

SEQ ID NO: 120553 - protein, 216 aa, Triticum aestivum
  Clone ID: PAT_TA_14971.pep
MHCDYIHHDSGKPTIHCDLKPSNILLDDDMTALLADFGIASFYQHPSSTPASSTASSVGMKGTIGYIAPEYAGGGRHAATSDDVYGFGIILLEMMTGRRPTDPMFKDGVSIINFVEGHFPHEIFQVLDAHLTEEYKNFAEAKKISENAVHQCLVSVIQVAFSCTKPIPSDRMNMKEIATRMHTIQSSYVSMGKQSNIVRPLGVELPEMLYNGTDHT

SEQ ID NO: 120554 - protein, 79 aa, Triticum aestivum
  Clone ID: PAT_TA_14972.pep
MAYLLTLYGSGGGQRRTSRDSGTAAPVRRLLRRLRSSFGRSAARPRRSAVRFGYDLHSYSQNFDDCGASSSPAAAMACS

SEQ ID NO: 120555 - protein, 181 aa, Triticum aestivum
  Clone ID: PAT_TA_14973.pep
LEASMAYVSGNPIMTDQEFDELKLRLKKEGSDIVTEGPRCSLRSRKVYSDLTVDYFKMLLLYVPAAVVALTLFFFLDDLTGFEITLLLELPEPFSFIFTWFAALPLIFWVAQAFTNVIVKDFLILKGPCPNCGTENLSFFGTILSVSSGGSTNSVKCASCGTVLEYDSASRLITLPEPAEA

SEQ ID NO: 120556 - protein, 177 aa, Triticum aestivum
  Clone ID: PAT_TA_14974.pep
HEDRFHQYQVVGRALPTPADEHPKIYRMKLWATNEVRSKSKFWYFLRKLKKVKKSNGQVLAINEIFERNPTTIKNYGIWLRYQSRTGYHNMYKEYRDTTLNGAVEQMYNEMASRHRVRSPCIQIIKTATVDFKLCKRDNTKQFHNSKIKFPLVYRKVRPPTRKLKTTFKASRPNLFM

SEQ ID NO: 120557 - protein, 404 aa, Triticum aestivum
  unsure (1)..(404): unsure at all Xaa locations
  Clone ID: PAT_TA_14975.pep
SADAWADAWETVEKTFQLSRADRETVXRSEYDLQVWCILMNDKVQFRMQWPQYAELEVNGFAVRVVTRPGSQLLGINGRDDGPLITTCSREGTNKICLRRVDNRTFCFGVRVAKRRSVPQVLNLVPKEAEGESFEDALTRVRRCLGGGDTAENADSDSDLEVVTESVTVNLRCPNSGSRMKTAGSLPPGFLLGCFDLDTFVELNQRSRKWQCPICLKNYSLENLMIDPYFNRITSLLRDCSEDVNEIDIKPDGSWRVKGDVPTRELSQWHMPDGTLCISKEDNKPGVENFNELKIEGTSDGHKSLKIGIKRKNGIWEVSNKADDKKPSVVGNITQNNITFRTPNTFPMSSSPTGSYRDGEDTSVNQEGSMHIDLSLNNGHEFESFPLNFRQTYKNNDISSTKLL

SEQ ID NO: 120558 - protein, 175 aa, Triticum aestivum
  Clone ID: PAT_TA_14976.pep
PEMGDAGASTFNPLLRRGANTSGPCDGKEDAMSGQMLKRGVKAMPTEDHIRGNPKKQLNLTEVLAEAVKCAQALKTDELITDTRFKEAFAKLINEVYPRLPESLQDQLLADFKLNILRRAQEKNTRPVELMDGEQKNFLGKKGVRTNTLWIIEKLVLLVGVCCFIYLMSFYVTGY

SEQ ID NO: 120559 - protein, 172 aa, Triticum aestivum
  unsure (1)..(172): unsure at all Xaa locations
  Clone ID: PAT_TA_14977.pep
SRHPHSSGSQRWRATAACARLLLLAAALLLSASCAAAANFEYCNKGRHYPVKVSGVEIVPDPVXRGQPATFKXISASTDKTITKGKLVVDVWYFFFTRLIHETHDLXCAGTPCPATGQIRTSHAKQTLPCYTSLFSHKCPCSVCWRNKNEELTCISFGYRHGVDRACRHYVD

SEQ ID NO: 120560 - protein, 117 aa, Triticum aestivum
  Clone ID: PAT_TA_14978.pep
MASLVAVQPVAVKGLAGSSISGRKLAVRPSPRALCRTTRRPRAAVVAKSGEKSGYFDLEDIGNTTGQWDLYGSDAPSPYYPLQSKFFETFAGPFTKRGLLLKFLLLGGGSLVAYVSA

SEQ ID NO: 120561 - protein, 63 aa, Triticum aestivum
  Clone ID: PAT_TA_14979.pep
MGIGFTRLFSSVFGNREARILVLGLDNAGKTTILYRLQMGEVVSTIPTIGFNVETVQYNNIKF

SEQ ID NO: 120562 - protein, 194 aa, Triticum aestivum
  unsure (1)..(194): unsure at all Xaa locations
  Clone ID: PAT_TA_14980.pep
MAAPPLPTQIVKKRVKQFKRPHLDRYKCLKPSWRRPKGIDSRVRRKFKGCTLMPNIGYGSDKSTRHYLPNKFKKFVGHNVSELELLMMHNRTYCAEVAHNVSTXKRKEIVERAPHLDIVGTNKLAKLRTQKAVKWDFFSSAPAGYPSAKIHPPSLVCEIFLRRITVIPTVFTHQAAELWLTLQLPCGYPGPLCF

SEQ ID NO: 120563 - protein, 207 aa, Triticum aestivum
  Clone ID: PAT_TA_14981.pep
LNAPATVEPLLSEANLPFNPATVFAPPYDTVSSFTSAKNLVFCEGNLYQVWRNASCTVTLQLPAGGQRRVAENEILVLRYYPRRQPCWDVVKDLGGHSLFVGRNNAVSMYAEGVAGLRGNCVYWIGGRGRDQGMVFDMESGRSTPCRAPPVGFLPGHPHSTICWYFLSDVMSINNSYNTSVSSSSSGGRKVYQTRARARADLADMEE

SEQ ID NO: 120564 - protein, 122 aa, Triticum aestivum
  unsure (1)..(122): unsure at all Xaa locations
  Clone ID: PAT_TA_14982.pep
VKKILKNKNKLRLSLFLPRARFTPHLTAVPPPPPPGCFPLNPTIRRPSNFPMLPASRXPPPRPAAPSAAASPARSIPPEPPSPPPPASPRPGEQKIRSWPPPSPRADRGVESVPSSSSITSR

SEQ ID NO: 120565 - protein, 173 aa, Triticum aestivum
  Clone ID: PAT_TA_14983.pep
CISSITVVTIAVVNVTIRMSIVAVGSCKRVMEKVVRPVEILIFLTHVHPLGSNSLSKALPLELGTLSTPRSALGFGGAQEGIFCTPGRGLAGGEANRDSGELELAGEAAAEGAAGRGGGHPGGPGALGHGEVARPAGGGVEEEGGGTAVRCGVAGARGRKRERRRVVLVFSIV

SEQ ID NO: 120566 - protein, 63 aa, Triticum aestivum
  Clone ID: PAT_TA_14984.pep
SFFFFFFGNFNQPSAQRRSSSFWFKYTQGNEQDFCCLFSLRQKAITEQAQNIELSTTPGPFLF

SEQ ID NO: 120567 - protein, 98 aa, Triticum aestivum
  Clone ID: PAT_TA_14985.pep
CIETREAWGDDADEFNPMRFENGITRAAKVPHGLLAFSMGPRNCIGQNFSMLEAKSTLALMLQKFSFALSPDYVHAPVDLFTLKPKFGLPVILRPLKI

SEQ ID NO: 120568 - protein, 121 aa, Triticum aestivum
  Clone ID: PAT_TA_14986.pep
HEGTASSRRARSVTPGMVVESSRVVFLSVGRCAMCCDCEAGSSGVGRPTGDCHYKQGDRAACGRRRVFGCGLDALLCSSEIQIRCTSSKEQGSALLLLFYVRFVLATELLSRNKVAVSSNS

SEQ ID NO: 120569 - protein, 345 aa, Triticum aestivum
  unsure (1)..(345): unsure at all Xaa locations
  Clone ID: PAT_TA_14987.pep
FAPTSRAEGDNMIDRSTNLDWYKGPTLLDALDLLNEPKRPSDKPLRLPLQDVYNTGGIGTVPVGRVETGCHLAWYGCHFWALLGLTTDVKSVGDGTMRLSGRSSPLDWVGGPALLVALDLCSVPKGPSDKPRPLPRRCXFNFQVIDMNNLGSVETGFISPGMVVTFGPSGLTTEVKSVEMHHEALQEALPGDNVGFNVKNVAVKDLKRGYVASNSKDDPAKGAASFTSQVIIMNHPGQIGNGYAPVLDCHTSHIAVKFAELVTKIDRRSGKELEKEPTFLKNGDAGMVKMVPTKPMVVQTFSEYPPLGRFAVRDMRQTVAVGVIKSVEKKDPTGAKVTKAAAKKK

SEQ ID NO: 120570 - protein, 80 aa, Triticum aestivum
  Clone ID: PAT_TA_14988.pep
SCFHNEALRCIQIGLLCVQDNPDSRPLMSSVVTMLENETTPVPVPIQPMYFSYRGTTQGTEENTSSSTNNMSLTTVLEGR

SEQ ID NO: 120571 - protein, 129 aa, Triticum aestivum
  Clone ID: PAT_TA_14989.pep
SPERSFSNDGTCKRFPLCPLAFAPNRPFFAEPATVRKGGSFRWRQPGGLRFTGLHTKMGVLYIYEGPPVTRKESNNTLDANVRLGLVLNHVILLCCRAFKQLRPVKLNLFSPMEGICMPDFVYPVRGGF

SEQ ID NO: 120572 - protein, 116 aa, Triticum aestivum
  Clone ID: PAT_TA_14990.pep
MVPEDARAKKIKSDNVTPVTPSLDPATSTSKTGKGKTREAEPTERQGDGSVSVANPKKESRPAFEDNIVLGVALEGSKRTLPIEEGNPYLSLSETELDNEEAASSPKDKIGQSPKL

SEQ ID NO: 120573 - protein, 151 aa, Triticum aestivum
  unsure (1)..(151): unsure at all Xaa locations
  Clone ID: PAT_TA_14991.pep
MSSLMDKAKGFVAEKIAHIPKPEASLDSLSFKGMSRECITVHSNVNVSNPYDHRLPICELTYTLKCAGNVVASGTMPDPGWIAASDTTKLEIPAKIPYDFLISLVKXVGRDWDIDYQLDVGLTIDLPIVGNFTIPLSTSGEMKLPTLKDMF

SEQ ID NO: 120574 - protein, 77 aa, Triticum aestivum
  Clone ID: PAT_TA_14992.pep
RHEEQVPLLEVVEVRNNRGQELVTRVSGYSGPMHYVTFSFSLVICCSSSCVCQNKSRMHINLGEQYLCYRLCSNFRG

SEQ ID NO: 120575 - protein, 180 aa, Triticum aestivum
  unsure (1)..(180): unsure at all Xaa locations
  Clone ID: PAT_TA_14993.pep
LKKTRPDKELXEKLGKSSQKEITLKDDLPLRDRAELYQTYLMFCITGETTNVSFGTAISSKKDDSEYLMLKQLGRILGLTAKEAQDVHIKLAEKAFVQQAEVVLADGKLTESKADQLATIQTQVGLPSEHAQKIIKSITTTKLSSAIEASISRGQIGIQQVRGLKDANFELDSLISEPLR

SEQ ID NO: 120576 - protein, 100 aa, Triticum aestivum
  Clone ID: PAT_TA_14994.pep
TREDRKTVWFCLYIPRAFADQSLKAHLSSEPDVKHIKINSSIQFVILASDGLWKVMKNQQAVDLVKSTKDPQTAAKRLTSEALGRMSKDDISCIVIRFRC

SEQ ID NO: 120577 - protein, 63 aa, Triticum aestivum
  Clone ID: PAT_TA_14995.pep
IKKKVYVCMYVCMYVCMYVCMYVCMYVCMYVCMYVCMYVCMYVCMYVCMYVSLAIIFRRCKRA

SEQ ID NO: 120578 - protein, 158 aa, Triticum aestivum
  Clone ID: PAT_TA_14996.pep
SARGRVVDHQRLSSSGYVFSASLPPYLASAAVSAVNYLEENPSVLANLRSNIALLHKELSDTPGLEISSHVLSPIVFLKLKKSTGSPTTDLDLLETIADKVLKEDSVFIVTSKKSNLDRCKLPLGIRLFVSAGHTESDISRLSSSLKRVSASVLSDYF

SEQ ID NO: 120579 - protein, 127 aa, Triticum aestivum
  unsure (1)..(127): unsure at all Xaa locations
  Clone ID: PAT_TA_14997.pep
GSATVEAPSRGNIESTSGSSLSADEPIVVGTEEIARVASLWSGIPVQQLTADDKKLLVXLDDELRKRVIGQDDAVVAISRAVKRSRVGLNDPDRPIATLLFCGPTGVGKTELTKALAACYFGSESAM

SEQ ID NO: 120580 - protein, 185 aa, Triticum aestivum
  Clone ID: PAT_TA_14998.pep
TRLTRILQAILKVIFEHAKDRPILFSSFQPDAAQLMRKLQGTYPVYFLTNGGTELYTDVRRNSLEEAVKLCLASGMQGIVSEARGIFRHPAAVPKIKEANLSLLTYGTLNNVPEAVYMQHLMGVNGVIVDLVPEITDAVSELIALPEPDLEVDNLSNQAARGATTPNFSQREISFLLRLIPELVQ

SEQ ID NO: 120581 - protein, 108 aa, Triticum aestivum
  Clone ID: PAT_TA_14999.pep
ARGTNRGKARRRRSRSEDPVRLPRPKKPSPCPAPSPSLARRCSLRRAARSPARPPPPRPSPSPCRPRRPPPPARRSGPSGCCALRSARRPPRRLRRPLRPPPSPPDRC

SEQ ID NO: 120582 - protein, 133 aa, Triticum aestivum
  Clone ID: PAT_TA_15000.pep
EYDQMLCEDETKNRMMETKELFDWVLKQRCFEKTSFMLFLNKFDIFERKIQKVPLSACEWFKDYQPIAPGKQEVEHAYEFVKKKFEELYFQSSKPDRVDRVFKIYRTTALDQKLVKKTFKLIDESMRRSREGT

SEQ ID NO: 120583 - protein, 190 aa, Triticum aestivum
  unsure (1)..(190): unsure at all Xaa locations
  Clone ID: PAT_TA_15001.pep
LATIYGSFINFSPSTIXSLGFIFLFTIGGLTGVILANSSIDIILHDTYYVVAHFHYVLSIGIVFAIIARLIHXFPIFTGFSINNFILKIQFILIFIGVNITFFPQHFLGLNGMPRRYTDYPNNFLLXNIISSIGSIISTFRIIILIYCIXNRIFLKKTTIFKLNLSNSIEXIHNLPPLEHSYSELPLIIS

SEQ ID NO: 120584 - protein, 704 aa, Triticum aestivum
  unsure (1)..(704): unsure at all Xaa locations
  Clone ID: PAT_TA_15002.pep
MDSAAAGMRDSALDLLAALLTGRAPPAAADGDQNRRLLALLATSLAVLVGCGVALLFRRSSSGAAPLAHKSAAAKPLAAKKDQEPEKEYSQRIIASQRSLLEVISEFPSAKPPLGVFFAAIAPRLQPIDLDDYAAEEMAPTRNSCNVNIAFFFLPTYGDXSGVCTTWMKNSTPSEESKECSWAPIFVRQSNFKLPADPTVPIIMVGPGTGLAPFRGFLQERLALKETGVELGRAILFFGCRNRQMDFIYEDELNNFAESGALSELVVAFSREGPTKEYVQHKMAEKAAELWSIVSQGGYVYVCGDAKGMARDVHRXASHQSCIHLDFEIAGTSLTYETGDHVGVYXAENSIETVEEAEKLLDYSPDTYFSIYADQEDGTPLFGGSLPPPFPSPCTVRVALARYADLLNSPKKSVLLALAAHASDPKEAERLRHLASPAGKKEYSQWIIASQRSLLEVISEFPSAKPPLGVFFAAIAPRLQPRYYSISSSPRMAPTRIHVTCSLVHGQTPTGRIHKGVCSTWMKNSTPLEESQECSWAPIFVRQSNFKLPADPTVPIIMVGPGTGLAPFRGFLQERLALKETGVELGRAILFFGCRNRQMDFIYEDELNNFAESGALSELVVAFSREGPTKEYVQHKMAEKAAELWSIVSQGGYVYVCGDAKGMARDVHRALHTIVQEQGSLDSSKAEGYVKNLQMEGRYLRDVW

SEQ ID NO: 120585 - protein, 136 aa, Triticum aestivum
  Clone ID: PAT_TA_15003.pep
RRVHIVRTRGGNKKYRALRLDQGNFSWGSEGISAKTRIIDVIYNASNNELVRTKTLVKNAIVVIHATPFRQWYEGHYALPIGRRKTTKLTEAEDAVLNKKRSSKAEVKYKKRQRFAKVEPAIDEQFQTLRLLACLG

SEQ ID NO: 120586 - protein, 140 aa, Triticum aestivum
  unsure (1)..(140): unsure at all Xaa locations
  Clone ID: PAT_TA_15004.pep
ASDNDTDYYDDHGEVKVRDRLNSTFWQRVGPIGCVQSRVKRVVFDQFXGGTNEVGFLKLVLGRAVLLQKVTVVLARPDSVAMSEAMCKLQPLASKRMWATQVVDNPSFEVSGRVAGHLCWYKEASDLSITDPFISMLRLY

SEQ ID NO: 120587 - protein, 108 aa, Triticum aestivum
  Clone ID: PAT_TA_15005.pep
HEASACVTLVTALVSLFSNRKVRADTAMTGEMTLRGLVLPVGGVKDKVLAAHRYGIKRVILPERNLKDLSEVPSPILSGMEILLVKRIEQVLDHAFEGGCQLRSRSKL

SEQ ID NO: 120588 - protein, 109 aa, Triticum aestivum
  Clone ID: PAT_TA_15006.pep
HHPVTHPPTHPSTASQIRLRSSAHPPRFPVSSSEVSLDLSEFSRVAGKVHSTLSSFSLLISSPSCFGLVFLEQSARDPGPFRSWASDLRFLLLLLLRFGFSSLGLLVGW

SEQ ID NO: 120589 - protein, 146 aa, Triticum aestivum
  Clone ID: PAT_TA_15007.pep
PRPRPRLPRRRARTLSWPRRAPSLSTTEQGAVHAATTTGKLEPCCAHVGALSHPSPSVTWGHHRLDHHLYSSRRPPPSSRSSRSTFLHLVDALRDVDETLVIFSYPCMLMIHDHSHLSMSYIFCLVRFRIYLYLLYDLKKKKKKKK

SEQ ID NO: 120590 - protein, 113 aa, Triticum aestivum
  Clone ID: PAT_TA_15008.pep
MGLDYYSVLKVNRSATEDDLKKSYRRLAMKWHPDKNPGDNKAEAEAKFKKISEAYEVLSDPQKRTIYDQYGEEGLKASAEAGSSSSSMNGSTNHRFNPRNAEDVFAEFFGSSK

SEQ ID NO: 120591 - protein, 239 aa, Triticum aestivum
  Clone ID: PAT_TA_15009.pep
YNGVKVTTEDGTSYFADACIISVPLGVLKANVIKFEPELPSWKSSAIADLGVGVENKIAMHFDRVFWPNVEVLGMVGPTPKACGYFLNLHKATGNPVLVYMAAGRFAQEVEKLSDKEAVSLVVSHLKKMLPDASEPTQYLVSRWGSDPNSLGSYSCDLVGKPADVCARFSAPVDNLYFAGEAASAEHSGSVHGAYSSGIAAAEECRKRLLTLKGIPDLVQVAAWEEMAGAVAPLQICRT

SEQ ID NO: 120592 - protein, 160 aa, Triticum aestivum
  Clone ID: PAT_TA_15010.pep
MEHQGQHGHVTSRVDEYGNPVGTGAGHGQMGTAGMGTHGTAGTGGGQFQPMREEHKTGGVLQRSGSSSSSSSEDDGMGGRRKKGIKEKIKEKLPGGNKGEQQHAMGGTGTGTGTGGAYGQQGHGTGMTTGTTGAHGTTTTDTGEKKGIMDKIKEKLPGQH

SEQ ID NO: 120593 - protein, 93 aa, Triticum aestivum
  Clone ID: PAT_TA_15011.pep
CAHPLISYALRYKAVLVREYYSSSCSCTYMVHIRYPVYIYLYHVVCMITLTKQLVPTCKIKYSCMLLFDHVIRNFDLLGNDKLDCRRTNNNLM

SEQ ID NO: 120594 - protein, 145 aa, Triticum aestivum
  Clone ID: PAT_TA_15012.pep
AGRPSFASTHNEATPGSFSRSYVETSAAHRGDNRSSGSKPWEMQQYSQQRIGYGSNSQLSDDGCPETQDNYGGGPSYSYHQNQNQNGKAPAPDIQAEEARPSVYISGAEERSPPPPPQRRWVPPQPPGVVMPEAVAAIRQPKSLA

SEQ ID NO: 120595 - protein, 95 aa, Triticum aestivum
  Clone ID: PAT_TA_15013.pep
VFFPVINEACRVLDEGIAPKASDLHIASIFSMGFPPYTGGVIYWADSIGANYIHGKLDEWTKRYGGFFKPCSYLAERAAKGIPLSAPAKKAHARL

SEQ ID NO: 120596 - protein, 50 aa, Triticum aestivum
  Clone ID: PAT_TA_15014.pep
SHVNITTKVSWVLRDLDSSLIFVHDPSTYYFNMSLYEFTYLCVRLFLSNM

SEQ ID NO: 120597 - protein, 264 aa, Triticum aestivum
  unsure (1)..(264): unsure at all Xaa locations
  Clone ID: PAT_TA_15015.pep
MRLLVPDGARQHSEAATPRRHRPPPEAPPEASGRTVAVGIRWDAASRELLTWALVKVANAGDRVVALHVAAGGGGGAGLEERRKAADSLATVLAVYDGFCNLKQINLELKVCAGSSIRKTLVKEAASCGAAHLILGVAKNSRSFGSSSTSVAKYCAKRVPTSCXVLAVNNGKIFYQRAAAREEPFNSTSPPETPRRSYRKLLTSLIGERSQDECIKDNRSISRAVTMPMRSHTSVSLALVPVSRRESEVATGWPFKLLPNRCVV

SEQ ID NO: 120598 - protein, 205 aa, Triticum aestivum
  Clone ID: PAT_TA_15016.pep
MSGAKFFVPTPATVASELMAEPGAHSETTRQDEPSSSPAMETAFSSPPALIPMQSTIQRYPSGDNIQRYPSGDNIPQHPSSDSIQRYPSGDNIPQHPSSDSIQWYPSGDNIPRHSSSDNIQRYPSMDNIVSPSGSVNSSMSRSRASSWSGTLPEQLSSTAATRSPDGQIMQSPSMPGKRPPHSRSSSTSSAQFNGLGEELHEVEL

SEQ ID NO: 120599 - protein, 216 aa, Triticum aestivum
  unsure (1)..(216): unsure at all Xaa locations
  Clone ID: PAT_TA_15017.pep
RREACQESAAPEMLLALMDEAYTGSAIEEPSGNSGSDDSGALDLADPMFLDLLKDENDGIAAKHWISPTISSTLQAAFNCPRPRSARSRLSLSRAPHVLPVSFATALRDVNNSLLCALIPVVMSRYAAMFPXKDFSCVARVLLSDFLLAXAFQRSPDIIALLXKPITDRLGEAHGNPAKIELAVHLCWAIGEHGARASKHKDVARELFENLELLLY

SEQ ID NO: 120600 - protein, 79 aa, Triticum aestivum
  Clone ID: PAT_TA_15018.pep
GSKLSYKHFVKLLPPKVADFGSASFCGVILQMRLVWPHKTEKLTPKGNEKQAHQLNHDRGAVGIMMLPTFTFQLNVSPF

SEQ ID NO: 120601 - protein, 61 aa, Triticum aestivum
  Clone ID: PAT_TA_15019.pep
FHFSYGLQVLVVLASQVANMLLFFGHLHNSFTVLQVHRFMCCSIDFYCFNSSYISPPNSIA

SEQ ID NO: 120602 - protein, 93 aa, Triticum aestivum
  Clone ID: PAT_TA_15020.pep
MLFFSYFKELVGKEVTVELKNDLAIRGTLHSVDQYLNIKLENTRVVDQDKYPHMLSVRNCFIRGSVVRYVMLPQDGVDIDILHDATRREARGG

SEQ ID NO: 120603 - protein, 125 aa, Triticum aestivum
  Clone ID: PAT_TA_15021.pep
WDGVVENLVVGELARTRGRLRPRCSGGRPPWRAHEPNNLAALPPSSCVVPPRAARRSCAASSSQSRHPFSRRPMQPRHLCAAAPSSRRRWTQPRRETLSQQVKGEDNGVKLFCDTYGEDTGRPSL

SEQ ID NO: 120604 - protein, 74 aa, Triticum aestivum
  Clone ID: PAT_TA_15022.pep
LRHAFMVFDADGNGLITPAELARVMRGLGESATVAQCRRMIQGVDRSGEGLVSFDEFKLMMAAGGGGFGRIGAA

SEQ ID NO: 120605 - protein, 72 aa, Triticum aestivum
  Clone ID: PAT_TA_15023.pep
NSAPMVVDSKCASANSEHQRPFVLPSIQERRGGSLGIRWRLAVGIFFILCILFSRTLLASDGLVTWLPRQFL

SEQ ID NO: 120606 - protein, 104 aa, Triticum aestivum
  Clone ID: PAT_TA_15024.pep
KFHRIIINTKRSSTGSVQKIDPANGPRLDAFQSSIGIQISPETGTSQLNIRSNAPITQIRILRARKPCGLVSLQADSPSHHSNQLARNLHIIIKKKKQTFPTNK

SEQ ID NO: 120607 - protein, 148 aa, Triticum aestivum
  Clone ID: PAT_TA_15025.pep
AASLLARNRRNTNKITLKSIRFCCPFAFSLRRASVLPNFSSRALFRSFVLRNASRKEILVELRSSIPISRSALTQLSRAFSLRRLCTVSRKSTKSWRRNGVVGSFKPLATSVTRFLAVQKPATRVSVGPRDSPRPFLFAPAIRSWLIC

SEQ ID NO: 120608 - protein, 102 aa, Triticum aestivum
  Clone ID: PAT_TA_15026.pep
NLVRESKEKQCSKIVCQRICPSEQRSEQAHHGSRGVHAGYRAAVGEPRAWVWLRMELSLCSRRSSRNCRMNSSARAFNSAFPSSASSPAFDTLRQSATTTFA

SEQ ID NO: 120609 - protein, 127 aa, Triticum aestivum
  unsure (1)..(127): unsure at all Xaa locations
  Clone ID: PAT_TA_15027.pep
MAANFGNKIRNAKLVLLGDVGAGKSSLVLRFVKGQFVEFQXESTIGAAFFSQDLXAVNDETVXFEIRGXTLGQERYHSLAPVYYRGXAAAAIVVXDIXNPAPYTRAKKGVXNFKLKGNPNTIMVLAG

SEQ ID NO: 120610 - protein, 407 aa, Triticum aestivum
  unsure (1)..(407): unsure at all Xaa locations
  Clone ID: PAT_TA_15028.pep
MPEKGGKSQSKRVTLKAKHEVLRKVKEHHRKKRKEAKKDGRSXRARIEKDPGIPNEWPFKEQELKNLEVRRAMAIKEQEDKKEARRERARKRKLGLPDDEDMANDNDAAEETVALXVPKTNDHSERAFYKELVKVIEASDVILEVLDARDPLGTRCVDMEKMVRKADPTKKIVLLLNKIDLVPKESVEKWLSYLREELPTVAFKCNTQEQRTKLGWKSSKLDKTSNIPQSSDCLGAENLIKLLKNYSRSHELKLAITVGIVGLPNVGKSSLINSLKRSRVVNVGSTPGVTRSMQEVQLDKKVKLLDCPGVVMLRSASSGVSVALRNCKRVEKMEDVITPVKEILGLCPQEKLLSLYKVPSFTSVDDFLQKLATLRGNLNNGGIVDVEAAANIAIHDWNEGKVPLLYT

SEQ ID NO: 120611 - protein, 158 aa, Triticum aestivum
  Clone ID: PAT_TA_15029.pep
MTSSSSPSRKALSKIACNRLQKELAEWQLSPPAGFKHKVSDNLQRWVIEVTGAAGTLYAGETYQLQVDFPEHYPMEAPQVIFLNPAPMHPHIYSNGHICLDILYDSWSPAMTASSVCISTLSLSIRNKERQWTMTAINCATEVRNKWWSYRVMTRCVK

SEQ ID NO: 120612 - protein, 83 aa, Triticum aestivum
  Clone ID: PAT_TA_15030.pep
GTLPALELCYSMTQRLHLVDDDKDKPPLLQQQHEGAAAAPDASAPSPPVTNWKISSPGDSPDEVKARLKYWAQAVACTVRLCS

SEQ ID NO: 120613 - protein, 249 aa, Triticum aestivum
  Clone ID: PAT_TA_15031.pep
MGGRRTIVLSLILGLLAAANAVPFDFFYLILMWPGAYCEDSDNGCCVPKYGYPAEDFFVEFFQTFDVSINKPIVRCRNGSPFDAKKLDKIENNINHYWTRLKCPPTDGVNAWKSAWDNYGVCSGLKQLDYFKAALSLRKQADILGALADQGILPDYKLYNTARIKAAVAAKLGVEPGLQCRDGPFGKKQLYQVYLCVDTDAKTFIKCPKLPATLSCPASVVFHPFYTWMLNSTATFDSKILLPTQTMLN

SEQ ID NO: 120614 - protein, 214 aa, Triticum aestivum
  Clone ID: PAT_TA_15032.pep
QHGKPAVHNVLHKASEKSAQAKKWAEPHIETAKTKWIPVKEKLVVLKKNAEPYVQKVSTRSVELYESSRDAVTPHVVKVKEFVHPYYQEAKMFSKPYIDQIAEITKPHVEKVRTTLKPYTKRAVHAYGSFLESATTYHRQAQASIMDYLHQHDITKSFATKELVWFLASALLALPVFIIYRLLVETFCTKKNKRPRGGNGNHGHKRQKRRHADK

SEQ ID NO: 120615 - protein, 67 aa, Triticum aestivum
  unsure (1)..(67): unsure at all Xaa locations
  Clone ID: PAT_TA_15033.pep
IRTRVDRFVXVERLIGQDLHGTSPCAHHLVDLDGGALAATAGAGAAHHHHHHHVHLHLPRFVGCFRA

SEQ ID NO: 120616 - protein, 128 aa, Triticum aestivum
  Clone ID: PAT_TA_15034.pep
KTLCEKAKEILMEESNVHPVKSPVTICGDIHGQFHDLVELFRIGGKCPDTNYLFMGDYGDRGYYSVETVTLLVALVVRYPQRITILRGNHESWQITQVYGFYDECLRKYGSANVWKIFTDLFDYFPLT

SEQ ID NO: 120617 - protein, 157 aa, Triticum aestivum
  Clone ID: PAT_TA_15035.pep
RGAGSQLLLPSSIRFLFCRREDPHQGPDGSPCRRLRSALRHGGRPRGLRIGAGVHGACVCAGAGTGRWSRLRSGLRCRRGVVRTAVPACGHPDAVEAYLCISSTAYVCYYIHGHGHAWHGVVVGFVSRFEREFDRSIECLLFLILFGSYMSPTCVYI

SEQ ID NO: 120618 - protein, 208 aa, Triticum aestivum
  Clone ID: PAT_TA_15036.pep
MAASSLCHGHLLLFLLVAVASACLGTAAAHQAGSGEGYTIAGRVKIDGASAKGFGLPAKTSNTKVILNGGQRVTFARPDGYFAFHNVPAGTHLIEVSSIGYFFSPVRVDISARNPGYIQAALTETRRVLNELVLEPLKEEQYYEVREPFSVMSLLKSPMGLMVGFMVLMVFVMPKLMENIDPEEMKQAQEQMRNNPVSFSGLLSRAQG

SEQ ID NO: 120619 - protein, 122 aa, Triticum aestivum
  Clone ID: PAT_TA_15037.pep
MAAEEGVVIACHNKDEFDAQMTKAKEAGKVVIIDFTASWCGPCRFIAPVFAEYAKKFPGAVFLKVDVDELKEVAEKYNVEAMPTFLFIKDGAEADKVVGARKDDLQNTIVKHVGATAASASA

SEQ ID NO: 120620 - protein, 51 aa, Triticum aestivum
  Clone ID: PAT_TA_15038.pep
QSSIVTTNGRSRGNHGDNSVKPRRGHGGDHRTAGGRRRGRWRPLAGARRRG

SEQ ID NO: 120621 - protein, 166 aa, Triticum aestivum
  Clone ID: PAT_TA_15039.pep
MAAAAAAADGERRIGVAMDYSESAKKALDWAIVNLLHHGDTLVVLHVLHHSGEETKHALWAKSGSPLIPLSEFREPEVMQGYGVRTDAEVLDMIDTAARQKQLKVVAKLYWGDAREKLCDAVGDLKIDSLVMGSRGLGPIQRILLGSVTNYVLSNASCPVTVVKGK

SEQ ID NO: 120622 - protein, 188 aa, Triticum aestivum
  unsure (1)..(188): unsure at all Xaa locations
  Clone ID: PAT_TA_15040.pep
QDISLQVLTIFLLLSNFGASICEVANDAIVAESGKKAASSSGSGQLQSFAWLFGSSAGALGNLLGGIALSYFSPKVMFLFFXILLLLQFFTTVAIPEGSLKLPKAATPTNLSALTSIRKQVKELSCALSMPEMFGSIIWFTASYAVIPFLLGTMFFYQTEVLRLAPAAAGLALGCGHGWCINTQSRRV

SEQ ID NO: 120623 - protein, 110 aa, Triticum aestivum
  Clone ID: PAT_TA_15041.pep
LWISITMQQYETWGGRARVQMYTCRGLFGPNRNQRCISWHESTHQCLNIIRWTYSRFLTAFKMPMQVRNYTFDGANGHLELLRIVISMPWSLHSSCSSQNTFCLAPLHKR

SEQ ID NO: 120624 - protein, 162 aa, Triticum aestivum
  Clone ID: PAT_TA_15042.pep
ILFSFVSGIAGTSLFNSVSLMAYNVRYTSIPVLTTVLDKDLSEKTVTQNPEILLYCQAGRLLNPSTFAGWFGRSLYHAIVVFLITIHAYANEKSEMEELSMVALSGSIWLQAFVVTLEMSSFTFLQFLAIWGNFAAFYVINLCISTTPTAGMYTIMFRLCRQ

SEQ ID NO: 120625 - protein, 123 aa, Triticum aestivum
  Clone ID: PAT_TA_15043.pep
EILVPTLKAFSLRAYDPKEVIIAGGDQEAVVLSPSGSILAMIELPAPPTHALLLEDFSGDGLTDIILVTSGGICGFVQTRQPGALFFSTLVGCLIVVIGVIFVSLHLNSSNGGKPRASSAEYR

SEQ ID NO: 120626 - protein, 238 aa, Triticum aestivum
  Clone ID: PAT_TA_15044.pep
MLAVFSGGVVEVPAELVAAGSRTPSPKTRASELVGRFLGASEPAVSVQLGDLGHLAYSHTNQALLRPRSFAAKDEVFCLFEGVLDNLGRLSQQHGLSTKGANEVLLVIEAYKTLRDRAPYPASFMLAQLTGSYAFVLFDKSTNSLLVASDPEGKVPLFWGITADGCVAFSDDIDMLKGSCGKSLAPFPQGCFYSNALGGLKCYENPKHKVTAVPADEEEICGATFKVEGSTVLTALHF

SEQ ID NO: 120627 - protein, 156 aa, Triticum aestivum
  Clone ID: PAT_TA_15045.pep
MASKRILKELKDLQKDPPTSCSARPVAEDMFHWQATIMGPSDSPYSGGVFLVSIHFPPDYPFKPPKVAFKTKVFHPNINSNGSICLDILKEQWSPALTVSKVLLSICSLLTDPNPDDPLVPEIAHMYKTDRVKYESTARSWTQQICNGLMILLAAG

SEQ ID NO: 120628 - protein, 99 aa, Triticum aestivum
  Clone ID: PAT_TA_15046.pep
FGRGLKEVFDRLKAKDINLQVTEKFRDRVVDEGYNPSYGARPLRRAIMRLLEDSLAEKMLAGEVKEGDSAIVDVDSDGKVIVLNGGSGVAEPLEPALST

SEQ ID NO: 120629 - protein, 155 aa, Triticum aestivum
  Clone ID: PAT_TA_15047.pep
PMGNEMALPIPCIYSQYWVSHLSVNRMPKIQRGIQRASKTPPSPRCLQSISNSGSFLPCVYQEAVLLLYFFDLLTQCQAQNQTGTRTSASLQVHNGSPQLQCYILEAVCSKVCCPAALSHSSELFGSKHCHCAFQHLDKMVLPHQTTVEKEIQKI

SEQ ID NO: 120630 - protein, 162 aa, Triticum aestivum
  unsure (1)..(162): unsure at all Xaa locations
  Clone ID: PAT_TA_15048.pep
AFFARAYAPSKISYVVELWXDKLSLISEKAGQSLADPEQYENLFPGYRESLKVEKFLNEENKKKIPAVAFPAVKANIDRKPLEEMLEAEAASSSSIDYMSNRLHDLGIANESTTIQESKQNPNHSSRPLIVDDELDIELELDENIDTTDVNLDDELLTEEEE

SEQ ID NO: 120631 - protein, 67 aa, Triticum aestivum
  Clone ID: PAT_TA_15049.pep
MDNRSGMPQNSIQHQPAEEVIDEVVKEAINKPWLPLPLGLKPPSTDSVLAELSRQGISTIPPRNQRL

SEQ ID NO: 120632 - protein, 203 aa, Triticum aestivum
  Clone ID: PAT_TA_15050.pep
VHHAGALGRVLVQARPGHAVHAGHAPRRARLLRERRVHPRRDAGLQPRAEFGTRVQQRGSKEVAEPMEECPLAFECLNSGTQEKLDRTLEDAQNITELSNQDLFPLVPPGFKSMDNGKGTNIHDTQFDEEPIGTTNSFVEPKGNGDMCSDHAGTKLAESDHVMETGIVSLDCPAQQSRGKVLQNDGSSQCVYRQLSIEELLCF

SEQ ID NO: 120633 - protein, 182 aa, Triticum aestivum
  Clone ID: PAT_TA_15051.pep
LHQRLQQYENRWLEYEQKMKAMEEMWQKQMRSFRSSLSVAKKSLALDETPRMSDSSVDQSWESNGNHVSSGSQLVPRTGGREMNAGLSVIGRLNEEFEQRSQVFADDAKFLVEVKSGQADASLNPDMELRRLKQNFDSWKKDFSGRIRETKVILNKLGNGNESSPNSVKRKWWGRLNTSKVS

SEQ ID NO: 120634 - protein, 90 aa, Triticum aestivum
  unsure (1)..(90): unsure at all Xaa locations
  Clone ID: PAT_TA_15052.pep
VARLLVLPXLGIGVVTLADKLHLLVEQNHMYRFVLSLQYSTPSAILLGAIANLRGYGVKEASALLFWQHICAVVSLSLYLIVYFKLFSFI

SEQ ID NO: 120635 - protein, 155 aa, Triticum aestivum
  unsure (1)..(155): unsure at all Xaa locations
  Clone ID: PAT_TA_15053.pep
SCDCQELRAYPQKQLGGDGNHVFDAAMRYKSEGHATIILAGAEYGSGSSRXDGAPPGPVLPGVTAVGASCSGRLHRSNLVGMGIIPLCFIPPEVARSLARARHERCSLAIPPTITVARPSSPGLAACRHGETLRCLXRPVSVLPLAYCNHGRILP

SEQ ID NO: 120636 - protein, 111 aa, Triticum aestivum
  Clone ID: PAT_TA_15054.pep
RNSRFKLIPSVPKGSWIVRQSVGSTPCLLGKAVDITYIRGSNYLEIDVDIGSSTVANGVLGLVCGVITTLVVDMAFLVQANTYEELPERLIGAVRMSHIELSSAIVPVLED

SEQ ID NO: 120637 - protein, 61 aa, Triticum aestivum
  Clone ID: PAT_TA_15055.pep
RITSTAATGDQAAFILSIPKRKLMDETQETLRTSAFPSNHVKEKWAKNLYIASICYGRTVS

SEQ ID NO: 120638 - protein, 449 aa, Triticum aestivum
  unsure (1)..(449): unsure at all Xaa locations
  Clone ID: PAT_TA_15056.pep
MARNPCDIRLLLVAAAVAFIYIQVRLLSTQVVSSSSSNSHPFDAGRLAEAEKCESQLHAMIDQVSAQQEKIAALEEINVRRRDDRVQLXGLIQDXLDRVTVHKAKNQVMVRLASFFIVAYKRLDYCFFFVQLYLNHQLGVSSKVPLFISQDGTGGAAKSAALSYNQLTFMQHVXLEAVHTGRPGAKHVYYEIAHHYXFEFNELFTKHDFLRVFILXYDMEIASASFHLSLAAXKLLPISSHXLAVSSCIATRLMLFFFDTIPLLRTALFRGTSSRPMXAASMEPSPKWPNADCDDWVRLKEVHRDRQFIRPEVCRTYNFGEHGSSMGQFFDQYLKPIKLNDAHIDWNSEDLSYLKEDKFLTKFGKDVASATPVHGSDALLKAHNLDVDVRIQYDNQGDFERIARQFGLFEEWKDGVPRAAYKGVVVFRYKSSRRRIYLVGPDSLRQLGV

SEQ ID NO: 120639 - protein, 93 aa, Triticum aestivum
  Clone ID: PAT_TA_15057.pep
FFFFFFLQPEGQLKFYLCYMCPYHTIQNDSKFGGVSGMTCCRIGPHTISLLCLTTTVCYSRLLYTYIRMLYTHTAKTTCHPFILMRGKRGKEA

SEQ ID NO: 120640 - protein, 60 aa, Triticum aestivum
  Clone ID: PAT_TA_15058.pep
ANITMKLPAVGLDGSAAYSVRDLWKHETLSENVVGTFGAQVDVHDTKMYIFSPATSVASI

SEQ ID NO: 120641 - protein, 215 aa, Triticum aestivum
  Clone ID: PAT_TA_15059.pep
KMRDGKNLRCVQNNPRVLRLRDSAPHHAIVLKMEDGSDLLLPIIVSDAPSIMLLAALRNIRIPRPTIYNVVLEMTTRMGYEVRLVRITEMVHDAYYSRLYLAKIGNDQDTISFDLKPSDAINIAFRCKVPIQVNRRIAYNNGLKVVQPKVAESYVGSDDIQITRLDRPDDQHCSEAQEFDLVRNMLIAAVEERYKDAAQYRDQLSTLRSKKKNAI

SEQ ID NO: 120642 - protein, 92 aa, Triticum aestivum
  Clone ID: PAT_TA_15060.pep
PRVPSQDDHVRVGITLNRQSETFLLPRVQDMFESLLLSPSVGIQAEPFAEMRQRKCREGSEILGSIREKLRMLPKDTLSTEFQECCSGIEKL

SEQ ID NO: 120643 - protein, 104 aa, Triticum aestivum
  Clone ID: PAT_TA_15061.pep
FGRGLNGTSFMTRILKVVRRSSHEAAHFYGWPGSGRSSLYGRHGRMAYPRAVLPGGSFRGRAPMKAGARSLQWKREPSGTDSSAGAKTDMSVPFSSEQVLPPAT

SEQ ID NO: 120644 - protein, 148 aa, Triticum aestivum
  Clone ID: PAT_TA_15062.pep
MALRRIIKELKDLQRDPPTSCSAGPVSDDMFHWQATIIGPSDSPYSGGVFLVTIHFPPDYPFKPPKVAFKTKVFHPNINSNGNICLDILKEQWSPALTVSKVLLSVCSLLTDPNPDDPLVPEIAHMCKTDRLRYESTARGWTHKYAMG

SEQ ID NO: 120645 - protein, 76 aa, Triticum aestivum
  Clone ID: PAT_TA_15063.pep
FGGDSISPVRLRKVPAHYGIRFIQISCMCYVLLEFAPWELWQGEFFISEPEVSSPSAEKSSCFSTDLMIAILFDLF

SEQ ID NO: 120646 - protein, 84 aa, Triticum aestivum
  Clone ID: PAT_TA_15064.pep
MAVVCLMLLAVGLMVDATDKPTSCTDSVKNDSPPDSDCICSKNCACAGKCILMEPASVQSCFIDCVLKNDCICEDKKNGADQPQ

SEQ ID NO: 120647 - protein, 149 aa, Triticum aestivum
  unsure (1)..(149): unsure at all Xaa locations
  Clone ID: PAT_TA_15065.pep
MEVLGKSVIAEPSNVIFLSTILNTEGEIPSHKCDMRCQNEHIFGNMYRCKLTGMTHICDKNCNXRILYDNHNSLCRKSGQLFALSPPGCCRQLRGIREEXHKADSSQVXGCSFKRRRGAQLHPSPFERSXSAVSPIPSQAGDGMDLSES

SEQ ID NO: 120648 - protein, 102 aa, Triticum aestivum
  Clone ID: PAT_TA_15066.pep
AGDYDLRSRGPPTLDYQALDRICIVGQLGACLVLSPSTITHRRVRIASECGRIVLLPWRFEDCVSKIWLAPVGEPNRLAWPSELLVTCGNAARHGEASYAQN

SEQ ID NO: 120649 - protein, 307 aa, Triticum aestivum
  Clone ID: PAT_TA_15067.pep
TRVTISKRPASSLLPAVAALVAVAGLLSLAGPAAATGKTGQVTVFWGRNKAEGTLREACDTGTYTIVVISFLSVFGQGGNKPPTLDLSGHPIAGIGDDIKHCQSKSIMVFLSIGGFGDHYSLPSAKAATDLADYLWYAYFPAPTPRAGVHRPFGDAYVDGLDFFLDRGSPAYYDVLAKRLWSYNRQFRARTPVQLSATPRCAFPDRQVQRVLATGLVTRINVRFYGDAHCAAYWQQEWDKWTAAFPEDSIYVGLPASEQTVGYVHPKNLYYGVVPVVQKAANYGGFMIWDRYADKQTNYSSYAIQYA

SEQ ID NO: 120650 - protein, 254 aa, Triticum aestivum
  unsure (1)..(254): unsure at all Xaa locations
  Clone ID: PAT_TA_15068.pep
EADNDAGTVESVQKLDSXKDTKVSLSANHLQKLRLSFQLTTPLGHTFKPHQVFLKLKHESKVEHLFVVPGSARQFKIVLDFLGLVEKFYYLSGRYDLELAVGDAAMENSFLRSLGHLDLDLPEAPEKAPRPPAQAVDPFSKFGPKAEIAHIFRAPEKRPPKELSLAFTGLTLLPFIGFLIGLMRLGVNLKNFPSLPGPAAFASLFHAGVGAVLLLYVLFWLKLDLFTTLKYLGFLVIFLVFVGHRTLSYLSSVS

SEQ ID NO: 120651 - protein, 95 aa, Triticum aestivum
  Clone ID: PAT_TA_15069.pep
FFFFFFFLFVLQPKTGDYHLVLFETTTIVIGFIVLAGFIHRIQDFTSNITASTIFSASLKRTFRVQKATIPNSHPRHTNSKPEELSDLHQGFGTT

SEQ ID NO: 120652 - protein, 154 aa, Triticum aestivum
  Clone ID: PAT_TA_15070.pep
WPGRKFETYVFSLFDENQKPGPVAERNFGIFNTDFTPKYDLGLLRQGSSGSPNPSPKPSPNPSPSGGGKWCVAKSGASATDLQNNINYACGYIDCKPIQSGGACFDPNNVQSHASYVMNAYYQANGLHDYDCNFKGTGVVTSSDPSYGSCKYVS

SEQ ID NO: 120653 - protein, 75 aa, Triticum aestivum
  Clone ID: PAT_TA_15071.pep
IRTRENYPLWNLICNNKQLLKAEVHPWNSGEELEKTLLKLVSKMIAAPAQASQFDYSKCEMSNPAIQHPALRVPH

SEQ ID NO: 120654 - protein, 137 aa, Triticum aestivum
  Clone ID: PAT_TA_15072.pep
ATASCSTQQILLLPARIQSKARSAYPALHRGRVSVTCENLVSDHMAASLLGLHTSGGSGRGRRIHARSGGRRRSAAAVKQLLSRLSRSWRRRAVRPRRTAVRFGYDLHSYYPNFDDGHHPLVVAVLYCTVLYLASVQ

SEQ ID NO: 120655 - protein, 340 aa, Triticum aestivum
  unsure (1)..(340): unsure at all Xaa locations
  Clone ID: PAT_TA_15073.pep
TKSWKKLVNIAVSGAAGMISNHLLFKLASGEVFGQDQPIALKLLGSERSFQALEGVAMELEDSLYPLLREVSIGIDPYEVFEDVDWALLIGAKPRGPGMERAALLDINGQIFADQGKALNAVASKNVKVLVVGNPCNTNALICLKNAPDIPAKNFHALTRLDENRAKCQLALKAGVFYDKVSNVTIWGNHSTTQVPDFLNAKIDGRPVKEVIKDTKWLEEEFTITVQKRGGALIQKWGRSSAASTAVSIADAIKSLVTPTPEGDWFSTGVYTTGNPYGIAEDIVFSMPCRSKGDGDYELATDVSMDDFLWERIKKSEAELLAEKKCVAHLTXGEGNAYCD

SEQ ID NO: 120656 - protein, 114 aa, Triticum aestivum
  unsure (1)..(114): unsure at all Xaa locations
  Clone ID: PAT_TA_15074.pep
XKXGPSAGPVWAPPPPPPALASPAAAPPAWPPQAQPMVAPDAAPPDAHFSQPCRRPRIGELGYAANSTGVVIRLLLIIIVATACYMNPRQRVKMLLLGNCAFALGSKQACTIQG

SEQ ID NO: 120657 - protein, 127 aa, Triticum aestivum
  Clone ID: PAT_TA_15075.pep
MAHGKGGAARKEEVVTREYTINLHKRLHGCTFKKKAPNAVKEIRKFAQKAMGTTDVRIDVKLNKHIWSSGIRSVPRRVRVRIARKRNDEEDAKEELYSLVTVPAIPPEGLKGLGTKGIDVPVYARSS

SEQ ID NO: 120658 - protein, 88 aa, Triticum aestivum
  Clone ID: PAT_TA_15076.pep
WRPDRRVQGDAAMLREPIMNRLEEELWEVGRDGRSIGSCKAFWRTWMEVWETFNCNESSWTVSPTSYASEKIGRLTIGAFWGGLTAKG

SEQ ID NO: 120659 - protein, 50 aa, Triticum aestivum
  Clone ID: PAT_TA_15077.pep
FGTRGTQAEQVIDGLRPAHEGKLQRIPVFFVAKRLTTKVLQLFPLAQKEQ

SEQ ID NO: 120660 - protein, 103 aa, Triticum aestivum; identical to SEQ ID NO: 107316
  Clone ID: PAT_TA_15078.pep

SEQ ID NO: 120661 - protein, 243 aa, Triticum aestivum
  Clone ID: PAT_TA_15079.pep
SGAQLVAILPLAIVHTMGNLFTNMSLGKVAVSFTHTIKAMEPFFSVLLSAIFLGEFPTVSGVASLLPIVGGVALASLTEASFNWIGFWSAMASNVTFQSRNVLSKKLMVKKEESLDNLNLFSIITVMSFFVLAPVTFFTEGVKITPTFLQSAGLNVNQVLTRSLLAGLCFHAYQQVSYMILAMVSPVTHSVGNCVKRVVVIVTSVLFFRTPVSPINSLGTAIALAGVFLYSQLKRLKPKPKTP

SEQ ID NO: 120662 - protein, 94 aa, Triticum aestivum
  Clone ID: PAT_TA_15080.pep
DSDEAEMGTLPCPWRSGHLFAFITFALLFSTSFAGRHYSFLTDQGALRQQGEAARKEALVPLVQVRRLNVKTNDYSSYDPSPSMDKPHFKLIPN

SEQ ID NO: 120663 - protein, 94 aa, Triticum aestivum
  Clone ID: PAT_TA_15081.pep
EYLLVDDERISGVCFKVLKNDWTCIFALGLLLDLLCTGLQPSDELKSTLEPIRSSHPETADADPATVVCCILQKCDPLRVEYWSWFKATISQMS

SEQ ID NO: 120664 - protein, 378 aa, Triticum aestivum
  unsure (1)..(378): unsure at all Xaa locations
  Clone ID: PAT_TA_15082.pep
MGCCGSSLRSWVHAEKPPAPRRPAPPPPPPHRPSFSLKAQKAAPPPPAAPRGEEEQEVPALAEFSLAELRAATDGFAAGNIVSESGEKAPNLVYRGRLRGAAPRAIAVKKFAKHAWPDPKQFAEEAKGVGKLRHRRLANLIGYCCDGDERLLVAEFMSNDTLAKHLFHWENQTIEWAMRLRVAYCIAEALGYCSNEERSLYHDLNAYRVLFDENGDPRLSCFGLMKNSRDGKSYSTNLAYTPPEYLRNGRVTAESVIFSFGTVLLDLLSGKRIPPSHALDMIRSRNIQALMDSHLEGNYSTEEATTLVNLASQCLQYEPRDRPDIKKLVSILEPLQTKSEVPSYVMLGVPKPXEPSKAPPSPTPQPQPPLSPMGEACS

SEQ ID NO: 120665 - protein, 163 aa, Triticum aestivum
  Clone ID: PAT_TA_15083.pep
MSSAPAAAFVPSVNVPMPEVVTHTPSPAMPVLPTTIPMSAPVSAPAIAPVSASGAVPAPPPVSAVVPELSDLDVHNEEKLLRELEEMGFRQIDLNKEILRQNNYNLEQSVDDLCGVNEWDPLLAELEEMGFDDTEVNKELLAKNGGSIKRAVMDLIAREKKDK

SEQ ID NO: 120666 - protein, 291 aa, Triticum aestivum
  Clone ID: PAT_TA_15084.pep
RNSVRTNRPSLLCLLAVDVMATCTRAPPAAAAAAAAVTTDPGKERGAFLPELEKGKDAAILPPAIAPAVLAKPGKESGAFLPELEKGKDDAILPAAVAPAFLAKTGKEMDSCLPPPEKDKPLARPAPNTATENLVNPGKKMRRPVPMTDEERNKIKELKEQHRSGLDELEDLFQIHRELRDELLFRRRCLAARLVSRIVFQRRDAAYVKRHLDMGLKVGDKLPEELKQARPPISMALFLWHEMGRALHIGMDNFLDEYSNTEECQRSMLALVPGAVCDENGAPRDSVASQE

SEQ ID NO: 120667 - protein, 133 aa, Triticum aestivum
  unsure (1)..(133): unsure at all Xaa locations
  Clone ID: PAT_TA_15085.pep
SPRAPNFPPPAPRPAPGPGSGARPPSPPSPFAPPKAPPPPPPAPPPPXPASPGVPRVPHLEDPVPPLRRSGMLGLRPFGPAGSLGVRAVLALLRPLRLPRQLKEWMEWTGRAGLVGRFSRNPLHPQRRRSKQC

SEQ ID NO: 120668 - protein, 481 aa, Triticum aestivum
  Clone ID: PAT_TA_15086.pep
SADAWADAWETIECIKGEPSIEEYYDMFIEAEEHREFVPEAIMQLHTTQQFLAPGRLVVVKSKSDDDHLLGVIVKNPSATLKQYVVLVLTGDCTSSALAPNLSSQNEKGPGDSQGYFIIPPKGKRGMDDDFFSSSRTRKSSGVINIKLPYMGDASGMGFEVRAVENKEIISICTSKIKIDQVGLLEDISKTAYAKTVQMLIKEQTDGKYPPALDAIKDLKMKDMDQVKRYHAHNNLLEEMSKNKCHGCIKLKEHKSMMKDQKVHKDELDQLKYQMSDEALQQMPQFQGRIDVLKEIHYIDSDLVVQLKGRVACEMNSGEELISTECLFENQLDELEPEEAVAIMSAFVFQQRNASEPSLTPKLADAKKRLYDTAINLGQLQKRHEVPVDPEEYARDNLKFGLVEVVYEWAKGTPFADICELTDVSEGLIVRTIVRLDETCREFRNAASIMGNSALYKKMEIASNAIKRDIVFAASLYVTGI

SEQ ID NO: 120669 - protein, 87 aa, Triticum aestivum
  Clone ID: PAT_TA_15087.pep
VGRTAAPMKASLFLEALASAYNHGRSACLSRWWNLAASPRSCISFLGVRRCVHSTKHVTVMKLLRNSQNHQTTFQIMMLHHNAILMA

SEQ ID NO: 120670 - protein, 211 aa, Triticum aestivum
  unsure (1)..(211): unsure at all Xaa locations
  Clone ID: PAT_TA_15088.pep
PRVRPRVRIDSIVPRPGNQPKMYASHTPQSPIQSSDIGNQGSIQGSPNQTLLASQQAPVHSSSQLATQQQQQQRHMNPSHNNIQKLMMQQNRHMNSDVRIELPVDQVNQVIPSTSVARSTDSGSPGVSSIQHRKQDSSQDPTAVASTSQLASSPQDSXVGNEAFLSAPNQGMLXRQMSXXCSYTWKCYWHPAAATAGSAATSNSAAAAAET

SEQ ID NO: 120671 - protein, 216 aa, Triticum aestivum
  Clone ID: PAT_TA_15089.pep
VANYCHDLRELDLSRSFRLSDRSLYALAHGCPRLTRLNISGCSNFSDTALIYLTCHCKHLKCLNLCGCGKAATDRALQAIAQNCGQLQSLNLGWCDDVTDKGVTSLASGCPDLRAVDLCGCVLITDESVVALANGCPHLRSLGLYFCQNITDRAMYSLANSRVKSKCGRWDAVKDGLANLNISQCTALTPPAVQAVCDSFPALHTCPERHSLIISG

SEQ ID NO: 120672 - protein, 164 aa, Triticum aestivum
  Clone ID: PAT_TA_15090.pep
MSRPNRSDAHLSAEDEATLEAEVRGYYDDAAPKRHTKPSRSEHSAVYADALVPDAGGNTPPELDKFQELEAHTERLVYDGGNVGEEFVETEYYKDLGGVGKQHHTTGTGFIKIDKAKGASFKLSEDPSAEERHASCKGNPATNEWIPSADTVYPASDKPSRSDS

SEQ ID NO: 120673 - protein, 94 aa, Triticum aestivum
  Clone ID: PAT_TA_15091.pep
FGRGSRLLALGIGLEISDSMKNLISQQGYDRSYGARPLRRAVTQLVEDVISEAILFGQFKPGDTILMDTDATGKPCLSRLNDQTVQLSDPAPTM

SEQ ID NO: 120674 - protein, 86 aa, Triticum aestivum
  Clone ID: PAT_TA_15092.pep
FLNKPVEAFVSGVSNLDCLIKWCCRPGPATPQLIFCHRLQTLSSSHSRKHFFHQMDHDPRSPECGYWHRMVWSAFAACLQSLHQSL

SEQ ID NO: 120675 - protein, 191 aa, Triticum aestivum
  Clone ID: PAT_TA_15093.pep
SDEGRAVLCRKGTAVVISKDHRPTYDAERQRVIECGGYIEDGYLNGVLSVTRALGDWDMKLPQGSPSPLIAEPEIHWTTLTEEDEFLIIGCDGIWDVMSSQHAVSTVRKGLRRHDDPERCARELAMEAKRLETFDNLTVIIVCFVPDLAGAASAAAPSSEQAPAPAGRIRCCKSLSPEALCKLRRWLESDH

SEQ ID NO: 120676 - protein, 369 aa, Triticum aestivum
  Clone ID: PAT_TA_15094.pep
MEAIRKQASKLREQVARQQQAVLKQFGGGYADSVFADEGEAQQHSKLEKLYISTRAAKHFQRDIVRGVEGYIVTGSKQVELGNKLCDDGKKYGVENTCTSGSTLSRAALSFAKARSLMEKERANLLKAFGTQVTEPLRAMVMGAPLEDARHLAQRYDRMRQEAEAQAIEVSKRQMKLRETSGNGDMISRLEAAESKLQELKSNMGTLGKEAVAAMTAVEAQQQRLTLQRLIAMVESERSYHQRVLQILDQLEREMVSERQRIEGAPPPVIENSMPPPPAYEEVNGIFMRTPTVAELVETVEHFLAEAIQSYRAESETELNLSTGDYIVVRKVSNNGWAEGECRGKAGWFPSEFIEKRDRVLASKVAQVF

SEQ ID NO: 120677 - protein, 173 aa, Triticum aestivum
  unsure (1)..(173): unsure at all Xaa locations
  Clone ID: PAT_TA_15095.pep
DMKANICSVKYNPGSNFYVAVGSADHHIHYFDLRNPSAPVHIFGGHKKAVSYVKFLSNNELASASTDSTLRLWDVKDNCPVRTFRGHKNEKNFVGLSVNNEYIXACGSETXEVFVYHKAISKPAASHRFVSSDLDDADDDPGSYFISAVCWKSDSPTMLTANSQGTIKVLVLA

SEQ ID NO: 120678 - protein, 229 aa, Triticum aestivum
  Clone ID: PAT_TA_15096.pep
MATQTGVAASKVLILVGAGMTGSILLRNGRLSDVLGELQEIMKGVNQGTASGPYDIALIQAQIRNLAQEVRDLTLSKPITILNGKSDSGGGLSSYILPAAAVGAMGYCYMWWKGLSLSDVMFVTKHNMANAVKSMSKQLEQVSSALAATKRHLTQRLENLDGKMDEQVEVSKAIRNEVNDVKDDLSQIGFDVESIQKMVAGLEGKIELLENKQDVANTGYLVLCQVQAV

SEQ ID NO: 120679 - protein, 83 aa, Triticum aestivum
  Clone ID: PAT_TA_15097.pep
QCNCFKIHSLSLEISRHTTRITDQLPHISHLHWLLRQNPVTQKGGKKRRKQSKQTNKRKIMNARAVILVSTLDRLVKIKQQTR

SEQ ID NO: 120680 - protein, 83 aa, Triticum aestivum
  Clone ID: PAT_TA_15098.pep
ADLYETEDEISRLLSEGKVPVAVGENTKISNCIIDMNARVGRNVSITNTEGVQEADRPELGYYIRSGIVVILKNATIKDGTVI

SEQ ID NO: 120681 - protein, 38 aa, Triticum aestivum
  Clone ID: PAT_TA_15099.pep
IRTRVQDVTILVSWANMDALSPEFSQARRMDAKTHLEM

SEQ ID NO: 120682 - protein, 92 aa, Triticum aestivum
  Clone ID: PAT_TA_15100.pep
GPPLETSSLPRAEFGTRNHWVKISEAGLKRIYEKYTWKIYSERLMTLAGVYGFWKYVSKLERRETRRYLEMFYILKFRELAKTVPLAIDQPQ

SEQ ID NO: 120683 - protein, 57 aa, Triticum aestivum
  Clone ID: PAT_TA_15101.pep
VHFKNIKESSRFNDLPQDSPKNHKTQNGRCMYIVACYKTHWISLFFLKSSWKLHQEL

SEQ ID NO: 120684 - protein, 138 aa, Triticum aestivum
  unsure (1)..(138): unsure at all Xaa locations
  Clone ID: PAT_TA_15102.pep
LESLSSHVRTVVATLGGKQGAASRFDRWQYLHSGFTVWLSVSDASDEATAREEARRSVSSGSVSYAKADVAVKLGGWDPQYTRAVAQGCLVALKQLTLADEKLAGKKSLYITLGCXGDWPNIEPPGWDPESDAPPTNI

SEQ ID NO: 120685 - protein, 156 aa, Triticum aestivum
  unsure (1)..(156): unsure at all Xaa locations
  Clone ID: PAT_TA_15103.pep
GDRLTRAAKVLEQLSGQSPVFSKARYTVRSFGIRRNEKIACYVTVRGEKAMQLLESGLKVKEYELLRRNFSDTGCFGFGIQEHIDLGIKYDPSTGIYGMDFYVVLEXRAGYRVARRRRCXSRVGIQHRVTKEDAMKXWFQVKYEGVILNKAQANTS

SEQ ID NO: 120686 - protein, 167 aa, Triticum aestivum
  unsure (1)..(167): unsure at all Xaa locations
  Clone ID: PAT_TA_15104.pep
MAGAEGERWVGLATDFSGXSRAALRWAAANLLRAGDHLLLLHVIKEPDYEQSEAILWESTGSPLIPLSEFSDPIIAKKYGAKPDIETLDILNTTATQKEIMVVVKVRWGDPREKLCQVIHDTPLSCLVIGSRGLGKLKRVLLGSVSDYVVNNATCPVTVVKSSSTEG

SEQ ID NO: 120687 - protein, 164 aa, Triticum aestivum
  Clone ID: PAT_TA_15105.pep
EEVSLFARASLKLEQVEVNPCCRQNKLRVFCREKGIQLCAYSPLGGKGAPWANNSVMNSPLLRQIALTKGKTVAQVCIRWVYEQGDCVIAKSFNEKRMRENLDIFEWQLTEDECRRISTLPESRGTYDFFVHESGPYKTAQEFWDGEIVAGQANNDALSLDPTN

SEQ ID NO: 120688 - protein, 180 aa, Triticum aestivum
  Clone ID: PAT_TA_15106.pep
SARGCKCGMPLCICEAPKPEPAPTPVKNISTVPSTTQSNPKPKKPANTQQKASATSSNNSSSFLNIGLMSNDSNDKGLSDYEVSGEGLREAIKGGDVKGVKKLLTQGVDCNYCDKQGFTLLHLAALFNQTEIALILMDHGANVESKNGQGETPLDCAPTMLQYKMRQRMEELAASRRPLE

SEQ ID NO: 120689 - protein, 227 aa, Triticum aestivum
  unsure (1)..(227): unsure at all Xaa locations
  Clone ID: PAT_TA_15107.pep
NGSHCLNLEAAAAGSSTRRYQLCGAAVEGVSIYQQLFPAAVCGCNSDRILFVRADILGVEALASXYEQDIRLDKETSANVSYKQAAISDIGVYHGPSVGTNQDISNSEANLLEANAADGGKSSPATSTLTSFAHRDGSLPAEPKVHAARTDQIWSITKLSVKTSSVDGNGGNSSCMADACNEISSCNASPMEYSGNSDSDSEIFRVKRRSSILGRPAPDTETTNFSE

SEQ ID NO: 120690 - protein, 129 aa, Triticum aestivum
  Clone ID: PAT_TA_15108.pep
LASIHRLNSVEEATADVEWKLEGNGPWNIGTDFEFIHTPGHTPGSVCLYYKPPKVLFSGARVAKSEESDDLNLFLMYSKQSVSLQLESIRKLLEVEFEWLLPGHGYRIRYKDVQAKNAAMESLLANYLS

SEQ ID NO: 120691 - protein, 139 aa, Triticum aestivum
  Clone ID: PAT_TA_15109.pep
RHEANSILSGVLKVTGFVTSTVLNSKPAQKFFKLMPGEVILASLDGFGKVWDAVEVSGKNVMQTSSVVTTSVVTHRYGEQAGEATHNYLHATGNALGAAWAVFKIRKALDPKGNLKKSSFVSQAAHPVAKESIARQKKK

SEQ ID NO: 120692 - protein, 111 aa, Triticum aestivum
  Clone ID: PAT_TA_15110.pep
VMKSEGVNLIGENFMSGLKVVFDRERKVLGWKKFNCYSVDNSSNLPVNPNPSGVPPKPALGPNSYTPEATKGTSPNGTQVNVLQPSAGFSLKLHCNRNVFVAAALLLLVIL

SEQ ID NO: 120693 - protein, 228 aa, Triticum aestivum
  unsure (1)..(228): unsure at all Xaa locations
  Clone ID: PAT_TA_15111.pep
DSDEGLLTKLXGRKMAEFPLDPPLSKMLLASVDLGCSDEILTIIAMIQTGNIFYRPREKQAQADQKRAKFFQPEGDHLTLLAVYEAWKAKNFSGPWCFENFVQSRSLRRAQDVRKQLLTIMDRYKLDVVSAGKNFTKIRKAITAGFFFHAARKDPQEGYRTLVENQPVYIHPSSALFQRQPDWVIYHELVMTTKEYMREVTVIDPKWLVELAPRFYKGADPTKMSKRK

SEQ ID NO: 120694 - protein, 136 aa, Triticum aestivum
  unsure (1)..(136): unsure at all Xaa locations
  Clone ID: PAT_TA_15112.pep
MAMAAARRALLAHLRVPVVHPAAAAATIPAAGRLLSSTTETKGSFLDKGEVADRVVSVVKNFQKVEPSKVTPSAHFQEGPWDLIAWYTVEIVMAFEEEFXFEMPXNDAEKMDSIXTAVDFSASHPRSKIRGFLSLS

SEQ ID NO: 120695 - protein, 97 aa, Triticum aestivum
  Clone ID: PAT_TA_15113.pep
NVLIPAPCRACVQVRVPLPIGFAVFVVHLATIPITGTGINPARSLGAAVVHAAWKDHWIFWVGPLIGATVAALYHKLVLRGEAVKALGSFRSTSATV

SEQ ID NO: 120696 - protein, 60 aa, Triticum aestivum
  Clone ID: PAT_TA_15114.pep
MIGVGKAKQYANVLDKPLGRGRQEVSLSAFAFLFSELGQYNQTQVDNIAELERRLEGPGM

SEQ ID NO: 120697 - protein, 196 aa, Triticum aestivum
  unsure (1)..(196): unsure at all Xaa locations
  Clone ID: PAT_TA_15115.pep
MIRVGKPRQYANMLDKAISRGREKVIYSALALXYRRSVSVPXTQLDNLADLDSKLKGARYAVGARVLELMCHMVXGQERLTRLLGSLTCIHSTVWKVLFGKVADSLEKGTEHEDEYMISEKELLVNRFISVPKDMGAFNXCGAFVAGIVRGVLDNAGFPXAVVTAHFVPIEGQQRPRTTILIKFAEEVLRRESRLG

SEQ ID NO: 120698 - protein, 110 aa, Triticum aestivum
  Clone ID: PAT_TA_15116.pep
RSSGPLTSWSEQKPCVRANQSTAIGNVISMRCCLYLVLKYSSIWNLQLHSRLGGDCHLALEIAPTICIRQTGTFLSFLNKNQALFSNTDATTQRVWSGMTIYKTISDRNS

SEQ ID NO: 120699 - protein, 152 aa, Triticum aestivum
  Clone ID: PAT_TA_15117.pep
MGKDSKPKDAKGKDAKGKGKQAAGSSGGDDGGGKGGKGKGGKSADGLGTCTYVKARHVLCEKQGKINEAYKKLQDGWLDSGDEVPPAEFAKVAQEYSECPSGKKGGDLGWFPRGKMAGPFQEVAFNTPVGACSAPFKSTHGYHFILCEGRKN

SEQ ID NO: 120700 - protein, 236 aa, Triticum aestivum
  unsure (1)..(236): unsure at all Xaa locations
  Clone ID: PAT_TA_15118.pep
GAIPANPNMKAIQESLEDISYLLRIPQRKPYGSMESDVKKSMKIAMDNKEAILGSIPAEHKEEGAKLYTSLLEEKGGFQTLLKYIKENDPDKLSIALASSLDIVAELELLQAPGLSFLLPQQYLEYPRLTGRGVVEFTVEKGDGSTFFPTGGGEPKSVATIQVIIXDGYSAPLTAGNFAKMVLDGAYDGVTLKCASQAIIADNETGKNGYTVPLEVKPAGQFEPLYRTPLSIQDGE

SEQ ID NO: 120701 - protein, 250 aa, Triticum aestivum
  unsure (1)..(250): unsure at all Xaa locations
  Clone ID: PAT_TA_15119.pep
LKDPVFSNILRYRSNVDLKDKWRNMNVTVNASGTRDKVRTTTTTTPTAKKPRSAPKQENHPTAITTITSDGDDDVIDVEAYHKAYRDVYYRFTGIIRYPKLRKYHTGRLLNTLNDPTGSYKPALLISIEEHXWSPPDFLLYIGEPXKVPLLGNVKEDPTKVEKVERDGFTAHTKSQVDAELARMRNMSAEEAAAAAARAVAEADAIMAEAEAAVREAEAAEADAVAAQAFAEAAMLTLKNRSSAKLIIRG

SEQ ID NO: 120702 - protein, 172 aa, Triticum aestivum
  Clone ID: PAT_TA_15120.pep
FGTRRRRRSPQDAIPGGHAHAQLEGPGRSPLRAPTGGGGCCCRRRRPCCWRRRQGEAGDQQAGAEEDARQGGHVAGRHGVSHAQGGEWPRTGGGVLLWRVATGAGEHTGRQRSLARTLYCLASFFDHRSDSCESHRISDRAYTTYIQEVTQDTFWNKRKQSICMLGIAYIHM

SEQ ID NO: 120703 - protein, 87 aa, Triticum aestivum
  Clone ID: PAT_TA_15121.pep
LSLERDAEEEAGSRAKMKEQANAPEDLPPQLLFAHQGQKDLKELHWHPQIPSMIISTAIDGFNVLMPSNIDTTIPGNTDTAMASAEP

SEQ ID NO: 120704 - protein, 231 aa, Triticum aestivum
  Clone ID: PAT_TA_15122.pep
VMADFDTSRNDIVEEEEFVQGMKKWLNEFKRNMPAGGAFSSKFNEYHERTRQEHDQLIDRSDEAVESVENPGWCITKAVALRLLGAAIAAAFADPLVDAVHNFSNATHIPSFFISFIALPLATNSSEAVSAIIFASRKKQRTCSLTFSEVYGGVTMNNTLCLGVFLALIYFRNLTWDFSSEVLIILLVCVVMALFTSFRTTFPLWTCLVAYMLYPFSLVIVYILDYVFGWS

SEQ ID NO: 120705 - protein, 290 aa, Triticum aestivum
  unsure (1)..(290): unsure at all Xaa locations
  Clone ID: PAT_TA_15123.pep
MAEQPHAEDAGHKPETLMEKIADKLHVGGGDHSSSSSDSDKEEHPRPSPPPARSRPRPXPSEVTTASFAASASAAAADAKNKMFRLFGREQPIHKVLGGGKPADVFMWRNKHISAGVLGGATAIWILFELLGYHLLAFLGHXALIFSLGVLFLWSNASSFINKSPPXRIPEVIIPEDLVVNIALSTRHEINRAFANLRQIALGRDIKKFLIVIAGLWLLSILGSCCNFLTLFYIVFVVLHTVPVIYEKYEDQIDTYGEKGWIEVKKQYAVFDAKXVLSKVPRGPLKDKKN

SEQ ID NO: 120706 - protein, 182 aa, Triticum aestivum
  Clone ID: PAT_TA_15124.pep
RHEARAARVDGDSQRRASVVSPSYFSNGSGSRSRPPSVPPLMPQFMRAHGSISEQYQQNSSSSLFAGAHRSGGMRPAPTPLPENPTFSLFPPGSSGHSSMETDDVGGSRFYAWERDRFAPYPLMPVDCETSWWTSQQQSHSTSEPTSAPRRLFGQWLGVGRSSPEHRSPEGSSYRQMHSPRM

SEQ ID NO: 120707 - protein, 218 aa, Triticum aestivum
  Clone ID: PAT_TA_15125.pep
GVRKPAHLFLDELGVAYDEAEDYVVIKHAALFTSTVMSRLLARPNVKLFNAVAVEDLIVKGGRVGGVVTNWALVSMNHDTQSCMDPNVMEAKVVVSSCGHDGPFGATGVKRLQDIGMISDVPGMKALDMNTAEDEIVRLTREVVPGMIVTGMEVAEIDGAPRMGPTFGAMMISGQKAAHLALKALGRPNAVDGTIKVVSPALRQEFVIASKDDEVVDA

SEQ ID NO: 120708 - protein, 254 aa, Triticum aestivum
  Clone ID: PAT_TA_15126.pep
MDEWIRQAEVWVRQAESWIRQQPPEQIYVAAAVVAVTILVLIGASCLKSSKLNTIVLSGLSGSGKTTLFYQLRDGSSHQGTVTSMEENSDTFVLHSEQEKKGKVKPVHIVDVPGHARLKPKLDEVLPKAAGVVFVVDAQDFLSSMQAAAEYLYDILTKATVVKKKVPVLIFCNKTDKVTAHSKEFIKKQLEKELNKLRESRTAISSADISDEVQLGVPGEAFNFSQCQNKVAVAEGAGSAGNVLAVEQFIREHV

SEQ ID NO: 120709 - protein, 209 aa, Triticum aestivum
  unsure (1)..(209): unsure at all Xaa locations
  Clone ID: PAT_TA_15127.pep
SARGLTTFNEVDMTNLMKLXRSDYKDXFVTKDGGKLDLMSCFDKAAVSALQNQPIVNAVIDGDDIIYRDYVDVSVTVGTSKGLVVPVIRDADTMNFADIEKGINNLAKKATEGALSIDDMAGGTFTISNGGVYGSLLSTPIINPPQSAILGMHSIVQRPVVVNGDILARPMMYLALTYDHRLIDGREAVFFLRRIKDVVEDPRRLLLDI

SEQ ID NO: 120710 - protein, 202 aa, Triticum aestivum
  Clone ID: PAT_TA_15128.pep
HERKSMFISDESRKLTAYHESGHAIVALNTKGAHPIHKATILPRGSALGMVTQLPSQDETSISKKQLLARLDVCMGGRVAEELIFGEENVTTGARNDLHTATELAQYMVSNCGMSNAIGPVHVKERPSVDMQSRIDAGVGRLLREAYERVTHLLKKHEKQLHALANALLERETLTEDEINKVVHPYQEEPQLPFQEEAFALT

SEQ ID NO: 120711 - protein, 79 aa, Triticum aestivum
  Clone ID: PAT_TA_15129.pep
VRYHNKNTRQLLLTFSTIPCALTTSSFLLYLLHYPLISLLVLYNISTHPYHYRIYHVSGLPCIFLLCNNLSTYEISSLN

SEQ ID NO: 120712 - protein, 196 aa, Triticum aestivum
  unsure (1)..(196): unsure at all Xaa locations
  Clone ID: PAT_TA_15130.pep
MGFVSFVGRVLFASVFLLSAYQEFSEFGTDGGPAAKSLKPKFNLFVKQVSAGIGMAVPHIDIKSVIAFTMFLKAFGGLLFIISSSFGALVLLVYLAFITPVVYDFYNYEMESQQFAKLFTMFSQNLALFGALLFFLGMKNSIPRRHSKRRTAXAKTTWKPARGIVVGGESYQYGNSVVFYAYFWSSTCPAFCPLGS

SEQ ID NO: 120713 - protein, 128 aa, Triticum aestivum
  Clone ID: PAT_TA_15131.pep
MEGPAAKSLKPKFNLFVKQVSAGIGMAVPHIDIKSVIAFTMFLKAFGGLLFIISSSFGALVLLVYLAFITPVVYDFYNYDMESQQFAKLFTMFSQNLALFGALLFFLGMKNSIPRRHSKRRAAKAKTT

SEQ ID NO: 120714 - protein, 167 aa, Triticum aestivum
  Clone ID: PAT_TA_15132.pep
ATVCDDGSTQPSAPSLAAPSPRVSRPPPYLPATWPPDAAIPHPRRRTRATRQRDATNGSPPTRPPRQDVGGGGDRQRHAARTPGRGMRARVVPDGALDVQEELPIRRNSSCRPPPPSRRPHPRRRLPPPGGRRPPPPGAGPPGGARRASRAPRRGANRRKKSPMYLV

SEQ ID NO: 120715 - protein, 200 aa, Triticum aestivum
  unsure (1)..(200): unsure at all Xaa locations
  Clone ID: PAT_TA_15133.pep
GTRVLAIQRVASCLQSECEIKNNCNLMSLACSKEMCFHFPWSSDMTALACDTNLTSFSQQNVPACLSGNGAFAYGIYKGALPVISSNSLAVKILYPIFWGLMTLSTFGNDLEPTSNWLEVIFXSIINVLSGLMLFTLLIGNIQVFLHAVLAXRKRKMQAAGSGTWEWWMKGGGKLPSPAAGQPGSAKYPRSGGAGITGER

SEQ ID NO: 120716 - protein, 146 aa, Triticum aestivum
  Clone ID: PAT_TA_15134.pep
ILADGIQDDCGNVTRFVMLAREPIVPRTDRPFKTSIVFAHDKEGTSVLFKVLSAFAFRDITLTKIESRPHRHRPIRLVDDANRGTAKHFEYMFYVDFQASLAEPRAQNALAEVQEFTSFLRVLGSYPMDMTPMTAGSSSTVTSSDS

SEQ ID NO: 120717 - protein, 216 aa, Triticum aestivum
  unsure (1)..(216): unsure at all Xaa locations
  Clone ID: PAT_TA_15135.pep
PRVRKENITRVISHPQALAQCEHTITRMGLNVVREAFDDTAGAAEYVANNGLRDTAAIASSRAAELYGMEILADGIQDDCGNVTRFVMLAREPIVPRTDRPFKTSIVFAHDKEGTSVLFKVLSAFAFRDITLTKIESRPHRXIRLVDDANRGTAPKHFEYMFYVDFXASLAEPRAQNALAEVQELTLFLRVLGSYPMDMTPMTGGVASLDSLSAYS

SEQ ID NO: 120718 - protein, 331 aa, Triticum aestivum
  unsure (1)..(331): unsure at all Xaa locations
  Clone ID: PAT_TA_15136.pep
RRLPKNLPAPLRIADVSPAPMHGSELRVAARGXPGAYSEKAAXGKAYPGCDAIPCDQFEVAFQAVELWIADRAVLPVENSLGGGIHRNYGLXVPVHHXLLALPGVRKETITRVISHPQALAQCQHTITRMGLDVVREAFDDTAGAAEYVANNGLRDTAAIASSRAAELYGMESLADGIQDDCGNVTRFVMLAREPIVPRTDRPFKTSIVFAHDKEGPSVLCKVPSAGASRHCSPTWSPSRPHRHRPIRLVDDANRGTAKHFEYTSPAAARRSISSTXFYVNFQASLAEPRAQNALAEVQEFTSFLRVLGSYPMDMTPMTAGSSSTVTSSDS

SEQ ID NO: 120719 - protein, 165 aa, Triticum aestivum
  Clone ID: PAT_TA_15137.pep
GGDNPQQQEQPQRTIYTGGTVGYMDPEYYRLQHLTRHGDVYSFGVVLLELMSGCRVVQRYAESVTPKNVVDFTVPHILADDVARVLDPRLPAPTPHEAEALAYVGYLAADCVGPVGCERPSMTEVVDALERALAACSTAPVSRSGTARRVLSRSGTDQFDLTDTD

SEQ ID NO: 120720 - protein, 144 aa, Triticum aestivum
  Clone ID: PAT_TA_15138.pep
RHEVTVKTSSARKDDKICSPPCRLWSLAPPVCVRRCVTHPSILTPAYPSCFCLTRFSSSVQHRPPGSSGARSGKEGTPQEKRRALRPRCSPRQRSGGGARIDGHDEAQSSLFPQLPSHPILQHEVTYPFPQLFFFLRAFLRRFL

SEQ ID NO: 120721 - protein, 139 aa, Triticum aestivum
  unsure (1)..(139): unsure at all Xaa locations
  Clone ID: PAT_TA_15139.pep
CDTSCTHYSCFVLCKICSDVVATAFRQRSTSSSSHASGLLTVPAVETRDSCGRDGDDDLLLLLLLLGDVTLFRPTSSIAIAFRCRASTXWPSPXNEGVDRARXGNQQATGXSCSAQXRLVFNSRPIXXXAXRLTGGXPX

SEQ ID NO: 120722 - protein, 200 aa, Triticum aestivum
  Clone ID: PAT_TA_15140.pep
DGFSVYDAGGELAFRVDNYSRRRKIFAGELTLMDGRGAPLLSLRPQIISMHDQWNCYKAPEEGQAKRARSQQLFSVRKCSVLQNNREAEVYMSSAAPSTTDASASDHGSTGHQSPGFWIEGCFRRRNCKIRRAHDGKEVARIARKKARTAATPDTAPLTLGEDVFSLVVQPDADCTMIMALVVVLDRICWRPYTPLICSS

SEQ ID NO: 120723 - protein, 103 aa, Triticum aestivum
  Clone ID: PAT_TA_15141.pep
GFRVCFAGGCNGAFSYFGRVSFRVVKNTQAFYFFITAMLQLFDRSGMLYGELARFVLRLLGVRTKSKKGRVQGAEAPAFEGPGQQLFEAPKAGNNSWDNVWGN

SEQ ID NO: 120724 - protein, 87 aa, Triticum aestivum
  Clone ID: PAT_TA_15142.pep
MSQRPGRHQRRASQSVFSLPENFASLEDVPADGVGEQRKPAAAGADASEQQPARAPAGRHRRAMSMAVPSRDLDMIAEDMGSYKYGA

SEQ ID NO: 120725 - protein, 413 aa, Triticum aestivum
  Clone ID: PAT_TA_15143.pep
MERVVVVSEDAAASVSSGPSSSFAETRVICRVCQKQFAQYTCPRCNSRYCSLTCYKGHSVQCTESFMRENVTEELKQIQPEDESKRKMLDILRRFHLEEEMESDGEDESMLSEELIQKAISGDEIKLEDLSDDEIKRFRQALASGELSKMIEPWTPWWKNPSAKSISLSHASGQLIRQISTDDTTLSDPMTASESIINEIPEGPEYPLPSLKQLTRAEPSPLLTVHLVDILYSYCFTLRLYNGDWQSDPLGASTVALSMSKVMGDGAKPETVSEALTTCIEETCSPAYRHTGGFRFAIGLVDDIVTILSLGGNAAACALCDFHRLIQACESILKEDKMGETEKAQSFKKLHAAGRKLFFMTCWAHEQPSEAWPSLARIVEVQKAAFEELDSGSGLRKAGRKNNPQSKVLIEEV

SEQ ID NO: 120726 - protein, 206 aa, Triticum aestivum
  unsure (1)..(206): unsure at all Xaa locations
  Clone ID: PAT_TA_15144.pep
DTPRRHSSAPPSPGHLLPPTAAAGATELAGAAFPVGVVISARTTLGEEFGGQIVSFDRPSNLLVIQEGVGRAERGERRNVRVLKAKYSQEFSVVGKYDDPLDPAGRVLDLAAIHATEEAAPRQAEIEAERIGVGVTPEAQRLFDALSKTLPVHWDKTDIVVMXEVRGMQSXLPEYVSGGTSAANERVKKVLDFERKRQHVRVPGQF

SEQ ID NO: 120727 - protein, 97 aa, Triticum aestivum
  Clone ID: PAT_TA_15145.pep
DSRLYALNCSLVSPTFFSSLHTATVACCSEVFVICITLSVKTTKPIKLIRENGLNLSDPLPEMSIWKLYKHACEYLVHPPVAHPFPPYSALVAMESR

SEQ ID NO: 120728 - protein, 199 aa, Triticum aestivum
  Clone ID: PAT_TA_15146.pep
EGEGGLFKYIEKRLKENGHMVIVVAGRAGQKLIAENMKEMGQDASGNALLLDVGLWLSQKINEHFKKNKTTINLKYIDPTYMIRAIPSNASDNVYCTLLAHSVVHGAMAGYTGFTVGQVNGRHCYIPFYRITEKQNKVSITDRMWARLLSSTNQPSFLSKQDVDDAKVEDERTAKLLDGSPSNPKVEDKVVPSNSNGVK

SEQ ID NO: 120729 - protein, 204 aa, Triticum aestivum
  Clone ID: PAT_TA_15147.pep
MYHGGPGMSPAAAGGRGGTARKVAPWILACGFLLCSSVLFLGAEGAIGVNYGMIANNLPTPDKVIAMYKANKISYVRLFHPDTTVLTALRGTGIGVVLGTLNEDLAHLASDESFAASWVASYVKPFAGAVTFRYITAGNEVIPGDLGTHVLLAIRNIETALKAAGVTGVPVTTAVATSVLGVSYPPSQATFSEASAPVMAPLVA

SEQ ID NO: 120730 - protein, 112 aa, Triticum aestivum
  Clone ID: PAT_TA_15148.pep
SVQLSEAARKIAEVQRECKLDVNVEEYVESTCKPYLMDVIYCWSKGATFGEVIEMTDIFEGSIIRLVRRLDEFLNQLKAAAEAVGEVNLEKKFGLASESLRRGIMFANSLYL

SEQ ID NO: 120731 - protein, 217 aa, Triticum aestivum
  unsure (1)..(217): unsure at all Xaa locations
  Clone ID: PAT_TA_15149.pep
MIPLLFLVLFAEGAVALLLMVKIGPLRELAMRGVEQVKTGKGPATVKTRGGGRSVILMSSVXAIVRIQDRGHKIGNVSPMDQVLWRTHLLEASLIGYTLFLAFVIDRLHHYLRKLITLRKSANTSREEVEKLQMENRSLREKEEKSASEMKKLQQDMAKLSEDMKKLKSESEDHQRKASDAEAHVNALQKQSEELLLEYDRLLEDNQILQSQLHYKG

SEQ ID NO: 120732 - protein, 129 aa, Triticum aestivum
  Clone ID: PAT_TA_15150.pep
RRGEQTAVYFYVSRGLDGGLHTSFCQDELRSSRAKDVTKRVIGSMVPVLDGEAFSMRVLVDHSIVQGFAMGGRTTMTSRVYPMEAYQEAKVYLFNNATGASVTAERIVVHEMDSAHNQLSNMDDHSYVQ

SEQ ID NO: 120733 - protein, 247 aa, Triticum aestivum
  unsure (1)..(247): unsure at all Xaa locations
  Clone ID: PAT_TA_15151.pep
HASEWYDILGVLSGSMTVLPNGTVIMIYTGATNASAVEVQCIATPADPNDPFLRRWTKHPANPVIWSPPGIGTKDFRDPMTAWYDESDDTWRTLLGSKDDHDGHHDGIAMMYKTKDFLNYELIPGILHRVQRTGEWECIDFYPVGHRTSDNSSEMLHVLKASMDDERHDYYSLGTYDSAANTWTPIDPELDLXIGLRYDWGKXYASTSFYDPAKKRRVLMGYVGEVDSKRADVVKGWASIQSVPRQL

SEQ ID NO: 120734 - protein, 456 aa, Triticum aestivum
  unsure (1)..(456): unsure at all Xaa locations
  Clone ID: PAT_TA_15152.pep
GRAELYCGWTTSSPSEERSSTADNPSLGCTSVAGSTGSPCRSVIWPTGGVGSRDFRDPSSAWYDESEDTWRTLPGSEDDNKGHHDGIAMMYKTKDFLNYELIPGILRPVERTGEWECIDFYPVGRRTSDNSSEMLHVLKASMDDERHDYYSLGTYDSAANTWTPIDPELDLGIGLRYDWGKFXASTSFYDPAKKRRVLMGYVGEVDSKRADVVKGWASIQSVPRTIALDEKTRTNLLLWPVXEIETLRLNATELSDVTLNTGSVIHIPLRQGTQLDIEATFHLDASAVAALNEADVGYNCSSSGGAVNRGALGPFGLLVLAAGDRRGEQTAVYFYVSRGLDGGLHTSFCQDELRXSHGPKDVTXRVIGSTVPVLDGEAFXSMRVLVDHSIVQGFAMGGRTTMTSRVYPMEAYQEAKVYLFNNATGASVTAERXLVVHEMDSAHNQLSNMDDLSYVQ

SEQ ID NO: 120735 - protein, 213 aa, Triticum aestivum
  Clone ID: PAT_TA_15153.pep
ESEVCTVDNFVNHIRIREEPGPEETAAKLRPKSQRKPGRASSKAVGTSDDHAAANLKDINASVDIDSQDGLINPHTDDTQPIFGEPSAEAAATFLLDLGKKKGKGKSVTFVLPDDYEGVAATDTNHNDIRSDENLNTLPQQAPQKHCLTEEHSDDQEYTDRESQYHEGERSDHGVEQQSKLDVGKQELSMKLRSRTEIQKVGLSEHIVDDHLD

SEQ ID NO: 120736 - protein, 178 aa, Triticum aestivum
  unsure (1)..(178): unsure at all Xaa locations
  Clone ID: PAT_TA_15154.pep
MPPISLLPLLLLLAGAAAAAPADSPTPPTPAAKNKTIYELLPLFGLPXGVFPANVTAFSLAGNGSLAVDLAGPCYVHFEYLTYFEPRVTGLLRYGSLTQLEGVQVRRFLVWFSVVRVKVDLPPPPRFVYLDIGWITRKLPAXIQSVHACEAGKRRRRCRLSSALAAAAAWFQDFFAQF

SEQ ID NO: 120737 - protein, 219 aa, Triticum aestivum
  Clone ID: PAT_TA_15155.pep
MSAAGEDIVQHVRSNSNPSSSKLAKLEARMAGKAVSVPPPSPPHHPVVAPASAPTFMDQEELPESSSSSDDDNGEEFLIQKNTLKRPRSPDDDHGLALGNFEGSANAAAKVLDVMDTRLPSENPSRKRQGRGRGRGGTGRGRGSKTVDQTRHTSASSVTVSNGQHDKLTDVDSRTSVLPGNDDRTALHEELSLLRGKVAFLEEELNKSRQEATEHHQLS

SEQ ID NO: 120738 - protein, 74 aa, Triticum aestivum
  Clone ID: PAT_TA_15156.pep
ILKLGHTTKYLFYWRSLWNWVVLIRMLLQQLTQSMWLMNQIVVATGKSISAIARYQDPMGIGRTNHHHYCFRIR

SEQ ID NO: 120739 - protein, 141 aa, Triticum aestivum
  Clone ID: PAT_TA_15157.pep
LDPRDGNEGNLVRVVTARAEFGTRSDVFLPLELSDQLWHMSLPVGASRDHPVANPFGPESPSLAPVELPPALVVAPLGDVLRDRALGYAARLKDMGKDVELVEIEGQQHGFSVRQPFGEAADELMRVLRRFVYQCDTPAER

SEQ ID NO: 120740 - protein, 139 aa, Triticum aestivum
  Clone ID: PAT_TA_15158.pep
RGNQARHPNVPLGTKGDEGWVAWTSWLLRGAVAWAKPAAKARNPHQRSPPARIDSGWSPPLRRRQTRKGRTLPTLLAAPAHAARTVRRKIQQVVNSSSPSPALLSSRNPQKKVSSCSGLYVFFENFSAGSISSGLPCAE

SEQ ID NO: 120741 - protein, 154 aa, Triticum aestivum
  Clone ID: PAT_TA_15159.pep
AGMVTACITMVIAALVEAKRLRVAKDAGLLDRPDVAVPMSLCWLVPQYVLIGLAEVFSYIGLEEFFYDQVPEALRSVGLALCLSIFGVGSYASGMLVWAIDWATKRGGGESWFSDNLNRAHLDYFYWILAGLGALEVVVFLYFAKQYVYRDKPE

SEQ ID NO: 120742 - protein, 309 aa, Triticum aestivum
  unsure (1)..(309): unsure at all Xaa locations
  Clone ID: PAT_TA_15160.pep
MCPGAPVAAAASDKSVCVMDASGPLGHALVHRLLRRGYTVHAATYGHSLDALALLAAAGHDEDRLKLFRADPFDYHTIADAVRGCSGLFCMFNTHEDQAGCDEVMVDGXTVRAAQNVLEACAQTVTMERVVFTSSVTAVVWKDDHKLVDAFDERNWSDLNLCRKRKLWHALAKTLSEKTAWALAMDRGVDMVAINAGLLTGPGLSSAHPCLKGVPEMYEHGVLVTVDADFLADAHVAAYECPTAFGRYLCFNNVVCRPEDALQFAQMLTPSAPCYPPSDELKVIPQRIQNKKLNNLMVEFASAIYGDLD

SEQ ID NO: 120743 - protein, 295 aa, Triticum aestivum
  Clone ID: PAT_TA_15161.pep
YHHSMLKAGHCYGPFDPVSNIIINTIWYNTVSPPSQKLELDMISTMSLLRIEARSFYGLVSFLCTSGKKLYEAMRFLLISASTLGKTQPFSNPLSDFGDENKKFHAFRAAGVAAWHPDPVAQAEFISKRSHTLIRHKINAPLDSADVDRITRKMFQGPPTPGNSLQHQSDPMPKLYKIPDEHTRVSKKVKAALASYALENRESTYDLHVICGVNHNVSGPEYCMDVDKPIFIYHHIHVNFLASQGGGDPKLFFAELSNDDAEDGGRKVLCCPVNFPKPRQEQIRCMYCDYEGTKI

SEQ ID NO: 120744 - protein, 248 aa, Triticum aestivum
  unsure (1)..(248): unsure at all Xaa locations
  Clone ID: PAT_TA_15162.pep
MADYEQEQEMELEALQAILMDDIKEIDPSESGIDTNSRCFEILLSPQDDDFDEAAHVPVQMALVFAHTEKYPDEPPLVNIKSVRGIKPDDLTSLKEKLDQEATENLGMAMIYTLLDSAKEWLTEKYGQNAGDEEPDETEEPAEEVIIPHGEAVTVESFMAWRERFEAELALQRAKLMPESALTAPKEKKLSGRQYFESGRHITKGAGTVAEEDEEEEEDIEFDDDFEDDEEDMLXEHFLAEQTGKSSA

SEQ ID NO: 120745 - protein, 270 aa, Triticum aestivum
  Clone ID: PAT_TA_15163.pep
DAWVALAGAANATFRPRLVTAAADTSDTNTRRRHWKAGEFPFPTTSPSSGTQQRRRPRTTERPPPPPPSKGEDPEGRGRQRHWKAGEDPEGGGRQRHWRAGEFPAAAESQSQSGRRGRARTPIKNVQKRLDARADAKAWACTVTEALADRIAAKNWREALQVFEMLKEQTFYYPKEGTYMKLLLLLGRSGQPSLAQDLFTEMQQQGCQPTPELYTALIGAYCRNGLLDEALKLLEDMKAAPLCQPDVYTYSILIKAFVDASRFDLVDAMY

SEQ ID NO: 120746 - protein, 202 aa, Triticum aestivum
  unsure (1)..(202): unsure at all Xaa locations
  Clone ID: PAT_TA_15164.pep
APGAPAAANPPTTSTGPAPSPRPSTPRPPAPTPSSPGPAPWSPSSASPPPTSAARAAPPRPAGRPRRRPTPRPPRGPPPPPPSRSRPPSGPPPPAPPSXGPAGLLLPAAPVPGPAPAPARPPXPPPPPPARASPAAPPPRPSSSAPRSPASPAGSCPGVAEPLNSTGPYPAGPIPQQAVIRSALARMAKPVYLLDFTFLSQL

SEQ ID NO: 120747 - protein, 206 aa, Triticum aestivum
  Clone ID: PAT_TA_15165.pep
MLLRLRPPAAAAGLSSFLPSAPFTRPLSSPSWRPRPRRPRLSTAAATGGGLDSLRERYDVIGVGTRPAGCEAALASARLGARTLLLTLNIDRIAWQPCNPAVGGPAKSQLVHEVDALGGDIGKIADRCYLQKRVLNSSKGPADRALRAQTDKREYAMEMRKVVESTQNLFIREAMATEVMIGKNDSVEGVRTFFGMDFYAPSVVLT

SEQ ID NO: 120748 - protein, 363 aa, Triticum aestivum
  unsure (1)..(363): unsure at all Xaa locations
  Clone ID: PAT_TA_15166.pep
RPGTGLGPTMEFYTLISHEFQKSGLGMWRGELPCEAGTDNTHIGPRTVVAPNGLFPRPWSASVDCASFLEVNKRFHLLGQVLAKAIKDGRILDIPFSKAFYKLILGQELNIYDINSFDPELAMTLMEFKALTCQRKYLESCXDKGMPRAHPDWPYPWVGKIEDLVIDFAVPGYPEYVLSSEGTSDNVTGENLEEYVSFVVEATVKRGPTGPGGAVASAFRQASSLFTRAAGACDVLDGLLSGGHGGRDFVKLVDHIKFDHGYTSSSPAVLNLLEIIQEFGCHERRAFLQFITGSPRLPPGGLAALNPNLTVVRKHSNNDADDDLPSVMTCANYLKLPAYCSKERMREKLLYAITEGQGSFHLS

SEQ ID NO: 120749 - protein, 170 aa, Triticum aestivum
  Clone ID: PAT_TA_15167.pep
MAVDLMGCGYAPYGHAAEAEEQFQEAAAAGLRSLELVISSFSFGAGCTPPLGEMADQAVSRFRRVINILDRTGHARFRRGPVGDAADSLTPPPESSAPPPMPAQAPAPAPAVSPQLAPQKSMTLDFTKPLKAPAAASAAAPSVTSTSFFSSVTAGGEGSVSKGWSQLVSS

SEQ ID NO: 120750 - protein, 417 aa, Triticum aestivum
  Clone ID: PAT_TA_15168.pep
MPTRKKGPARNATVEHVNTKTSRQPGRSTQSAAPDKKVNDLITSSSKKQKPAEDPLKKNQVLSGGRKLTSLCDSDTENGVADVPSSSMLDHKLSHGNDDEPCENIFSQPFHHHNEDGSDGLSKVPAQSRGGNTKRADDEYSELGSLSPEVSAIYLAMQHSKLECIDEQSQDSISTDGGCADPDETEELDEFDPYTFIKDLPELSMVVPKFRPVLLPKQTRSCPRTTLVLDLDETLVHSTLEPCEDSDFTFPVHFNLRDHTIYVRCRPYLKDFLERVASMFEIIIFTASQSIYAEQLLNVLDPKRRLFRHRVYRESCVYVEGNYLKDLSVLGRDLSRVVIVDNSPQAFGFQLDNGIPIESWFDDPNDKELLALLPFLESLVGVEDVRPFIATKFNLRQKVASATSLAMHFFPNAERAN

SEQ ID NO: 120751 - protein, 147 aa, Triticum aestivum
  Clone ID: PAT_TA_15169.pep
RLSNVPRPSSHPMLNIQFCHVEYYTAECYSQAVLAAVLPAPGLPFLPPAGSSCTSCCACSAAGCGRGRWPHVPYGACAGAAPSECVTASSGLAELWAVSGEKYLSGFWWPSVIDMEMNNYADALLLFLHLLRDDLLRAHEQKSKARL

SEQ ID NO: 120752 - protein, 305 aa, Triticum aestivum
  Clone ID: PAT_TA_15170.pep
MIIINRALSQKKRTLRRAVGAERQCSFLQVQLKHRGEECNGKLHPAFRFPHKTPAAAPHQPPEREPRTLSVDRMVPMVTEAWTLAGCGGAAASKPLPAQEVPVLPHPTAKKPASSRGVAVARSAGQDGRRDAAVVGRRRGIASCLLAALALAGSSSGGAARAAILEADDDLELLERVKEDKKKRLQKQGIISSSAAETGYLQDLVYKLSKVGQAIDKDDLAAAGDVLGPAPDAPWVQNVNAAFSKFSSSSEEKSAVDSFNSSLSSLFTSVSKSDINSSKSAFVSSATALEKWVELAGLTGKLKGF

SEQ ID NO: 120753 - protein, 187 aa, Triticum aestivum
  unsure (1)..(187): unsure at all Xaa locations
  Clone ID: PAT_TA_15171.pep
MNHAKEKVKDAASAAKAKAKITQAKVAEKTEAATARSHDERXRLAHERGKAKVAAAEAELHQAKVTHREEAMEHRLHKRARTGHKHGAWPLMCMKEPDGRPPARKMYRARIVHATTPACTCFHLFFHYLLTPRRSVCPLTSGLIWRDDSSHPDSSKCICLYFGFLTNRPQTTNQTRGSPSMGVGTLH

SEQ ID NO: 120754 - protein, 280 aa, Triticum aestivum
  unsure (1)..(280): unsure at all Xaa locations
  Clone ID: PAT_TA_15172.pep
MLPKMPSVRWISASLLVILLSLHPIADAFYLPGTFMHTYEAGEEIAAKVNSLTSIETELPFSYYSLPYCKPPEGVKKSAENLGEVLMGDQIDNSPYHFHVNVNESLYLCTTDPLTKEHAELLKNRARNLYQVNMILDNLPVMRFTEQNGMTIQWTGYPVGYNPMGSSEDYIINHLKFRVLVHPYQAQGDVVVTXEDGVAMVESDRKSGFQIVGFEVVPCSVKRDPAAMAKLKMYEKGDSVYCPLELEKSQVIREKEQITFTYEVEYVKSNIKWPSRWDAY

SEQ ID NO: 120755 - protein, 186 aa, Triticum aestivum
  Clone ID: PAT_TA_15173.pep
MGEGWPLVSKTSYRWGTHDGPVRCVEYSDTTGQVITGSWDRTINGWDQRGATGPEYTLIGTHTQPERVYALSLAGHKLVVATAGEHVNVYDLRNMSEPQQRKSYLNSQTRCVECYPNKTGFALGTTDGRVAMDFFDQSESSLEKRYGFKCHRLTEGRVRVAYPVNAIAFHSVHRTFATGGMDGFVC

SEQ ID NO: 120756 - protein, 330 aa, Triticum aestivum
  Clone ID: PAT_TA_15174.pep
KDKQMEALVDKLCNRFAGVNDVRQWEYISYCLSQLTFTEKGLKKLIDNFKMFEHALCEDSVLNHFRSVIAKCKKFAKPDLKACIEEFEEKVSKVHEAAREQEATARNAEAHKQKIDSLDKILLAKEAGQNDRNSADEETSEVIDPSVEGNAEDKETEETSEVTDPSVDSNAENKGAEEGTGDIDPSVDSNAENKETEEATEVTDPSVGSNAENEETEEGTKVTGPSVDSSAENEETDEATEDIDPSADSAAENKENRTKGSGNICSGKSQTSSTVTESEDDSTEVQSSKTVRSRKGSTRSTVKKIREPILEDSADVAPPVRRSTRSSRRQ

SEQ ID NO: 120757 - protein, 129 aa, Triticum aestivum
  Clone ID: PAT_TA_15175.pep
PGPRVPRPEVRSGGEVFTILYAGLVPAGLAFALQIWCIDRGGPLFTAVFQPVQTVAVAVMPAVILGDPALHREGSSAPVLIVIGLYFVLWGKSEEKKTRSQDPEMARHLLGEDGCAADKDQQVSTTVLA

SEQ ID NO: 120758 - protein, 284 aa, Triticum aestivum
  Clone ID: PAT_TA_15176.pep
MVLGQQNTPGISSEPKIKTAGVIISSSILPAENTVLTVGSITVGGISFGSFNQERLKLPEEAQSTANSRPKPQQAKGSKKIQHAIRPVEKPHGNESVVWAPVKPSGWNEPSEEANVAVAARPKPIGKGTTDGENVTRTKRAEMERYVPKPLSKELQQQNLEQNLPVEKSSVENKSNDNEKLTAAKEPKKWEDRKTSKGHGKSHSSWRRRNTDDSSSVVPIPSERADSYQESHEVQRPSDKHPQLEPDKQADYAAGNSLAPAEAVELPASAAKEHAAANRQRRQH

SEQ ID NO: 120759 - protein, 92 aa, Triticum aestivum
  Clone ID: PAT_TA_15177.pep
MVYSSKQFYSERHHKADDGLQIYQLAAGYASSSLGSVSSSSSSLHGFRYSVDWLQVNPSPSLAVDSCRNGCSFHASKITVSLIQESNFGPFP

SEQ ID NO: 120760 - protein, 124 aa, Triticum aestivum
  Clone ID: PAT_TA_15178.pep
RRHARSLRGGRRPTASARKEQGRKGRRWWNFFLGSVKAMGLSSNCAKTIKVQQCVKVADSNYLHIDDELAGCFGTEDHGDGRTALVLNPFGKNVWPVKVDRDAKGAFLGDGCPRQVVELLSWIC

SEQ ID NO: 120761 - protein, 221 aa, Triticum aestivum
  Clone ID: PAT_TA_15179.pep
RSSSSTAASVLLRAGPFPAHASPAAPVGRSPACFAAPAPQPPPIVGPRPPAAARRAPGVAPALARVFLRVCLPQGCDASVLLTGNNSEQALGPNLTLRPMALKLIDDIHAGVEATCPRTVSCADVTVLATRDALLQVYILGCHKHTDMRDETNPASADLVLALPAPSFDVPTLISSFGNRSLGVADLVALSGAHTFGVAHCPSFSDRFMPIIDANPAIGPK

SEQ ID NO: 120762 - protein, 179 aa, Triticum aestivum
  Clone ID: PAT_TA_15180.pep
GGRTRRKGSVRSDLGASLARDGWIHPTLFQTEREDLLTGAMSWPCLPYRLFPSLSPCPVVRLCARFKTAAGTLCVAARPLGWLAPRTGRATSPSFLFVCQHRCARRVAAGPGWWYENWFCIMVICVVELELDFFEVGVAMLSIHICRPLNSDFSILFRIGVDHCVVFRIELERREELPP

SEQ ID NO: 120763 - protein, 249 aa, Triticum aestivum
  Clone ID: PAT_TA_15181.pep
SARGVPLAIDFSIRNGSCPEKGQHPPPDYACVSGNSSCSNATSGLGYVCKCWDHYDGNPYIVNGCQDINECELHDLYPCSADGVCKNKLGGYDFPCKPGMKGDGIKGTCTDKFPATARVILGGIGGVFIIAAISFLILLRKEKKKTRQFYEKNGGRTLEKAKFIKLFEKEKLKPIFKSSNFIGKGGFGEVYKGILDNEPVAVKKPISGSVLENEQFANEVIIQSQVIHKNIVRLIGCCLEVEAPILVYE

SEQ ID NO: 120764 - protein, 236 aa, Triticum aestivum
  Clone ID: PAT_TA_15182.pep
GRPRVRPRVRKNPSLPLAPRARRPRIRTAKPASRELLLLTSMAATQGASDVLSIDKVDFLKLQNGSDIRGVAIAGVEGEPVNLTELVAEAIAAAFAAWLLNKKKADGLRRLRISVGHDSRISAHKLQNAITHGITAAGHDVLQFGLASTPAMFNSTLTKDAINHCPADGGIMITASHLPYNRNGFKFFTSDGGLNKTDIKDILERASRVYEESAHCGKQEQTGVVTHVDYMSIYAS

SEQ ID NO: 120765 - protein, 333 aa, Triticum aestivum
  Clone ID: PAT_TA_15183.pep
MAALSAKVIQNAFLAQDGPRTRHNPRYTCDFCALNTRSMHSVQGCRLSLADTSAKWLNTTSTAWISFGKQGNISCNATQGASDVLSIDKVDFLKLQNGSDIRGVAIAGVEGEPVNLTELVAEAIAAAFAAWLLNKKEADGLRRLRISVGHDSRISAHKLQNAITHGITAAGHDVLQFGLASTPAMFNSTLTEDAINHCPADGGIMITASHLPYNRNGFKFFTSDGGLNKTDIKDILERASRVYEESAHCGKQEQTGVVTHVDYMSIYASDLVQAVLKSAGNKEKPLEGLHIVVDAGNGAGGFFVDKVLKPLGAVTDGSQFLEPDGLFPIIFRS

SEQ ID NO: 120766 - protein, 168 aa, Triticum aestivum
  Clone ID: PAT_TA_15184.pep
TSFIRCICKIEKCGCSTCINSLSNQINKLSNQQHLYTMYLYGWLRSCHETLSAEFTRKFLIMTSSIITKRMHHLTLLTTSSHLAKEKSHLPKAASCSTIPGHTSGRPPPSQARRKKPRPRPGPVYAAHTSSIGEWLEKVLLMIDATCFSASGSWPCTRKDAPHDGGGE

SEQ ID NO: 120767 - protein, 112 aa, Triticum aestivum
  Clone ID: PAT_TA_15185.pep
TSKKLMQIFPLMMKLQPQQDPNSTRKPSLSIVFFFFFLCSVTNLTTGAQASRRRQHTAIVESQQHSFSTQRVVFYSLKHPAHLGPLGVNLPRPGQQYHVLKIVVSIHKIQQY

SEQ ID NO: 120768 - protein, 144 aa, Triticum aestivum
  Clone ID: PAT_TA_15186.pep
FPGRRGYRDDHRGRDSRRRSRSRSGDRYGRDRYRERDHHRRSRSRSTSPDDYKRRGRDRSPSRSRSRSYSPDDDRKGGRDSLSPARRSTSRSPRKTPPPRKTPPPCEGSPAKRNDDRSPVRRNDDRSPVRRNDDRSPGSRSPST

SEQ ID NO: 120769 - protein, 83 aa, Triticum aestivum
  Clone ID: PAT_TA_15187.pep
AVVISVLAYKLECKIACVNAMCSCVVCTTLKRRSMVVEALLYANTCLVLHIKACMYCRSSTLCYLLLVSWLTSKWTSSVTRQR

SEQ ID NO: 120770 - protein, 210 aa, Triticum aestivum
  Clone ID: PAT_TA_15188.pep
DELNMDGSKSNDQHGQASGMRQRKPAHSGHVSGPTHASEPSDGSSIYAGNESPTANRTVEHFRGHAGNDGGWLARVAALLVGEDPTQCFALICGNCHMHNGLARKEDFAFVTYYCPHCNALNGSRQQEDGEMVTPTDRSFGNSIQASASLADSGVSSPVGRSLPTVEELPAESSGASNLTIAEQPRAESSSATNNLRPTVEVQPTDQLAS

SEQ ID NO: 120771 - protein, 166 aa, Triticum aestivum
  Clone ID: PAT_TA_15189.pep
DDDRRGRDSRRRSRSRSGDRYGRDRYRGKDHHRRSRSRSTSPDDYRRRGRDRSPSRSRSRSCSPDDDRKGGRDSLSPARRSTSRSPRKTPPPREGSPAKRNDDRSPAKRNDDRSPVRRNDDRSTVRRNDGRSPPTRRVDRSPDSHTPSRSAECQTCADPLCIAAHS

SEQ ID NO: 120772 - protein, 257 aa, Triticum aestivum
  Clone ID: PAT_TA_15190.pep
TGPDSWVVRGRVGSISKSFEHTRDNAFLLRHVSLIINKEELEKLGDAPKVVLASMSSLEVGFSHDIFVEMANEAKNLVLFTEKGQFGTLARMLQVDPPPKAVKVTMSKRVPLVGDELKAYEEEQERIKKEEVLKASISKEKELKASHESNAKASDPMVVDASSSRKSSNAGSHVGGSVDILIDGFVSPVTSIAPMFPFFENTADWDDFGEVINPDDYMMKQDEMDSNMMLGAGDGMDGKLDESSTRLLLEFSTVKSY

SEQ ID NO: 120773 - protein, 107 aa, Triticum aestivum
  Clone ID: PAT_TA_15191.pep
GGGNNIYGDNLRETLIRLRKDGSNETAAYILMQRIFPPASPSYLVREGTFVRDNVVSEFGIFGAYLRNNDKVIINDQCGYLLRTKAASLNEGGVVAGYAFLNSIFLT

SEQ ID NO: 120774 - protein, 94 aa, Triticum aestivum
  Clone ID: PAT_TA_15192.pep
MTGRRRQEVVFPARRALAAVSTRVRSRKTGGGGSILKLHEDVQTCGYKDVQVMFEMLTSELEDPKRRKQQQTASWRPPSAWPSRSSSSIAAAAQ

SEQ ID NO: 120775 - protein, 276 aa, Triticum aestivum
  Clone ID: PAT_TA_15193.pep
MASARSRLIILLVFLAAASSPASACDRCVRRSTAAYRASSPALHNAGSCGYGSLAATFNGGLLAAARPALYRGGVGCGACYQVRCTDAALCSAAGATVVVTGRARGAATDRADLVLAGAACAAMALGGGGAAAARRLRERRAVGVEYKRVPCEYARRRNLSVRVEEGAPPGGLTIRFLYQGGQTDIVAVDVAAAGSSSWRSMTRERGGPAWSTGQAPAGPLQLRMVVTGGYDGKWVWAEGEVLPRRWAAGRVYDTGVQIADVALEGCSPCDAREWK

SEQ ID NO: 120776 - protein, 226 aa, Triticum aestivum
  Clone ID: PAT_TA_15194.pep
GTRGFCINTATGDCFLVYEYVENGSLDLCLLDRGRARRLDWRTRLHIALDLAHGLQYIHEHTWPRVVHKDVKSSNVLLDARMRAKIANFGLAKTGHNAVTTHIVGTQGYIAPEYLVDGLVTTKMDVFAYGVVLLELVSGREGRRRRRRRRPAAGRRGGEGVPRPGGQAGGARGRVDGPVLADQNCPPGSATVMAWQGVLQRDPNGHGGRGTCPRIFGYGKLWWNIS

SEQ ID NO: 120777 - protein, 152 aa, Triticum aestivum
  Clone ID: PAT_TA_15195.pep
MAPKAEKKPAAKKPAEEEPAAEKAEKAPAGKKPRAEKRVPAGKTASKEGGEKRGRKKGKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 120778 - protein, 184 aa, Triticum aestivum
  Clone ID: PAT_TA_15196.pep
MCIFLVACNRISTLTPVPSWLITLRTCVRCTRTRGALYVCRYRAITSAYYRGAVGALVVYDVTRHITFENAERWLTELRDHTDANIVVMLVGNKADLRHLRAVSPEEARAFAERHRTFSMETSALEATNVEDAFTEVLGEIYRVVSKKALDIGDDPAAPPRGKTIDVGGKDDVTPVNTGGCCSA

SEQ ID NO: 120779 - protein, 300 aa, Triticum aestivum
  unsure (1)..(300): unsure at all Xaa locations
  Clone ID: PAT_TA_15197.pep
SLDEVASMVCATVSVFDTKVQNTFRDFEECNILRPFMGDTIKEIAKACQTLEGKDSSPTAVKMLHALHSEMTKLYILRLCSWPRVPSKEVSKHETWVTLSTLERNKSPYAISCLPLEFREITISAMDRIELMIFNLRNETAKSYDITRQLQEIHESVRLAFLNSFRDFAGYLGTFGAELAQNRSNKENNHVQNGYMNGTDRESSASMDGNLHKKLLVVLSNIGYCKAELSDQLYNKYRHIWSPIRDNDERSADMRDLVTSFSGLXXKVLDQYTFAKSNVIRNAAQNYLLDSGIXXXAAPV

SEQ ID NO: 120780 - protein, 222 aa, Triticum aestivum
  Clone ID: PAT_TA_15198.pep
VRPRVRARKMPRAVRIRGDEPETERRAKRRNVAGEEEEEGTALRSTSPRSPGDRVDRRRRRRRRRKGAVRTSHPEMLFAVFEPDKDQSEGKQDRVYDVDESVTEESSDPPSPTIYEPYIPDELVDDPDILAAFHYAKANYEAEKSRRANLFTMDHYGYEAPSCLFDDHRFLPIRERATGAVLLAAKSVVLLSSFIGSRPLNKCCGLWFQRNDHSKTAHVLTS

SEQ ID NO: 120781 - protein, 149 aa, Triticum aestivum
  Clone ID: PAT_TA_15199.pep
ILWCLRGQTPEGRKSSEPPSAACVAGGQRGHRAPLNPLMLFLALPRFAHGRRRRCLDDVDALRRSSFCTPPPPNPWTPPLRAGTDLATSHGLHLLAPALWWRWPACYCGSLVSAPMCILRATFTSSGVLWHWPSVPSAVQRIRIPGSML

SEQ ID NO: 120782 - protein, 264 aa, Triticum aestivum
  unsure (1)..(264): unsure at all Xaa locations
  Clone ID: PAT_TA_15200.pep
MPEAGRYTHKKDDGICNSVCGEPTSKAVMAMSRLKCALRGFDFRVILALLIGVPLVMLMIYAHGQKVTYFLRPIWESPPEPFKIIPHYYNENVTMENLCKLHGWKVRETPRRVFDAVLFSNELDILELRWNELSPYVSEFILLESNSTFTGVIKPLYFKENRDRFRFAESRLTYGTYGGRFMKGENPFVEXESFQRVALDKLIXIAXIEDDTYDHVNVDENPKWPHIKLLXRGDDTPKIXXLKLRNXXYSFEFFPDXKIGGNSQ

SEQ ID NO: 120783 - protein, 129 aa, Triticum aestivum
  Clone ID: PAT_TA_15201.pep
NHPPLVIVLPSSPPPRAIPTTHPERRQPPTPRRAAPSRAPPAFHSLASCPIPSAASLPQPPVPPGSATSTRWQLLHQITPRVAIPTVPPAPAAQPRWRFDGPPPGEARRQHRGSPGAVVPCYGSRRRRP

SEQ ID NO: 120784 - protein, 353 aa, Triticum aestivum
  unsure (1)..(353): unsure at all Xaa locations
  Clone ID: PAT_TA_15202.pep
MAAGEDAAAACRRTAISDYRKKLLNCSKVEGQIAAAMADGEDAAAARRRTAISDYRKKLLNCRELESRVGTVRENLKIARKDFAKTEDDLKSLQSVGQIIGEVLRPLDNERFIVKASSGPRYVVGCRSKVDKEKLTSGTRVVLDMTTLTIMRTLPREVDPVVYNMLHEDPGNVSYSAVGGLSDQIRELRESIELPLMNPELFLRVGIKPPQGVLLYGPPGTGKTLLARAIASNIDANFLKIVSSAIIDKYIGESARLIXREMFGYARDHQPCIIFMXDEIDAIGGRRLSEGTSADRXIQRTSWDFLNHLDGFDDLARQDDHGNKRPDFLTSLLXPXLLDRKIXXPYQTTKTDS

SEQ ID NO: 120785 - protein, 213 aa, Triticum aestivum
  unsure (1)..(213): unsure at all Xaa locations
  Clone ID: PAT_TA_15203.pep
TRRRTRGRPSCRPAPATGGRPRASGASPPRSSPRSSAPASSPAAASRSSPTSPSPSSSPSTPPSSLARPTRPACSRTPRRRRRRRPSRRRRMPSRPKTPHSSAARTATPWIPSISQRRGRRRPALKSPACRRCSRERRTKPRRRRRRRRPPCQSHLRTAAPVRXPAAXPTSTATRTRGATTPRPRRRPSACSPASSGPAPRGRPWSPTSCRRS

SEQ ID NO: 120786 - protein, 364 aa, Triticum aestivum
  unsure (1)..(364): unsure at all Xaa locations
  Clone ID: PAT_TA_15204.pep
MKLLCILTVVLALASVEPAVSSSPRRYESIITFGDSFTDTGNAIVVLAEKSRFDPTVQPPYGMTFFGRPTGRYSNGRLIIDFIAEKLDLPFVPPFLSHNGSFREGVNFAVAGATALNASFFRDIPLVGSLALHSAPCGRLPWRPSPAPSRGSPAQECPGFFHKTLFFMGEIGLNDYSFAIFGMTLPQLRSMVPDVVKTIAAATEVLLRQGAKTVVVPGIPPLGCMPPNLVFFPSNESAGYEPSTGCLKGLNDIARHHNSELQKALDKVPXNHPNALVIYADFFTPVIEMVESPHKFGLTTDVLSCCCGGGGKYNFNISAGCGMPGATVCDDPSQYLYWDGHSTEAARRYIAKGWLNSINSCKPC

SEQ ID NO: 120787 - protein, 105 aa, Triticum aestivum
  Clone ID: PAT_TA_15205.pep
SRPAAAASSAGSALSTARRPTTLSATTASTSATATRVRLALTPYSSRPPPLPRRGRTPSPLGTSHSTSSRGASLAIAAGSSPTSGAAFCSSSTRSWRQASSSAIP

SEQ ID NO: 120788 - protein, 230 aa, Triticum aestivum
  unsure (1)..(230): unsure at all Xaa locations
  Clone ID: PAT_TA_15206.pep
SADAWADAWVWLSFAPVIIVLLVGTELQHVVAQLALEVVEATATNVGTQLKLRDDLFWFGKPRVLWWLIQFISFQNAFEMATFLWSLWELSANSCFMKNQYMVVIRLASGLLVQIWCSYSTLPLNVIXSPSMGSKFKKSLVSESVRDSLHSWCKRIKDRRHNPLFMRNGTLTSRSVCSLDTTIYETDHETNTVCTLSRTVSASSLDEALTVVTVDDDEEISHIEQDIPHP

SEQ ID NO: 120789 - protein, 230 aa, Triticum aestivum
  unsure (1)..(230): unsure at all Xaa locations
  Clone ID: PAT_TA_15207.pep
NSKQGYTXQDLRTTVIAEGAEDNTRFPKIFVDGPFGAPAQNYKKYDILFLIGLGIGATPFISILKDLLHNIKSNNEQQSMNDEEAGSSFKSNGPSRAYFYWVTREQGSFEWFKGVMNEVAECDSDNAIEMHNYLTSVYEEGDARSALIAMVQSLQHAKNGVDIVSGSKIRTHFARPNWRKVYSDLANTHKNARIGVFYCGSPTLTKTLRELAIEFSHTTTTRFHFHKENF

SEQ ID NO: 120790 - protein, 166 aa, Triticum aestivum
  Clone ID: PAT_TA_15208.pep
MSEFDCEEGTMEVKFRASLKDPSVKVPVKIDFKKIQEDIFQEYALIARSMPNDIITQDPTPKSLHAVFYELSPQLWPILEKDSVRCLLNFLVSKRGMAYKHTITSQTLTYMISYDALRCAKVILEGKAPRLNGHHANPNCINPYGYFPLHEAAERFSVDMIKLLFR

SEQ ID NO: 120791 - protein, 369 aa, Triticum aestivum
  Clone ID: PAT_TA_15209.pep
VRGRVGGRVGKNMKLSRELLDEKYKDRLVESYQGLVHEVFVKVLRGLSGAKVTRPGSFRNYKNGYAVKSSLKAEDGLLYPLEKGFFFLPKPPTLILDEEIEFVEFERHGAGGASMSSQYFDLLVKLKNDQEHLFRNIQRSEYRNLFNFINGKGLKLMNLGDGQGTSGVTDVLQDTDDVAPDPHLERIKNQAASSEDSDEEDEDFVLHKDDGGSPTDDSGGEESDASESGGGKQSSKMEARSSKPPVKRKPKGKDGEGSGKRKPKGMDGEGSEKRKPKKKKDPNAPKRPMMPFMYFSMAERAGVKGSNPDLAPTDIAKKLGEIWQKMSTEDKQPYILQSQADKKRYEKESAAYRAAAPVDVDAGSGNGSD

SEQ ID NO: 120792 - protein, 202 aa, Triticum aestivum
  Clone ID: PAT_TA_15210.pep
DFRDPTTAWYDESDGTWRTIIGSKNDSDHSGIVFSYKTKDFISYELMPGYMYRGPKGTGEYECIDLYAVGGGRKASDMYNSTAEDVLYVLKESSDDDRHDCYSLGRFDAAANTWTPIDTELELGVALRYDYGRYDASKSFYDPVKQRRIVWGYVVETDSWSADAAKGWANLQSIPRTVVLMRRVSSSSTGHWMRFVRVFSSS

SEQ ID NO: 120793 - protein, 322 aa, Triticum aestivum
  Clone ID: PAT_TA_15211.pep
MASDGVITHRSVEVNGVRLHVAEAGPAGAPVVLLLHGFPELWYTWRHQMPALAAAGYRAVAPDMPGYGDSEAPPAGPDQYTALHIVGDLVALIDSLGEEQVFVVGHDWGAIIAWSLCLFRPDRVKALVALSVPFSPRSPAMKPVDGLKALYGDDYYICSIQEPGAIEAEFARLGTELVLRKFFTYRTPGPLFIPKSGWGSPDDEVPLPSWITEEDIKYYASQFDKSGFTGALNYYRALNKTWELTSPWTGAEIKVPTKFIVGDVDLSYHVAGAHDFINKGGLKKFVPLLDDVVVMKDVGHFINEEKPEEISAHIISFLKKFD

SEQ ID NO: 120794 - protein, 269 aa, Triticum aestivum
  Clone ID: PAT_TA_15212.pep
MAAQGLLSGRQLLGRPLQSSISRSSSSRKSPFVVRASSSPPAKQNDNRQLWFASKQSLTYLDGTLPGDFGFDPLGLSDPEGTGGFIEPRWLAYGEIFNGRTAMMGVVGMIAPEALGKVGLVPPETAIPWFQAGAIPPAGTYQYWADPYTLFVFEMALIGFAEHRRLQDWYNPGSMGKQYFLGLEKYLGGSGDPAYPGGPIFNPLGFGTKSEKEMKELKLKEIKNGRLAMLAFLGMSLQAIFTGVGPFQNLLDHLSDPVNNNILTSLKFH

SEQ ID NO: 120795 - protein, 33 aa, Triticum aestivum
  Clone ID: PAT_TA_15213.pep
ILKGAEAQVLAYYSLAGQRQDCPDWVTPLHPAA

SEQ ID NO: 120796 - protein, 364 aa, Triticum aestivum
  Clone ID: PAT_TA_15214.pep
GDTCKKLRRLRIERGDDDPGLQEEQGGVSQLGLTAVAVGCRDLEYIAAYVSDITNGALESIGTFCKNLYDFRLVLLDRQKQVTDLPLDNGVRNNSVLVTLNFYMTELKVVPADLELLAKNCKSLLSLKISECDLSDLIGFFEAANALQDFAGGSSHASELTKYEKVKFPPRVCFLGLTFMGKNEMPVIFPFSASLKKLDLQYTFLTTEDHCQLISKCPNLFVLEVRNVIGDRGLEVVGDTCKKLRRLRIERGDDDPGLQEEQGGVSQLGLTAVAVGCRDLEYIAAYVSDITNGALESIGTFCKNLYDFRLVLLDRQKQVTDLPLDNGVRALLRSCTKLRRFALYLRPGGLSDTGLDYIGHYSGI

SEQ ID NO: 120797 - protein, 170 aa, Triticum aestivum
  unsure (1)..(170): unsure at all Xaa locations
  Clone ID: PAT_TA_15215.pep
TCSTGTLALLRRNTKLPIFALYLRTGGCLGVGFGYIGQHIGTIKSMHQVHVGXTDGGLISFAAGCRNLRKLELRSCCFSERSLALAIRQMPSLRYVWVQGYRASQTGSDLMLMARPFWNIEFTPPSTETAGRLMEDGEPCVDRQAQVLAYYSLSGKRSDYPQSVVPLYPA

SEQ ID NO: 120798 - protein, 386 aa, Triticum aestivum
  unsure (1)..(386): unsure at all Xaa locations
  Clone ID: PAT_TA_15216.pep
LEIGENELKEAISAVRGSQRVTDQNPEGKFQALEKYGIDMTELARRGKLDPVIGRDDEVRRCIQILCRRTKNNPVIIGEPGVGKTAIAEGWALRLLRGVVPVPXLQSVLISLDMGALLAGSKYRGEFEERLKAVLKEVTASNGQIILFIDEIHTVVGAGATGGAMDAGNLLKPMLGRGELRCIGATTLDEYRKYIEKDAALERRFQQVYCGEPAVEDTVSILRGLRERYEMHHGVKISDGALVAAAALSDRYITGRFLPDKAIDLVDEAAAKLKMEITSKPIELDEVDREIIRFEMEKLSLKNDTDKASRERLSKLEAELESLKQKQKNLSEHWEYEKSLMTRIKSIKEEIDRVNLEIEAAEREYNLNRAAELKYSTLLTLQKQLD

SEQ ID NO: 120799 - protein, 126 aa, Triticum aestivum
  Clone ID: PAT_TA_15217.pep
RRALQAAALTVKTVAPRRRQPQPPVGRSTASQPSAAGAPPPDDQFNHCSSSRLTTTRPLPGHSQLKMFSEHDEDLNENEDALMSVEAEADAEAAAAEAGDESVLHSIIEGRRARPTVGLLLVYSMD

SEQ ID NO: 120800 - protein, 340 aa, Triticum aestivum
  unsure (1)..(340): unsure at all Xaa locations
  Clone ID: PAT_TA_15218.pep
MGEVLAKLLEAGFIRDIKHPRRLANLVIVPKKDKSWRLCIDFKDLNKACPKDPFPXPRIDQIIDATAGHDSLCFLDAYSGYHQIKMAEPGQAATAFITPYGPFCFNTMPFGLTNAGATYQRMIQTCLANQIGKTVEAYVDDVVVKTKHVDTLVDDLRLTFDNLRTYDIKLNPEKCVFGVPAGKLLGFIVSGRGIEANPAKIRALSQLDIPKDLKQIQKLTGCVAALSRFISRLGEKALPLYRLLRRTEHFEWTDAATAGLDEIKAILATNPVLAAPITGEPMLLYIAATHQVVSAVLVVERETDGHKFPLQKPVYYVSIVLTPCKSRCPHYHKIAYAVFM

SEQ ID NO: 120801 - protein, 419 aa, Triticum aestivum
  unsure (1)..(419): unsure at all Xaa locations
  Clone ID: PAT_TA_15219.pep
MVGTGALGSVIVKLATLLGDGHTMLKSVRKDIAFLERELRTMQILATMLVGMEGLDKLAKGCMGSMRDLGHDMEECIDRFMLRLDENDMEMEAAPTFPRSTARQLKAMFARHGVGAQIKKLKARVVEEGERRRRLNLDNYVQMMIDPRLAALHGVAKDLVAIDGPRNEVISLLTEESVDLKVVAVVGGAGLGKTALAMEAYRKIGRHFKCRASVSVSRTPDRDXLFKDLLSQIDQAAFHDCQSERWDKDQLIRRIRHILTGKRYFLVVDDVWKEQDWKFRQRSFPDNHNGSRIIVTTRIANVAKSTCSNXGGSSIKCYLLNYIDSPKIVFKRIFHSRYSCPPQARKISTRILKXKCGGLPLAITTSGIVQQHQTPGKPGPLGWLQYMITWGMGHHANYGISTETAVKLFKGVLRNNECT

SEQ ID NO: 120802 - protein, 213 aa, Triticum aestivum
  Clone ID: PAT_TA_15220.pep
MARWRPAMLLVAALALAAAAGWRAEALSVTVTDTECIHEFVPYEGDSVSGNFVVVDHDIFWSSDHPGIDLTVTSPGGNTVYTMKGKSGDKFDFKAPRGGMYKFCFHNPYGAPETVSFYIHVGHIPNEHNLAKDEHLDPINVKIAELKEALESVTAEQKYLKARDARHRHTNESTRRRVMFYTMAEYAAFMAASALQVVYIRRLFSKNVGYNRV

SEQ ID NO: 120803 - protein, 75 aa, Triticum aestivum
  Clone ID: PAT_TA_15221.pep
GTRVSLLLSLGYTILVSAACIRAGLSKNAPAKDYSLSSSKSEQTFNAFLSISILASVFGNGILPFFFENLTKLYY

SEQ ID NO: 120804 - protein, 180 aa, Triticum aestivum
  Clone ID: PAT_TA_15222.pep
MAPQELHDDGKHKEAPTSTCTPPGSNGNPSGAVHPTTSSPPSDASGHRPAAANPFPLVLKFEEVVYKVKVGQATEGWCTRVVSSACGGGAGTRKNKAAALPPREKTIISGMSGAVRPGEMLAMLGPSGSGKTTLLTALGGRHRHALLSGKITYNGQPFSRAVKRRTGFVTQHDVLYPHLT

SEQ ID NO: 120805 - protein, 237 aa, Triticum aestivum
  unsure (1)..(237): unsure at all Xaa locations
  Clone ID: PAT_TA_15223.pep
MAGGGGGKKDRGEGLGRALVRQRNKQALAAKARGQQLVISRRAQQALPLESVIEVSDIDAVLQRAAEEELLHGDDAEGAAALTAALRSGLIDLDGTGDTQDERRLLREEQEALHADSLRVPRRXVLGTDVPFFFGRLEWDEPCMVERIRDVFRPPWTAQMTTEELDTNEKRAFLEWRRNLARLQENEELVLTPFEKNLDIWRQLWRVLERIDLLVMVVDSXNALFYRCPDLEGYAPG

SEQ ID NO: 120806 - protein, 624 aa, Triticum aestivum
  Clone ID: PAT_TA_15224.pep
PPPSLPRAPLVRPAGGGGRRRRRRREGRPRPRARPRSWPAAPAAARGRQRVGPPPPQLPPPPAAAAARGRLRALRQRPPPPARRRGGAPPRPPPRAPPRPARRARLRPPRAAGDGGRLLREEQEALHADSLRLPRRPPAPPPPAALPRVTTEERASLEWRGFLAWRRDLAGLLLTPVLVLPPFGRHLDIWRQLWRVLERSDLLVIVVDSRNPLFYRCPDLEEYAQEIDEHKRTLLLVNKADLLPLSVRRKWADYFKEHDILYLFWSAKAATAVLEGKKLSSQTMEESDTDLDTKIYGREELLVRLQGEAEYIVSQKGTSAVGEEPESSSESALVRPKRVVVGFVGYPNVGKSSTINALVGEKKTGVTSTPGKTKHFQTLIISEELMLCDCPGLVFPSFSSSRHEMVACGVLPIDRMTKHRGAIQVVANRVPRNILEQVYKITLPKPKAYEEASRPPTAAELLMAYCTSRGHVSHAGLPDETRAARQILKDYIDGKIPHFELPPGEIDDETDGEDNSDLEGSSTAAADQSDDGASDEDDEEINRAEPNISHALNDLASFDMHGQMTKGSTKKKKKEASHKHHRKPQRKKDRSWRVGNDGADGSGVIRVFQKPAVNLAASSTSVVG

SEQ ID NO: 120807 - protein, 41 aa, Triticum aestivum
  Clone ID: PAT_TA_15225.pep
IHSTREDQGLTRHYNSWYKRSSHTHTQYQLITVHTNDSSAL

SEQ ID NO: 120808 - protein, 309 aa, Triticum aestivum
  Clone ID: PAT_TA_15226.pep
LGNKQQIVGQSLYYQGKKDSSSRSSFGNFACLRSCTAEVFDGAQDLKGLILLCNDQTGALFPAAQYLMDGGGTGLIIVSSTTDDMRPVTDCEGIACVVVNIEDAERMCQYYEDTSSAQAKIEPAGTVTGKEILAPKVAIFSSRGPSVTYPAILKPDIAAPGANILAAKQDGYVFKSGTSMAAPHVAGIAALLKVLHPYWSPAAIKSAMVTTAHVTDERGMPIMAEGYSRKIADPFDYGGGTINPCGAAHPGLIYDIDPSDYSKFFKCTISNKRTPVDCNTTTMQPAYYLNLPSISVPDLRHPITVSRTV

SEQ ID NO: 120809 - protein, 187 aa, Triticum aestivum
  Clone ID: PAT_TA_15227.pep
MAIPPKNALYFLLLVSSFILGAMADLALSCPSRCEVELQWTLYARQIGGGANANQEEMVHSVHPTTGFGTIVVNNWDVLDAPLPNAAIVARARGTHTKAGPAAGDWFTSLSIVFEGARFNGSTFQVMGITNTDGLWAIVGGTKELSRADGTIKHTLLRATALENYRQLDIRAFYTPPAVNANGIAAQ

SEQ ID NO: 120810 - protein, 170 aa, Triticum aestivum
  unsure (1)..(170): unsure at all Xaa locations
  Clone ID: PAT_TA_15228.pep
VSHHPPAAGLVASHCDARLLRVLQLRKIMLDLLVHASTCRSRSCQFPNCLKVKELFLHAKECKRRASGGCALRKKVWYMIRLHAQACRDSGCSMPRCRWMGASIICPATSTSLLHARTVLQSGVTPDHHFWKLHRDLKDHLRRLHQQSESRRXAAVNEMITQRAAEAWDG

SEQ ID NO: 120811 - protein, 203 aa, Triticum aestivum
  Clone ID: PAT_TA_15229.pep
ISVVAAEVPNVTVEQSKKLSGSFDFIGLNHYAVFPTLADETAFNLKQRDYFADGGVANPTKYILEGQNEYAPWALGELLEHVKLKYGNPAIMIHENGYGDAPKTPGKIEYDDDNRSKILQNYLEVLYLSIRNGSNVQGYFVWSFVDVFEFLFGNRMRFGLCGVDMSTAGRKRYLPGRPRWYSGFLNGGELRSVSPLSKAYGAA

SEQ ID NO: 120812 - protein, 100 aa, Triticum aestivum
  Clone ID: PAT_TA_15230.pep
RGRTWTWTPSGRPTRSSSGPSSRTPSPAARTATSRTRSSPSSSASNHTIQHYYAPRGTVAMARRPSVCFSSWFISFRVCVCMLMNRCRAGRVRVLKAFVQ

SEQ ID NO: 120813 - protein, 137 aa, Triticum aestivum
  unsure (1)..(137): unsure at all Xaa locations
  Clone ID: PAT_TA_15231.pep
SLPPLLPLPFPLLLTSSTPPSLPFPPPTPLQPPPPCRRSAASARAAPPCGRSPVRPYPTRRRRPPPAPPAPRRPPCRPSSXWTPPPSTSSTNLHAPRTRARSPSTRPRSAGASQRAISRRSCRAAPPPRRPRATGGA

SEQ ID NO: 120814 - protein, 409 aa, Triticum aestivum
  unsure (1)..(409): unsure at all Xaa locations
  Clone ID: PAT_TA_15232.pep
LPVLPLPAPPPPTRPPRHRPPPPQGNPHRLLPPPHPSLVPPPSPLQASAPPASPLLAHRTPGHCRLLRAHARPQRHRRRSPSPSRTSTTLSVSGSKSTPAAPTDLDSDFEPFATCRPRVSDVHTVYXEPSANRGRHPVLFLHTGPSAGTSPXNRRFFDPEFYRIVLFDQXRGAGKSTPHACLEQNTTWELGRXDIEKLRQHLDIPEWQLFRGSWGSNLALXVLRLTLLLWKKELDWFYEGGAAAVFPDAWEPFRDFIPEDERNCFIAAYSKRLTSSDADVQVEAAKRWTTWEMMTAHLLQNHENIKRREDDKFSVPLARSENHYFINKGFLDSDSHLLDNVDKIRHIKTFIVQGRYDMCCPMMSAWDLHKAWPEAEFKAVQDAAHSANEVGVAAELVSANEKLNSMLRK

SEQ ID NO: 120815 - protein, 138 aa, Triticum aestivum
  Clone ID: PAT_TA_15233.pep
MRKHGWQLPYHPLQVVAIAVFAALGFAFYVFFLPFVGSQTSQYVAMGLYTPLITCVVTLYIWCAATNPGDPGICKSAKLHSRMDKDGRQSHSHMDSDHGLNAADNSEKLSSMLERKDSPSWPRCSQLLCLVCLPFSCL

SEQ ID NO: 120816 - protein, 296 aa, Triticum aestivum
  Clone ID: PAT_TA_15234.pep
MSVMLSLVSWFLLAMAAGGGLHANSATAEVTIASNSAAVTAYWHTMLPNTLMPSAILELLAPPAGNEVQNSKCVWGPSTPNDVEKINNGNWGPSTKAEDEKSNGVWDPSTTNDVMKNNGNWGPSTTNDVEKNNGNWGSSTRKDVQKSKGVWGSFTTNDVEKINNGNWGPSTKAEDEKSNGVWDPSTTNDVMKDNGNWGPSTTNDVQKNNGNWGSSTRKDVQKSKGVWGSFTTNDVEKINNGNWGPSTKAEDEKSHGVWDLSTTNDILKNNGNWGPSNKAEDQKNNGNSGSSTTNDI

SEQ ID NO: 120817 - protein, 154 aa, Triticum aestivum
  Clone ID: PAT_TA_15235.pep
SETLKMECSCKGELALAHQDCAVKSRSIKGNKICDVCRQEVKNLPVTLLRIPTQTVTRRLANGAQQRAAQQYRFWQDIPILVMVSMLAYFCFLEQLLVTDLQSRALAISLPFSCVLGLLSSMIASTMVTKSYLWAYASFQFAIVILFAHIFYNV

SEQ ID NO: 120818 - protein, 83 aa, Triticum aestivum
  Clone ID: PAT_TA_15236.pep
IFHTSRSVVHMQILMKVHVINFWLPFISADIVHIFRTHKIFGGQSICARMNFHNLIIWSSMVALSTVIYMKPYVCSLCFILLP

SEQ ID NO: 120819 - protein, 138 aa, Triticum aestivum
  Clone ID: PAT_TA_15237.pep
PRPDLVLGIKPHSDVYALTVLLMDKDVAGLQFLRDGTWYNVPSASNYTLLINVGVTMEIMTNGRPHGPVHRVVTNSEKERMSVAVFYGLDPEREIGPIAQMLAEDQPARYRKMKVKDFLVAHLEHFSRGERVVDSLRI

SEQ ID NO: 120820 - protein, 137 aa, Triticum aestivum
  unsure (1)..(137): unsure at all Xaa locations
  Clone ID: PAT_TA_15238.pep
RARSSPPGSPRLCPPGWPRXGPCPATPRGPGGAPPAAPTPPHPPAPPRVLSALCGLPPPPRPAFRXPGASREAPSPLLRPPASPAPPPPSALDPRPAPPSSRGPAPAPAGPPPRAPALGRCSSSSNCRDTTRPWCTR

SEQ ID NO: 120821 - protein, 194 aa, Triticum aestivum
  unsure (1)..(194): unsure at all Xaa locations
  Clone ID: PAT_TA_15239.pep
MQARVASMEDMKEARLAAPGQGGGRVFPTGMLKVFLGFLLLGVGLSAAGMYMARHTLAAAAPAIFRPCLGASAGAGEEQPLDGLERWTRPPSRARHAMTDEELLWRASFAPRVRPYPFPRVPKVAFMFLTRGPLPLAPLWERFFPRTRGPATSVYVXTPLPSYRAKLQPKNSVFYPPANPQXRFAEWGXDEPCC

SEQ ID NO: 120822 - protein, 175 aa, Triticum aestivum
  Clone ID: PAT_TA_15240.pep
MGRAPCCDKATVKKGPWSPEEDAKLKAYIDENGTGGNWIALPQKIGLKRCGKSCRLRWLNYLRPNIKHGDFTEEEEHIICSLYISIGSRWSISAPPPPRWSHRVLHVLGITLLRKIPLGFPAPSRRPPRARPLAPCPYSAPAAGGGSASSSGNASGTTAALSSSALERIQLHMRL

SEQ ID NO: 120823 - protein, 256 aa, Triticum aestivum
  unsure (1)..(256): unsure at all Xaa locations
  Clone ID: PAT_TA_15241.pep
VVASSHLQITPPAQESRAKLSKHLNCEERVESSAVTSTASSTHRRSPLWAPPDRSDSLSAAHLLYGMKPLCRLTETELSHFVNRGTGVLSLSLLSPPPRESAASELCAADPGPVFDPVQDPSLCMNLWSAVSERWRSGADLEPWLAGRTLHQAGCRTMAPQIVWRNHPVEEQNTQTAACCSAMDSMSFLLWHRQKVGFCFLVWLYRLKLQFRRRHHSAGCRCWYSASWNESFTTTFLPNSLRTDVAXPVHDPSLTS

SEQ ID NO: 120824 - protein, 223 aa, Triticum aestivum
  Clone ID: PAT_TA_15242.pep
ARGELADPPIIHRDIKSTNILLDENLKAKVADFGLSKLVADTEKGHVSTQVKGTLGYLDPEYYMTQQLSEKSDVYSFGVVMLELVSGRQPIEKGKYVVREVRQAIDPADRDYYGLRAIVDPAIRDAARTPGFRRFVQLAMQCVDESAAARPTMGTVVKEVEAMLLNEPDGEGSNSAGSSATEFDGAGRGAPSHPYSDVEITRSSYGGAGEASDYMPYFEVKPK

SEQ ID NO: 120825 - protein, 120 aa, Triticum aestivum
  unsure (1)..(120): unsure at all Xaa locations
  Clone ID: PAT_TA_15243.pep
LRKATCLVQPHPLTALLLHHHTLLSSSPPCQPGTLPLPPPFAAGECPAAGVWPNSNNCGSSAPGEAARWAMWRRTTCRFLIRASSSAPPRLVPPRPTPRRRPPGTPPXAPTPATPSPPPH

SEQ ID NO: 120826 - protein, 254 aa, Triticum aestivum
  Clone ID: PAT_TA_15244.pep
RHEARPDAFHTICHYSILKDITNNFSDDRIIGRGGFSVVYKGIQPSEEMVAVKKFVQPTSSQEEFENELKLLMELKHPNIVQLAGYCYETRKLHMFHEGEYIFAEDTQTLLCLECLPNGSLENYISDASSRLHWCTRYKIIEGICCGLQYLHEQSKDPILHLDLKPANILLDKNMLPKITDFGLSRLFDQSQTIHTARTCGTLGYMAREFLQGIITPMSDIFSLGVIILEVITGHKGVPDDIRTSSKIFIEPEL

SEQ ID NO: 120827 - protein, 145 aa, Triticum aestivum
  Clone ID: PAT_TA_15245.pep
HRSFDPFLKNSYAQLGRAKNKTRTRRIYKRKNSRRLITGWSRARATQGGRGVADRSGDDGGGVEAVEAAPDLAEGGGRAAAAGDDEEDPLQLAHEVHEPPRRRQQQREGQQPDAQLQYEHRRSPPPPLSPSPPPLLLLGTINGSS

SEQ ID NO: 120828 - protein, 154 aa, Triticum aestivum
  Clone ID: PAT_TA_15246.pep
LVAFMRARVDGLSWQRSDIPGVPRKVIEHHLAICPHARPVKQKVWKQAVEHQEFIAEEIKKLEAAGLVRGVLHPTWLANRVVVRKANGKWRLCIDFTDVNKACPKDPFPLPRIDQIVDSTAGCDLLSFLDAYSGYHQIFMAEEDEEKTHSITHV

SEQ ID NO: 120829 - protein, 125 aa, Triticum aestivum
  Clone ID: PAT_TA_15247.pep
LGSGANAGEEAAGGEEVARGRRGGGAGVPLDDDVLRPARGHAAYHRGALLLPANMAACQGQGGREPAAGCVVAGAQRGVEETSGDNQDEGGYGWVPCEEPQRSDPPLISPYFFFVILCTVVPLFS

SEQ ID NO: 120830 - protein, 299 aa, Triticum aestivum
  Clone ID: PAT_TA_15248.pep
MRRQQGQGQGQYGDPNINSMASSQLHHYQAQQRVQQLPDNSYPGRDPGQAAGENQYTTQKVRQSQWDRGGPNIPNQISPYAYNEGQSAEGKRSFYDGQQSDMKVGLEKQPRKELRDQPRTDKIEARRDDYNLPRTFESLEQSFREDIVVLSKELNDAEDAENTRHRERLNEINAQYHEKLLALRARQTAYREEFLRKESLERQQQYQKASISNYANNVVPREPRGYPPTAAATPPAAAPSGSSYGEAHRGYASGQYESFGERPDYPEFHGGGQGRDHGFEHRGHQYPGGRAYNSGGRRF

SEQ ID NO: 120831 - protein, 592 aa, Triticum aestivum
  Clone ID: PAT_TA_15249.pep
TTSHVRVKGFPEVALHFVKDEKNRFNLALESGNIQIAVASAKELDDKDHWYRLGIEALRQGNVGIVEYAYQRTKNFDRLAFLYLLTGYLDKVGFMSKIAGQNNNLMGQFHNALYLGDAKKRVEILENAGQLPLAYVTAATHGLTEIADRLAGELGEEVPSLPEGKTRSLLIPPAPLTACGDWPLLRVMRGIFEGGLDATGRAEQEEDYDDAGGDWGDEDLEIVDASNVIENGDAGHADESETNEEDGDEEGGWDLEDLELPPEADTPKASGPERSALFVAPTPGMPVSQIWTQKSSLAGEHAAAGNFDTAMRLLSRQLGIKNFAPLKALFLDAHMGSHTFLRAFASAPVIPIAVEKGWSESASPNVRGPPALVFSFAQMDDKLKAAYKATTEGKFPEALRQFLNILYTIPLLVVDSRREVDEVKELIEIVREYVLGLRMEVKRKELKSDATRQQELAAYFTNCKLQKVHMRLVLTSAMGLCFKGGNYATAANFARMLLDNGPNEAQAKKARQVLQACGDRKDAHQLNYDFRNPFVVCGATFVPIYRGQKDVSCPYCASRFVPSVEGQLCSICELSVVGADASGLLCSPTQSR

SEQ ID NO: 120832 - protein, 283 aa, Triticum aestivum
  unsure (1)..(283): unsure at all Xaa locations
  Clone ID: PAT_TA_15250.pep
AIKSGVRPVLPSQTGQTPEELNSVMLSSSGPTPLATPTPGAVPSSISIPQQPLPMFRQPVGVHVPHYQPSFIPYNQYISPFYVPPHALHHFMGNAAFPQAPSPGSMYPPVSSAVAPPVKYSATAYKPGANTGSQTYAVTPGAYGTYGSNPSVYTNNNVVASGTSAENGDVSGSQFXENASDIAGQQSEGSTVWIPAPGRDLSALQSSSFYGLPPQGQHLAFAPAQAGHGAYGGMYHPAQTLAGAAGHPLLQPSQTIAGAVEMVGPPANGYQQPQHAQMNWANY

SEQ ID NO: 120833 - protein, 218 aa, Triticum aestivum
  Clone ID: PAT_TA_15251.pep
MAEYHLSAQLHGHEDDVRGICICGDVGVATSSRDKTVRFWTQHPEKKREYVLSKTLVGHSSFVGPMVWAPPSDRFPEGAIVSGGMDTLVLLWNLHTGEVVGTMRGHTSQVTGLAIDDNGDIISSSMDCTLRRWRDGNAVEVWEAHKVAVQTVLKLPSGELFTGSSDSTIKLWKGRTCLHTFSGHADTVRCLAQMPGMGILSASHDGTIKLWALTGQPL

SEQ ID NO: 120834 - protein, 339 aa, Triticum aestivum
  Clone ID: PAT_TA_15252.pep
MAVLSRAAMVLTMMGLAATSALSQPSLISMTTDVPLPDGLSYDFHALSCSNLQNMVRDAVQGAMARDAGVVPGLLRLFFHDCFPQGCDASILLTGGNSEQNMPQNGGLRRSVLDLIEGIRATVHRACGPTVSCADITSLATKEAVMQSRLPGYDVPLGRRDSLAPATAQQVGILPGPDFNVERLVRTFADRGFDKMDLVALSGAHTVGKASCGSFRNRAGENADFVRVLQQVCARNPGHLQDLDVTTPNTFDNRYYNNLQVGRGVLNSDMALTQDGETRNWVNNFAGNQGWFFSQFSTSMRKLAHLPGGNIGEIRNNCFRRNGNGESVVLAAEIFAAFA

SEQ ID NO: 120835 - protein, 517 aa, Triticum aestivum
  Clone ID: PAT_TA_15253.pep
MSTGGAASAAAEAMASEAYLAGAAVREARELVAELCRHFYLQGWVTGTGGSITVKANDPAVPLAQQLIVMSPSGVQKERMVAEDMYVMSAEGKVISAPVAKPWPYKHPKCSDCAPLFMKSYLMRGAGAVIHSHGMETCMATMLNPGAKEFRITHMEMIKGIKGHGYTDELVIPIIENTPYEYELTDSLAEAIAAYPKATAVLVRNHGIYVWGDSWINAKTQAECYHYLLDAAIKMYQLGIDWTTPEHGPINSAKRLRSVASPGVPNGCHTAKSSKHCVVLDIEGTTTPISFVTDVMFPYARDNVRKHLTSTYDSEETKEDIKLLRIQVEEDLKIGVVGAAPVAPDDAGKEEVISSLVANVEAMIKADRKITSLKQLQGHIWRTGFERKELQGVVFEDVPEALKNWQSQGMKVYIYSSGSREAQKLLFGHTSYGDLRQFLCGFFDTTTGNKREARSYFEISQSLGVDNPSQILFITDVLQEAVAAKSAGFEVIISIRPGNAPLPANHGFRTISSFSEI

SEQ ID NO: 120836 - protein, 157 aa, Triticum aestivum
  unsure (1)..(157): unsure at all Xaa locations
  Clone ID: PAT_TA_15254.pep
MASGAGSCWALVVLLLAARAFPAAATSFTVGGKSGWTIGVDYTTWASGNTFKVGDSLVFNYAKGLHTVAEVSAADYLACAAANAVGSDASGATTVPLKTAGKHYFICTITGHCAGGMKLEVTVSGSGSGSSTXNPIANPTNAVHEVRPKRTTNAHAV

SEQ ID NO: 120837 - protein, 262 aa, Triticum aestivum
  Clone ID: PAT_TA_15255.pep
APPPSTAPHHHHPPPRRRPTSLHRAAPPLPSPAPSHHLPPPRRTTILPRTVAPPPTTAPHHHLPPRRRPPPTTAPHRELPPSRCPPRPPRRIRAAPAIPRPTGDGSELLLHMPPPNPMLFISMYPPDPVRPRPFRWCGSWWGWARSSPAINGDPFRPRYMASGSGWASLSSFLPWVKIHGETAACFLIFCWDPFSRMGMATFDKMHLHFQVHPWGCSGIGQDARLRCGTDAMLFGGDTWCGSYRACSLEHGNMQCKNVAFCV

SEQ ID NO: 120838 - protein, 167 aa, Triticum aestivum
  unsure (1)..(167): unsure at all Xaa locations
  Clone ID: PAT_TA_15256.pep
YPAPPVGRWPPVSQSCPSYEGAACRTPEPLRIPVRSPVRSLGGCLAAPPEPHPPGGSHLRIPHRRHLRHEGWRRSEGNPYPTEPRTRSMKREDHPWPDYRLYAALEGHHVAQKRNYKSFRNPDTYDLAGGLALEGHSSSXTLALAELSGGRVLPFLDPSASPVGEAS

SEQ ID NO: 120839 - protein, 181 aa, Triticum aestivum
  unsure (1)..(181): unsure at all Xaa locations
  Clone ID: PAT_TA_15257.pep
MKGTAPWRRLAEAEAAVNRSVAASTVGKYFKLEARKSSFTKELRAGAATFLTMAYIISVNAAILTDSGGPCTVLDCTPVGNSTAVPGPECTLGTSNPGYEQCLXRTKSDLIVATAVAAMVGSFAMGTLANLPLALAPGMGANAYFTYNMVGFHGSGSIPYRTALAGVMLEGIVFLLLSAVG

SEQ ID NO: 120840 - protein, 168 aa, Triticum aestivum
  Clone ID: PAT_TA_15258.pep
MATAEADVGAPASVTAPMMLHGRVAIVTGGAGGIGSAVSRHLASLGARVAVAYVGDPAPARELVAAINNAAHAGDHGPRAVAVEADVSDAAQVRALFDAAAAAFGGELHVLVTAAAVMDTSYPPLADTSEATYDAAFGTNARGTFLCLREAARRLARDGRGRIVTFSS

SEQ ID NO: 120841 - protein, 181 aa, Triticum aestivum
  unsure (1)..(181): unsure at all Xaa locations
  Clone ID: PAT_TA_15259.pep
METVEEDVEEYSWREVVLPRLIPVVPHAAPELERETGERRRGRDLLVAIDFGPNSRHAFRWALAHLARIADTLHLVHAVSSVHNELVYNKSQELMDELAVEAFKESLVHTKARIVEGDAGNVICREAERLKPAAVIIGTRGRSLIQSSVLQGSVSEYCFHNCXAAPVIMVPGKEAGEQSVL

SEQ ID NO: 120842 - protein, 174 aa, Triticum aestivum
  Clone ID: PAT_TA_15260.pep
RPEAHPPPPAPSRPARAPPPPPPRRPPRPTPARPLPPLPLGRSPRCVVLHGRPPSPPRLQLPAPPPAVRAAPGAAAPLAGGPAAPPACGVVPAARRPAVAPPGAAPPPGLCGWLLVLGLPCRAWSGSGFSLVLRRSWDGSCVCPGADDASAGDATQLKWELVEDLGCCFMFLSG

SEQ ID NO: 120843 - protein, 201 aa, Triticum aestivum
  Clone ID: PAT_TA_15261.pep
YFYYSAAICDERIAASRSWKVAAQAPPAPRRRRLLLLLPAAPAPAASPPPLHLAAPAGRGRRAPGRCRRRPGGSAGRRRRRPPRCARRPPPPGARSPPGVGVPGRPNLPGRLEWACRSAASGDYVAPRRCHPRARLLVGGLGTLPTHGCYSGHAAALAGGTTMHIDFVIPVNGNLTAGLESYKHKAEKAAMDYGFHMAITK

SEQ ID NO: 120844 - protein, 165 aa, Triticum aestivum
  unsure (1)..(165): unsure at all Xaa locations
  Clone ID: PAT_TA_15262.pep
MAAEQVAKPATLPPYPEMILAAIAALNDKNGSNKSAISKYIEGKYGDLPKEHGALLTAHLVRMKESGQLFFLKNNYFRTDAPDAPPKRGRGRPRKPIDPNAPPPPPKSASPRPRGRPAKPKDPEAEAANPPKKAXDRQRPAPAPAVDGSAKRGRGRPPKARPAEP

SEQ ID NO: 120845 - protein, 270 aa, Triticum aestivum
  Clone ID: PAT_TA_15263.pep
MPIAPPQNPFQGQGGSAAVPPVTPLPNTFSVTPTVQPYGVSSVSSFALPPLHRGLPPASLQMGPSSSQVGGPTTYFSGILSNLMNHGVITLEPSSQPQDSVGVDFNVDLKVRNESVINALYQDLHRQCKTCGLRFKCQEEHRAHMDWHVTKNRNSKNRKQSSRKYFVTVGEWLRAAETVGNDGVPSFELTEPIPDRNEEKEMAVPADENQTTCALCQEPFEDFYSDETEEWMYKGAVYMNAPDGNIVGLQRSHLGPIVHSKCRSGPSNIS

SEQ ID NO: 120846 - protein, 151 aa, Triticum aestivum
  Clone ID: PAT_TA_15264.pep
MAAVILSNTRVMPTSYNKTIMSNLSLHRIGNGADTNQATVIQKDYKFGHTAVNDWVIYEGAGPGPVFARGQGSHILAGNSISTIMITFEDPRYKGSSLAVMGNILDNGQWAIVGGTGLFKYATGFIDLVPVQQSSPKNISNITIEVCNPNY

SEQ ID NO: 120847 - protein, 166 aa, Triticum aestivum
  unsure (1)..(166): unsure at all Xaa locations
  Clone ID: PAT_TA_15265.pep
XRISSGPTHRPPPSAYLIASDDQRPDPLIHRSRIAAIASAPHLASTSSRASPPRPSATGDAVPAGHGHPLPRLYLLGCPATIFPLLMKRNATLFFPVLEPAGELLQPTGGFASTGKDGGGRRRRWQREKIVLGGDGDERRWLKQHEGESGVATITATTDERPGWRE

SEQ ID NO: 120848 - protein, 93 aa, Triticum aestivum
  Clone ID: PAT_TA_15266.pep
HLAWADAFIITADSISMLSEACSTGKPVYVVGTEHCRWKFSDFHNTLQKRGAVRPLTGSEDMSDSWSYPPLNDAIDVAARVREVLAQRGWTVG

SEQ ID NO: 120849 - protein, 155 aa, Triticum aestivum
  Clone ID: PAT_TA_15267.pep
TIAFILVYGPIVRPSASGLYAPAAGGRPPYSSHQQQEALLRIPSACPSFLGAASPTPSPQPPPALSFNVLPPPLQPSFPAKPARAAAHQQDVLSRKSLDLNSDQQHVIPRKPDDFNSDQQALLSGKPDDLNSDQQDLLSWKPDDLNSQQKEHVGR

SEQ ID NO: 120850 - protein, 466 aa, Triticum aestivum
  Clone ID: PAT_TA_15268.pep
MDASEYPHMQGGASSSSSSCRAADAAAWDAVQQQKRQRCQGSSSGDKVGSCTENNSFKASEAELQNFDSGEIEEEDYYIDDEDEGCYDDDNEGSDYEFDESDFNQQLADKFDDLDLPPGVEASVPWLQKAATDDGPGNFKSMSEIEDEIGKKYKFFKQFDTVEDFSDHHYANKPVGKTGKEWTKRIQHDWKLLENDLPASIYVRVSENRMDLLRAVMIGPQGTPYHDGLFFFDAQFPASYPASPPIVYYHSGGLRLNPNLYACGKVCLSLLGTWEGHGCEKWNSAHSTMLQVLISIQALVLNEKPYFNEPGYETYANNASGQRTALEYNDTTFQYSCRTMLYSLRRAPQHFEDLVAGHFRERGRAILAACKYYMEGNKVGSMVPDEDDEDKELESANAEGSSSSSAVKPKNNQVDLRAGAGVVRPASFKTNMEVLFEELLMEFNVKGADTKKFCAEKLKKSQPAAA

SEQ ID NO: 120851 - protein, 194 aa, Triticum aestivum
  unsure (1)..(194): unsure at all Xaa locations
  Clone ID: PAT_TA_15269.pep
PESHTTVVKTAISSYRKAIDEGLLLKLPFTTIFEYLQLLQLVSTAMNCLERHGMFYCAAAVSDFYVPWESMAKHKIQSAGGPLNMQLXQVPKMLFILRNHWAPSAFCVSFKLETDPRXILYRRQEAALRKYGMNVVVANELANYKDVVVMVTKQAGRRPLSRRSKEDDLEEQLIGLLVKMHSDHTKQSNPDQEK

SEQ ID NO: 120852 - protein, 204 aa, Triticum aestivum
  unsure (1)..(204): unsure at all Xaa locations
  Clone ID: PAT_TA_15270.pep
ARAYVRSYPSGPRQVSATSTEPLLPHPPPLLALLPRTLAATPPAAAAAAAGGAHSVFVYGSLMADEVVSAILKRIPASSPALLANHHRFNVKDRIYPAILPVESKKVAGKVIMGISDAELIVLDAFEDFEYVRRRVQISLTDTLCMMHADTYVWSDAMDPXGYGEWDFEEWTNVHMKDFLTMTLGFMDGLERPVPVFHARARTT

SEQ ID NO: 120853 - protein, 268 aa, Triticum aestivum
  unsure (1)..(268): unsure at all Xaa locations
  Clone ID: PAT_TA_15271.pep
VLSVVEQRRGVKKISIVAHSLGGLVARYAIGRLYECSNRTKCSIGNNREQVECLEGLIAGLKPMNFITFASPHLGSSGNKQILPPXPFLCGLHFLERRASETAHLIVGRTGKHLFLTDSDDGRRPLLLQMVQDHDDIKFRSGLRSFKRRVAYANANFDHMVGWRTSSIRRQHELPKHRLLVRDEKYPHIVHVDRGIMERNETEVSANLCGPEEEMIRGLTQLQWERVDVSFQKSSQRLVAHNTIQVKSYWLNSDGADVINHMMDNFLI

SEQ ID NO: 120854 - protein, 127 aa, Triticum aestivum
  Clone ID: PAT_TA_15272.pep
DVIVSWASEKFSSAIFFLYEQIHPDDAFGEQMIRNLESRGCPLLGINATPTLSHKEKLFLDHGWKRAVARDMLKIYNDFIDGGERRRIELLELFDEFEEWHMMQEHYCVAYGINDPEGIFDDFGFKE

SEQ ID NO: 120855 - protein, 98 aa, Triticum aestivum
  Clone ID: PAT_TA_15273.pep
TIRCLLKLYKLTSLLQMPPSHILQIVDNITTTRSEASSAQIQDERMQTRILCDIRPSGDNCQLACTSYHPVAKLFLPSLTRPALGSGHRAWVNVFLTS

SEQ ID NO: 120856 - protein, 100 aa, Triticum aestivum
  unsure (1)..(100): unsure at all Xaa locations
  Clone ID: PAT_TA_15274.pep
MFCILQGGILQSTTLMCSVKTLAIQVPFSEKGHTTFVAQLLKCFPCLETLHVEADSRSISQRVAPESWDTTTSIRCIEAFGSXKLVFEDFGGEMCQVGAF

SEQ ID NO: 120857 - protein, 256 aa, Triticum aestivum
  Clone ID: PAT_TA_15275.pep
KVQNPDNGTESLYDLWMASDSSLIGRLGGGGSDYSAFVQHIGIPSVDMAIGSGYAVYHSLYDDFTWMEKYGDPMFRRHVAVASIWGLVALRLSDEEILPFNYSSYATELENGAVDINKRVLGMPVSLSPLHKSIKQFNRAVLKVDSELQALQTWKFWSPWRNDPLRVRDLNDRLMMTERAFTEREGLSGRPWYKHMIYGPSLYNDYGAEVYPGVDDAIQTAKKANTTESWQSVQHEIHRIARVISQAALVLSGGLT

SEQ ID NO: 120858 - protein, 132 aa, Triticum aestivum
  Clone ID: PAT_TA_15276.pep
PTSYSACFTYSSYSICIGFTYTKRLTNAATSKALHGRVLNILILMLPSCDVSSTETISGEILLALRCFNRNYPLLFISPILTRGNNYAHAYKLQLHLNRCTAAPNIFGALATCSAEESRAVCANESLDRNVS

SEQ ID NO: 120859 - protein, 322 aa, Triticum aestivum
  unsure (1)..(322): unsure at all Xaa locations
  Clone ID: PAT_TA_15277.pep
MAALAGSALLLLAAALLLSAPAATEAYDSLDPNGNITIKWDLKEWTPDGYVAMVTIYNYQQFRHISAPGWQLGWTWAKKEVIWSMVGAQTTEQGDCSKFKTNPPHCCKRDPTVIDLLPGTPYKDQVGNCCKGGVISTFNQDPANAASFQISVGLSGTTNKTVKLPKNFTLKTPGPGYTCGRATVVRPTKFLIGDRRRTTQALMTWNVTCTYSQFLAQKTPTCCVALSSFYNNTIVGCPTCSCGCQNNNTHPGSCVXPLVQCTSHMCPVKVHWHVKLNYKDYWRVKVTITNFNYRMNYTDWNLVVQHPNFNNITKLFSFNYKP

SEQ ID NO: 120860 - protein, 119 aa, Triticum aestivum
  Clone ID: PAT_TA_15278.pep
IQQVLEHLKQFYGNPPIYIHENGYPMHQDVVFDDGPRVEFLSEHLKNLLTAVRNGSNTRGYFAWSLMDLYELLSVGDTYGLYYVDFADDDLKRYPGRSGPRYKDFLKGRHTETGRFSDH

SEQ ID NO: 120861 - protein, 103 aa, Triticum aestivum
  unsure (1)..(103): unsure at all Xaa locations
  Clone ID: PAT_TA_15279.pep
RHHHLVPXAPPPPRAPCNPSPCCSSTFLLVLTLLLLFFFFPSLFAALPSPNPQTASPLPYTPTAVLLLLSCCTTTDAPCLQRPLLLLTCCCCSFLPYLAAALL

SEQ ID NO: 120862 - protein, 108 aa, Triticum aestivum
  Clone ID: PAT_TA_15280.pep
SQLLDRPRQLQLLHGILPCHRRNLGPTPSCYQCLLRNIYLNLTENSNGTIFSVQESGVVAAKRYASTSSDPAPRVRTSALLTLPPTQDNLTIFDPGTAWAHITGATWG

SEQ ID NO: 120863 - protein, 377 aa, Triticum aestivum
  unsure (1)..(377): unsure at all Xaa locations
  Clone ID: PAT_TA_15281.pep
CNVELFPGGLFRSLPFLRYLIYTPTYHTIHHTGKKANFCLFMPLFDRLGGTLDASSWELQRKNRAGMDEAPDFVFLAHVVDVMQSMHVPFVMRTFASTPFAVRXFLLPLWPIALLFMFXVWAWSKTFIISYYHLRGKLHQIWAVPRYGFHYFLPFAKDGINDQXIELAILRAXRMGVKVVSLAALNKNEALNGGGALFVNKHPDLRVRVVHGNTLTAAVILNEIPKGTTEVFMTGATSKLGRAIALYLCRKKIRVMMMTLSTERFQKIXKEAAAEDQQYLVQVTKFQSAEQCKTWIVGKWLSPXREXRWASPGTXFQXFLVPPILGFXXRDCXYGKLAAMXPPKGPPGGLRLAKFLEPRGWCPCHPRFNFQGGGPGQ

SEQ ID NO: 120864 - protein, 130 aa, Triticum aestivum
  Clone ID: PAT_TA_15282.pep
FLVPMTRRSNYDLAGRAIGKDLVSNPDLVSTDAVVSFRTAMWFWMTAQGNKPSSHNVALRRWTPTAADTAADRVPGYGVITNIINGGLECGMGRNDANVDRIGYYTRYCSMLGTSTGGNLDCYTQRNFGS

SEQ ID NO: 120865 - protein, 235 aa, Triticum aestivum
  unsure (1)..(235): unsure at all Xaa locations
  Clone ID: PAT_TA_15283.pep
MVRFVMLAVCAAVLLLAVAAGGAAAQGVGSVITRQVYDTMLPHRDDSICEAKGFYTYEAFIAAASTFPEFGTTGSADDVKRELAAFFGQTSHETTGGPQFQWGYCFKDQIDKTMLAPYYGRGPIQLTGQSNYDLAGKALKLDLVNNPNLVSTDAEVSFRTAMWFWMTAQDNKPSCHDVALRRWTPTAADTAAGRVPGYGVITNIINGGXDCGKGMNPSNVDRIGYYTRYCGILGT

SEQ ID NO: 120866 - protein, 421 aa, Triticum aestivum
  unsure (1)..(421): unsure at all Xaa locations
  Clone ID: PAT_TA_15284.pep
MQAAAAARRHLLDQHHLSPASSAAIAAFRSAAQPALAPQGLGGADGARYMSARAPAVKGAGHLVRKGTGGRSSVSGIVATVFGATGFLGRYVVQQLAKMGSQVLVPFRGCEDSHRHLKLMGDLGQIVPMNYNPRDVNSIKTAVAKSNVVINLIGREYETRNYGFEEVNHQMAEQLAMISKEHGGIVRFIQVSALGASASSPSRLLRAKAAGEESVLKEFPEATIMRPATLIGTEDRILNRWAMYAKNWGFLPLFGGGSTKFQPVYVVDVAAAIVNSLKDDGTSMGKTYELGGPDIYTVHDLXEMMXETIREISKIXVNIPCPIAKAMATRREMLLNKVPFPLPTPSIFNLDHMKALTXDNLVSENALSFADLDIKPHKLRGYRSEFPVRDRKGGPAVGRPVSAMMGSADEAPRLYSPLPNS

SEQ ID NO: 120867 - protein, 252 aa, Triticum aestivum
  Clone ID: PAT_TA_15285.pep
MARFAALAALLLAVAVGGAAAQGVGSVITQSMYASMLPNRDNSLCPARGFYTYDAFIAAANTFPGFGTTGSADDVKRELAAFFGQTSHETTGGTRGAADQFQWGYCFKEEINKATSPPYYGRGPIQLTGQSNYDLAGRAIGKDLVSNPDLVSTDAVVSFRTAMWFWMTAQGNKPSCHDVALRRWTPTAADTAAGRVPGYGVITNIINGGIDCGKGMNPSNVDRIGYYTRYCGILGTATGDNLNCYTQQNFAT

SEQ ID NO: 120868 - protein, 256 aa, Triticum aestivum
  Clone ID: PAT_TA_15286.pep
MARFAALAVCAAALLLAVAVGGAAAQGVGSVITRSVYASMLPNRDNSLCPARGFYTYDAFIAAANTFPGFGTTGSADDIKRDLAAFFGQTSHETTGGTRGAADQFQWGYCFKEEISKATSPPYYGRGPIQLTGRSNYDLAGRAIGKDLVSNPDLVSTDAVVSFRTAMWFWMTAQGNKPSSHNVALRRWTPTAADTAAGRVPGYGVITNIINGGLECGMGRNDANVDRIGYYTRYCSMLGTSTGGNLDCYTQRNFAS

SEQ ID NO: 120869 - protein, 147 aa, Triticum aestivum
  unsure (1)..(147): unsure at all Xaa locations
  Clone ID: PAT_TA_15287.pep
SSLPPAYPVSALGPILASELRRPFLKIGASLETGKGFSLVANMSARVGSIGDNALGGWHSYRASKTALNQLTKTASVELGKKDNIACILLHPGTVDTDLSRPFQRNVAKDKLFTREFSVQKLLSIIDNAKKXDNGNSSAWGWPRNPW

SEQ ID NO: 120870 - protein, 216 aa, Triticum aestivum
  Clone ID: PAT_TA_15288.pep
MVIGEMDAAQVAAYFRGKNILITGATGFLGKVLLEKILRIQPDVTKLFLLVRATDDESARRRVQTEVTGREIFQVLREKHGKGFEDFIEEKVCPLAGDVMYEDFGLDTAKLKEVSKDVDIIVNGAATTNFYERYDVSFDTNVLGAKQICAFANKCTKLKMLLHVSTAYVCGEQEGLILEKPFMMGDTLREGTHLDIESELNLIKHTQMELKANCAT

SEQ ID NO: 120871 - protein, 163 aa, Triticum aestivum
  unsure (1)..(163): unsure at all Xaa locations
  Clone ID: PAT_TA_15289.pep
PRVRXKVLNIFSSPQLACASSSPPPSKGEGSMAARIMRLLHHHNRRLLATAAEATARRLPRAPLGGAIYKDVAKAEASSLKNSRWYMTKSSPSSPLTMQEYRKTFPSLIRSSASYSSQASDQNPKEGKKDLSTVGDPFDAPTYNIPRERQLTFAXGGFLQCLL

SEQ ID NO: 120872 - protein, 183 aa, Triticum aestivum
  Clone ID: PAT_TA_15290.pep
MVQGPSPVVKLGAWGSDGGAAHDIDVTAAPPHRLESIALRWGKVIDSLAFTYTDKDGQPHAAGPWGGAGGVSEDLITLAPSEYVTEVGWTVGPFKLKEIKACVTSLKFVTNLGTTYGPFGNGDGTHHSLPVLDAGSVVGMFCRADDYLHAIGFYVRPLAIVKSTTASPAKPQGESLPALATEG

SEQ ID NO: 120873 - protein, 534 aa, Triticum aestivum
  Clone ID: PAT_TA_15291.pep
YFGEHNIDGMLAVLEPLHAMLERGAETIKENTFIQAYGHELLEAHECCLKYRATGEDAELTKAWDLYYHVFRRIDKQLPSLTTLDLHSVSPELLKCRKLELAVPGTYSADSPLVTIEYFVPQLIVITSKQRPRKLTIHGSDGEDYAFLLKGHEDLRQDERVMQLFGLVNTLLENSRKTSEKDLSIQRYAVIPLSPNSGLIGWVPNCDTLHALIREYRDARKIFLNQEHRLMLAFAPDYDHLPLIAKVEVFQHALQNTEGNDLAKVLWLKSRTSEVWLERRTNYTRSLAVMSMAGYLLGLGDRHPSNLMLDRFSGKILHIDFGDCFEASMNREKFPEKVPFRLTRMLVKAMEVSGIEGTFRTTCENVMQVLRTNKDSVMAMMEAFVHDPLINWRLFNFNEVPQVSNYGNAHTHTVVSSEEAAPSEELMQPPRGAREKELLQAVNQLGDANEVLNERAVAVMARMSHKLTGRDFSSGSALSGAGGSSQHGSEHLASVDAREVEPGLSVKVQVQKLILQATSHENLCQNYVGWCPFW

SEQ ID NO: 120874 - protein, 166 aa, Triticum aestivum
  Clone ID: PAT_TA_15292.pep
LENSYSWNALETHGWPLLHDDGASVTIYSESHFSVCIQHVLLTKSDSVSAYARTERVGYSALKRLPCASPEPPRARSLDSTELVLREHLLPRGAPGTPPGKPPARAPPSRYPGTAPRKPPARAPPPRSFGHAAGIHRRESAVGGGVVRLSGVSGEVGGVWLWVWSK

SEQ ID NO: 120875 - protein, 299 aa, Triticum aestivum
  unsure (1)..(299): unsure at all Xaa locations
  Clone ID: PAT_TA_15293.pep
MRQAITDGVRGSSLNFHPLEHLHSLKFHRPGETALHLAGSTIDLRSRDTSLEVAEMRNALFAEEESTALSTWAVATICGCLRLEHVITLFAAALLETQIGIVCSNLGMLSASVLSIIPLIRPYQWQXLLIPVLPNDMLDFLDAPVPYIVGVQNKTPDLQSRLANAVIIDANKNQIKSASVPQLPQQKELLSALRPYHSRLVGENYLARKRPVYECTDAQVEAAKGFLAVLRSHLDSLCSNLRSHTITNVQSNNDKVSLILRESFIGSFPARDRPFMKLFLDTQLFSVHTDLVLSFYQKD

SEQ ID NO: 120876 - protein, 254 aa, Triticum aestivum
  Clone ID: PAT_TA_15294.pep
GIRRLLKAWRPCFWGKIPIDSLGSSLDCVTLSLGRTVELTSEISMNPGFIEPSLLEHDSCLTFCSLKANATGSYKLKASIDVQEAGARNMRLSPYNIYSYDDIPQSLLPKIIRLRTGNVLFNYKYYKNLYKRPVTEDFTCSFCLVPCGSFKGLECHLTSSHDLFRYEFWVSKEYQAVNVSLKIDTRREELPTVAGNDPGSRVFFYRSSRFKRCKISETATEKTKDVYPHITELGSPGMTVPVDQDMWDQDHHEI

SEQ ID NO: 120877 - protein, 242 aa, Triticum aestivum
  unsure (1)..(242): unsure at all Xaa locations
  Clone ID: PAT_TA_15295.pep
IRHEGLKVETLIFANTMFYFVPPPPSYNLDYFHKLVVENGGSFSMNLNDSVTHCIAAEKKGIKYQAAIRHGRIIHYSWILDCCKQKILLRLQPKYILFLADFARHKFPEEIDSYADFYYWDIDVSDLKQIFINMDKVTVDPSMVHRYKKKYYADERFCFFQGCCVYLYHAPLVNEDYNVISDLALKRVKHDLTMHGGQYCSSLAPATHLVIVSVLQVYNFDILYKSFSPAXXRYLHDKRLHV

SEQ ID NO: 120878 - protein, 215 aa, Triticum aestivum
  unsure (1)..(215): unsure at all Xaa locations
  Clone ID: PAT_TA_15296.pep
RHEVSTNHKCFDKPEERGXEEDVIRKHTTPAYRAPEMWDLYRREVISEKVDIWALGCLMYRICYLKSAFDGESKPRVRNGNYRIPELPKYCSSITSLIEEMLQSSPDARPDITQVWFRVNELLPLELQKDLPDGSPSGSAWELQTTEDEGPSSSRSRDNVRNTPPKGPSSLRSQVPAESKGSASAFWSTQHAQELAFADDKGSVLDQEPIHDGIA

SEQ ID NO: 120879 - protein, 196 aa, Triticum aestivum
  unsure (1)..(196): unsure at all Xaa locations
  Clone ID: PAT_TA_15297.pep
AGTREAXSDPLVAVAVAVAETSEEPNAAARPLDPNLVGQRLELDLNLVGQRLIERLAKEQAAVNRRWEQQYNRPRAEEAMYRKEQEKLSQVKVVVKVKPKQDKLGINWTQIKNKIFRREGREICSEHVNHQTHPITEVRRHYRLDSDEANHFDAYSEYRSVIGDGECFYRSFIFSYLEQVIDRQDTNEENPSPSCC

SEQ ID NO: 120880 - protein, 313 aa, Triticum aestivum
  unsure (1)..(313): unsure at all Xaa locations
  Clone ID: PAT_TA_15298.pep
MLPVMEYYPAAGTDSTNANYYMQASDSQILQSHQHSYYAPLSASGVSIPVETTSIPPVPGSYYSYPSVTMAATEVAAESSGYYASSTSAISSGELDNKTSLASLVANSNVNTVESDKVISKEPTVASLSQSVGVVSSGPTVHGSSTQASTSTTNQTKVPRTKKRPVAVASSLRSNKKVSSLVDKWKAAXEELRDEEEEEPEDALEYLERKRRKEIDGWRKQQIASGEAKENANFVPLGGDWRDRVKRKRAEAKKEAKTEPIRAAAEQHKGEPDLSELSKGFPSGWQAYIDESTKQVYYGNNLTSETTWDRPSK

SEQ ID NO: 120881 - protein, 191 aa, Triticum aestivum
  Clone ID: PAT_TA_15299.pep
SARGRLAPLLFFDLRLEVRLDLSMATPAPPAPALAPGSMGTASDSVVRGVPFVSGTAGPAVADSAVGVESPETPAVDQVPPARGLVGDLSDVDLSGESRTTLRRLAEVWRRQAPVSGRAPATPAARSSPSAPVLRRRRAPLSTLAGSAGEPHELLQPSTIALAGEGFSGRFLVHDDCWGQGYPADQMRGRL

SEQ ID NO: 120882 - protein, 192 aa, Triticum aestivum
  unsure (1)..(192): unsure at all Xaa locations
  Clone ID: PAT_TA_15300.pep
QPVAEKVEWGYLRLGSRRRARRRSGSPLRLRPSRPLLRLRCPRPPFRCVSIPAPVLPCSLLASSRGEALVGRQPWRPSVEKTGCGVKIFPSSGSSRAPPRPPLRPPSRARVRSSCIWRPSAPAPPGPALXRPAARQPHPTSRQGTSGRQRGQAPAGSPTCAPSPSGAGTPGSTSRAAAPPTPPDGSGYLARW

SEQ ID NO: 120883 - protein, 74 aa, Triticum aestivum
  Clone ID: PAT_TA_15301.pep
SSGRPGWYLHGVAGDHGDKADFKLVVPRDVALVNKTIDLLTDEYPVPGSWWVIKNKCMVKGTDGQWKLDDFEEA

SEQ ID NO: 120884 - protein, 327 aa, Triticum aestivum
  unsure (1)..(327): unsure at all Xaa locations
  Clone ID: PAT_TA_15302.pep
MDPAAEMDTFELDAPLRPPAYLATYPSQNPERARGGEKQQQHHLSWMDPPAEMDTGELDALLRAAADFASYPGTHGEDTVRQFLEQFPLPKLLGVLQSQADVPETVETVAACLDKVFSSRYGASLLPSYGEFIQAGLLTNSNSIXQLACKAVVXLLDKAGRYXLFAVDTFVQHNLYPLLINCLIEGDEEISAIVLDAIKRLAEIPTGTDIIFPPDGQGLQLNKVAAQSSSMARIRILSLIAKLFGASSCTATAIRDSNLLSLFEDEIKDRKDMLKTLSALEVLYELAEHPHSNMFLLKTSLLQHITDVINDPSADSIVRSRASLISG

SEQ ID NO: 120885 - protein, 216 aa, Triticum aestivum
  Clone ID: PAT_TA_15303.pep
ARGLLWRHTKHRPIAWSWYARRRRRILPLRLMATVHARLGCLPQPPPPRLPRRRATFSSGSRRSAAARSRVTSLRRASRLGPWTAQAMSGAEPPAGGGEAGEIIDAVEVEPSNAGASLLAKVAVALGVAVTVTAISIFMKQPSSGPSFSLPQIIDASAQSDTVGYTFSQFGKKVIIPEYTPGWVYFWLLMAAGFGLFVSEEALNVWVCPPLWLGSR

SEQ ID NO: 120886 - protein, 122 aa, Triticum aestivum
  Clone ID: PAT_TA_15304.pep
MKLFAFVRRARRTSSAAMTPEPVPVALENATAPVSVAEKRRRRPSSGSSSWKPTLVAISEDAAVAAAKADAGKAKGKAKGKPAAAKAKARASPRALRPDYDDFRRFGAPTVLPAFAPTAFLF

SEQ ID NO: 120887 - protein, 226 aa, Triticum aestivum
  Clone ID: PAT_TA_15305.pep
LLPCAQPSSAQLTTHLSADPSLSSPPSPSTRGFLSDSTFSTFPASAAFSASTAPARPSLLDEDSVAPPTASTCRGPLADFSEIAQEPSLSEQASVAPPVPSTTAASPAIAFSAETGASAVSPVSSPPPKAATTPSLVCGVISPSPGDARPSFSCLPLDSRTYPKIPPEDFTRPASEGCSLLGIARLLLITIDTMSPADGFSAVLGLPSVPLDTALPVPTETAYYGL

SEQ ID NO: 120888 - protein, 128 aa, Triticum aestivum
  unsure (1)..(128): unsure at all Xaa locations
  Clone ID: PAT_TA_15306.pep
MEGGCVVAAGTEDGCGKKQQQQARPQFGRSLTYHHHQGHRLLPRWRRPQLADEPRARPQAVVLYTTSLRGVRRTFADCSAARAILRGSRVAVXDERDVSMDAXALRRELQPLLAARGRAFSLPQLFIG

SEQ ID NO: 120889 - protein, 186 aa, Triticum aestivum
  Clone ID: PAT_TA_15307.pep
LAVAVALPCSQGMRVRPGLLRLRASSGSDRSTEEFIRLGPPSGLRILLRICFVCLQLWIPCSSSCSRPRALVACRIVEPGFWNWSSDMEPEAEARSVSRASSDRFLCVRPRCQISIKWIHGPCDPVVARALWFIYSLSSVSSRCIHSRPSIRGRFSYIVPADLGFGMSCALTLDAEEARGRASSAE

SEQ ID NO: 120890 - protein, 404 aa, Triticum aestivum
  unsure (1)..(404): unsure at all Xaa locations
  Clone ID: PAT_TA_15308.pep
GTRSVKAWMRSHAADRSGAGEPCSMSRGELQLMLGVIGAPLIPLPVSRARQSPSSVLCEQLKGDPIESSSAKYIVQQYIAASGGEWALNKVTSMYAMGKVRMTAAELNSSDADGSSNNGGAQRGGKKGGGKGGAGGEIGGFVLWQKKPELWCLELVVSGCKISAGSDGKVAWRQTPWHQSHASRGPPRPLRRSLQGLDPMLTASLFAEDSVCIGERSIDGEDCFVLKVEAEASSLRARNTTGVEIIRHTVWGYFSQRTGLLVQLEDSHLLQIKSGAGGGSVFWETTMESRLRDYRAVDGVNIAHSGRTAVSLVRFGDTHDGGNTRTRMEEHWDIEEVDFNIWGLSMDCFLPPSDLRDGGKESQXAAPEELAVVKAARPPPLXIPGVGXLRRFQRWPSTWTVPCQ

SEQ ID NO: 120891 - protein, 199 aa, Triticum aestivum
  Clone ID: PAT_TA_15309.pep
MAPQLRSWGRLLALAALLAAAAAQSSPAAAPATPTPVAVPTAPAQSPPAPTTPAPTATPVTPAPTATPVAPAKPPPAVAPVKPPPVVAPVSAPPPVVTPPPVTPPPVKAPPPVTPPPVAAPPPATPPPAAAPAEAPAVLPPLATPPPVAEVPAVLPPAEAPSKSKNKHKRKRSGKKKSPAPAPEPLSPPAPIAPEPTTV

SEQ ID NO: 120892 - protein, 92 aa, Triticum aestivum
  unsure (1)..(92): unsure at all Xaa locations
  Clone ID: PAT_TA_15310.pep
VPTPRGPALGFPSPSPPLPSPSGSIYLSPLPTPPPPSWIPSPPPAGLPGCSVSPAPWTTPGSRACSRRKGNKRPPPSXAPAPXAQGGGKFES

SEQ ID NO: 120893 - protein, 103 aa, Triticum aestivum
  Clone ID: PAT_TA_15311.pep
LGAAAAATAPPAELFNAAAGAYLGAVFSSVEMGLVVVVPITSYGQHAGNMPETTIYRRMDQYTTTRTVPGVLVLRADSPIYFTNSGIMRERITWWIDDATTTT

SEQ ID NO: 120894 - protein, 106 aa, Triticum aestivum
  unsure (1)..(106): unsure at all Xaa locations
  Clone ID: PAT_TA_15312.pep
MSSQKHGGAAAVLQRAVSWSNYLVVXGAIIQGGGEELFRADLSKLXIWAGFAERHSRVYSGRYASLNIAIKMASQPXQDAAKLKHPFACEVARRLRHHILADCITL

SEQ ID NO: 120895 - protein, 300 aa, Triticum aestivum
  Clone ID: PAT_TA_15313.pep
MNVHLSFEDGWKVLEQGIVTCSKILEGSTGTRPTVAEYMNCYDCAYRMAVQTTSYCEEMYNGYKATLAESVRALVCPHLMHQRDGYLLRQLAKMWSNYCIMVKCVSGFFNYLDRCFVEQRKLPCLEDTAATSFFSTVFSFFSHEVSDALLTSRRRTRGGINADMDILMGIMRGICRSEVKSFMKNAVVQDTYAYYSRKSSEWIVQYPLQDYLAKVQDCMEKETMRLMSYLSIAEGDSTELCLKVVSAPLMQTYDSYAREKQIGGQLLLQTYKTVEDDLLARCSRLTIDSGVDNSSGSYME

SEQ ID NO: 120896 - protein, 292 aa, Triticum aestivum
  Clone ID: PAT_TA_15314.pep
MAGAIFMCNTRAREQFFVSGVFRLALEYQPFVDNVKQGMPLFLFDYNERKLYGVFEAASDGGLDITDRAAFRSSVHSHPAQVRFKIIWKCRPLAEDEFSHAIKENYYTMYKFYFDLSYQQVVQLYELFDNKRVEQPIRNYTISAHSKEGHFCKGRPDKRSLTPNISPISTDQSHTLTVTAGTNYSAPTRMRGTAPHNFEARTNLSVPLVSKPVGVQIDPIRSSHHVQKILPYHNNSHLQDVSTVDGISTYAPCSQTNGYHRDQFVTNQSYPISDDYMHSSLSSGCMTASPTD

SEQ ID NO: 120897 - protein, 223 aa, Triticum aestivum
  Clone ID: PAT_TA_15315.pep
SARAHPSPHPPPTFPTIYIGILPDPANHQLPSRSTYQASPFFPLLSVPNQPAPCPASFSPPPCLARCPICITPMPSFPATASLPELLEPPTPLVASPEQAPQKKRATSCRWPPLFLLVPAATAKPEHPIAARGAATPARAPPCPRLLPPRRLPRARAHTRALRPPASSQSAPGALSLRLKSADATIFRDGLPPAGSDAVPASPAISGVPAPAAAPRSCRCSAC

SEQ ID NO: 120898 - protein, 223 aa, Triticum aestivum
  Clone ID: PAT_TA_15316.pep
MARSVPGRLALFCVLASCIALAAGTTVATRPSRRGLGVSDSHDGAVAVGVGGGGGYDDSLMPRPAPSSEPRACQFENERLYRAYLVIQKFRKTVICDPKGVTATWAGTDLCGSYKGFFCGRPINVSDRTVASVDLNGFNLRSDSLQGFVDGLPDLALFHANSNNFGGAVPNLRGLQYFYELDLSNNKLAPAPFPTDVLGLTNCTFIDIRFNSFFGELPAGLFS

SEQ ID NO: 120899 - protein, 118 aa, Triticum aestivum
  unsure (1)..(118): unsure at all Xaa locations
  Clone ID: PAT_TA_15317.pep
LTIPHQDEWEYSDGKSTTCVAFILAMFKAAGVFAPFTESIQVTEFTIRDAYMLRIFXDNRTRLPXWCTGDXGRAPLLPRSSGEYKMELPXEYNTIQPYANMNENCPSSPPTYDRPLRC

SEQ ID NO: 120900 - protein, 120 aa, Triticum aestivum
  Clone ID: PAT_TA_15318.pep
MKAKAGSRAGDSRLAVKKSKAEKDPNKPKRPPSAFFVFMDTFRKEYKEKHPDVKQVSVVGKAGGEKWKSLSDAEKAPYYCQGPRSSKAEYTKKINAYNNPQAGEASGDSDKSKSEDERRE

SEQ ID NO: 120901 - protein, 325 aa, Triticum aestivum
  unsure (1)..(325): unsure at all Xaa locations
  Clone ID: PAT_TA_15319.pep
LNVPAGMAGSLRLDASSPASSSSSVARLLEIPKTPSPSKVTYSDRFIPCRTSSRLHNFALADRPSPGSGSRDDGSAYSRLLRAELFGGDASPGGDRQDSPGSNNLFRFKTDRSSAPSSPFAEKLDCAGGARPPTPPRPPPRXLDAPPLQDDFYLNLVDWSSQNMLAVGLGTCVYLWSASSSKVTKLCDLGPXRDSVCAAHWXTREGSYRPARPPPSPSAPAGGDPHCLAELLPGTRSRPRAGPPAPGPGWLCPPRQPASCFGSHGPSPFPAASPSAVPLATVQRPVGLKWPHDDRELASGGNDNQLLVWTPPPQQPVLRLTEHTA

SEQ ID NO: 120902 - protein, 182 aa, Triticum aestivum
  Clone ID: PAT_TA_15320.pep
MARVYVGSLDPAVTARELEDEFRVFGVLRSVWVARKPPGFAFVDFDDRRDAQDAIKDLDGANGWRVELSRNASSGRGGRDRSGGSEMKCYECGESGHFARECRLRIGSGGLGSGRRRSRSRSRSRSRSPRYRRSPSYSRRRYSRSPRRRSVSPARGRSVSRSPVRGRDESPAYGNGYRRSRS

SEQ ID NO: 120903 - protein, 156 aa, Triticum aestivum
  unsure (1)..(156): unsure at all Xaa locations
  Clone ID: PAT_TA_15321.pep
APRPGHQAPHAACRRPPPRAAHPLPLLPTFFFATDRRGGRHAHPVSTTPPNRFLPGKRWVMECASRGWSVSLLPGRAVPWLATCGPGSMGFLFTGTPVSTMQFASWLGVVSVSRQCSLIECFRCTLQISFLVCPDLHCNVVKSRLGGAKXNLCVQK

SEQ ID NO: 120904 - protein, 141 aa, Triticum aestivum
  Clone ID: PAT_TA_15322.pep
MPRTVSDGGEDFDGDVSSQPGSRRHTDSNSTHHHHGYKVGFPPVKGLFAEFADGVKETFFADDPLREYKDQPRSKKLWLSLVHLFPVLDWGRSYTFGKFKGDLVAGLTIASLCIPQDIGYAKLANLQPHVGLYSSFVPPLI

SEQ ID NO: 120905 - protein, 147 aa, Triticum aestivum
  unsure (1)..(147): unsure at all Xaa locations
  Clone ID: PAT_TA_15323.pep
MLLGSSFASPFTQLHLSPGPNAGAAARAAAGLVLRIEAAKQLTGRVVTTKANKTVGVEVARLKQHPKYHRREKIKKKYXAHDPDNQFKVGDVVELVRSRPISKTKHFLAVPGPPPRPTPGRKAQPPPPARVPPPATAAAAAEETPAS

SEQ ID NO: 120906 - protein, 391 aa, Triticum aestivum
  unsure (1)..(391): unsure at all Xaa locations
  Clone ID: PAT_TA_15324.pep
MDSKNSKHEKTPEMIHVAKESQEKLPAGEQVRKKKKKKVRAPGNAEEQWNNNYQDFGPENFAGMPLGPQGGFNPYWGGGMPWPFGSTRAPGPGPLPYMAHPPPGPVVPVPGGVRSLAPSRPPAYMLPPGPRDLSELAGFGGALGLGPPVVRGGELEPRLPVGSRRGMDRLNGREREPVRGRDHFREWDRERXRQRERDCHGDRDRDRDRDRGREYRREARESSGAVNDSTSMRPKDRSRPQADRSERALPPPLHSPDRHSRRSPHRSSSSGKKRSSSDRYDDLPLPPPPPPASRHEAEHAKAAAAAADQRSKAKASVFSRISFPGEANTSDPKRSRRSSSDKRPASSSSSSKRSVAAAAATEESDSRHHHQETVLAAEEERRRPAPTDYDD

SEQ ID NO: 120907 - protein, 192 aa, Triticum aestivum
  Clone ID: PAT_TA_15325.pep
VRQQQHRYRPVNHNDHSSQHPRHPPAGELDRHQGQGGSSTSTRRLRPNRPPQPRPTFTDHKPSPTSTPNANEPDDKARRNAANFECNVCFDMADDPVVTKCGHLFCWDCLYQWLHVHSNHRECPVCKGQVADDAIIPIYGRGGSAASVHAAPPRPTGTRVESSRQQQLQQFAASNLNMMMDEDDEDDDPFLE

SEQ ID NO: 120908 - protein, 195 aa, Triticum aestivum
  Clone ID: PAT_TA_15326.pep
IRLLPSYVRTWFTGLRDRSLSSSIESLTRVWCSPPLLLDEFCQVKESVYADETFSVSVNRSAYEIIATYKKEETGIDLVIRLPSCYPLRHVEVECTRSLGISEVKCRKWLLSLTSFVRNQNGAVAEAIRTWKSNFDKEFEGVEECPICYSILHTSNHGLPRLACKTCKHKFHGACLYKWFSTSNKSTCPLCQTPF

SEQ ID NO: 120909 - protein, 286 aa, Triticum aestivum
  unsure (1)..(286): unsure at all Xaa locations
  Clone ID: PAT_TA_15327.pep
MEILKNGKTINAGQMVYPVASPSQLTPKHLXVDLSPDNVAVATVYFVQGVLGLSRLAVSFYLKDALQLDPAETAVITGFSALPWLVKPLYGFISDSVPLFGYRRRSYLILSGLLGAISWSLMATIVDDXVVDSMVVERTRGESQSTSGSLQSLCWGSSAFGAIVSAYFSGSLVDTYGXFVFGVTAFLPLMTSAVAVLVNEKRLPTEERSISLSSSRLIESSKQQIRQIWTAVKQPNIFLPTLFIFLWQATPQSDSAMFYFVTNKIGFTPEFLGRVTLVTSVASLLG

SEQ ID NO: 120910 - protein, 128 aa, Triticum aestivum
  Clone ID: PAT_TA_15328.pep
HDAMKSQIVRPLPAHFPVLLCCPVHQPSSKGAVVCCPCACFSYLALSPHYRFSRMLALCLSRVPLLLSRSAAAGGGNPVGHASPALLPCPPSGVAVLVLGRAPPDSGRVLLLCSASPLCYCCLYDTLE

SEQ ID NO: 120911 - protein, 155 aa, Triticum aestivum
  Clone ID: PAT_TA_15329.pep
ALTCFFKPEVLEGANKYSCERCKKLTSARKQMFILKAPKVLVIQLKRFDGIHGGKINRNIEFKEGLVLSDFMYDKNQAADSDPQPVYNLFGSIVHSGFSQDSGHYYAYVKDAAGRWYCCNDSHVSLSSSQDVLTEKLNLPTPMGMAYQVPHVVSP

SEQ ID NO: 120912 - protein, 534 aa, Triticum aestivum
  Clone ID: PAT_TA_15330.pep
MANVSKGSSGSVILFIEILNKYLYFFEKGIPQITNTVIQDLIELIRTEKQNDSSASDPFLQVEAFAKFSNAIGKVIEAQVDMPVVGAVTVYVLLLTFTLRVRPDRLDYVDQVLGACVKKLSGKEKLEDSRATKQIVALLSAPLEKYSNIVTALELSNYPRVMDYLDNATTKVMALVIIQSIMKNTTCISTSDKIEALFDLIKGLIKDMDGAQDDELDEEDFKEEQNSVARLIHMLHNDDHDEMLKILCTVQKHILQGGPKRLPFTVPSLVFSALKLVRRLQGQDGDVTGEEVPATPKKIFQILHQTIEALQCIPCPELSLRLYLQCAEAANDCDLEPVAYEFFTQAFILYEEEIADSKAQITALHLIIGTLQRMNIFGVENRDTLTHKTTGYSAKLLKKPDQCRAVYACSHLFWTDDQDGIMDGERVLLCLKRALRIANAAQQMANVSKGSSGSVILFIEILNKYLYFFEKGIPQITNTVIQDLIELIRTEKQNDSSASDPSAEAFFASTLRYIEFQKQKGGSIGEKYEQIKAS

SEQ ID NO: 120913 - protein, 271 aa, Triticum aestivum
  Clone ID: PAT_TA_15331.pep
SSPPKGTRETNHLTPAVPPLIHRAIQTPPQQRQHPHSNGPVASPRTTIHPANHGKANRVPVASPLKGRHHHSIPVNNTHGISGAPVVAPSKGRHHRSLPVNRTSVEGPVVSPQISPSIRRRGHGIPVAAPPKEPSSHVPPANHKHHKGSFPVISPAPHRTGNASATSHGHSGLDHGPAPAPLVLPPSNGKDGNPAYAPHHPRQYHSPSYSPEHALPPDNPAFRKPRALAPAPSHSLPPPPPNSYCTALNCKDPMTNSPPGTTCPLCVANKS

SEQ ID NO: 120914 - protein, 207 aa, Triticum aestivum
  Clone ID: PAT_TA_15332.pep
RAASPPRAPCPSPPPVGFPSGAPSAVARSRLPRSVGPPPPGSRPVRPLGPQPPARPPAAPAQAGPRPPPPPRPPSLPRPALLAPPRSPGCPPWGAPPPPPRPGLRPPPAPPIPARHPASDPRLAAPPAPPLLGPPARPPLPRSPRSSSPPAPPALSPRPPASSRPSPPPAPGPSPAPLPPWLLASVDSPAAVRAPPAPCSSSSRGPA

SEQ ID NO: 120915 - protein, 232 aa, Triticum aestivum
  unsure (1)..(232): unsure at all Xaa locations
  Clone ID: PAT_TA_15333.pep
RHEDWFVTLSSWDYPLVTQDDLFYAFSSVPRHLDVIDHTSNLGWKEHERFEKLIVDASLYMDKNTQPFPATETRQMPEAFKIFTGSPWVILSRNFTEHCVHGWDNLPRRLLMYFANAAYSMESYFQTVICSSSDFRNTTVNGDLRFFVWDDPPGLEPRILDETHLDNMVNSSAAFARRFVEEAPVLKKVDDELLNRSSAQLVPGXWCRNLGEKQGGGDVEACSEWGDINVVX

SEQ ID NO: 120916 - protein, 161 aa, Triticum aestivum
  Clone ID: PAT_TA_15334.pep
ARAYVYSCNAFMSTFSFLQVAAVGLCAHRSLGLAAWLVTSKFQILTILYAGVVGCGVSFVLLTWCIEKRGPVFVAAFVPVVQIIVSVMDFTVLHETLYLGSVLGSVLVIGGLYLLLWGKRQEALQQPPKVAEDDTEQQQQQQQHHHHQQQQQVQVQVQMQP

SEQ ID NO: 120917 - protein, 121 aa, Triticum aestivum
  unsure (1)..(121): unsure at all Xaa locations
  Clone ID: PAT_TA_15335.pep
STYYSSSAXVSLLLLLHCQPPPCQSPPRRLSRRGCLSRNCSRCLLVSSSSTTLSVMFSVTIHSSSQEVGCTFSSCRFSSSSAVSTRFLPFFLPWLFPPDEPPLSILFFFSWLFSLLKADVS

SEQ ID NO: 120918 - protein, 110 aa, Triticum aestivum
  unsure (1)..(110): unsure at all Xaa locations
  Clone ID: PAT_TA_15336.pep
QIAVXCRLCYMPHIFTHVSLFTGFLXTHPGGALGGQADASSPPVEEKDDKDVEARSDPGTSGAAFYAAPRDMHPFSLYRQNKYSFLTRTKLAVKKLCCWKGSWGTKQNIV

SEQ ID NO: 120919 - protein, 274 aa, Triticum aestivum
  Clone ID: PAT_TA_15337.pep
PTNSLPRITIFLQAKAHVSLLLGFVAVRHGDRFGLRWCAGVTGGHHLLELLESDAAVAVDVDGGDHLLALLGAASLADAAQDLAELGDGDAAVAVDVVDVEGVAQLGVELAPLAASAVAGWELSEILVGVAAGAELDLQRPQLASSIAQVSLRRASPRRRRQLAARGQGGAAVGAAVVDVVGLAALRCRPPVLLGLVRRLRPAPRGRGKRAPPLSRRSGRRPPFRSWSRPSRSRWPGPPPGAALAAGAAAARGRAAARKTRDSMDAASQLSFKA

SEQ ID NO: 120920 - protein, 372 aa, Triticum aestivum
  Clone ID: PAT_TA_15338.pep
IIRQDYRKARLEQYKNYENFPQSGELMDKLCKQVESSSKYYEFQYNTRIVKPSILHFQLRNLLWATSKHDVYFMSNSTVGHWSSLSHKMTDVLDFSGHVAPAKKHPGCALEGFTGVQVSTLAVNEGLLVAGGFQGELVCKSLGERDVKFCTRTTLSDNAITNAMDIHRSTSGSLRITVSNNDSGVREFDMERFQLLNHFRFNWPVNHTSVSPDKKLLAVVGDDRDALLVDSRNGKVTSTLVGHLDYSFASAWHPDGVTFATGNQDKTCRVWDIRNPSTSLAVLRGNIGAIRCIRYSSDGRFLLFSEPADFVHVYSAAECYRKRQEIDFFGEISGISLSPDDESLFVGVCDRVYASLLNYRMVHANGYLDSYM

SEQ ID NO: 120921 - protein, 331 aa, Triticum aestivum
  Clone ID: PAT_TA_15339.pep
MLATASPHLHAAAHRLSLAAPARAARSARLPLRRPLRYAPLRLRASAAAEAAPSAKEGAEELGFEEMVARTTRRYYMLGGKGGVGKTSCAASLARRVANSGHPTLVVSTDPAHSLSDSFAQDLTGGALAPVEGTDSPLFALEINPEKSREEFRTINQKNGGTGVKDFMDGMGLGILADQLGELKLGELLDTPPPGLDEAIAISKVIQFLEAPEYSMFSRIVFDTAPTGHTLRLLSLPDFLDASIGKILKLRSKIASATSAIKSVFGQEVQQQDAANKLEQLRERMVKVRELFRDTESTEFIIVTIPTVMAISESARLHSSLQKESVPVRRL

SEQ ID NO: 120922 - protein, 201 aa, Triticum aestivum
  unsure (1)..(201): unsure at all Xaa locations
  Clone ID: PAT_TA_15340.pep
HAALLQVAGVPAAALQAAHPLLLSSRRAAVPFFSVERVIHPWGAVGSSASRGGGTALGDLPENCVAEVMLRLNPTEICXLARLSRTFRAAASGDAVWEAKLPRNYARLLAAAAGGDEEAAALEAEAIPKKEVYARLSRRNSLDGGTKEFWLDKAGGGTCMTIYSRALSITGIDDRRYWNFIPNDESRFRSVAYLSQIWWFE

SEQ ID NO: 120923 - protein, 145 aa, Triticum aestivum
  Clone ID: PAT_TA_15341.pep
MEIPTATIHRLLSSIREGTTAAPPAPPFPSVADAVAAFRPRCLTGAPVPGAAARPGGLLRGAQPAVCVHCGSPRRGEGDDIAFRGSAAYQWLLGSLRLDGSALVEFDGDSTDSNKSKETPKSGLVLSDLLDLKLTFPPENREISG

SEQ ID NO: 120924 - protein, 246 aa, Triticum aestivum
  Clone ID: PAT_TA_15342.pep
SADAWAVTYSTYVAGLCRAGYIEDAFRQLDIMVAKGLQLTVVGLNILLDYADKDVDMWVAKEVLERCEELGFEVDVVTYNTVMEHFSKKMQWLIALRLFTDLLKKPITPDVQTYNILISSLCRAGKFELAKFVFSCNGFVADTVTCNILIHQFYGAGKEGELGFLFSDVDAGKITPDTITYNTLVDCLFRSGRRTEAANLVRHIDGGYPAEPVAHLAFWLVRSGNVREALSLFDDMLVKGVALDAM

SEQ ID NO: 120925 - protein, 264 aa, Triticum aestivum
  Clone ID: PAT_TA_15343.pep
GLAMATQKLDAAEFEIMPLMDNRCCTDAHRLLFGQQFNDFVRDCQDAFAGLTRLHLRNMRFGKSDISNILSHCKRLEFLSFFEVDEGVRSVLHVEHAQLVELVIIFGRFETVELACLPKLQRMSYRDWQYDDNPLVLGFVPQLSKLSLACPYLSGKTLNLSKLLANAPTVSDLYLEFRSEKIWIQPECQKVLAPVLAKLRFVNLDHLREECDISWTLFLLEAAPHLGALCTTMGGPPSRTEHVPRSVELVSMRLLTRFLEGRGR

SEQ ID NO: 120926 - protein, 439 aa, Triticum aestivum
  unsure (1)..(439): unsure at all Xaa locations
  Clone ID: PAT_TA_15344.pep
LVECAPPPGTPPEEWGLLLGPPVPRPRPGRRAALGGREPGPPGAGSGGPRAPPSASTAAPSSPTASTPSGPWPWAPAPPRGARAPPPPARPPPPAPPAPRPWAFTDGGSKALHYAPGSYXENTFKGLDFVMSEARKNGIKVILSLVNNYDTFGGKKQYVKWARGRGQAVGSEDDFFTNSVVKGFYKNHVKTVLTRLNTVTGVAYKNDPTILAWELMNEPRCQSDLSGRTIQSWIADPPARVKSIDGNHMLEAGLEGFYGASSSRAASVNPAGRQVGTDFIANNQVPGIDFATVHSYPDQWLSSSDDQAQRSFLGRWLDAHIADAQGTLRKPLLIAEFGKSQRDPGFSSAQRDAQFGMVYAKIYESARRGGPTVGGLFWQLMADGMDSYGDGYQVIFAEAPASTTGVITSESRKLKMLGKAFARAERAKRDASGKVTGGN

SEQ ID NO: 120927 - protein, 134 aa, Triticum aestivum
  Clone ID: PAT_TA_15345.pep
SPASVRLRWRGRARPVGWRRLDPFLNQELRGGRGWGVMHGRLHPASISTRAAATPEELKPHPWSTSPSSAGGAWVAERAGSVRLSRCRPSTRDTSPRVLAYILSRCHTHSLFRPLTHVLVAGYLSLVLEESREL

SEQ ID NO: 120928 - protein, 187 aa, Triticum aestivum
  unsure (1)..(187): unsure at all Xaa locations
  Clone ID: PAT_TA_15346.pep
MKPHVGRRMNAEMRRMGTALTASAGQTAAGAPGCATPGPDAATGGRSIRLRNSGHGHARGTGPAAKGQGPGTGGATGAAAGRLGGGAXAAREMAVERTGSARGEGQGRRPPGPGARPKRGAAQAGARQREDGGPEGAGRQRRGGRSTGLRVEPHQPSSQRRAPARARPRANSSAAGTHGAAPETPAP

SEQ ID NO: 120929 - protein, 344 aa, Triticum aestivum
  Clone ID: PAT_TA_15347.pep
MAAAPVVVPRMKLGSQGLEVSAQGLGCMGMSAAYGERKPDQDMIALLRHAVAAGVTFLDTSDIYGPHTNELLLGKALQGGAREQVQLATKFGITAAWEVHGDPAYVRAACEGSLARLGVDCIDLYYQHRIDKNVPVEITMGEIKKLVQEGKVKYVGLSEASASTIRRAHAVHPITAVQLEWSLWSRDVEEDIIPTCRELGIGIVAYSPLGRGFLSTGPKLVDTLPEDDFRKNLPRFQPENMKKNAEIFERVSEMAARKGCTSSQLALAWVHHQGSDVCPIPGTTKVENFNQNLRALSVELTAEEMAELESYAAMDAVQGDRYHNTFLNTWKDSETPSLSSWKAT

SEQ ID NO: 120930 - protein, 393 aa, Triticum aestivum
  unsure (1)..(393): unsure at all Xaa locations
  Clone ID: PAT_TA_15348.pep
MHQAQQARTEWLQFPGQLAAPSLRPRDSITCRQHPSPAGSTTLTTMATAPVTVVPRLKLGSQGMEVSAQGLGCMGMSAFYGPPKPEHDMVALIHHAVAAGVTLLDSSDIYGPHTNEILLGKALLGGVRERVELATKFGISFADGKREVRGEPAYLRAACEGSLERLGVGCIELKXHHRIDIRVPIEVTVGELXKLVEEGKIKYIELSEASTXTIRKVHAVYPINAVQMDWSLWSRYVEEDIIPTCRELGIGIVAYSPLGXRGFFSKGAKLVDSLSDQDFRKNLPRFQPESLEKNAXIFERVDAMATRKGCTPSQLALAWVHHQGSDVCPIPGTTKIENFNQNVGALAVKLTPEEMAELESYAAAGDVQGDRYPPMASTWKESETPPLSSWKAE

SEQ ID NO: 120931 - protein, 123 aa, Triticum aestivum
  unsure (1)..(123): unsure at all Xaa locations
  Clone ID: PAT_TA_15349.pep
LLSLVALTMLHHIDNXDTWKMYIVVNVRKEPFTKFVCRQGGKNPKIYNICMYELLSLWTVSSGTKLYLWTVSSSALYVYVLNASLYQVYLSITFATLVCTTACDFSFYTELCLPGLHFHTVRN

SEQ ID NO: 120932 - protein, 346 aa, Triticum aestivum
  unsure (1)..(346): unsure at all Xaa locations
  Clone ID: PAT_TA_15350.pep
RPAASTFLPFSSFAFVVLTATQRHLLPSTTLPPSPPFPSPSPPPRSRGRRRYQRAVLGWGERTSQTTTSTTRPRVDGDVGRRDVGKMEHGCEHYRRRCKILAPCCKEVFPCRHCHNDATALCDRHNICRQDVEKVVCTLXVCXQPVSSICIIYHLNMGEYYGIFSXFELRATIKGXYLCDDCGICRVGGKENYFHCAKCGSCYAVALRDNHQCVEDSMRQNCPICYEYLFDSLKGTRVLNCGHTMHMDCFAEMVDHNKYTCPICSKTALDMTVHWGMLDQEIEATIMPPVYRYKVWVLCNDCNKVSEVDFHVIGHKCSHCNSYNTRSTSRPADLSGSSSPSTTDSS

SEQ ID NO: 120933 - protein, 173 aa, Triticum aestivum
  Clone ID: PAT_TA_15351.pep
MANDSLTRAQIVGDVLDPFVSSVPLTVMYDGRPVFNGMEFRSPAVSLKPSVEIGGDDFRVAYTLVMVDPDAPNPSNPTLREYLHWMVTDVPSSTNDSFGKEIVPYESPSPTMGIHRMVLVLYQQLGRGTVFAPQARQSFNSRSFARRFNLGKPVAAVYFNCQRPTGTGGRRFT

SEQ ID NO: 120934 - protein, 154 aa, Triticum aestivum
  Clone ID: PAT_TA_15352.pep
MAATACSTALLGVAGARLPAGAPPTFLLPRRHFSPRRLQDAPRLSLLRAKASSGDTSAASGDELVDDLKAKWDAVENKSTVLTYAGGAIVAVWFSSVIVGAINSLPLLPKIMELVGLGYSGWFVYRYLLFKERRKELADDVESLKKSIAGTEAE

SEQ ID NO: 120935 - protein, 257 aa, Triticum aestivum
  Clone ID: PAT_TA_15353.pep
VTPATAEQCGSQAGGAKCADCLCCSQFGFCGTTSDYCGPRCQSQCTGCGGGGGGVASIVSRDLFERFLLHRNDAACLARGFYTYDAFFGQTSHETTGGWPTAPDGPFSWGYCFKQEQGSPPSYCDQSADWPCAPGKQYYGRGPIQLTHNYNYGPAGRAIGVDLLNNPDLVATDPTVAFKTAIWFWMTTQSNKPSCHDVITGLWTPTARDSAAGRVPGYGVITNVINGGIECGMGQNDKVADRIGFYKRYPWPSPTRP

SEQ ID NO: 120936 - protein, 183 aa, Triticum aestivum
  Clone ID: PAT_TA_15354.pep
MATGQNGQKEKENVMNRNIRLFSLMKVLLTCLAVQSMNYELLAYGTINVIAFSSYRMRKNGLRNLHPLRLQDAPRPSLLRVKAASDDTSASGDEIIEDLKGKWEAIEDKPTFLLYSGGAVVALWLTTVVVGAINSVPLLPKLLELVGLGYTGWFVYRYLLFKESRKELATDIESLKKKIAGTE

SEQ ID NO: 120937 - protein, 323 aa, Triticum aestivum [sequence omitted]

SEQ ID NO: 120938 - protein, 305 aa, Triticum aestivum
  Clone ID: PAT_TA_15356.pep
APDPSESLDGPKFSIKAAKTGTTSLYVSTKQRSGQRVLSQVINVEVYKPLRIHPEYIYLTPGASFVLSVKGGPKIGVSVEYTSLNVGTLEVQSATGKLSAKTVGNSTVRAAVVPRGRTVIREAFGRVEVGIPVAMALSTQSDRLCVGCSMPVYPSVPKGDPFSFYETCQSYTWMIADQKVVTFQSARSWQNGLDQALYSEGKTYPWLSNGSSNAFINHVIGRSAGKTKISISVTCDFSLHGSSGSVSYDASKTILVVPDPPLARGLPITWLLPPFYTTTDLLPRSVNSFGEQDSNGLDTTIGYSL

SEQ ID NO: 120939 - protein, 206 aa, Triticum aestivum
  Clone ID: PAT_TA_15357.pep
MARLIGASGAVRAPRRPARAAAPPPPRPGAARQLWDDGRKVGGRTEVRDVEDDKEVQELGRYSVEEHNRRREEGCEGGGVCGRLEFARVVSAQRQVVSGIKYYLRVAAAAARPPGSAARGAAPAATAAGAAPPWPPSPAPSPARWSGSRRPTPNEQLHARSDEPLARRGPFCPPEYPWVWSRGWRGRRWRWPPRRAGRRCGGRPPG

SEQ ID NO: 120940 - protein, 63 aa, Triticum aestivum
  Clone ID: PAT_TA_15358.pep
GLTKAGVALVGDLADALGPSIKLLLKNSNFHSELLGRCSQSDDEQLRETASWVQGVISRVLVS

SEQ ID NO: 120941 - protein, 303 aa, Triticum aestivum
  Clone ID: PAT_TA_15359.pep
LRNDQAINVIRKKYELEKVEIISAEKEKAEKLIREMEHKCNEKILENKRESERCLMRLKEEHAAVVARIQQDNELKESTLRAYHKEELQRIRSQGESELRERLSSLRQEHEAQIKTVNIRHEEDCQKLQDELELQKSKEEKQRALLQLQWKVMGESQQVDQEVNSKKRRDPYVRKESQLQLPGPGPETKRKDVNISGVIHSPISNVMRKVEKASQDVTNHRKVTHHEYEVETANGTITKRRKTKSTVMFGEPNTQKSLQNTADKDVTKTRKVVAGSRPHPANIGELFSEGSLNPYADDPYAFG

SEQ ID NO: 120942 - protein, 130 aa, Triticum aestivum
  unsure (1)..(130): unsure at all Xaa locations
  Clone ID: PAT_TA_15360.pep
TRIPAFDTDEHARRERLPLVREAYARQFRKHFTLFLELRAKELVPGGRMVVSLVGPPSDVIASKFFPLPGTVAQILSAMAPEGAIDKAKFDSFQVPVQGPSXKKVXEIIEXKGSFSTRKIRAQEPTTEMN

SEQ ID NO: 120943 - protein, 154 aa, Triticum aestivum
  Clone ID: PAT_TA_15361.pep
MCGKGQNNGLASPAGTSSTATAIVVLASLLLAASVAAFFLSPSPSPAADEKPPEPVELAIGVAGHEACRGAPRAGPRLASPIPRPLVPACRRWSPGSLKKAARQSLAMGKEAVEHTAVSAARAAEETIGRTTEKVRRKVSASPSPSAPRADGDL

SEQ ID NO: 120944 - protein, 250 aa, Triticum aestivum
  unsure (1)..(250): unsure at all Xaa locations
  Clone ID: PAT_TA_15362.pep
MARGLDSDYIGSISLMDGFDMGITFDGFGENMKKFMELPIKYLDSAHDKAVEXLRDIHALIYAHSPDDKXRAKDHGTLTDPSRYPTSSRAPSSCGFMQQVNPNEEFSGYPSSLVTAEDHSLGSTATDVHETESVSSTSPAMCASEDPISLERTADTKEEVTFCNSEDLSDNCTPENHNSLGGSDSSDEEIILWNQWNSVTSRQYPEQATVVQDYISEEANGNKIIEQVELHGSGHSVAFDGAILLGKGKW

SEQ ID NO: 120945 - protein, 249 aa, Triticum aestivum
  Clone ID: PAT_TA_15363.pep
SCFFNLHCCPFSLSTHPTATRCRSSLCASLLDSPTILCHPLRSTTHSAPRAPTTTPRSSPRRHPRTVPLHLGCVGPLHLLQHLHPISLLDPASIHRAVHQQPSSGLLSIWEERHLPIRSDKGHGAVQFGWGSHPVPRRPPQGRRTRNSTTGPSTPPSSLQRVRVQDGKHVDAVHHPIRPQMPAPLHLGARRGHHRSPIPVPPPSGSDPPAHPPPTARHGQQHFSEPLSLTASLMISLPLDLSMPEQLWR

SEQ ID NO: 120946 - protein, 245 aa, Triticum aestivum
  unsure (1)..(245): unsure at all Xaa locations
  Clone ID: PAT_TA_15364.pep
ARGDNWISTFSRLCGSYEEATSIKPMRYTDEPPPPFAGVGYANAVVIFSVKVTQLDDSLXWPLDVYGIVAARDSIDRNRNLLFNRTRDNCQRLTAGDASLLLTGPSRAVVIVDPVNYEVELKVKGDTPSEDKLLSLLVIEDKYYLPGDRRQGVHCHTYSSKLSTVEVTVGHLAKTVEATIAVQVVEGSWXNWPTGHHGRFAARMASLDDLEMVLLDSQDGMVPVTNDGAIEFSRCVVSVEADGEL

SEQ ID NO: 120947 - protein, 161 aa, Triticum aestivum
  Clone ID: PAT_TA_15365.pep
RPETFERQHGWIMRTMNREAAPLQDEYAPGIFSQDTVSYLARMDMMSGEEDRENILRARETGKPVLTNPFRLLGSNHLGVVLTFAVYRPDLPADASVEQRVEATAGYLGGAFDVESLVENLLSKLAGNQDILVNVYDVTNASEPMAMYGSQTPDNKVDLLH

SEQ ID NO: 120948 - protein, 328 aa, Triticum aestivum
  unsure (1)..(328): unsure at all Xaa locations
  Clone ID: PAT_TA_15366.pep
MASAETLARSPSREPSSDPPRDASRDASSEPHHNGSANAAGDGDSSSRRRRRSRWEQSNDESGANSGGEGGAGGRKRKSRWAEEEPRPTIALPDFMKDFAAEXDPEVHNLNSRLLEISRLLQSGLPLDDRPEGARSPSPEPIYDNLGIRINTREYRARERLNRERQEIISQLIRRNPAFKPPADYRPPKLHKKLYIPMKEYPGYNFIGLIIGPRGNTQKRMEKETGAKIVIRGKGSVKEGKLLQKRDLKPDPSENEDLHVLVEADTQEALEAAAGMVEKLLTPVDEVLNEHKRQQLRELAALNGTIRDDEFCRTCGEPGHRQYACPNR

SEQ ID NO: 120949 - protein, 440 aa, Triticum aestivum
  unsure (1)..(440): unsure at all Xaa locations
  Clone ID: PAT_TA_15367.pep
MEGSNLPTGNMMQGIPYSGLNVHGNSMQMHASNSGKQLFNQSQMLGSFAMPINRATAPDNPGFQFGEHEKKDHHQQQQQQQHSHYSKNSISDEEEHDMTEDVTDTQNDKGKKGSAWHRMKWTGSMVKLLITAASYTGEDPGADQGGRRNIAIVQKKGKWKAISKVMGERGCSVSPQQCEEXVQCSSPSDIRGLSPEDRALQHSLQVALRCKEEHDHSLSDKMKEDARKILNSKHLFYEQMCSYHNNNRVNLPEDLALQHSLQVALRCKDEHDLRRXQVQILEEVEQSADSDYEEHDEEHQTVHTNLRDSYMNKRMCRAVDHGDVGFVTSSSNGVSGRFNPHDITLDINNAIPGGANLSFARKDLTSQQIELQKHRLQTQEQKLEVAKQRLKWERFRMKKDREIERMTLENEQMMLQQKRLELQLRHNELELELKGNANHA

SEQ ID NO: 120950 - protein, 196 aa, Triticum aestivum
  unsure (1)..(196): unsure at all Xaa locations
  Clone ID: PAT_TA_15368.pep
SADAWARRHAYAAMMYMGTPRDYEFYVATRVMMRSLRGFGADADRVVIASLDVPPRWVQALKDDGVKVVSVDNLKNPYEXKIHFNSRFKLTLNKLYAWSLLHYDRXVMLDSGQHVSSKNTDXLFQCGHFRASFINACIFNTSPFVLEPSMEFLXTCTEQLWAKPVQLSLQLFQTADSKFITTKDKLMTLLKVQRSK

SEQ ID NO: 120951 - protein, 110 aa, Triticum aestivum
  Clone ID: PAT_TA_15369.pep
MPSHSDLDRQISLLRDCKFLPDAEVKALCEQAKAILMEEWNAHQLGAKARHGTAATAVTVFSAPNYCYRCGNMAATLEIGENMDQNFLQFDPAPRQIEPDTTRKTPDYFL

SEQ ID NO: 120952 - protein, 309 aa, Triticum aestivum
  unsure (1)..(309): unsure at all Xaa locations
  Clone ID: PAT_TA_15370.pep
MPWHSQLVRQISLLGDCKFLPDAGVKTLCEQANAPFIKGRINLPVRCPIALCGEIRGHYFSVSQTILTGVVTPLTFYLYLGEYVSDLSSFGSSATANAAINIRYGHRILILSGSHEIFLISHVYGFYDXRLQKYLDSIVXTLFIGIVXDLMPLAALIVNLVFCVYGGLFPSLDTLDNIRSLDRLXEVPHEGXPMCDLLXWSDPDDRCGWGISPRGAGYTFGQDIAQQFNHTNGLSLISRAHQLVMEGFNWAQEKNVVTVFSAPNYCYRCGNMAAILEIGENMDQNFLQFDPAPRQIEPDTTRKTPDYFL

SEQ ID NO: 120953 - protein, 235 aa, Triticum aestivum
  unsure (1)..(235): unsure at all Xaa locations
  Clone ID: PAT_TA_15371.pep
SLRGSLPAIFPKGLQSLDLSGNQLSGRIPPGLGDCSRLRRLRMSSNSLDGFIPPQIGRLAELRVLELSGNRLAGGVPPELRHCSYLVKMDLSRNLLHGQVPSSILKELKKLRFLSLAGNNFSGEIPSGLGQLRSLRVLNLSSNSLSGVVPIDLVALRDHTVLLLDGNLLPAKVSAPMPSPQMDEISQVTADSSXVGPPPHSAEVFTVTPQYKSTWVLTEANRGTPPDGSGNVGHL

SEQ ID NO: 120954 - protein, 233 aa, Triticum aestivum
  unsure (1)..(233): unsure at all Xaa locations
  Clone ID: PAT_TA_15372.pep
ETYTWLFKAWVACMSGNLPKAIITDQCRGIQSAVAEVVPGVRHRICLHQIMKKAAEQLSGLSEYKAISKALQKAAYDSLTVDEFEGEWEYFDHXNGLQGHDWLRSLYECRFSWVPIFLKDAFWAGMSATQRSETITPFFEGYVDLKTSLKQFLGKYEMILQSKSEKEAQADFETFHKHRPPVSKFFGEQQLANAYTPNVLMKLHLDLPAFLYGQGPPLYGFSERLFFTREWGF

SEQ ID NO: 120955 - protein, 339 aa, Triticum aestivum
  Clone ID: PAT_TA_15373.pep
MAPLVPSSQPWVEKYRPRQVKDVAHQEEVVRVLTNTLETADLPHMLFYGPPGTGKTTTALAIAYQLYGPELYKSRVLELNASDERGINVVRTKIKDFAAVAVGSARKGGYPCPPYKIIILDEADSMTEDAQNALRRTMETYSKVTRFFFICNYISRIIEPLASRCAKFRFKPLSEDVMSNRILHICNEEGLTLDAQALSTLSAISQGDLRRAITYLQSAARLFGSSISASDLISVSGAIPEDIVKSLLVACKSGEFDVANKEVSNIIADGYPVSQLLSQFLDVIVNADDIPDEHKARICRKLGEADKCLVDGADEYLQLLDMASETIRALFNIPQGLVF

SEQ ID NO: 120956 - protein, 188 aa, Triticum aestivum
  Clone ID: PAT_TA_15374.pep
MATRCAAAADLPAGRPRKRARHGWDVAPATKAQITFCGQEVGDMTTLVLPSHPPDYTCFSLLSKGVARNASPPRREDDKDGHYVFAVGENLTSRYKIYMKMGNGLLVRCWWDRARKEILAPLKFFLLKIQRPTLWLFCPTDPQSGLWMLCVFRSLAFGPCVGPLLANCYRKLRIHHILENFDITSIKL

SEQ ID NO: 120957 - protein, 333 aa, Triticum aestivum
  unsure (1)..(333): unsure at all Xaa locations
  Clone ID: PAT_TA_15375.pep
RGWRVNARTARPAGAAALMLNDHWRLFCTSELCPLSCFGEVXPQAGFLHQLNMPHRDMLTRNNLXRYKMHQHLKFHQXGRYRKTSEYDPLDLFSGXNERLGTAIKSFYSTPQNIYWIFSNRSLSFGGMVGGADNVRANETGKCLEDLKKTGRLQLSDFIELVSEAIAKSGVLSKLLAKPKLDDHDIESAIHVYYNIIXRPCLVCKNITDAELLHKYSVLHSLPLDKSCKIVRDFLISATAKDCSLMMCFRPRXCERTDSEYDSVFLKSWNRAYDYKASXVDLDVKPLDKLTHYFKLDQKIVSFYTKSGEVGRVACDSQKGVGTSDDTAVQPHH

SEQ ID NO: 120958 - protein, 693 aa, Triticum aestivum
  unsure (1)..(693): unsure at all Xaa locations
  Clone ID: PAT_TA_15376.pep
TRRPLVLQLVRHSAPEEWGEFLHAPGRRFDDFEHIKREIQSETDKEAGGNKGVSDKQIRLKIFSPNVIDITLVDLPGITRVPVGDQPSDIESRIRTMIMQYIKHPSCIILAVSPANADLANSDALQLARLGDPDGSRTIGVITKLDIMDRGTDARNFLLGNVIPLKLGYVGIVNRSQEDINFNRSIKDALAFEEKFFSTLPAYHGLSQCCGVPQLAKKLNMILLKHITDMLPGLKSRINAQLVAVAKEHAAYGDTAESTAGQGVKLLNILGKYCEAFSSMVEGKNKVSTDQLSGGARIHYIFQSIFVKSLEEIDPCKNISDEDIRTSIQNSDGPKGAMFLPEVPFEILVRKQIGRLLDPSLQCAKFIYDELVKISHGCLTSELQKYPILKRRMGESVSNFLRDGLRPAETMITHIIEMEMDYINTSHSSFVGGXKVVRTRGHEGLSSRGPTSLSVHKDGVGISSEAQLKSSTENNVQLKSERGQKSRAVFARDTSRGATAEKGFQPDTDAGTSVAGGGQNGHSLVSGSLSSMSDPRVYSLNSLYSMIRLREPPSTLKPSENKTDRDRTEIAIVKLLVKSYYDIVKKXIEDAVPKAIMHFWVNHTKRELHNVLIXKLYRESLLXXMLXETDEVLYQNGSVFKETLQVLEQAHRTLEEFPLEAEKLERGYSLSEYGTGLPNIPGLSNRNPRGILP

SEQ ID NO: 120959 - protein, 138 aa, Triticum aestivum
  Clone ID: PAT_TA_15377.pep
KEHQFTAALRGGGGGRPKGERGGPPQEMKQRGKAARGRRQIRIIWRGKRGVIWRKPLILLPVKVVQTSLKFFCLVPVGNVHLASGGRGSQDDGRGSSARVSNCQVCLLPTCEGWPCQTLLFLSEAHIARWPLPSTTSQ

SEQ ID NO: 120960 - protein, 129 aa, Triticum aestivum
  Clone ID: PAT_TA_15378.pep
APPGNGQGLLVLHLVGTLHTSPRPLPRPAKRRLERAVWNDTSFLASVGVMDYSLLVGIDEEKKELVMGIIDYLRQYTWDKQLETWVKASGILGGSKDGMPTIISPDQYKKRFRKAMSKYFLTVPDQWSP

SEQ ID NO: 120961 - protein, 265 aa, Triticum aestivum
  unsure (1)..(265): unsure at all Xaa locations
  Clone ID: PAT_TA_15379.pep
MDRPPHLDFDLNEPPPPSPAPPAGLQPPPREFAAPIPIVAPPPPLXPPPPPQLPPPANVQAQAAAPAPGPRASAGVPPWRNPWRLAAANGQCGARTXLAHRWEVPPTARRFSGPPTFAPPPLPPPPPPIIRSPPPAPPPPPPPRRPPPPNVQAQLLLAHQASEIALAYQRGEWGEPWRPRRGRRAGASASAGPRSSEVGREPVRVLGASPNWQDRTLFATPANVVPPKAGSKVGRRASVGGNQPLKCPGCAKGTLKAQEITRPVL

SEQ ID NO: 120962 - protein, 201 aa, Triticum aestivum
  unsure (1)..(201): unsure at all Xaa locations
  Clone ID: PAT_TA_15380.pep
RVRPRVRSASAASPTADRSVWKSTEXEIQALLDKLQDVNDAMSRCAAPAAPATGSVSQKLARHRDILHEFTQEFRPTRGNLSSMREHADLLSSVRGDITESKATGGMSPRVHLLRERASIHGSVNQIDEVIGQAQSTRAALSNQRALFGDVQGKVKQLGEKFPVVRGLLGAIKRKKSKDTIILSAVIAACTIFLIIYWLSK

SEQ ID NO: 120963 - protein, 41 aa, Triticum aestivum
  Clone ID: PAT_TA_15381.pep
GPFFFFFLLVIFTTKPSIRDAFFMLRIKGNHSYILQHVDRR

SEQ ID NO: 120964 - protein, 121 aa, Triticum aestivum
  Clone ID: PAT_TA_15382.pep
MRGVVVVAMLAAAFAVSAHAEQCGSQAGGATCPNCLCCSKFGFCGSTSDYCGNGCQSQCNGCSGGGTPVPVPTPTGGGVSSIISQSLFDQMLLHRNDAACQAKGFYNYGAFVAAAHSFSGF

SEQ ID NO: 120965 - protein, 266 aa, Triticum aestivum
  Clone ID: PAT_TA_15383.pep
MRSLAVVVAVVATVAMAIGTARGSVSSVVSRSQFDRMLLHRNDGACQAKGFYTYDAFVAAANAFPGFGATGSNDARKREVAAFLAQTSHETTGGWATAPDGAFAWGYCFKQERGAAADYCTPSAQWPCAPGKRYYGRGPIQLSHNYNYGPAGRAIGVDLLRNPDLVATDPTVSFKTAMWFWMTAQAPKPSSHAVITGQWSPSGADRAAGRVPGFGVITNIINGGIECGHGQDSRVADRIGFYKRYCDILGVGYGDNLDCYNQRPFA

SEQ ID NO: 120966 - protein, 338 aa, Triticum aestivum
  unsure (1)..(338): unsure at all Xaa locations
  Clone ID: PAT_TA_15384.pep
MKPYMPTVLRPPRVVAILAVVLAAALATAVNAQQCGSQAGGATCANCLCCSKFGYCGSGDAYCGAGCQSQCSGCGPTPPGPSPGGGVSSIISRDLFXARLLLHRNDCQEARGFYTYDAFLAAAAAFPSFGTTGSTETRKREVAAFLGQTSHETTGGWPAAPDGPYAWGYCFKQEQGSPGSYCEPKPEWPCASGKKYYGRGPIQLSWNYNYGPAGRAIGVDLLNNPDLVAADATVSFKTALWFWMTAQANKPSSHAVITGQWTPSGTDNAAGRVPGYGVITNIINGGLECGRGQDDRVANRIGFYKRYCDVLGVGYGNNLDCYNQRPFNSGLSMGLATE

SEQ ID NO: 120967 - protein, 133 aa, Triticum aestivum
  Clone ID: PAT_TA_15385.pep
MARAKPSSAAAKKSQAAQQGGGAGHAAPSGLARYLDPEAPWDKDRLLDAVHWIRQAVGLACGLLWGAVPLVGAAWIVLFVAISSGIIYWYYAHLLKVDEEEFGGHGALLQEGMFASFTLFLLSWILVYSLAHF

SEQ ID NO: 120968 - protein, 317 aa, Triticum aestivum
  Clone ID: PAT_TA_15386.pep
MRGVVVVAMLAAAFAVSAHAEQCGSQAGGATCPNCLCCSKFGFCGSTSDYCGNGCQSQCNGCGTPVPVPTPTGGGVSSIISQSLFDQMLLHRNDAACQAKGFYNYGAFVAAANSFSGFATTGGADVRKREVAAFLAQTSHETTGGWPTAPDGPYSWGYCFNQERGATSDYCTPSSQWPCAPGKKYFGRGPIQISHNYNYGPAGRAIGTDLLNNPDLVATDATVSFKTALWFWMTPQSPKPSSHDVITGRWSPSGADQAAGRVPGYGVITNIINGGLECGRGQDARVADRIGFYKRYCDLLGVSYGDNLDCYNQRPFA

SEQ ID NO: 120969 - protein, 348 aa, Triticum aestivum
  unsure (1)..(348): unsure at all Xaa locations
  Clone ID: PAT_TA_15387.pep
EHGGGTVHLRRTTCPHYADHLGWWPAWLGAGRRRLAPAVTAQQCGPQAGGATCPNCLCCSKFGYCASAAAYCGAGCQRQCSGCPPPPPGPDPRRRAAPIICSALFERPLLHRQEGPRARAGFYRAXTAFRAAVDALPAVAPTGGRPPRPRGRGAPAGHTSHETTGGCPAAPDGAYAGGYCFNQEQGAPGPPXCRPSRQWPFGAPGRHHXGGPCPAPHTENTGPARPARGAGVRDSPDLLARDXAESFAGAKTALWLWMTPQXPNRYDVIPGRWSTSGADHAPRRGPGYGVITNIINGGLECGRGQDGRRAGPIVFPKRNGVLLSASYDLHRGQLRRQPGLATNQRPFA

SEQ ID NO: 120970 - protein, 68 aa, Triticum aestivum
  Clone ID: PAT_TA_15388.pep
FHNMNTNLSLFLLTEKKPRRSVCILCPRSFEIIHPKKGKFICGKEEGHEKEFIRLNNMLEKPFTCQPS

SEQ ID NO: 120971 - protein, 217 aa, Triticum aestivum
  unsure (1)..(217): unsure at all Xaa locations
  Clone ID: PAT_TA_15389.pep
MGCKSCQKPKAQHRKGLWSPEEDQKLRDYIVRYGHSCWSTVPVKAGPPSPGLRGGLRCAGPPSPAPGLAWDLLAYESCQKPKPQPRKXLWSPEEDQKLRDFIVRHGHSCWSTVPVKAGLQRNGKSCRLRWINYLRPGLKHGMFSREEEETVMGLHAALGNKWSQIAQHLPGRTDNEVKNYWNSYLKKRVEGARSPAKSAGSGAPRSPTAKRERVRPL

SEQ ID NO: 120972 - protein, 275 aa, Triticum aestivum
  Clone ID: PAT_TA_15390.pep
HASADQVGSGHEGARRVLRRRLPDAAVSGEAAAGGGGEANGVQPNVTIYINNLNEKIKLEALKKSLNAVFSQFGKIIEVLAFKTLKHKGQAWVVFEDVASATEALKRMQDFPFYDKPMKIQYAKTKSDVVAKADGTFVPREKRKRNDEKPEKKQKREQHHDVNQAGVGMHAYPGAYGAPPLSQLPFGAGPSFMMPEIIVPNNILFVQELPHDATALMLQMFFCQYPGFKEVRMIEAKPGIAFVEYGDEGQATAAMNLLQGFKIKENPMRITYAKK

SEQ ID NO: 120973 - protein, 126 aa, Triticum aestivum
  unsure (1)..(126): unsure at all Xaa locations
  Clone ID: PAT_TA_15391.pep
ASRRDDSGXVSLCEASGTARKGRGRDGGTPRKERERSQGPSSRTSPRARKTRRTSTRARQRDGRRRHMYPSSQGRARERTNELEGECRVRQTFEGDGVRNRTEGNLGRPKSCTRFQRMTKGNRGCP

SEQ ID NO: 120974 - protein, 289 aa, Triticum aestivum
  Clone ID: PAT_TA_15392.pep
MVSAFFLFCGCVEQANVAVVEKWGRFLRLAEPGLHFFNPFAGELVAGTLSTRVQSLDVKVETKTKDNVFVQLICTIQYRVVKENADDAFYELQNPQQQIQSYVFDVVRAIVPRMELDSLFEQKNDVAKAVLEELEKVMSDYGYSIEHILMVDIIPDAAVRRAMNDINAARKGAVRLWVTKEKRRISCLVKKAEGEAEAKYLSGVGIAKQRQAITDGLRENILNFSHSVSGTSAKEVMDLIMVTQYFDTIKELGDNSKTTTVFIPHGPGHVKDIGDQIRTGMMEASSSGL

SEQ ID NO: 120975 - protein, 153 aa, Triticum aestivum
  unsure (1)..(153): unsure at all Xaa locations
  Clone ID: PAT_TA_15393.pep
MKSATSLLLGAALATACFLLYTSVGRDLGARTPPAPRWAPEKGAGGADRPKQEVVVKVEEVTKGVVASSDGGGRDGSSPEQEKQQRQQQIVMPVNKQQQQDKPQDLGXDLLRRAANADRTVLMTALNEAWAAPGXSFLDLFLESFKHAGDAPP

SEQ ID NO: 120976 - protein, 272 aa, Triticum aestivum
  Clone ID: PAT_TA_15394.pep
MEMTSTKIALCCVLILSGATIRGCFCYKEENIKEKTQSIPWPLQIPPINRDEASTQASEEQINHFSVHLWNKRLDGNNYYALEATMDVYGFHLGHEEQSVAAIWIYSRGEDGKSPVTGFALGWHIHPALYKDTNTYFLTHWTGNGSPPDGCYNIRCPGYIRTSSSTTPGDVITPVSSIRDKKQYITIKAYKDKKSGDWQVHYGFNSPAKLIGYFPKSLFSDMEKKQLIISFGGFTSHPHAQPILQWGAGYFQGRNAAPSKNLKFVDAKRSYS

SEQ ID NO: 120977 - protein, 83 aa, Triticum aestivum
  unsure (1)..(83): unsure at all Xaa locations
  Clone ID: PAT_TA_15395.pep
LCSXLTLTKGNKSWSSTAVAAALELVDPPGCRNSARGHNXVKKKKKNSRGGPVPNSPYSEXSYYNSLPAFYNVVTGKTLALPT

SEQ ID NO: 120978 - protein, 221 aa, Triticum aestivum
  Clone ID: PAT_TA_15396.pep
MGMKWHVVAVLGVACTVAAAVAADRGLSFAGAVAPPEEASYDLRKLASSLWQSDGTAYHHVWPPMKLGWKIVLGSFIGFFGAAFGSIGGVGGGGIFVPMLTLIIGFDPKSSAAMSKCMIMGAAVSTVYCNLKLKHPTLDMPVIDYDLVLLIQPMLMLGVSIGVICNVIFPDWLVTGLLIILFIGTSTKAFLKAIETWEKETVIITVKKKSWIGVLFVLTSH

SEQ ID NO: 120979 - protein, 204 aa, Triticum aestivum
  unsure (1)..(204): unsure at all Xaa locations
  Clone ID: PAT_TA_15397.pep
TNPRRRTVNRTNHGPREGQGRRPRRRQVVPVAGLVLGVVVRVRVHGDAVAGGQAAVGGAAVPRRRPLLQGPSCCRCTCRRASPWCARCCSRWASXSSASLRXTFGSTSSATSTXDLLLLXTDCARACCSRTXAPFFSRPSSGGRRRPAPXTLLPGEPAXYARAFPAGPKRNXGKASNLFLXFGXXRVXFFPXFPXKPRGGXXPG

SEQ ID NO: 120980 - protein, 235 aa, Triticum aestivum
  Clone ID: PAT_TA_15398.pep
MARHAPPGSTALLWLPSCAGAARRTPSPPPSGGASRARPAPRVGRWYPGRAARQPTLPPAPGGARAAAPQHGRRPRRPAAPGRGACRHRVPAHRPRRPSTGRSRRRPRPARTGGTRAFGHAAGTRATAGPRVPALGRRAVPSAQRPPPPPTLAAAPHPQRFGAGATCVISHPGATMARSGPPPPDAARASGVLGPETFAFADDGGPRPHPAEVGGVRLWLARTPAQGPMFRPPAT

SEQ ID NO: 120981 - protein, 194 aa, Triticum aestivum
  unsure (1)..(194): unsure at all Xaa locations
  Clone ID: PAT_TA_15399.pep
REQKLELHRGGGRSRTSGSPGLQEFGTRLRQNPHNVEEWHRRVKLFDKDPAKQVATYVEAVKTVDPMKAVGKPHTLWVAFAKMYEKHNRLDSAEDIFKKATQVNYKAVDHLATIWCEWAEMELRNQHFDKAIELMRLATAKPSVEVKMRAAAXGDQPVQLKLHKSLKLWSIYVDLEESLGSFGNNPVLVYEKKY

SEQ ID NO: 120982 - protein, 189 aa, Triticum aestivum
  unsure (1)..(189): unsure at all Xaa locations
  Clone ID: PAT_TA_15400.pep
MDPDSEVAFDFPPYLCQYKSGRVHRPGGDAIAPAGTDPLTGVVSKDIHAGPARARVYLPPDASAAAAPGRLPVVVYFHGGGFVVGSPARPSTHAYLNDLVARSGAVGVSVYYRLAPEHALPAAYDDGWAAVRWVLAGGDGADPWLRDHADLSRVFLSGCSAGANIAHNMAXRAGRARRGARRRRRPGPH

SEQ ID NO: 120983 - protein, 220 aa, Triticum aestivum
  unsure (1)..(220): unsure at all Xaa locations
  Clone ID: PAT_TA_15401.pep
MAAMPMPRSLLLILLLATPLLILPLAAAAVPTSNPDIDLEYLIKNAGLDDPTPATTATDPEDDGAPDFPGLDADYDDEDLFGDDDGPEEDSSHPSAADEAHVLLLTAANFTSVLAARRHVMVEFYAPWCGHCRALAPHYAAAASALAEQGVDVALAKVDATEDHDLAQAHGVQGYPTLLFFIDGVPRDYAGERTKDAIVAGISKKLGPXVQNLTTADEAE

SEQ ID NO: 120984 - protein, 318 aa, Triticum aestivum
  unsure (1)..(318): unsure at all Xaa locations
  Clone ID: PAT_TA_15402.pep
TNPTKGNKSWSSTAVAAALELVDPPGCRNSARVAVCLKATRGDVSLALVLRLGPDGSRGISVHHRAGRGLRRSNNLHNILPLPLSLAPSLPSSGLHAAAGSSRSIPSTPACRNGGRGRGRRRRSRPGELIAPRGGAGSPRSTITLPGPFSAMFGASRVPGFVGRSHIHSGETFFSXGPSVGTPRRLESXNTFXKPPDXSGRNLNTNLAVRTLFQKLGPGFPPFPTGGKGDPLGAANDPLWGLWGGRPPRQFLARDPIWGFPGGGKFPTGGGTPGPVPLSHLTKERAKPYYHTGFRWNGVGKPQLGFWEFGAWLGPLLD

SEQ ID NO: 120985 - protein, 146 aa, Triticum aestivum
  unsure (1)..(146): unsure at all Xaa locations
  Clone ID: PAT_TA_15403.pep
PPPPSPATAPPSPPSSGLPAVPPRRLHVQPHAVVVFFAQPAAAAPHARVQGREGEPPPAPGARGGRGEAAPRSTAASTRRRRPEPPPSSWPPPSAAPAPRLPPPQAPCLVGPGGLARGRQPXTPSPIQSSSXTPSPGPGAAPAVHE

SEQ ID NO: 120986 - protein, 187 aa, Triticum aestivum
  Clone ID: PAT_TA_15404.pep
MDAAAAAAQKRKRAEQEEEQAATDGLDVLDLRAAKRLLLGFERRLRDNLEARMKHPDDPARFADSELALHAETDRLRLLAGAPELFPDLVPLGLASSLSSLLTHDNADLAAAAASLLADLTDSDDPSDLAGVQALADALVDANALDLLVHNLSRLSEAGPRRARAGAPPPAAPHDPLAPSPGRKPLN

SEQ ID NO: 120987 - protein, 209 aa, Triticum aestivum
  unsure (1)..(209): unsure at all Xaa locations
  Clone ID: PAT_TA_15405.pep
SFKRRTNIYSYYYMSTCILVSDGTPTTQTIPSRSRVFTLGRSRMASSASSPGRTTKSSSPLVAGAVQLELAEVQRRPLLPDPSLRPGPLGEVAVLHLHVALGEELLHDVVAELVPHGVDPPGERRPLRVLRRRARLALQGQDELHVRLRQSRLLPGAGPAVEVEWLHRTTGAGNLSIDIGPSPHRIWPPDXVCLSDLEVGLCGVGRTRG

SEQ ID NO: 120988 - protein, 156 aa, Triticum aestivum
  unsure (1)..(156): unsure at all Xaa locations
  Clone ID: PAT_TA_15406.pep
MPIGSSADPDIFGSFCKTREDQSNSEESTQSARSQLSKEDLKNATHDASDISESFDNFPYYLSEDTKCALLSSAFVHLQRKDYIEFTRHISSLGQRALLSGLAGTEIYQQYLVKALXKHFGARLLTVDSSMLXSGQTFRNXSHQKGDRVRYIGSLL

SEQ ID NO: 120989 - protein, 128 aa, Triticum aestivum
  Clone ID: PAT_TA_15407.pep
MLGPGRSTSTDASAKPKRPHLADGDGGGGEADNDRLSALPNDLLHEILSRLNALETVGTCVLSARWRHLWRAAPCLDIDEREFTAKQPFFVNFTGNLLRGHEVALLEDLRVYLRLRRPRVVRLWGAAP

SEQ ID NO: 120990 - protein, 182 aa, Triticum aestivum
  Clone ID: PAT_TA_15408.pep
MALNQPAIAMGLLVVLVLAAMAQVAYCAGGGTTQNYREALAKSILFLEAQRSGVLPASQRVGWRSNSGLQDGKANGVDLTGGYYDAGDNVKFGLPMAFTVTMMSWSVLEYGGQMQAAGELGNALEAIKWGTDYFVKAHPEPSVLYGEVGDGDTDHFCWQRPEEMTTSRQAYRLDPQRPGSDL

SEQ ID NO: 120991 - protein, 121 aa, Triticum aestivum
  Clone ID: PAT_TA_15409.pep
MAPSASSSSSSSSGTDSSGSSSSSGSDRRVRRRHSRRKDAAPSTSSSSALKVRKDRKSRHKRRRRERRKSRSDDDSYSSASSYDSDREASGRSRKHKKSSRSRKSRERERSKDRHHKRDKS

SEQ ID NO: 120992 - protein, 206 aa, Triticum aestivum
  Clone ID: PAT_TA_15410.pep
WIPRAAGIRHELPSPSSPPAPPCSGAEAASSSGCSSLPSPAPPSLSIASYPPPPHHRHTLGAASSPLPAASSPAPQPPASPRPLGSPWRSTLSTPAASPDPRHSRLPPSCPTSGPPPTPTLCSPSSPVAASPAPTSPPSSPRTPSSSDQGRQGLSPSYGLSASAADPTWRALCSPNKFREIIAQLTILPLRGLESCRHNSHTSCER

SEQ ID NO: 120993 - protein, 200 aa, Triticum aestivum
  Clone ID: PAT_TA_15411.pep
SSLLGKPEPRAPMVLVPRVFDYEPIDARTRKGVPDYELTARMLPVGHLLDEYVVDAGSLSSQITQTQLQDHLVNRVSTGSSSWGKKRVAQKISGLDFHAGLRLGWGGVIGLGVLFRSLDAVKRNRRSVGIHVVPLGASGRVKLLIGKRLSSPGWADQGARYRSMYLSLGASFRTGRRRTDLESAWRISGSPATRGQTRTT

SEQ ID NO: 120994 - protein, 74 aa, Triticum aestivum
  Clone ID: PAT_TA_15412.pep
YFIMSVLRISLHANHSFPHLAMLFCHVFSRFLCILFSARVKHRQHCIDVVKSCRLIAEQIYTFVGTKSENDNWD

SEQ ID NO: 120995 - protein, 128 aa, Triticum aestivum
  unsure (1)..(128): unsure at all Xaa locations
  Clone ID: PAT_TA_15413.pep
MAAVGGDAASMVAVGLVWGATNALMRRGALVWDRRSRSLPAGTGAVRRWADLLLTWQYSAPFAANLSASAAFFRLLGDAPISVAVPVTNATTFAGNRRSPAGLFGEAPAXARRLGTALIVLGVWVCIS

SEQ ID NO: 120996 - protein, 197 aa, Triticum aestivum
  unsure (1)..(197): unsure at all Xaa locations
  Clone ID: PAT_TA_15414.pep
YXCSKLTLTKGNKSWSSTAVAAALELVDPPGCRNSARARSSSPCVPAAAAGSSKLLLHTLADAANHLSSRPLVGLLEHRPRRAPNLPPSPSLLLCSCPAGRLCLDPAPGLPRPRLSVTAPCTPAILLRQVPPAGVPASPAVVLRRRVGLLDLRCEPHRRLVLAVLASDPERSWAAQVSCCPLSWAPGSKSGPPGGHR

SEQ ID NO: 120997 - protein, 191 aa, Triticum aestivum
  unsure (1)..(191): unsure at all Xaa locations
  Clone ID: PAT_TA_15415.pep
AKIPLIQACIVVQPEAKRVXWMDSDYXLIDVNLTLPLGQYRGHNFVVNGWPSLVYDEASPSWTGLNAGVFLVRNCQWSLDFMDAWAAMGPDSPDYRRWGAVLTSTFKDKVFNESDHQSALVYHACSTRAGRGGTRWSLGKAYSFQSRLLAGKSPGAPLGTKFDGKLHGPPLPQARSGRVTPRNMGVSVFVP

SEQ ID NO: 120998 - protein, 167 aa, Triticum aestivum
  Clone ID: PAT_TA_15416.pep
KASPPHNFKPTISRRKPSSSTSRGRRGAHSSEWRPPPNPLAAGGRGRHGSRPPNPMPPLPLVPPVGRSSQAPPLARAKAGEEAIEGEDHLGVAVPRSEEEGGIIIFCDLAPAGPPIGGRRAHAQLRQLKRQRSLPPPKICHQPPPLRSRWAPLGDVMMIRIHQKPFK

SEQ ID NO: 120999 - protein, 162 aa, Triticum aestivum
  unsure (1)..(162): unsure at all Xaa locations
  Clone ID: PAT_TA_15417.pep
MASHVHGHGLLLDPAALAYSWAAEPEIPPQLLAALGEYLSNSAAAGSHGDNQSAVDTESDAEADDEFMMYEFKVRRCARARSHDWTACPYAHPGEAARRRDPRRVAYAGEPCPDFRRRPGAACPRGSSCPFAHGTFELWLHPXRYRTRPCRAXPXCRPRVCF

SEQ ID NO: 121000 - protein, 80 aa, Triticum aestivum
  Clone ID: PAT_TA_15418.pep
LLIPPSSKLTLTKGNKSWSSTAVAAALELVDPPGCRNSAPGLVLLLASAADRTTFQDGQEPATFPAAAACQTQLLGPGDA

SEQ ID NO: 121001 - protein, 96 aa, Triticum aestivum
  unsure (1)..(96): unsure at all Xaa locations
  Clone ID: PAT_TA_15419.pep
TGPDPPGPPPRPEPRPPQPXPPRPSPPAHSFPSVPSRRRPAAAAHPAGRRPPPPLRPAAPPSVEQPLPPCSVEQPLPPNNAAARNYAGDQSIGRRL

SEQ ID NO: 121002 - protein, 133 aa, Triticum aestivum
  Clone ID: PAT_TA_15420.pep
GARSTNGIGCTSPRTAPPIDGSTFKQPPPPTAARAPIGSHPPKGPRRSNLVYPTMAIAHEGLASLAVDLHEVGDLLALTNSLVQLHNLVGGSQVTPNQSRRHHSPRSNKWCVDNELLALVLQMIVSPTLNSLS

SEQ ID NO: 121003 - protein, 144 aa, Triticum aestivum
  unsure (1)..(144): unsure at all Xaa locations
  Clone ID: PAT_TA_15421.pep
MATRALFVSLLLALCSALGEGVSALRGRSNGDAVKFDFTPFLIQYQSGRVQRLMGTSVVPPSVDARTGVASTDVVIDQGTGLAVRLYRPSRRGRLPVLLYFHGGAFVVESAFGPVYHNYLNVLAARAXVIAVSVNYRLAPEHTL

SEQ ID NO: 121004 - protein, 282 aa, Triticum aestivum
  Clone ID: PAT_TA_15422.pep
VGYMSGGCKSDDGSLSCGYSSFRGKRASMEDFFDIKSSKIDDKQINLFGIFDGHGGSRAAEYLKEHLFENLMKHPQFMSDTKLAISETYKKTDSDFLDSEINTHRDDGSTASTAVLLGNHLYVANVGDSRAVISKSGKAIALSDDHKPNRSDERKRIESAGGIVMWAGTWRVGGVLAMSRAFGNRLLKQFVVAEPEIQDQEIDDELEFLILASDGLWDVVPNEDAVSLVKMEEDPEAAARKLTETAFGRGSGDNITCVVVKFQHSKTGGGDSPPISPPGNQI

SEQ ID NO: 121005 - protein, 136 aa, Triticum aestivum; identical to SEQ ID NO: 106789
  Clone ID: PAT_TA_15423.pep

SEQ ID NO: 121006 - protein, 204 aa, Triticum aestivum
  unsure (1)..(204): unsure at all Xaa locations
  Clone ID: PAT_TA_15424.pep
MASERQGHRSISSCILLVAAVLLLSAPRSSASCYKRIFAFGDSIIDTGNFVYSTGSAPNALKEFPYGMTFFHHPTGRVCDGRVLLDFYAQALGLPLVQPSLPEQRWGQCTFGANFAVFAATALPPEYFQRRGLSIPGSGNLGMQMGWVKEVVQPIAXPGPGARRLLGESLIILXEIGGNDYHFLLLGPNVGKRINKPFWGYSKQ

SEQ ID NO: 121007 - protein, 202 aa, Triticum aestivum
  Clone ID: PAT_TA_15425.pep
TLAMADATAPRPLLRRVLSFREPLLLIPHLVVFLGTVASAFFHSYASFLQSFARSIVVPSPAACAKCPYATSSAVCCEDVDAEEEEDEELRKEEVEAIMARIGLGVAGAGEGLRASMGHNEVSRLFDAEEPSFAEVRRAFAVFDGDADGFIGAADLQGALARLGFPDVDAAACGAMISSSCGSTDGRMNLFQFVRFLEDGLC

SEQ ID NO: 121008 - protein, 146 aa, Triticum aestivum
  Clone ID: PAT_TA_15426.pep
MARAFGVGAAMLVVVVSVLAPAVTAQTGSCSGPLPFELVGNYSGLACSPVWNNFVLRYHQDKNNVLRVVLSTMYSTGWVGMGFSRDGLMIGSSAMVGWMGKKGLPHIRQFSLRSKSGSKAGVVDRGFLVSNNHDHTVVGQQAKIYV

SEQ ID NO: 121009 - protein, 200 aa, Triticum aestivum
  unsure (1)..(200): unsure at all Xaa locations
  Clone ID: PAT_TA_15427.pep
XQLSKHQDKTSFTFDFTTGKGFADGPFPYGLRRAHGGLNLFAWGILMPIGAILARYFRRMDPLWFYLHVSIQFAAFIIGLAGVVAGVALYSKIQADIPAHRGLGIFILFLGILQVLAFFLRPNTDSKYRKYWNWYHHWSGRLVLFFAAVNIVLGIHVGGGHDSWKIGYGFNLAILLVAVIGLEFMLWTRWSKNSASTPTY

SEQ ID NO: 121010 - protein, 371 aa, Triticum aestivum
  Clone ID: PAT_TA_15428.pep
MPRAFGVGALVLVVVSAFFAPALVTAQTGSCDDPLPTELVGNYSGLACSPVWNNFVLRYAQGADNVLRVVLSAMYSARWAGMAFSKDGLMVGSSAMVGWVGKKGQAHVKQFALNGKAPSMVVADRGFLVSNGHAHTVLVKQAKIYLAFQLNFDSQLKKQQVLFAFGSAIPVNDRLAEHQGKTSMTFDFTTGSSSGSSFPSGLKRTHGALNLFAWGVLLPIGAIIARHCRGWDPLWFYLHGGIQFVGFILGLAGVVAGVSLYGKIQADVPAHRGLGIFVLVLGILQILAFFLRPNKDSKYRKYWNWYHHWVGRLVLFFAAVNIVLGIKVGGAGNSWKIGYGFNLAILLITIITLEVLVWTRWKNNSGPTTTY

SEQ ID NO: 121011 - protein, 143 aa, Triticum aestivum
  Clone ID: PAT_TA_15429.pep
NMTNRKVARVLCLLVFLAIYSCSRNAQPIHGVDHCTIDKNNVIEYCKGIIEKNLGNQVPQPWTLCCGTIRGVTDIHCICDRFAAHDLTRISLPKFACMAYICGKGLHPHTHCAGYLVPVMKVRPPPPGKHLGLQCKNTHNGNN

SEQ ID NO: 121012 - protein, 113 aa, Triticum aestivum
  Clone ID: PAT_TA_15430.pep
LPPTKGNKSWSSTAVAAALELVDPPGCRNSAPGQPPPQPICHHHSTNASTPWPDPPGAPPLRTRAARTPAASPPPHHGRRPPLPSATITIHRINPLPPPTTTIQNRAGGQIRR

SEQ ID NO: 121013 - protein, 185 aa, Triticum aestivum
  unsure (1)..(185): unsure at all Xaa locations
  Clone ID: PAT_TA_15431.pep
MASSSAALLAVLVVVSCAGMAAATSYTVGDTKGWVTGVDYSGWTSGKSFAVGRHAKCSGYASKVHTVTEVSQGGYTSCSXGSNALANFDSGATTRHARDPPERTYGHLATIPGHCASGTEARRHRRRGRLVPARVRRGLPGPGDGRRRRRGGGGSDQGGAVLNVGGRARAEAVQVIGRFRGFRSS

SEQ ID NO: 121014 - protein, 46 aa, Triticum aestivum
  unsure (1)..(46): unsure at all Xaa locations
  Clone ID: PAT_TA_15432.pep
LKPVKFENPXSSXLTLTKGNKSWSSTAVAAALELVDPPGCRNSAPA

SEQ ID NO: 121015 - protein, 202 aa, Triticum aestivum
  unsure (1)..(202): unsure at all Xaa locations
  Clone ID: PAT_TA_15433.pep
WIPRAAGIRHQAFHLFLHPVHRILHVRLTPRASAALRLEADAIASLRPGAVLRLRKLLLLAPPHHRLRLEHIRLLRRDFGLPDDFADSVILSNPALFRLTPDGFVEFVPSPDDPPDLTVAAVERSRERHYREHRAPGAGEEDARFAFPTRFPPGFKIGKVFXALQFGKWQAPSPTLSPYCGRLLANDLRSLEATTPAWKKPR

SEQ ID NO: 121016 - protein, 200 aa, Triticum aestivum
  unsure (1)..(200): unsure at all Xaa locations
  Clone ID: PAT_TA_15434.pep
REQKLELHRGGGRSRTSGSPGLQEFGTRLAAAVRCHCPPPLLPRRAPPATAATPLRSRPLQLRPLTSSPGLRTRGRRHAVDPEDDGGEDDGFLTLDVEDFEGFADADEEAEGPSPWEGAVVYRRDAAAQHVEYATTLERLGLADLSXPHFRARAGGMGIMPPSKPRRGAREAPTTPVLVFVDVARRRGRLXRLDGILRTG

SEQ ID NO: 121017 - protein, 60 aa, Triticum aestivum
  Clone ID: PAT_TA_15435.pep
LLLLTLTKGNKSWSSTAVAAALELVDPPGCRNSAPEMLQLHRILNSRFSIRTAAPCRKWH

SEQ ID NO: 121018 - protein, 230 aa, Triticum aestivum
  unsure (1)..(230): unsure at all Xaa locations
  Clone ID: PAT_TA_15436.pep
RRTQDADGSSSLSYNSKKKRRKNTFPANADLNGKQIFDDNVTNADRQSVPSDVSGKVDIQEEAKTPDXGDQDNIRAEVTDTVGQSQPCYSVKLSFPDADFXDFASLRDASLFATGQIWALYDNLDGMPRYYARIKSLDASNFKGHLTWLERIAMNEAEEKWSDEELPVACGSFSLGTTEISQDRLMFSHIXVSWTKGKRRKYEVHPNKGEVWALYKGWNMQWGSDADNHR

SEQ ID NO: 121019 - protein, 112 aa, Triticum aestivum
  unsure (1)..(112): unsure at all Xaa locations
  Clone ID: PAT_TA_15437.pep
AFDPLHECYTMIVVSRSMISAYSKLWNAPELEKKLCVKNNVQQKLSFALSLLAVTCRHDENYSEMLNLPGAEFLQPGGSTSSRAAATAVELQLLFPLVRVNFELAXQXXXXX

SEQ ID NO: 121020 - protein, 226 aa, Triticum aestivum
  Clone ID: PAT_TA_15438.pep
MVASAAEKAPATASGGTRRVLLFPLPFQGHLNPMLQLADVLHARGLRVTVFHAAFNAPDPACRPAGYRFVPVGAGVPTADLVPTGSNADFAGALLRINERLQTPFQNSLREVLEDEEGVPACLVLDSNLRGMHVVADRLGVPTLVLRTGGAACLVAYMAFPALCDKGLLPPQGIYVLTDKQVNLPPLQLQDMVFSTTTPHETMTTCLETHCGIGKVFFKVVILNNL

SEQ ID NO: 121021 - protein, 131 aa, Triticum aestivum
  Clone ID: PAT_TA_15439.pep
HEADASEGSESSGALPDFSWQGVSAFDEAPAYPAPEPETEQLAKRARTTEAEDADEGMSAHQASDCDSDALFDALLVADQFAYFNGGAYESLDSLFSADAVQSGATAADEAALGLWTFDDDCLVDECSLSF

SEQ ID NO: 121022 - protein, 340 aa, Triticum aestivum
  Clone ID: PAT_TA_15440.pep
MCGGAILAELIPGAPARRAASGHGHVWPGKGAKHTKAAAADDFQAAFREFNEDSDEEDVVMVVERQEEVAESKPFVFAASPKKKQQQQQEEEEEQAAPARRRKPAQYRGVRRRPWGKWAAEIRDPVKGVRVWLGTFPSADAAALAYDEAARAIRGPRAKLNFPSSSAVAAAAPGARKRGRAAAPAAKPAPVITLVDDEEEHASSFVKHEAEASEGSESSGALPDFSWQGISAFDEAPAYPAPEPETEQLTKRARTTEAEDTDEGMSAHPASDSDSDALFDALLFADQFAFFNGGAYESLDSLFSADAVQSSATATAVNEAALGLWTFDDDCLVDECSLSF

SEQ ID NO: 121023 - protein, 97 aa, Triticum aestivum
  unsure (1)..(97): unsure at all Xaa locations
  Clone ID: PAT_TA_15441.pep
MGQMVSDGVIQEQAARNGGIIKNGREILLQAFNWESHKHNWWSNLEGRVADIAKPGFPSGALPPPSPSGSPEAFPPLYLLSLVASDGSLLRLXXLQR

SEQ ID NO: 121024 - protein, 73 aa, Triticum aestivum
  Clone ID: PAT_TA_15442.pep
TNVLLLWINFKKKKKKKKKKKKKKKKKKKKKKKKKKKKKKKKKKKKKKKKKKKKKKKKKKKKKRGGPFKKNQI

SEQ ID NO: 121025 - protein, 187 aa, Triticum aestivum
  Clone ID: PAT_TA_15443.pep
QSIPTIAASPASSSGISPRAADARQAVDAPDLKAGRAAPSACVPSTAVCKISLLKEMQHRNIIRLQDVVHNEKREGAMAKKEGPCGHCGVTSVLFLYPSGYIREDPLGVPNNLSPMCSKSLSGGACADGLWDRIQHQGWNRGGEIMVQNTRNSSGCEAGFYPGCEVRIHVRSFEAYRQRVAYYVLNL

SEQ ID NO: 121026 - protein, 96 aa, Triticum aestivum
  unsure (1)..(96): unsure at all Xaa locations
  Clone ID: PAT_TA_15444.pep
DTXSSKLTLTKGNKSWSSTAVAAALELVDPPGCRNSARDALQPTASAFFHASEQRHPMAPPPLLLLAREDLDGATSIASSIWPPPHLRLDLIWERW

SEQ ID NO: 121027 - protein, 135 aa, Triticum aestivum
  Clone ID: PAT_TA_15445.pep
WIPRAAGIRHERRPPHPPPTSSLPPLTISPYPLPASPASSPDPIDTTPLPPHPVLSTMAASSSSPHQPITPSWGRVRGGYPSTPSPSAPAAPQSPPNPHPPRSRRRHRSAATTPTGPPACPCPSPVPSRAAAAVG

SEQ ID NO: 121028 - protein, 135 aa, Triticum aestivum
  Clone ID: PAT_TA_15446.pep
MHPAMSHVFCFGLLLLIILDPHTLPQCHAATDTLSPSQELAGRDKLVSLNGRFALGFFQTGSNFSNGTPKWYLGIWFHTVPKFTPVWVANAENPIANLTACKLVLTRDGNLAVHHQATTVWSTKANAATNTTVAA

SEQ ID NO: 121029 - protein, 546 aa, Triticum aestivum
  unsure (1)..(546): unsure at all Xaa locations
  Clone ID: PAT_TA_15447.pep
HASGRAKFKLSQALERKHIVEGIVIGLDNLDAVIQVIRETSNHTVAKEALAKEYGLSEKQAEALLDITLRKLTSLERKKFIDEANSLSESISKLNELLSSKKLMFQLIEQEAADLKSKFATPRRSFLEDSANRGVDDMDVIPNEEMLLILSEKGYLKRMNPNTFNLQNRGTIGKSXVGKMRTNDNMSDFIVCXXHDHVLYFSDKGIVYSERAYKIPECTRVAAGTPLVQLLNLSDGERITSIVPVNKFVEDQYLVMLTVNGYIKKVPLNAFASIRSTGIISMRPRPRDELKWVRLCRDDDLVALASQSGMVIVNTCNRLRPHGRTTRGMGAMRLKEDDKMAAMDIIPSTTHTMPGKTVSRVRDLSPPWLLFIAENGYGKRVPLNAFRQSSFNRVGLRGYKLPEDCRLAAVFVVGEPTDDDASEEQVVLVSHGGTVNRIKVKDISIQGRAAKGVILMRLEHAGKIQSASLISATADGRDLGRLIQLTLQEGRSRFCWLVLHSKLGRAANFVMLGGSCCSPVEARNDTDLTLIRRGRRVELWLPLTCV

SEQ ID NO: 121030 - protein, 73 aa, Triticum aestivum
  unsure (1)..(73): unsure at all Xaa locations
  Clone ID: PAT_TA_15448.pep
RLIRQLEINPTKGNKSWSSTAVAAALELVDPPGCRNSXSFIQKMHRDRLGGPVPNSPYSESYYNSLAVVLQRR

SEQ ID NO: 121031 - protein, 131 aa, Triticum aestivum
  Clone ID: PAT_TA_15449.pep
NAQSPRSGVWVRNFTTESSATLPNTTNPAAADELTALTHGSERRTQNFTERTKCSNNRFFSTDLCPNFTAACSATPDPAAKSAKLCYAAGSQEKRVGNRVGIAARRNFLTPAACFCRRTMAHDTNLSGPED

SEQ ID NO: 121032 - protein, 146 aa, Triticum aestivum
  Clone ID: PAT_TA_15450.pep
MHFFNVPTAVLQLFVLLILASPTTACTKQEKCYVLRFLAGLSRDGGLATSWRDSSTDCCEWLGITCNGDGTVTEVSLASRGLEGRISRSLADLTSVLHVNLSYNSFSGGLPPELMSSTSIIVIDVSFCQLNGPLPSCRIPAARGIH

SEQ ID NO: 121033 - protein, 103 aa, Triticum aestivum
  unsure (1)..(103): unsure at all Xaa locations
  Clone ID: PAT_TA_15451.pep
GVCVQTFVKHANFLPHHLGGMTLHQARFHVFLIIFLFFGIKMPWYPRVGPAVRQDNAKLKSAPGVAXGGPYQSXKDXIXPTASLKVYGNWVQLTLXTLPXETX

SEQ ID NO: 121034 - protein, 212 aa, Triticum aestivum
  unsure (1)..(212): unsure at all Xaa locations
  Clone ID: PAT_TA_15452.pep
XXXSXSLXXLTLTKGXKXXXXXSSTAXAAALELVDPPGCRNSXPAQNAKTQTPLREGEEAAQCWRRRRSLSCGAPCTGGSPHGCCSSCSTSSSSPSSSPPWPRPRRRAEKGLRPVLTARGGTSPSGRQWSSTGTGRPTCLASPPPPLRPRRPEYWIWGSPTISRRRSRWSRRIRVSASTRAWRGACLRRPSRPSCRSSRRGLHKSASDMSAF

SEQ ID NO: 121035 - protein, 145 aa, Triticum aestivum
  Clone ID: PAT_TA_15453.pep
MAMVAVLLAATATTRAASLVPAADDRNSRSMPTAYEMLGRYGFPPGILPEGVQGYELRPDGSFEVHLPRHCKIRIAGQNIHYSSRIAGKIQNGLIKGLEGVKVKIFILFISVRDVRRNGNELRLHAGIIAKSFSANDFSFSPRCN

SEQ ID NO: 121036 - protein, 115 aa, Triticum aestivum
  Clone ID: PAT_TA_15454.pep
MDELCSPKDDRLEENIQCTAAADGDPDNSNISSSLSTDKCNIATLEWQRIQQRMKMTLPLCKGHREPCIPRSVKKGSNIGRLFYVCARAQGPSSNPEANCNHFQWASVKSKGKRQ

SEQ ID NO: 121037 - protein, 237 aa, Triticum aestivum
  Clone ID: PAT_TA_15455.pep
LVRSAVLGFAASVFALTRPRPVLLVGFACCSAPDLPAARVLVVLRHSALCGFSDDALEFQRKILERSGLSEETYCPEGMHAIPPEPTMANARAEAESVMFGALDSLFAATGVKPKDVGILVVNCSLFNPTPSLSAMIVNRYKLRGNVRSFNLGGMGCSAGVIAIDLARDMLQVHRGTYAVVVSTENITQNWYFGNRKSMLIPNCLFRVGCSAVLLSNRGADRRRAKYSLKHVVRTHK

SEQ ID NO: 121038 - protein, 163 aa, Triticum aestivum
  unsure (1)..(163): unsure at all Xaa locations
  Clone ID: PAT_TA_15456.pep
MAPACALTTIAILAAILFYVLLLLSRAMELRFTASYAMVDCAPPPASDAAAAAAFRDTVLPLLAALPAAAAPTGFASLQSGGGAFARGLCLGDPAPRDCLACLAAAAKKLTGCGASRRAXGVWRSEGCFLAYADGNTSSTHEDVFRDVVSFDDGTPSSYPNCF

SEQ ID NO: 121039 - protein, 150 aa, Triticum aestivum
  Clone ID: PAT_TA_15457.pep
AARQDEARKEREAPPPVPFPRENEEERNLKLPSRVVSLFFGGDISTTAQSFEKWVSLVRLRSGTFRPSSVPRRNSKIEVMPSGSFSLFGSADLREEVIKAEAASREKNPTLDQPPEISLWERLGNASALDIESSGFSWNMLSSLHHTEHS

SEQ ID NO: 121040 - protein, 197 aa, Triticum aestivum
  Clone ID: PAT_TA_15458.pep
REQKLELHRGGGRSRPPGSPALQVVAPRLFQKNEGVDVCLFAMYVQEYGSASPSPNQRHVYLAYIDSVKYFRPEIKSASGEALRTFVYHEILIGYLDYCKKQGFVSCSIWACPSTKRDDYVLYCHPTAQKMPRSDKLRSWYQNLIKKAVKEGVVVERNTLYDFFLQPTSECKAIISAACLPYCENDFWPGEAEKLLV

SEQ ID NO: 121041 - protein, 127 aa, Triticum aestivum
  Clone ID: PAT_TA_15459.pep
PCRPPRSEPRSTALSPPSSPRVRWISISCSCTVMRRYKKIRKGMVAEVMERFLQDADKILTEIAVLLNEPQLDYDKVEGIADQLEGCSNSTVGAKRSQPLMRGVPSFLRQNPKKGPTPGGPLPRGAP

SEQ ID NO: 121042 - protein, 113 aa, Triticum aestivum
  unsure (1)..(113): unsure at all Xaa locations
  Clone ID: PAT_TA_15460.pep
IXPSSILTLTKGNKSWSSTAVAAALELVDPPGCRNSAPAARDPFSSSFPRRARSRAPSPAAGAVSSFSPSSVTALRVSPFAARKASSRRRSPANILVVGHQSIRLVAGLFAAR

SEQ ID NO: 121043 - protein, 238 aa, Triticum aestivum
  Clone ID: PAT_TA_15461.pep
MNSEMKAIRPSLSAKSVEKLSKSRKGALSKQVLSRLSMSIVALASFDGDTQLHECTGTCIESSCPDATCFLTSINLIPYTWWLGKITESLTIKVRLPDDQIVTGWIENPEIYVDFFIVKIKNDDVIDPLHLRHLSLDRATQFEPYRKVAAVWRHYDSGELKATSGVDLASVCALTDEEMLSTCRIHEVGIGGPLVDFDGNFVGMNCSGTKPRTTLYVQRPSIREFMWHRGMDSVKEEV

SEQ ID NO: 121044 - protein, 259 aa, Triticum aestivum
  unsure (1)..(259): unsure at all Xaa locations
  Clone ID: PAT_TA_15462.pep
MGMLQARVVVLVLAAAAAAVVVVVDGQMSPAFYDASCPELQSVVRRGMAQAVQKEARMGASILRLFFHDCFVNGCDASVLLDDTANFTGEKNAGPNANSLRGYEVIDAIKAQVEASCKATVSCADIVALAARDAVSLLGGPSWTVQLGRRDGLSASQNAANANLPPSDARLPDLLARFNDKGLDARALTVLXSGAHTMGWALCTTFRTHIYNDSGYEGVDADFSTQIRAKAVPSVGGXGTLAPIEXLRAPVEFDNRFFP

SEQ ID NO: 121045 - protein, 136 aa, Triticum aestivum
  Clone ID: PAT_TA_15463.pep
WIPRAAGIRHQVFLAPMPKRRRLVSFKNERTGRKGTAVSKRHYGKQADTPVQPVPKANEASAGANPFVWSTISSSSTNITFGTNSNHTYCGQLHNVPPNVEVVYKEKAQRKHVIDLNIPQMPSDYESTTSYLQNFL

SEQ ID NO: 121046 - protein, 189 aa, Triticum aestivum
  unsure (1)..(189): unsure at all Xaa locations
  Clone ID: PAT_TA_15464.pep
LQAAVCIHGLFMMAPNRWDPAFRALLRPLRLAYDRSRSLLARVSRHPARPYRSLLVSLFGADALYPLDQXTAFLEQVRRMLRLSEEDXGRVGAELHAMHAAREGSGGSARIFPALANSWFQGTLQKWQFLSLANFAQPRGDQKKPFWAMGPLPWPPLVARSLFKIWGRFRKQFSIFGINLGKRFLFGKF

SEQ ID NO: 121047 - protein, 206 aa, Triticum aestivum
  unsure (1)..(206): unsure at all Xaa locations
  Clone ID: PAT_TA_15465.pep
HEGGILLCVTGSEAMYADLGHFSQRSIQIAFISVVYPALVLAYMGQAAYISQHHSFENSYHIGFXRPRTRGLRWPVLVIAILASVVGSQAIITGTFSIIKQCSALSCFPGVKIVHTSSTVHGQIYIPEINWILMILCLAVTIGFNNTKHLANAQGLAVITVMLVTTCLMSLVIVLVWNKSIFIALGFLXXFGSIEVMYFSASLGKH

SEQ ID NO: 121048 - protein, 136 aa, Triticum aestivum
  Clone ID: PAT_TA_15466.pep
NEEQNLEYFAFAKINKLRTKMIVSSDNSPFPFGSMPRKHSLDCDPPIIFSSAPCRHKNFLSIPFRTISQPSFTMHLDNFGPSKVFSRPGPRLRPAAHWEGVKSAAASSHSAYLPSNVDPTHEIVHEQNSSHLEGSW

SEQ ID NO: 121049 - protein, 252 aa, Triticum aestivum
  unsure (1)..(252): unsure at all Xaa locations
  Clone ID: PAT_TA_15467.pep
XFXXIXXLEINPTKGNKSWSSTAVAAALELVDPPGCRNSSIHLSPPLPANSRLLAGLAAMATSHMTTIVFSAIVFMLLSPAIAAQSSGDVGGKKPKPNDFMVEACKNASANSLVYDEGSNNVTQEFCISTLRSDNRSADAKNLRDLALIPVDILKQRVVTAGGNVKEMLHKTKNSTSPMARNLMICELGYGATVGMLNLCGAFLRDYEGDNTSEDYDGPLSFELYDCVDDLNVCDYCGRDTLFRMPGAEPRL

SEQ ID NO: 121050 - protein, 201 aa, Triticum aestivum
  unsure (1)..(201): unsure at all Xaa locations
  Clone ID: PAT_TA_15468.pep
MERIGEAHQVHQLQQVQQQGVAAASFGVVEHSVVAAAAAAKPRAPGLPPTPPASFAGQQRGAGGDVCMDDSSGAPGRKQAQVVPAHRRTRSDVPFAGYFPPPTQQLAAAQGGGXGGLGRRQAAATTLFSSYLNLGGGWDVLKLLGSPRTSKRPKAPTSKPKNRAELPEGKCPPAVGGPLGPPGPSKKEGNRPPGGKPRAEM

SEQ ID NO: 121051 - protein, 180 aa, Triticum aestivum
  Clone ID: PAT_TA_15469.pep
MVGTPTISVAMVLVVLALMSYGLPSAHADVAFISNTCKKTKNPALCEDVLSYHENSTQASTVHELASIALEIATAIAKFNSKNFGVGARYNQGTPVEDALDVCLQAYDDAIDNLKVLAKHSLHVGDYADALRKVLDAKAAGDVCDNALKRIKEDFAVESDRKMTERCGVTAELIGLFIHT

SEQ ID NO: 121052 - protein, 226 aa, Triticum aestivum
  unsure (1)..(226): unsure at all Xaa locations
  Clone ID: PAT_TA_15470.pep
REQKLELHGGTSGSPGLEFRAFEGCDRVHVVDLVIKQGVQWTTLIQALSIRPGGPPSVRITGMSSAPGVDEAGLRLCELGRAMNVPFSFQRFTDDCLDQLKPWMFQVLPGEAVVENSMWQLHRLLVDPDAASTSIPTPMDVMLGWIASRQPMVFTVAEHEADHNMPRLPTRFENAMFYYGSVLDYMEAMYDSRGCVICNRARADAVRAEGDLCHRLAGGSVXTERY

SEQ ID NO: 121053 - protein, 108 aa, Triticum aestivum
  Clone ID: PAT_TA_15471.pep
MAAAAPLRPLRASIALLLLALALSALVPSSDAYDSLDPVGNITIKWDVKKWTHDSCVSYCMTIHLLCALGHSIAWWKQPVCRAVHLRFRAGPPRSRANCPRCSCARLV

SEQ ID NO: 121054 - protein, 185 aa, Triticum aestivum
  unsure (1)..(185): unsure at all Xaa locations
  Clone ID: PAT_TA_15472.pep
MENGEGAYAQDGSVDLRGNPVLRSKRGGWTACAFIVVYELFERMAYYGIASNLVMYMTNRLHQGTVEASNNVTNWSGTVFLTPLIGAVVADAYLGRYWTFVAGSAIYLMGMILLTLSVTVPALKPPACDGASCPRASALQLGVYFGGLXYTIALGHGGTKPNIXTIGADQFDDFDPAEKLHKLSF

SEQ ID NO: 121055 - protein, 184 aa, Triticum aestivum
  Clone ID: PAT_TA_15473.pep
SAKRPTDGDRYQSQRSSIYNPAFSPAGVKRDSAVRPRLREVVSPAFARGTPVICRFVRCLLAGGHGELLREQDRLRQPLQEQRRLRLPLFLLRVGVEEGRGKGARACRAAGCRPRRRRRCPPTPDGARGKIPASRANGQRAFAFQRKPQGPANPRKLYRARTSRRFGRRGRLFRATRLSKGPGG

SEQ ID NO: 121056 - protein, 345 aa, Triticum aestivum
  Clone ID: PAT_TA_15474.pep
PRVREKEKKDDTAGEERGSAGFIFMCNGKTKPECFQNSVFGLPKAKIDVVEKIRPGAKLFLYDFDLKLLYGVYKATARGGMDLVRRAFNGKFPAQVKFRIDKDCLPLPESSFKHAIKENYDSKGKFTQELNSRQVRKLLALYKPINIQQPSSQHVQEVPRTNRVERRMPHYVEERRQPYDYEERRLPRYREEMQHPQFAEERRLAYDYEERRPSLHVEEIRRPQFVEEAQPPTYYVAPAPHGSYHPHQANIIYERAPAEPASRVDPFLPRDYRLPPQEVAAHPSYADEIYRGAAYPAAQDPSYAARPAAYPANLPGPAASKGAGVLPLTRSPAHRRTDDRCSACS

SEQ ID NO: 121057 - protein, 164 aa, Triticum aestivum
  Clone ID: PAT_TA_15475.pep
DCHGGLARARPPAGPPLATHQAGATQQPGAAMRMAAARSVSQVHKTRMNTCSAGAWPWHSVMPRKRKILMNCSSFSTNNWIRLDWHRLQQLRCSPGRYVSYVCKKVRLADTPANELSLSCLCLASAFSPAPGGCALYGSPLFFLKSSAWLMLHGMYSLCPPSTY

SEQ ID NO: 121058 - protein, 299 aa, Triticum aestivum
  Clone ID: PAT_TA_15476.pep
SARPAARKHAFERDDLVKTLRRLIREISQIDSADSFVDTKSKTEAVQACSWLDNRLKEQGSISIYEVPPSLTCKDIQNWIDKLKQVTEPKRPEITETSKVHMAFLTGLIVGKNFLQPMISQSLTKSGLELPIISRRSVQQAHGTGLGQVMSLAHETSSGPVAGSSIEDYVTSIPIPSTPIYTGETLFEIFSIETNLSLISTIVLYDDQGGTLVYQSNEGNKEKFIRRRSKWLSKHTGKIAADFTDSLILIGPNRPMTAGAGCWIFEINVPIESSLGVEDSEFSDAIFETTLCLDDDYFG

SEQ ID NO: 121059 - protein, 205 aa, Triticum aestivum
  Clone ID: PAT_TA_15477.pep
DTPSSKLTLTKGNKSWSSTAVAAALELVDPPGCRNSARAAPFDLEAAVCSHGLFMMAPNRWDPASRALLRPLRLASDRSRSLLARVSRHPARPSRSLLVSLFGADALSPLDQDCILEQVRRMLRLSEEDGRVVAEFQAMHAAAREAGFGRIFRSPTLFEDMVKCILLCNCHRWTRTLAMATALCELQLELRHSSGTEVLELRTPP

SEQ ID NO: 121060 - protein, 229 aa, Triticum aestivum
  Clone ID: PAT_TA_15478.pep
LSIHPHLSLSYKAYNTISAILAAMATARATAAFSSVAIMLLFVCVGAHAGGRGDKVKVVDLVVETCKNASSSCRNKHLNVTQEFCVQTLRSDKRSSKAKDLRDLSLVAVDILKIHVAAAGGKVKEALQKAKKGTDEALGLRYCQVDYDAAIGTLGLCDAMLRDFHVPRGDADGPWSFELPECVEKATDHVSDCWHDLHMDSQTLINENEELIKLGDLNNVLLGPYDFDS

SEQ ID NO: 121061 - protein, 151 aa, Triticum aestivum
  Clone ID: PAT_TA_15479.pep
CYLEINPTKGNKSWSSTAVAAALELVDPPGCRNSAREKNNHRTSQRNPLPPRSSHHPRAPTSSPIQPPTIAGASPSRDNGHRAAPPREPVAASPPATDCVVAAASLPGSRRCPRHPPRIMSPASFPDRAHRPPLATSCLCRPSLVVAADHR

SEQ ID NO: 121062 - protein, 373 aa, Triticum aestivum
  Clone ID: PAT_TA_15480.pep
MASSILSDCSSCATSRLLPPRPPLLPPSPRFRPSPGPAPLPRRPLLAAATPLPLLPRARRMAALAAAASSADPATVLADASAKIIDGKLVAKQIREEVGVEIARMKDAIGVVPGLAVILVGSRKDSQTYVRNKKRACDAVGIKSYEVNLPEDASEYEVIKHIATFNDDPSVHGILVQLPLPHHMNDENILNAVSIEKDVDGFHPVNIGRLAMQGRDPFFVPCTPKGCMELLHRSGVEIKGKRAVVIGRSNIVGTPAALLLQKANATVSIVHSKTKNPEEITRQADIIIAAVGVANLVRGSWIKPGAAIIDVGINPVDDPASPRGYRLVGDVCFEEASKVAGAITPVPGGVGPMTIAMLLSNTLDSAKRIHKFK

SEQ ID NO: 121063 - protein, 229 aa, Triticum aestivum
  Clone ID: PAT_TA_15481.pep
RARGPGSRSRPAHARAASRAIAKQAATRGPDPLAHSFDPERLQLLGRRAPSIPEAPGHRRTGGGGPPRHRQRPRRARAFGEGEGRRRPWCIAYPPCLLAFPSSAAPPRRAAEAVSVAHAPASVVHPPARGTTAGQPPPLPGLAAPSLPHTPPPLPRLAAPSSILPASALRPPARGTAAAIADARRNGRSRRRGGRSSCSPGDPLVLERAATAVELQLLFPLVGSSKGNN

SEQ ID NO: 121064 - protein, 187 aa, Triticum aestivum
  Clone ID: PAT_TA_15482.pep
FSFDSLSSNLTLTKGNKSWSSTAVAAALELVDPPGCRNSARGDHQQGGSDSQQQLQERRKRQRRHTPEQVQKLEESYKKSDHPSEIECAQLGRELGLETKQVRSWFQNHRTQIRIEHERLENRFLRWENMSLRSEIMAVREALKNSATCPNCVGVAKDCIDQQELNRENARLNAGLLHCTTSFQEEP

SEQ ID NO: 121065 - protein, 167 aa, Triticum aestivum
  unsure (1)..(167): unsure at all Xaa locations
  Clone ID: PAT_TA_15483.pep
TRDYFIGMMKSSAHTVDPLVVASYFPLSQCIKGLNVLVESLFASAFHQVPMGDGESWHPNVIKLSLHHPDEGDLGFMYLDLYSRKGKYPGCAHFAIRGGRRLSDMNYQLPIIALVCNFSSSRGLTARLNHCDVETFFHEFGHALHXXLSRTEYQHFSGTRVALDVAE

SEQ ID NO: 121066 - protein, 214 aa, Triticum aestivum
  Clone ID: PAT_TA_15484.pep
REQKLELHRGGGRSRTSGSPGLQEFGTRISRSPTTAATVLRLSPNPSRRRPLPFPSLPRPRSDPRSLLARDLDLAAWHGHGHGSGQIHPLPCSVPSTPGGHSPLCHPPPFFLPRQLTRSLPRGSRVLGAAAPPLPVWLRRLYRLLPDIYCAETAASLTCRFPSGCYWTRSLLVACMLPRLSLLPNKAAVGHLLPRQRRRRSTPPFSSHGCPQHI

SEQ ID NO: 121067 - protein, 82 aa, Triticum aestivum
  unsure (1)..(82): unsure at all Xaa locations
  Clone ID: PAT_TA_15485.pep
XXLLXARNXPSLKGTKAGAPPRWRPALELVDPPGCRNSARVHRQARPTSFLVHVQWEVKSVEQVLMQVQGKLYFSSFIVFIR

SEQ ID NO: 121068 - protein, 214 aa, Triticum aestivum
  Clone ID: PAT_TA_15486.pep
REQKELHRGGRSRTSGSPGLQEFGTRSRLRIAILPKSPLRRNGSSAAAPLNPTSSHPWAFPAGFFPSFSAAAGAFPSSPAPPPPAPSSRAPCRPTPSPRRRRTTPSPSRACASPAGRSTWTCRRPRPVGTPRGASTPMPPLSTFSRLRATPHFPHPNLLTAWGSSGRPPGRREGPGAAAGWTRGLNSGGPDPPKGRNPFFNPFGGRPTPEVAHN

SEQ ID NO: 121069 - protein, 259 aa, Triticum aestivum
  Clone ID: PAT_TA_15487.pep
YVFADLAYIHLCTEKCRIGPEEEQSDWYFFSHKDKKYPTGTRTNRATAAGFWKATGRDKPIYAKHCLVGMRKTLVYYKGRAPNGQKSDWIMHEYRLETNENGPPQASYSYVISLDIHRSLSSTTRRDLDHDAPCWYVDDDGPFMHDLNSPMRGMPPHHSMALQEQHLQMLNNTYKRELKLQYQMPNHHHVLNTIPHELESPSSFHSLLVSPDDHQINVHHAQHHHVQLIDHAVDDQAATDWRVLDKFVAPTRPPTRPRT

SEQ ID NO: 121070 - protein, 218 aa, Triticum aestivum
  unsure (1)..(218): unsure at all Xaa locations
  Clone ID: PAT_TA_15488.pep
GVGWRLGATPVRASRRVCRFVTQEVVAVRSLARLGLCASLALEARLPRAQKQEAAHELQKLHAGGHRRLDGPGSGREGGGRADPVGRRGICPVQVTWRRSNLELRGVGIHDPATDLVEARRYKEITERGDTHKAGKRRRDLGGRRHRRRSPDHARGRQRRRRTGGGAQGRALVVSAYRRRQHSGLDGPDFLVXNXXSPGDXLVLXRPPXRXSSSFCSL

SEQ ID NO: 121071 - protein, 181 aa, Triticum aestivum
  Clone ID: PAT_TA_15489.pep
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIANKS

SEQ ID NO: 121072 - protein, 224 aa, Triticum aestivum
  unsure (1)..(224): unsure at all Xaa locations
  Clone ID: PAT_TA_15490.pep
FGTRGMLADPKEARAGIREVHFLPFNPTDKRNALTYIDAEGNWHRASKGAPEQIITLXCNCKEDVKRKVHSVIEKYAERGLRSLAVARQEVPEKSXKDSPGGPWQFIGLLPLFDPPRHDSAETIRKALVLGVNVKMITGDQLAIGKETGRRLGMGTNMYPSSALLGQSKDGSLESLPVDELIEKADGFAGVFPEHKYEIVKRLQEKKHIVGMTXGDGVNDAPAL

SEQ ID NO: 121073 - protein, 135 aa, Triticum aestivum
  Clone ID: PAT_TA_15491.pep
SSQGKTGWRDALVVDRRGAYVEAVAETTLDGPRSGQGASTSPSSSTYSLIERQQQRWEEPGHRGEKWKRGCKARRWGRRMSTAAQGLIPPLPEQSGGPHGARWGGRERAAPGSQEGNAAVLASPLPAPLSCVVTT

SEQ ID NO: 121074 - protein, 100 aa, Triticum aestivum
  Clone ID: PAT_TA_15492.pep
SEVFTFIGALEFFYDQSPDAMRSLCSALQLITTALGNYLSAFILTMVAYFTTRGGRPGWIPDNLNEGRLDNFFWLLAGLSFLNFLVYVLCANRFKSKKAA

SEQ ID NO: 121075 - protein, 77 aa, Triticum aestivum
  Clone ID: PAT_TA_15493.pep
ERPPGQVLGRSVNGTTYAGIRARTTGAPQNHWFGPAGDPRGAGIGTPEAIKLVWSCHREIIYDIGPLPKKWALPAAT

SEQ ID NO: 121076 - protein, 105 aa, Triticum aestivum
  Clone ID: PAT_TA_15494.pep
MADVEYRCFVGGLAWATDDQSLQNAFSKYGDVIDSKIITDRETGRSRGFGFVTFASDEAMRQAIEAMNGQDLDGRNITVNEAQSRRSGGGGGGFGGGSCGGYWRE

SEQ ID NO: 121077 - protein, 98 aa, Triticum aestivum
  unsure (1)..(98): unsure at all Xaa locations
  Clone ID: PAT_TA_15495.pep
PPIXXXFCAAXYXXTLXXYIXXAXRXIPTAXVXTXPRXXRXXXXSVXIXESMXXPSWRXRSGGLXAVPSEXXTKXPFPLPPLLLNXNERNGTGPGTED

SEQ ID NO: 121078 - protein, 151 aa, Triticum aestivum
  Clone ID: PAT_TA_15496.pep
EFGTSRVGVGVVLIRTGKLDWEVCCFRSADDGYDAMPSTSANAITAGTTGTTAVRCALRDAAVEGSSRSYGCQQTSLCRRQCINQIGWRTSHNSLSPGHKENGGTLGFEDAASRRTTNMGRSVEFFLTRQDSHAANLVTGKIFGCPDVYAD

SEQ ID NO: 121079 - protein, 91 aa, Triticum aestivum
  Clone ID: PAT_TA_15497.pep
MADVEYRCFVGGLAWATDDQSLQNAFSKYGDVIDSKIITDRETGRSRGFGFVTFASDEAMRQAIDAMNGQDLDGLHITVNEAQSRRSGGCG

SEQ ID NO: 121080 - protein, 67 aa, Triticum aestivum
  Clone ID: PAT_TA_15498.pep
MLDAMFCKRPRLMCDYHVPHQVKCAISPQTLTKLSSVNGEKFIKVAEVQGSEIKPFVDSLSKCPKPT

SEQ ID NO: 121081 - protein, 68 aa, Triticum aestivum
  Clone ID: PAT_TA_15499.pep
MIYQAKTTSEMEEVMLKSLNRIPWERVDVSFKRSRQRIFAHSTIQVKTYFFNSDGADVIFHMIDHFLY

SEQ ID NO: 121082 - protein, 176 aa, Triticum aestivum
  Clone ID: PAT_TA_15500.pep
EEEEEEEDDEEEEEEELMEDEDMEAGMQSVDTMSSTPTGVETPDVIDLRKQQRKESERPTDKQLYQVLEQKEEKIAPGTLYGSSHTYVVGAQDKAGVKRVDLLKNQKSDKVDVTIHPEELEVMDDVLAAKYEEAREEEKLRNQKEDFSDMVAENASKRKRKHEKDGKSSKKKDFKF

SEQ ID NO: 121083 - protein, 65 aa, Triticum aestivum
  Clone ID: PAT_TA_15501.pep
AVMLVFANKQDLPNAMNAAEITDKLGLHSLRQRHWYIQSACATSGEGLYEGLDWLSNNIASKVSI

SEQ ID NO: 121084 - protein, 162 aa, Triticum aestivum
  unsure (1)..(162): unsure at all Xaa locations
  Clone ID: PAT_TA_15502.pep
MADVEYRCFVGGLAWATDDQSLQNAFSKYGDVIDSKIITDRETGRSRGFGFVTFASDEAMRQAIEAMNGQDLDGRNITVNEAQSRXSGEGGGGFNGGGGGGYGGQRREGGGGGYGGGGGGYRGGRSGGGGGYGSRDGGGGYCCGGVGYRGSRGGSGGCNWKE

SEQ ID NO: 121085 - protein, 172 aa, Triticum aestivum
  unsure (1)..(172): unsure at all Xaa locations
  Clone ID: PAT_TA_15503.pep
GASPSRSPPPVAFVPSISGCVAGEPDTANRIRRQGEREEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDNNDRDRVVEARDELHRMXNEDELRDAVLLXFANKQDXQML

SEQ ID NO: 121086 - protein, 63 aa, Triticum aestivum
  Clone ID: PAT_TA_15504.pep
IVAFLDMEMWISFSSEESAYFWSYVIPIYLDKHAKSVETQVRVQIRGVVLAAKLILDFLLAIL

SEQ ID NO: 121087 - protein, 91 aa, Triticum aestivum
  Clone ID: PAT_TA_15505.pep
LAVKLRSRREQAVAEERGYEGGRRSGIANRFAAEPHHRLLFGGGKEKGAEDVLLYAWLLKYIIVMMCMVSLFSALLLQIPNPMTMPPPLLR

SEQ ID NO: 121088 - protein, 111 aa, Triticum aestivum
  Clone ID: PAT_TA_15506.pep
DFFLHIAPVHFQLDSWLGPRQPATPFVKRRIHQSLQLYTFLLRRNIMSSVATGFPSRLQTCAHCESVSRQSKHSMISFQIHNFNRKNWEQKATKFIHLYLSLGAGIYRLMQ

SEQ ID NO: 121089 - protein, 49 aa, Triticum aestivum
  unsure (1)..(49): unsure at all Xaa locations
  Clone ID: PAT_TA_15507.pep
SSQDLIMSCLGLHWTNDLPXAMIQCRLALKPDGVFLAANLGGKTLNSGG

SEQ ID NO: 121090 - protein, 174 aa, Triticum aestivum
  Clone ID: PAT_TA_15508.pep
SFHCACFPRSSPPICSQPSSSSAMGNCLVIQDRKEIKVMSVGDGEILKALPPPLSKGAVARVSGSDTDDALRAQKQHLDGRVGDLGQLHRLFPSDVKAPSAVADPGAVMRVKLVISKQELRRMLGKDDQAVSLDDMVALMRRGSEDQHQEEIGCCRGWRPALHSIPEGSGDLFY

SEQ ID NO: 121091 - protein, 98 aa, Triticum aestivum
  Clone ID: PAT_TA_15509.pep
IKFSNLKIFKYQSLNSIVLPNNLNLYSEVIYKWRGYCLINSNYYTNSAYVLRFFSAHRSRSLSVRLMVRPPSTGNTLFHRHQHVLVLALVLLAWHHGR

SEQ ID NO: 121092 - protein, 199 aa, Triticum aestivum
  Clone ID: PAT_TA_15510.pep
SAQQTQTRAQRALANCNLSIARASLDRSSSPICPQLSSSPAMGNCLVIQDRREIKVMSVVDGEVLKPLPVPSPSKGALAPVSDSSDAEDALRPQKQGLDGRAGGMGQLHLLFPSDANAPSAAAADPEGAVVRVKLVISKQELRRMLGKDDEAVSLDDMVALLRGGPEHQKQEDVGCYRGWRPALHSIPEGSGDLYSMLA

SEQ ID NO: 121093 - protein, 171 aa, Triticum aestivum
  Clone ID: PAT_TA_15511.pep
MADVEYRCFVGGLAWATDDQSLQNAFSKYGDVIDSKIITDRETGRSRGFGFVTFASDEAMRQAIEAMNGQDLDGRNITVNEAQSRRSGGGGGGFSGGGGGGYGGQRREGGGGGGGYGGGRSGGGGGYGSREGGGGYGGGGGGYGGSRGGSGGGGGGYGGSRGGSGGGNWRE

SEQ ID NO: 121094 - protein, 226 aa, Triticum aestivum
  Clone ID: PAT_TA_15512.pep
AQPFLLDLSPSAATNPSPLSYHPAVAVAAPSDLPRQPPPLRLLGPPTLSVQAASFLPPRPSPLSPSSSSVPCCSRCSSAQAARRKHEEERPRLEKPREEGLKQRRAVASQVFGLARRCPSCPGRGRPLRHHSGVFAAAGVYVLSFRLMYWLRSRREQAIAEERGYEGGRRPGIANRFAAEREAGASPLAPVWRWQRESCRGCVALCTAVEVHSCYDVFDLSTAKAG

SEQ ID NO: 121095 - protein, 176 aa, Triticum aestivum
  unsure (1)..(176): unsure at all Xaa locations
  Clone ID: PAT_TA_15513.pep
RPYPSSSSDKPSPSPPPPPPPPRRSPAPLRAVPMAEEAAANGKEKGRKEEFSTGPLSLLLMSVKNNTQVLINCRNNKKLLGRVRAFDRHCNMVLENVREMWTEVPKTGQRQEEGLPVNKDRFIXSKMFLRGDSXVIIVLKEPRNEFRRRRRHIVRPEESLCYVVAVKFVILNTLKQ

SEQ ID NO: 121096 - protein, 168 aa, Triticum aestivum
  Clone ID: PAT_TA_15514.pep
SFHCACFPRSSPPICSQLSSSSAMGNCLVIQDRKEIKVMSVVDGEILKALPPPLSKGAPARVSGSDPDDELRAQKQHLNHVRVGDLGQLHRLFPSDVKAPSAAADPGAVMRVKLVISKQELRRMLGKDDMVALMRRGSEDQQQEEIGCCRGWRPALHSIPEGSGDLFY

SEQ ID NO: 121097 - protein, 140 aa, Triticum aestivum
  Clone ID: PAT_TA_15515.pep
FKPTAVFVPLVEILKNGNFELVTKEIFGPFQVVTEYSEEQLDLVLEACERMNAHLTAAVVSNDKLFLQEVLGRSVNGTTYAGIRARTTGAPQNHWFGPAGDPRGAGIGTPEAIKLVWSCHREIIYDIGPLPKKWALPAAT

SEQ ID NO: 121098 - protein, 108 aa, Triticum aestivum
  unsure (1)..(108): unsure at all Xaa locations
  Clone ID: PAT_TA_15516.pep
WIYVFLRLKGKTEEFRARLGRGETLAGVQAEAFSVVREVAKRTLGMRHFDVQXVTVNDYLAQRDAEWMGRVHRFLGLTVGLIEYSECEACYYESLGFADHQQDFSDDE

SEQ ID NO: 121099 - protein, 312 aa, Triticum aestivum
  unsure (1)..(312): unsure at all Xaa locations
  Clone ID: PAT_TA_15517.pep
MATHFVLNTGAKIPSVGLGTWQSDPGVVGEAVYAAVKXAGYRHIDCARAYNNEKEVGLALKKLFEEGVVKREDLFITSKLWCGHHAPEDVPEALGDSLNDLQLDYLDLYLIHWPFRVKKGTSIGNPENFLPPDIPATWGAMEKLHDAGKARAIGVSNFASKKLGDLLAVARIPPAVDQVECHPGWQQSKLHSFCQSAGVHLSAYSPLGSPGSTWMNGNVLKEPVVLSIAEKLGKTPAQVALRWNIQMGHSVLPKSVSEERIKQNLAVYDWSIPEDLLAKFSEIKQARLLMGNFIVNKDSVYKTHDELWDGEI

SEQ ID NO: 121100 - protein, 147 aa, Triticum aestivum
  Clone ID: PAT_TA_15518.pep
VDTMSSTPTGVETPDVIDLRKQQRKESERPTDKQLYQVLEQKEEKIAPGTLYGSSHTYVVGAQDKAGVKRVDLLKNQKSDKVDVTIHPEELEVMDDVLAAKYEEAREEEKLRNQKEDFSDMVAENASKRKRKHEKDGKSSKKKDFKF

SEQ ID NO: 121101 - protein, 100 aa, Triticum aestivum
  unsure (1)..(100): unsure at all Xaa locations
  Clone ID: PAT_TA_15519.pep
MLRKEEEEFSTGPLSLLLMSVKNNTQVLINCRNNKKLLGRVRAFDRHCNMVLENVREMWTEVPKTGXKGKKKALPVNKDRFISKMFLRGDSVIIVLRNPK

SEQ ID NO: 121102 - protein, 95 aa, Triticum aestivum
  Clone ID: PAT_TA_15520.pep
LLFLRYVVGAQDKAGVKRVDLLKNQKSDKVDVTIHPEELEVMDDVLAAKYEEAREEEKLRNQKEDFSDMVAENASKRKRKHEKDGKSSKKKDFKF

SEQ ID NO: 121103 - protein, 102 aa, Triticum aestivum
  Clone ID: PAT_TA_15521.pep
MADVEYRCFVGGLAWATDDQSLQNAFSKYGDVIDSKIITDRETGRSRGFGFVTFASDEAMRQAIEAMNGQDLDGRNITVNEAQSRRSGGGGGGGSGGGNWRE

SEQ ID NO: 121104 - protein, 311 aa, Triticum aestivum
  Clone ID: PAT_TA_15522.pep
MATHFVLNTGAKIPSVGLGTWQSDPGVVGEAVYAAVKAGYRHIDCARAYNNEKEGGLALKKLFEEGVVKREDLFITSKLWCGHHAPEDVPEALGDSLNDLQLDYLDLYLIHWPFKIKKGTSIGNPENFLPPDIPATWGAMEKLHDAGKARAIGVSNFSSKKLGDLLAVARVPPAVDQVECHPTWQQSKLHSFCQSTGVHLSAYSPLGSPGSTWMNGNVLKEPVVVSIAEKLGKTPAQVALRWNIQMGHSVLPKSVSEERIKQNLAVYDWSIPEDLLAKFSEIKQARLLMGNFIVNKDSVYKTHDELWDGEI

SEQ ID NO: 121105 - protein, 156 aa, Triticum aestivum
  Clone ID: PAT_TA_15523.pep
MLHLRLADYNSTYVKGNHRKKHRSALHSFKRYVAYSNVCGDFVVGWKTSSIRRQHELPKKEDFVDDVRYPHVVYVEKPKARDVDFSDEMIYQAKTTSEMEEVMLKSLNRIPWERVDVSFKRSRQRIFAHSTIQVKTYFFNSDGADVVFHMIDHFLY

SEQ ID NO: 121106 - protein, 106 aa, Triticum aestivum
  Clone ID: PAT_TA_15524.pep
MAEEAAANAKKEEEEFSTGPLSLLLMSVKNNTQVLINCRNNKKLLGRVRAFDRHCNMVLENVREMWTEVPKTGKGKKKALPVNKDRFISKMFLRGDSVIIVLRNPK

SEQ ID NO: 121107 - protein, 177 aa, Triticum aestivum
  Clone ID: PAT_TA_15525.pep
SSSHVFNGPVLTQEVNNPNYTYSPTQKVVEPNFVVGAPSSTRLSEAGGQLNCVVLPDSQAKNGRFVKMLDSISAPPAFAAEFPGKSLSGVHPNTISVSTEVISIGSLTVASRQGKWSFQKDEDMELLFSTGFQPDNRIHCGGCNTVTAVLRGGFCLFFLSAIMLLVSYEVGLCIYGK

SEQ ID NO: 121108 - protein, 497 aa, Triticum aestivum
  Clone ID: PAT_TA_15526.pep
NGAPAPAPFADKKKSRESERRRRRRKQKKSKAPASDAAASDADADAGEEDISDSKPPVEIEVEYVPEEPDLADGLLADFKSIFDKFTFKEPVAAEDEEKKDEAADAAKKGSGSDSDDDEQETQQKKKEGGISNKKKKLEQRMKIAELKQICNRPDVVEVWDATASDPKLLVYLKSYRNTVPVPRHWSQKRKFLQGKRGIEKQPFQLPDFIAATGIEKIRQAYIEKEDSKKLKQKQRERMQPKMGKMDIDYQVLHDAFFKYQTKPKLTSHGDLYYEGKEFEVKLREMKPGMLSRELKEALGMPEGAPPPWLINMQRYGPPPSYPSLKIPGLNAPIPPGATFGYRPGEWGKPPVDEHGRPLYGDVFGILQLDEPNYDEEPVDRSKHWGDLEEEEEEEEDDQGKKEEEEFSTGPLSILMLSVKNNTQVLINCRNNKKLLGRVRAFDRHCNMVLENVREMWTEVPKTGKGKKKALPVNKDRFISKMFLRGDSVIIVLRNPK

SEQ ID NO: 121109 - protein, 135 aa, Triticum aestivum
  Clone ID: PAT_TA_15527.pep
MADVEYRCFVGGLAWATDDQSLQNAFSKYGDVIDSKIITDRETGRSRGFGFVTFASDEAMRQAIEAMNGQDLDGRNITVNEAQSRRYGGGGGGYGGGRSGGGGGYGSRDGGGYGGGGGGGYGGSRGGSGGGNWRE

SEQ ID NO: 121110 - protein, 96 aa, Triticum aestivum
  Clone ID: PAT_TA_15528.pep
MPSFRTSCGQVAPFTFEVSKNCLGDAGASMLDAMFCKRPRLMCDYHVPHQVKCAISPQTLTKLSSVNGEKFIKVAEVQGSEIKPFVDSLSKCPKPT

SEQ ID NO: 121111 - protein, 141 aa, Triticum aestivum
  Clone ID: PAT_TA_15529.pep
MERTGGKGDDDSRLMRDLCTLLVTIIAPVAAASSTNSPRRPVARRPRGGMSPAGAASMLLGASMALMLCGSVTFAIGFLLMPWVAGVALLFGFAGVISTLSSGLLPSSSSKEQRLRTPTQGRVRVSAPPMSSVPDKLVAWR

SEQ ID NO: 121112 - protein, 145 aa, Triticum aestivum
  Clone ID: PAT_TA_15530.pep
MEQTGGKGDHDSRLMRDLCTLLVTIIAPVAAASSVDSPRRPVARRPRGGMSPASAASMLLGASMALMLCGSVTFAIGFLLMPWVAGVALLFGFAGVISTLSSGLLPSSSPSSSKDKERRLLMPTQGRVRASAPMSSVPDKLVAWR

SEQ ID NO: 121113 - protein, 350 aa, Triticum aestivum
  Clone ID: PAT_TA_15531.pep
RGFYIGLRQKRARGEEYDELMEEFMAAVKTFYGEKVLIQFEDFANHNAFDLLEKYSKTHLVFNDDIQGTASVVLAGLLSSLKVVGGTLAEHTYLFLGAGEAGTGIAELIALEISKQTNAPIEECRKKVFLVDSKGLIVSSRKNSLQPFKTSWAHEREPVTTLLDAIKSIRPTVLIGTSGVGRAFTKEVIEAMASFNERPVIFSLSNPTSHSECTAEEAYKWTQGRAVFASGSPFDPVEYDGKIRVPGQANNAYIFPGFGLGVVISGAIRVHEDMLLAASETLAAQATQENFDKGSIFPPFTNIRKISALIAASVAAKAYELGLATRLPRPRDLEKYAESCMYTPVYRSYR

SEQ ID NO: 121114 - protein, 107 aa, Triticum aestivum
  Clone ID: PAT_TA_15532.pep
MAEVAPVDQGKKEEEEFSTGPLSILMLSVKNNTQVLINCRNNKKLLGRVRAFDRHCNMVLENVREMWTEVPKTGKGKKKALPVNKDRFISKMFLRGDSVIIVLRNPK

SEQ ID NO: 121115 - protein, 417 aa, Triticum aestivum
  unsure (1)..(417): unsure at all Xaa locations
  Clone ID: PAT_TA_15533.pep
QICNRPDVVEVWDATASXPKLLVYLKSYRNTVPVPRHWSQKRKFLQGKRGIEKQPFQLPDFIAATGIEKIRQAYIEKEDSKKLKQKQRERMQPKMGKMDIDYQVLHDAFFKYQTKPKLTSHGDLYYEGKEFEVKLREMKPGMLSRELKEALGMPEGAPPPWLINMQRYGPPPSYPSLKIPGLNAPIPPGATFGYRPGEWGKPPVDEHGRPLYGDVFGILQLDEPNYDEEPVDRSKHWGDLEEEEEEEEEDEEEEEEELMEDEDMEAGMQSVDTMSSTPTGVETPDVIDLRKQQRKESERPTDKQLYQVLEQKEEKIAPGTLYGSSHTYVVGAQDKAGVKRVDLLKNQKSDKVDVTIHPEELEVMDDVLAAKYEEAREEEKLRNQKEDFSDMVAENASKRKRKHEKDGKSSKKKDFKF

SEQ ID NO: 121116 - protein, 187 aa, Triticum aestivum
  unsure (1)..(187): unsure at all Xaa locations
  Clone ID: PAT_TA_15534.pep
HIHASQLFNGSHPLGDSTLLGQLVGTSCRIGTSISTTTSYSRFPDRQGQINQTMMQAAVASSAVLPVAVRGRPAARRRSATVAGGRRIVGAGVRASAXAAPEADYSSNVSVFPMEACDLVGGEACDAQMYPETKLGAGTGGPAAAVARAPEVEREYLAYDEPKTVFPDEACDDLGGEFCEAPYQTSK

SEQ ID NO: 121117 - protein, 122 aa, Triticum aestivum
  Clone ID: PAT_TA_15535.pep
KFSHCWLEDILQYAVNTSLPRKEILWDDVRYPHVVYVGKTKGSGMLIFPDEMIYQAKTTSEMAEVTLKSLNRIPWQRVDVSFKRSRQWIFAHSTIQVQLSLPSLALSFTHLSARRSPDLLSS

SEQ ID NO: 121118 - protein, 312 aa, Triticum aestivum
  unsure (1)..(312): unsure at all Xaa locations
  Clone ID: PAT_TA_15536.pep
MATHFVLNTGAKIPSVGLGTWQSDPGIVGEAVYAAVKAGYRHIDCARAYNNEKEVGLALKKLFEESVVKREDLFITSKLWCGHHAPEDVPEXALGDSLDDLQLDYLDLYLIHWPFRVRKGTSIGNPENFLPPDIPATWGAMEKLHDAGKARAIGVSNFASKKLGDLLAVARIPPAVDQVECHPGWQQSKLHTFCQSAGVHLSAYSPLGSPGSTWMNGNVLKEPVVLSIAEKLGKTPAQVALRWNIQMGHSVLPKSVSEERIKQNLAVYDWSIPEDLLAKFSEIKQARLLMGNFIVNKDSVYKTHDELWDGEI

SEQ ID NO: 121119 - protein, 107 aa, Triticum aestivum; identical to SEQ ID NO: 121114
  Clone ID: PAT_TA_15537.pep

SEQ ID NO: 121120 - protein, 205 aa, Triticum aestivum
  Clone ID: PAT_TA_15538.pep
MDHKDEHSAHPDQEVEEEEDEEAKRAVVLGPQVPLKDQLELDKDDESLRRWKEQLLGQVDTEQLGETAEPEVKVLNLTILSPDRPDLVLPIPFVPDEKGYAFALKDGSAYSFRFSFIVSNNIVSGLKYTNTVWKTGVRVENQKMMLGTFSPQAEPYTYEGEEETTPAGMFARGSYSAKLKFIDDDGKNYLEMSYYFEIRKDWPAV

SEQ ID NO: 121121 - protein, 588 aa, Triticum aestivum
  unsure (1)..(588): unsure at all Xaa locations
  Clone ID: PAT_TA_15539.pep
MAEAGDPTLEQGLLANPEESNQLTYTGDGSVDFSGNPVVKEKTGRWKACPFILGNECCERLAYYGISTNLVTYLTKKLHDGNSSAARNVTTWQGTCYLTPLIGAILADAYWGRYWTIATFSTIYFIGMSVLTLSASVPMLMPPSCEGAICPEASPLQYTVFFLGLYLIALGTGGIKPCVSSFGADQFDDTDPAERIQKGSFFNWFYFSINIGALISSSFLVWVQDNLGWGLGFGIPTVFMGLAIISFFAGTSLYRFQKPGGSPITRVCQVVAATLRKWNAPVPEDSSLLYELADGVSAIEGSRQLEHTDELRCLDKAATITDLDVKEDSFNNPWRVCTVTQVXEELKIWVRMFPVRGNDNCVFQCPMLKMSTMFVEQGMVLDPTIGSFKXIPPASLSTFDVVSVIIWVPIYDSILVPIARRFTGKERGFSELQRMGIGLVISILAMSAAAVLEIKRLAIAREAHLVDQNVPVPLSILWQIPQYFLVGASEVFTFIGALEFFYDQSPDAMRSLCSALQLITTALGNYLSAFILTMVAYFTTRGGRPGWIPDNLNEGRLDYFFWLLAGLSFFNFLVYVLCANRFKSKKAA

SEQ ID NO: 121122 - protein, 107 aa, Triticum aestivum; identical to SEQ ID NO: 121114
  Clone ID: PAT_TA_15540.pep

SEQ ID NO: 121123 - protein, 181 aa, Triticum aestivum
  Clone ID: PAT_TA_15541.pep
MGLSFGTLFGALFAKKEMRILMVGLDAAGKTTILYKLKLGEIVTTIPTIGFNVETVEYKNISFTVWDVGGQDKIRPLWRHYFQNTQGLIFVVDSNDRDRIAEARDELHRMLNEDELRNAVLLVFANKQDLPNAMNAAEITDKLGLHSLRQRHWYIQSACATSGEGLYEGLDWLSNNIASKS

SEQ ID NO: 121124 - protein, 389 aa, Triticum aestivum
  unsure (1)..(389): unsure at all Xaa locations
  Clone ID: PAT_TA_15542.pep
PRDLLIPVLXAVLDKTGINPAEIGDVVVGTVLGPGSQRAIECRTSSLLAGIPETVPVRTVNRQCSSGLQAVADVAAAIKAGFYDIGIGAGLESMSVNSVGWEGQVNPRVIELQKAQDCLLPMGITSENVAQRYGVTREEQDKAAAESHARAAAATASGKFKDEIIPVHTKLIDPKTGEEKKVVISVDDGIRPGTTLSGLAKLKTVFKKDGTTTAGNSSQVSDGAGAVLLMKRSVAVSKGLPILGVFRSFVAVGVDPAVMGVGPAVAIPAAVKSAGLEIDDIDLFELNEAFASQFVYCCNKLGLDRSKVNVNGGAIAMGHPLGATGARCISTLLNEMKRRGRDCRFGVVTMCIGSGMGAAAVFERGDSVDELSNGRHTQSHNFLSKDAAK

SEQ ID NO: 121125 - protein, 181 aa, Triticum aestivum; identical to SEQ ID NO: 121123
  Clone ID: PAT_TA_15543.pep

SEQ ID NO: 121126 - protein, 143 aa, Triticum aestivum
  Clone ID: PAT_TA_15544.pep
MSSTNSVQCFGKKKTATAVAHCKAGKGLIKVNGRPLQLVQPEILRFKVYEPLLVVGLDKFANVDVRVRVSGGGQVSQVYAIRQAIAKSLIAYYQKFVDEHSKNLLKQALVQFDRTLLVADNRRCEPKKFGGPGARARFQKSYR

SEQ ID NO: 121127 - protein, 164 aa, Triticum aestivum
  unsure (1)..(164): unsure at all Xaa locations
  Clone ID: PAT_TA_15545.pep
HYRANWVPGPPLVFRFLDRQDQINQEMMQATVALSAVLPVAVRGRPAARRRSATVAGGGRRTVGAGVRASAAAAPEADYSSSVSVFPMEACDLVGGEACEAQMYPETKLGAGAGAPAAXARAPEVEREYLAYDGPKTVFPXEACDDLGGEFCEGALPNHQVATH

SEQ ID NO: 121128 - protein, 409 aa, Triticum aestivum
  Clone ID: PAT_TA_15546.pep
MTHPSSSSSSAPAAAPDDPTSLAPGFRFHPTDEELVSYYLKRKVLGRPLKVDAIAEVDLYKVEPWDLPARSRLRSRDSQWYFFSRLDRKHANRARTNRATAGGYWKTTGKDREVRHGARVVGMKKTLVFHAGRAPKGERTNWVMHEYRLEGDGAAGIPQDSFVVCRIFQKAGPGPQNGAQYGAPFVEEEWEADEDDDFGPMPVQRDVFGEHEAPGAMEKGYLQMNDLIQDLAGQNENGSVVLPVSDTSNTSSHSEDVEGNSGDILNDPSLCSNFLQYIHPGEQNSPMLVENMLSNANVGDFLNSSSPNDKFLELKDLELPLGNDSTIWPSDGWAWKTAFPLDAVNRSNNEVPLITGDQPFQPDELAQLLQTLQDDSSQLGSTMTDLPHPSITNSVKPEDDSLMYFDAPL

SEQ ID NO: 121129 - protein, 463 aa, Triticum aestivum
  unsure (1)..(463): unsure at all Xaa locations
  Clone ID: PAT_TA_15547.pep
MEKAIDRQRVLLAHLLPSASSQAQLSASACAAGDSAAYQRSSCFGERRPSSSLPTRTPICKXAKRGGFKDTYPEXDFLTQFLKAVLDKTGINPAQIGDVVVGTVLGPGSQRAIECRTASLLAGIPETVPVRTVNRQCSSGLQAVADVAAAIKAGFYDIGIGAGLESMSVNSVGWEGQVNPRVIELQKAQDCLLPMGITSENVAQRYGVTREEQDKAAVESHARAAAATASGKFKDEIISVHTKLIDPKTGEEKKVVISVDDGIRPGTTLSGLAKLKTVFKKDGTTTAGNSSQVSDGAGAVLLMKRSVAVSKGLPILGVFRSFAAVGVDPAVMGVGPAVAIPAAVKSAGLDIDDIDLFELNEAFASQFVYCCNKLGLDRSKVNVNGGAIAMGHPLGATGAXRCISTLLNEMKRRGRDCRFGVVTMCIGSGMGAAAVFERGDSVDELSNVRHIQSHNFLSKDAAK

SEQ ID NO: 121130 - protein, 128 aa, Triticum aestivum
  Clone ID: PAT_TA_15548.pep
MSQETVNPKAYPLADSQLTITILDLVQQAANYKQLKKGANEATKTLNRGISEFVVMAADTEPLEILLHLPLLAEDKNVPYVFVPSKQALGRACGVTRPVIACSVTSNEGSQLKQPIQSLKDAIEKLLI

SEQ ID NO: 121131 - protein, 680 aa, Triticum aestivum
  unsure (1)..(680): unsure at all Xaa locations
  Clone ID: PAT_TA_15549.pep
MGGLEEIRNEAVDLENIPIEEVFEQLKCTRQGLTSDEGAQRVEIFGLNKLEEKKESKVLKFLGFMWNPLSWVMEMAAIMAIALANGGGKPPDWQDFVGIIVLLVINSTISFIEENNAGNAAAALMANLAPKTKVLRDGRWGEQEASILVPGDIVSIKLGDIVPADARLLEGDPLKIDQSGLTGESLPVTKNPGDEVFSGSTCKQGEIEAVVIATGVHTFFGKAAHLVDSTNQVGHFQQVLTAIGNFCIVSIAVGIVIEIIVMFPIQRRKYRAGIENLLVLLIGGIPIAMPTVLSVTMAIGSHKLSQQGAITKRMTAIEELAGMDVLCSDKTGTLTLNKLSVDKNLVEVFAKGVDKEHVLLLAARASRVENQDAIDACMVGMLADPKEARAGIREVHFLPFNPTDKRTALTYIDAEGNWHRASKGAPEQIITLCNCKEDVKRKVHSVIEKYAERGLRSLAVARQEVPEKSKDSPGGPWQFIGLLPLFDPPRHDSAETIRKALVLGVNVKMITGDQLAIGKETGRRLGMGTNMYPSSALLGQSKDGSLESLPVDELIEKADGFAXGVFPEHKYEIVKRLQEKKHIVGMTXGDGVNDAPALKKADIGYXLSDDATDAAPNASDIVLTEPSPKCHYHAVLTSKCIFXQRMKNYTILSVSINTRIVLGFKLXALIREFDSLPSRP

SEQ ID NO: 121132 - protein, 772 aa, Triticum aestivum
  unsure (1)..(772): unsure at all Xaa locations
  Clone ID: PAT_TA_15550.pep
MGGLEEIRNEAVDLENIPIEEVFEQLKCTRQGXTSDEGAQRVEIFGLNKLEEKKESKVLKFLGFMWNPLSWVMEMAAIMAIALANGGGKPPDWQDFVGIIVLLVINSTISFIEENNAGNAAAALMANLAPKTKVLRDGRWGEQEASILVPGDIVSIKLGDIVPADARLLEGDPLKIDQSGLTGESLPVTKNPGDEVFSGSTCKQGEIEAVVIATGVHTFFGKAAHLVDSTNQVGHFQQVLTAIGNFCIVSIAVGIVIEIIVMFPIQRRKYRAGIENLLVLLIGGIPIAMPTVLSVTMAIGSHKLSQQGAITKRMTAIEELAGMDVLCSDKTGTLTLNKLSVDKNLVEVFAKGVDKEHVLLLAARASRVENQDAIDACMVGMLADPKEARAGXREVHFLPFNPTDKRTALTYIDAEGNWHRASKGAPEQIITLCNCKEDVKRKVHSVIEKYAERGLRSLAVARQEVPEKSKDSPGGPWQFIGLLPLFDPPRHDSAETIRKALVLGVNVKMITGDQLAIGKETGRRLGMGTNMYPSSALLGQSKDGSLESLPVDELIEKADGFAGVFPEHKYEIVKRLQEKKHIVGMTGDGVNDAPALKKADIGIAVDDATDAARSASDIVLTEPGLSVIISAVLTSRCIFQRMKNYTIYAVSITIRIVLGFMLIALIWKFDFAPFMVLIIAILNDGTIMTISKDRVKPSPLPDSWKLNEIFATGVVLGTYLALVTVVFFWLIHKTDFFTNKFGVESIRNTEFKEMYALYLQVSIVSQALIFET

SEQ ID NO: 121133 - protein, 551 aa, Triticum aestivum
  Clone ID: PAT_TA_15551.pep
MSRLVSRRHLAAAAALRRSPAAFASRWLHTPAFATVSPEEISGSSPAEVQNFVQGKWIKSANWNWIVDPLNGEKFIKVAEVQGSEIKPFVESLSKCPKHGLHNPLRAPERYLMYGDISTKAAHMLGQPEVLDFFAKLVQRVSPKSYQQALLEVQVSQKFLENFCGDQVRFLARSFAVPGNHVGQMSNGYRWPFGPVAIITPFNFPLEIPLLQLMGALYMGNKPVLKVDSKVSIVMEQMIRLLHECGLPAEDVDFINSDGITMNKLLLEANPKMTLFTGSSRVAEKLAADLQGRIKLEDAGFDWKILGPDVQEVDYISWVCDQDAYACSGQKCSAQSMLFMHKNWSSSGLLEKMKKLSERRKLEDLTIGPVLTVTTATMIEHMNNLLKIPGSKVLFGGEPLGNHSIPEIYGAIKPTAVFVPLVEILKSDNFELVTKEIFGPFQVVTEYSEDQLELVLEACERMNAHLTAAVVSNDKLFLQEVLGRSVNGTTYAGIRARTTGAPQNHWFGPAGDPRGAGIGTPEAIKLVWSCHREIIYDIGPLPKKWALPAAT

SEQ ID NO: 121134 - protein, 162 aa, Triticum aestivum
  Clone ID: PAT_TA_15552.pep
MADVEYRCFVGGLAWATDDQSLQNAFSKYGDVIDSKIITDRETGRSRGFGFVTFASDEAMRQAIEAMNGQDLDGRNITVNEAQSRRSGGGGGGFSGGGGGGYGGQRREGGGGGYGGGGGGYGGGRSGGGGGYGSREGGGGYGGGGGGYGGSRGGSGGGNWRE

SEQ ID NO: 121135 - protein, 124 aa, Triticum aestivum
  Clone ID: PAT_TA_15553.pep
TPHSIRRPPPRRARLCQWTQVRALVGGFSLIIFSFQLKNGRWISVTPFCLSWSVHFEKIAYIVLMCLLCETLTYWSTIYELYVIKNISLGSSLKYASNGILFVAYNSHVVGKINAQSYFSVTKH

SEQ ID NO: 121136 - protein, 123 aa, Triticum aestivum
  unsure (1)..(123): unsure at all Xaa locations
  Clone ID: PAT_TA_15554.pep
MSQETVNPKAYPLADSQLTITILDLVQQAANYKQLKKGANEATKTLNRGISEFVXVWQLTRSPLEILLHLPLLXEDKNVPYVFVPSKGSPWAPVIACSVTSNEGSQLKQPIQSLKDAIEKLLI

SEQ ID NO: 121137 - protein, 780 aa, Triticum aestivum
  unsure (1)..(780): unsure at all Xaa locations
  Clone ID: PAT_TA_15555.pep
MGGLEEIRNEAVDLENIPIEEVFEQLKCTRQGLTSDEGAQRVEIFGLNKLEEKKESKVLKFLGFMWNPLSWVMEMAAIMAIALANGGGKPPDWQDFVGIIVLLVINSTISFIEENNAGNAAAALMANLAPKTKVLRDGRWGEXQEASILVPGDIVSIKLGDIVPADARLLEGDPLKIDQSGLTGESLPVTKNPGDEVFSGSTCKQGEIEAVVIATGVHTFFGKAAHLVDSTNQVGHFQQVLTAIGNFCIVSIAVGIVIEIIVMFPIQRRKYRAGIENLLVLLIGGIPIAMPTVLSVTMAIGSHKLSQQGAITKRMTAIEELAGMDVLCSDKTGTLTLNKLSVDKNLVEVFAKGVDKEHVLLLAARASRVENQDAIDACMVGMLADPKEARAGIREVHFLPFNPTDKRTALTYIDAEGNWHRASKGAPEQIITLCNCKEDVKRKVHSVIEKYAERGLRSLAVARQEVPEKSKDSPGGPWQFIGLLPLFDPPRHDSAETIRKALVLGVNVKMITGDQLAIGKETGRRLGMGTNMYPSSALLGQSKDGSLESLPVDELIEKADGFAGVFPEHKYEIVKRLQEKKHIVGMTGDGVNDAPALKKADIGIAVDDATDAARSASDIVLTEPGLSVIISAVLTSRCIFQRMKNYTIYAVSITIRIVLGFMLIALIWKFDFAPFMVLIIAILNDGTIMTISKDRVKPSPLPDSWKLNEIFATGVVLGTYLALMTVVFFWVIHKTDFFTNKFGVRSIRDSEFEMMSALYLQVSIVSQAPIFVTRHVLGLC

SEQ ID NO: 121138 - protein, 648 aa, Triticum aestivum
  Clone ID: PAT_TA_15556.pep
MLSARTAAAASPAASLWKRGGGAGARGDGCTSCLEVRRRAAAVTVRAAQPKRVEAVAMESAAETAEAEKEVAAEKEVAAAGGGVEDKYGEDRATEELPVTPWAFSVASAYTLLRDPHHNKGLAFTERERDAHYLRGLLPPGVVSQDLQVKKIMHNLRQYKVPLQRYVAMMDLQERNERLFYKLLIDNVEELLPVVYTPTVGEACQKYGSIFRRPQGLYVSLRDKGKVIDVLRNWPERNIQVIVVTDGERILGLGDLGCQGMGIPVGKLSLYTALGGVRPSACLPITIDVGTNNEQLLNDEFYIGLRQRRATGEEYHELMEEFMDAVKQIYGEKVLIQFEDFANHNAFDLLAKYSKSHLVFNDDIQGTASVVLAGLLSSLKVVGGTLAEHTYLFLGAGEAGTGIAELIALEISKQTNAPIEECRKKVFLVDSKGLIVSSRKNSLQPFKTSWAHEREPVTTLLDAIKSIRPTVLIGTSGVGRAFTKEVIEAMASFNERPVIFSLSNPTSHSECTAEEAYKWTKGRAVFASGSPFDPVEYDGKIHVPGQANNAYIFPGFGLGVVISGAIRVHEDMLLAASETLAAQATQENFDKGSIFPPFTNIRKISALIAASVAAKAYELGLATRLPRPRDLEKYAESCMYTPVYRSYR

SEQ ID NO: 121139 - protein, 488 aa, Triticum aestivum
  unsure (1)..(488): unsure at all Xaa locations
  Clone ID: PAT_TA_15557.pep
RPIPTAQQQPRTPQSQREREISPCFFFLEKAIDRQRVLLAHLLPSSSAAPSRISASPCAAGDSAAYQRSSCFGDDVVIVAAYRTPICKAKRGGFKDTYPEDLLTPVLKAVLDKTGINPAEIGDVVVGTVLGPGSQRAIECRTASLLAGIPETVPVRTVNRQCSSGLQAVADVAAAIKAGFYEIGLGAGLESMSVNSVGWEGQVNPRVIELQKAQDCLLPMGITSENVAQRYGVTREEQDKAAVESHARAAAATASGKFKDEIIPVHTKLIDPKTGEEKKVVISVDDGIRPGTTLSGLAKLKTVFKKDGTTTAGNSSQVSDGAGAVLLMKRSVAVSKGLPILGVFRSFAAVGVDPAVMGVGPAXVAIPAAVKSAGLEIDDIDLFELNEAFASQFVYCCNKLGLDRSKVNVNGGAIAMGHPLGATGARCISTLLNEMKRRGRDCRFGVVTMCIGSGMGAAAVFERGDSVDELSNVRHIQSHNFLSKDAAK

SEQ ID NO: 121140 - protein, 233 aa, Triticum aestivum
  unsure (1)..(233): unsure at all Xaa locations
  Clone ID: PAT_TA_15558.pep
TLSLPPSLSRPPVSAHLLRLRRRRTHRGSSDSPDQERRAGRKSTYAGGEEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEVXDELRDAVLLVFANKQDLPNAMNAAEITDKLGLHSLRQRHWYIQSTCATTGEGLYEGLDWLSSNIASKP

SEQ ID NO: 121141 - protein, 455 aa, Triticum aestivum
  unsure (1)..(455): unsure at all Xaa locations
  Clone ID: PAT_TA_15559.pep
LTPSASVPMXMPPSCEGASCPEASPLQYXVFFLGLYLIALGTGGIKPCVSSFGADQFDDTDPXERIQKGSFFNWFYFSINIGALISSSFLVWVQDNLGWGLGLGIPTVFMGLAIISFFAGTSLYRFQKPXGSPITRVCQVVAATLRKWNAHVPEDSSLLYELPDGVSAIEGSRQLEHTDELRCLDRAATITDLDVKEDSFNNPWRVCTVTQVEELKILVRMFPVWATTIVFSAVYAQMSTMFVEQGMVLDPTIGSFKIPPASLSTFDVVSVIIWVPIYDSILVPIARRFTGKERGFSELQRMGIGLVISILAMSAAAVLEIKRLAIAREAHLVDQNVPVPLSILWQIPQYFLVGASEVFTFIGALEFFYDQSPDAMRSLCSALQLITTALGNYLSAFILTMVAYFTTRGGRPGWIPDNLNEGRLDYFFWLLAGLSFLNFLVYVLCANRFKSKKAA

SEQ ID NO: 121142 - protein, 181 aa, Triticum aestivum; identical to SEQ ID NO: 121071
  Clone ID: PAT_TA_15560.pep

SEQ ID NO: 121143 - protein, 136 aa, Triticum aestivum
  Clone ID: PAT_TA_15561.pep
FFYKYLLERAKTAIINISKHHTETVVNIAHTFAFKIAYNKIEINVWFFLRDSTQLRYTYTYTQQFAASLDIAIVEECSPCSSLYKHPDDCVLPVIGEEACNSIELDVYHTRLFRENVLVKLWLSLFARFSLDHSGL

SEQ ID NO: 121144 - protein, 236 aa, Triticum aestivum
  unsure (1)..(236): unsure at all Xaa locations
  Clone ID: PAT_TA_15562.pep
VVTSKTLLKGTKAGAPPRWRPALELVDPPGCRNSARAQIGHGARGDVTILPTFVVNNRQYRGKPDKRAVLRAICSGFXETTEPDICLTQDIQTNQCLENNGGCWLDKNTNFTACKDTFRGRVCECPVVNGVKFVGDGYTHCEASGVGRCQINNGGCWKETRNGKSVSACSNEQAKGCKCPQGFKGDGIHGCEDVDECKERLFCQCKDCTCXNTWGSYDCGCGGXRXVSKQYYNERR

SEQ ID NO: 121145 - protein, 103 aa, Triticum aestivum
  unsure (1)..(103): unsure at all Xaa locations
  Clone ID: PAT_TA_15563.pep
VSSSAPSADPFSQLDGLLGPASASPALSGTXAPSASNTPDLMSVVAAEVQTGGTSASTEPAQKGATTKKGHSLQDALQKDATARQVGVTPTGNNPNLFKDLLG

SEQ ID NO: 121146 - protein, 98 aa, Triticum aestivum
  unsure (1)..(98): unsure at all Xaa locations
  Clone ID: PAT_TA_15564.pep
RYXITLSSKLTXTKGNKSWSSTAVAAALELVDPPGCRNSARADSHARSPPPAPCIRGLASESLARSGARQPPEPRRLPAMAPAPSSRAAPPSSSPSLL

SEQ ID NO: 121147 - protein, 115 aa, Triticum aestivum
  Clone ID: PAT_TA_15565.pep
WIPRAAGIRHETIPVSSLESSTEADSEDDSVMAVDETVSSRRLAKEITWQMRMRLKDSQDEDSSLSYEYHDTYNENSSFSKSEVETAKEVSGEISEDLEFGTSTSGPFLGFPEQE

SEQ ID NO: 121148 - protein, 246 aa, Triticum aestivum
  unsure (1)..(246): unsure at all Xaa locations
  Clone ID: PAT_TA_15566.pep
HPQLLLPRSSPLSRPACLLPPPDPNPXAPPPSIPKSLPPPPSPPPSSPPAPPSXPPCAAPPLPSPPRLPPPPTPRFPPPSPHPAPRRPDLAGRHAPYRAAAPPPVSRRPPRRALPPPVRRPPPXPPRPAAPPXPPGARGTPSPAPCAPSPPPPSSSSPRRSPFFTYCGRRYPVGLPVHHRLTMGTLFSADKNLVAMYAGGVPPGHRSLEATSRRRNDSSLDPELPPPLHRASGASRRAWRAAPDPS

SEQ ID NO: 121149 - protein, 197 aa, Triticum aestivum
  unsure (1)..(197): unsure at all Xaa locations
  Clone ID: PAT_TA_15567.pep
SKLSSXQTLTKGNKSWSSTAVAAALELVDPPGCRNSARASLCQTLPLSLSLDSSKFHPPSPTSSFVSKFRPPAMASLGEMLLNQELAAVAAMSADVHGRFERYILSPAHGFPHFQQAGSAPAGFPDTGLLVFRLWACLPPPSSCRRGPTPAAGYGAEARPRWKPRGPGDKEPGRQRNDGGRHPVQEGTRWDREGRKE

SEQ ID NO: 121150 - protein, 174 aa, Triticum aestivum
  Clone ID: PAT_TA_15568.pep
WIPRAAGIRHEAQRLCFLSLLLLLLLAAAASATADAAAAEEFTEELLLRPLPDRKALAHFHFRSSAPPASAAGRHHHLFPKAISQLVQKFHISELELSFTQGRWNYEQWGGYDPMSTNNAKPPGVELWAIFDLPLAEIDATWKNLTHTLSGLFCASINFLESSTAFSAPRWGFK

SEQ ID NO: 121151 - protein, 128 aa, Triticum aestivum
  Clone ID: PAT_TA_15569.pep
GKLVLWTLNNGPNMVGHCRSAFDESGLWAVMAEEVVKLCMLVEVACLQGEITRATLYYSVTAVISRMPGIWLIKRLLRIKLSPANKLLRMSVGLRPRGNRQLSQVVHHGHHVLIFGAAPVWPLVRDPQ

SEQ ID NO: 121152 - protein, 195 aa, Triticum aestivum
  Clone ID: PAT_TA_15570.pep
TPGTQSPVADWRISNTPFRVPEPERPRATQASGHPTRIRKREGLPRCRTDRTPMPRRKKTLKGPEGPSVRRRIVGPKPRSGDQGRTAVRTEEPGAGRQRRERRNARSSVHARKGVGGSQCEEPCTVHGEPVSAWAREGRRPAPPGGQRVVAASVKGANRVTRHKSRPRERRDAGPRLGKRDPKGSRPRFGKLGGA

SEQ ID NO: 121153 - protein, 156 aa, Triticum aestivum
  Clone ID: PAT_TA_15571.pep
RSFYTFPLFSIHSQPPFLYPRPPTAAPLFVVSLSSHLFPLNLVLLRLPYYFLFAFALPLLSSHSLFFPIPLLFPLSAFFLMRDFVFLSSVLPMYRCNWISPSPQYIASPAWVRCACYYTSTIHLVPPHYYLDSEILSSVVSLYTHSLVVSICVSLL

SEQ ID NO: 121154 - protein, 152 aa, Triticum aestivum
  unsure (1)..(152): unsure at all Xaa locations
  Clone ID: PAT_TA_15572.pep
MGISRDCMHKRRATGGKQKAWRKKRKYELGRQPDNTKLSSNKTVRRVRVRGGNVKRRALRLDTGNFSWGSEAVTRKTRALDVDYNASNNEXVRTQTLVENAIAQVDAAPFKQWYLTHYGVEFGTKKKAAAAAKKEPAEEQEAEVAAAATKES

SEQ ID NO: 121155 - protein, 110 aa, Triticum aestivum
  Clone ID: PAT_TA_15573.pep
KSYRCLDGLPVLAGVNLVVRSPDDELEFRVDKSYKLTVPTTGNPIYARIKTIYKRFSKGLKFATTTKISLWNNSVWLFCAIFLSSRYASGALGEASSCLTYVVFVCCTML

SEQ ID NO: 121156 - protein, 120 aa, Triticum aestivum
  Clone ID: PAT_TA_15574.pep
RETDCFSARGRGTVLADSYTALRWFLLSGEASSVRALSSLTVGDHSQLCIPGADYLLVHYLCAHLILSFICGVSTTVHALCSSSGRLVVDLVRTLRVPCAPPSGLSHSFCICWSPTRSWS

SEQ ID NO: 121157 - protein, 211 aa, Triticum aestivum
  Clone ID: PAT_TA_15575.pep
MAPAAKKPPLKSSSSHNSAAGDAAGKTIEEMYQKKTQLEHILLRPDTYVGSVQNHTQTLWVYEDGAMVNRPVAYVPGLYKIFDEILVNAADNKQRDPSMDSLKVDIDVDGCCISIYNNGDGVPVEIHQEEGIYVPELIFGHLLTSSNYDDNERKTTGGRNGYGAKLANIFSTEFVIETADGHRQKRYRQVFSDNMGKKTEPRYNKCKQSEN

SEQ ID NO: 121158 - protein, 54 aa, Triticum aestivum
  Clone ID: PAT_TA_15576.pep
RCPWRRGPVDVRSRKPKNCGRKRIVVDLSMLAEIPRSKRRTMRSLARALGVKKT

SEQ ID NO: 121159 - protein, 237 aa, Triticum aestivum
  Clone ID: PAT_TA_15577.pep
NSARGQAGLSGSSAIVCAALSCLLDFYGVRDKIRVEVRPNLILNAEKELGIVAGLQDRVAQVYGGLVYMDFSQEHMDKLGHGVYTPLDVDLLPPLYLIYAENPSDSGKVHSSVRQRWLDGDEFIISSMKEVAQLAYDGHNALLQKNYSELARLMNKNFDLRRKMFGDDALGELNIKMVEVARSIGAASKFTGSGGAVVAMCPDGDAQAELLKNACQEAGFRVEQIESAPVTQRRSWQ

SEQ ID NO: 121160 - protein, 182 aa, Triticum aestivum
  Clone ID: PAT_TA_15578.pep
SDGTSSTREESEAGKQNSKKGRKTKFDLFVEQYKQDTVKTQGVLDILVGKQADIVDDWYKEMAEKFLDETWMKRLKVIKAVVPHVAKIFFLYVFVKMMRQSKVPIWKYPAAARAGRLAASQKILEMLEEAEKLEKAERLKNGGDSKLFSKMWAILKSGGTTSGKGEHKPGKDVPKQGGDEDK

SEQ ID NO: 121161 - protein, 198 aa, Triticum aestivum
  Clone ID: PAT_TA_15579.pep
ASQMTTTIFSTIVIMLLSSAIAAQSSGDVGGKPKPTDFMVGACKNVSNFSRGHNEGDKYVSQEFCISTLQSDNRSANAKNLHDLALIPVDILKERVVTAGGNVKNMLHNTKNSTSSTARHLRICELDYAATASILNFCDALMRNYQGERSAGHDDDKPLFSKLARMWWTKVYEGLQATAANCAFFDMPRGRKAPSSKE

SEQ ID NO: 121162 - protein, 91 aa, Triticum aestivum
  Clone ID: PAT_TA_15580.pep
MPPSISRASPPPEPACATSPAATTSSGPTASALRRPPTPPILTPPAQSSPSRFAPSLTLRTPASSSPPLPTNPKAVRPLPPGTCSATPSRS

SEQ ID NO: 121163 - protein, 92 aa, Triticum aestivum
  Clone ID: PAT_TA_15581.pep
QLCHGKERDSTHCVTCRDFASPSVIFGTPPKGLVPTMRAGHTVRLRDWPTLAYMRSNQFTGYTMTVVGIESTRPCHNLTPTSRNYCIDRRRV

SEQ ID NO: 121164 - protein, 106 aa, Triticum aestivum
  unsure (1)..(106): unsure at all Xaa locations
  Clone ID: PAT_TA_15582.pep
NPPEMSVSRGFSLVLVPAFPSIXFLSSSFGLSLALPCNFLLRLWALTCICTDCQVTFELEYNKRWVFLGPRQSRKKKPKKSTETICIDYSSYGSSFHVQQKFICVL

SEQ ID NO: 121165 - protein, 62 aa, Triticum aestivum
  Clone ID: PAT_TA_15583.pep
PLSGTRTIHIILHYVSLLSHQLLFHSTKHNIPHKTYLFYIILFLIHTHLFFCLLVTFIITLF

SEQ ID NO: 121166 - protein, 138 aa, Triticum aestivum
  Clone ID: PAT_TA_15584.pep
QVEVLAPHHRTGVLMSGCSPSSSHVNVQVVSRIRLSSQVSGKSLPVQGQSVTVGVQSECFRLRDAISNSRHSMVGTLSWLQSSVTHDSGFSQLWVATPGLQSNGLNDRSTKIQSSRRGPKAIDDSRSNSVQLYLNGQG

SEQ ID NO: 121167 - protein, 140 aa, Triticum aestivum
  unsure (1)..(140): unsure at all Xaa locations
  Clone ID: PAT_TA_15585.pep
DRVRETHTHTRLLPHRGRRLSPAPSFLVSRCGIGDHLSINHIVSFKGAFVLCLIDRDGCLCSSVLGTVMRLLSLGPTPADVYXVIIVLDADGDGSICFSXILILIAREMNVTVSYEDLLEAFSVFVMDLDCSSLLVDSLL

SEQ ID NO: 121168 - protein, 178 aa, Triticum aestivum
  unsure (1)..(178): unsure at all Xaa locations
  Clone ID: PAT_TA_15586.pep
MATVDMRRLETGAGGGYDAMGLSKRVDDDLDDDGRPRRTGTAWTASAHIITTVLGSGVLSLAWGVAQLGWVAGPGVMTLFAAVIYYTSALLADCYRTGDPVXGPRNRTYMAAVRATLDESKVKLCGAIQFVNLFGIGIGITIAASVSMLAIKKAGCFHKEGHKGDCNSYSMSPYIAIY

SEQ ID NO: 121169 - protein, 167 aa, Triticum aestivum
  Clone ID: PAT_TA_15587.pep
MHSFGHRANAVATFALTILAAMCFAASFSDSFNSPTPAASVKILNINWFQKEANANDEVSMTLNISADLSSLFTWNTKQVFVFVAAEYETPQNALNQVSLWDGIIPAKEHAKFLIHTTNKYRFIDQGSNLKGRDFNLTMHWHIMPKTGKMFADKIVMTGYQLPEQYR

SEQ ID NO: 121170 - protein, 155 aa, Triticum aestivum
  Clone ID: PAT_TA_15588.pep
QQLASTLSSHETCFTQTGDSLFFMHEGLQQARAPIFDVSSAIEVIHTGSYWRLPKSVEEIGTQNTLFQDERRPTLKKLSTLVRAKLLETLVPKEMSEVSVTDGIANVQVDGEFKVLLTLGYRGHFSLWRILHIELLVGEKTGPIKLEETRRYVLG

SEQ ID NO: 121171 - protein, 76 aa, Triticum aestivum
  Clone ID: PAT_TA_15589.pep
VNLIHCQHRSRYIGISSSLSTTHILLRMMDRPTTSTNPLFIEQDDDMSSYVTESHLFGAQRALHQEQQAMNDRIDN

SEQ ID NO: 121172 - protein, 55 aa, Triticum aestivum
  unsure (1)..(55): unsure at all Xaa locations
  Clone ID: PAT_TA_15590.pep
SPTTPTTXXTAKERAPEERAGASPQSRHYPSLPRRLEEQRGAWISGRAAGSRRGE

SEQ ID NO: 121173 - protein, 220 aa, Triticum aestivum
  unsure (1)..(220): unsure at all Xaa locations
  Clone ID: PAT_TA_15591.pep
RERERERERERERERERERERERERERERERERERERESIRSSRPSPSPVQWSPSPTAACPSSPPPHTLATNPASGRPSPWPSRARSAARSLSISGSASDRITSTSRSHSGGPFWCPTPPGRHXLFRXATRSQSPWPCDPAILPPDARAPYDPSGGLGGRLPGRYYPPGRHPPPLFRTGIVFAPPPMPRILPXXRGAGSTPPAGLVFLFKITKPPLLLCP

SEQ ID NO: 121174 - protein, 163 aa, Triticum aestivum
  unsure (1)..(163): unsure at all Xaa locations
  Clone ID: PAT_TA_15592.pep
MMHMLPASDGRGWEMHPYADVPADQELELHRDNAADDSLDGHVRCLRCGIYRNATPHMRRGPDGPRTLCNAXGIAYTMGNMRRMIXAEPPIDDASLAKLVPDVDMEFESEEIAYEFYNLYAGHVGFSGRKSTLHKSSENITKVRTFVCSREGYNRDEQSLDAR

SEQ ID NO: 121175 - protein, 191 aa, Triticum aestivum
  unsure (1)..(191): unsure at all Xaa locations
  Clone ID: PAT_TA_15593.pep
HPDVLARILLLLSCIVDRVRASAVNKHWRRVSLQNPPPLPRLLRPSTAQTETYRIFGGFGDPRPSLSEEGRGSRFCGSAPGGWFVISAEPWRGHALLHLRTGERVALPERVRIPLNSGDITCPMMIRAXVISAAPPSGDCFVAAITSSQTNMAFWRPGMDCWLSPPVGMGPARRSAEDLTYYDGWFCAVDS

SEQ ID NO: 121176 - protein, 120 aa, Triticum aestivum
  unsure (1)..(120): unsure at all Xaa locations
  Clone ID: PAT_TA_15594.pep
PDIAGTFGYIPPEYGQTMKSSTKGDVYSFGVGVVMLELLTGRPPTGQEDLEGGGNLVGWVRWVIARGTRNELFDPCLPVSGVLREXQMVRVLGMALDCTAXPWKRPSMVEVVQGRIVLAS

SEQ ID NO: 121177 - protein, 149 aa, Triticum aestivum
  Clone ID: PAT_TA_15595.pep
TLPPANHPDLGSLPCAALASATNRPPSSAPPPSLSPSALPPGLLPERAAARPPPHRAAAGPPPHRAAAGPPPSAPTAGLSPTAPPPGLLPTTPRWPAFSPSAPPPGLLPIARHIKFFGCACTNQKSTPVEQKNISLAVHTKKGSDVSSR

SEQ ID NO: 121178 - protein, 194 aa, Triticum aestivum
  unsure (1)..(194): unsure at all Xaa locations
  Clone ID: PAT_TA_15596.pep
NKEVGKDHLFKRSIILIKAWCYHEGNIHGSNHWLMSTYALEVLILNIFNLFHTSIHGPLQALYKFLLYYSKFDWDNQCLTLAGPXPLRNDTAGPSGSNEELLLSQEPLKRXCVKLFELSPGSDRRDPDLRLKYLNIVDPLKGDNNLGTSISEANSRVIRDAFAAGAEKLGNILKLPCERIAEERYVFLHIRCHD

SEQ ID NO: 121179 - protein, 190 aa, Triticum aestivum
  unsure (1)..(190): unsure at all Xaa locations
  Clone ID: PAT_TA_15597.pep
AATTTPASPTSPAGARSAPRRSSRRRTRRRPRPRRRWPRSRPRRGRWSSTSRIWSTGRRFTXFILTDKFKSCFWLIDGYDMPDDGRMIYWMKAXILQGDKELAENPYYADELIYGEARGCELNDIVHVTGITEGGNSMEVIYWDRTDDSILAGNYDINTVXCERKPWNKEALMPMRGLPWYRKVLLEAFR

SEQ ID NO: 121180 - protein, 176 aa, Triticum aestivum
  Clone ID: PAT_TA_15598.pep
MVASIAAAADAASISHLLPAPKPKPRTPPRLSLLPRRRSRAAGAISASASDDFDLLAPVRCLKCRLGAGDTLYGLLLLCFYATLAQIGALAGYHYIVVDMEHGPGGITEALDCLRALDVGRTPVMLRLPEAWPVWAKNALDLGPAGLMLPADESPVAAAEAVSHCRYPSNGVRGTV

SEQ ID NO: 121181 - protein, 180 aa, Triticum aestivum
  Clone ID: PAT_TA_15599.pep
VVAPEAFGAGGGGTYILAFSRTPGTIPWLVLATSLEEAPLSTLPMLQPSASLVARQVVGAVDVGAVGPCGGKGAVDGHHHRLLHLVRQPDYHHRAQPRPLIRGGRRGRRGGGSGRASTPPACCGGRCTDEVDGSRRWGAPAAGGRGALRRLLPVAARVGRGAVAGGDRCAVEREMRRRGG

SEQ ID NO: 121182 - protein, 224 aa, Triticum aestivum
  unsure (1)..(224): unsure at all Xaa locations
  Clone ID: PAT_TA_15600.pep
KILQAHLDLQRIVTRCREPXAAGPSPATGYSAPAPPTPPALLPLPQVPPTLATFYCRRHSTPRPLPAPTPAGLYLHGGGRRRPARTAGWPCPWGVGATRALRRPHAPPSALPPRTMPTSLSLMRSWWWPRPARVCCWLRPKQSWPXGGQPFVVEELXVWVGXPEXSGVGFPNHKGGRPLIPPFGAPPQNQPLNXSGLLPLEGLAPGLFRGGGGKKNWNGGGMAP

SEQ ID NO: 121183 - protein, 100 aa, Triticum aestivum
  unsure (1)..(100): unsure at all Xaa locations
  Clone ID: PAT_TA_15601.pep
SAAKLANNQPPCFYYCGLCXLLNEALTPDMEHTAMSPGLLQSLLQPICNAPKQLQVWSQEHSALQASAQEGLFIGVYTALGVTSSDVDPVLTVCVRQHLL

SEQ ID NO: 121184 - protein, 168 aa, Triticum aestivum
  unsure (1)..(168): unsure at all Xaa locations
  Clone ID: PAT_TA_15602.pep
MLVYQDKLSGDELLSDSFPYRELENGVLWEVDGHWVVQGAVDVDIGPNPSAXGGGDDEGVVDQPGKGVALVATFRLKNQPVFAKKQXISHMKRYIKNLSGXLKGDDLDAFKKNVESATKYLLSKLKDLQFFVGESMHDDGGVVFAYYKEGAADPTFLYFAHGLKEVKC

SEQ ID NO: 121185 - protein, 185 aa, Triticum aestivum
  unsure (1)..(185): unsure at all Xaa locations
  Clone ID: PAT_TA_15603.pep
MAGRYARSLFVDSLMGRLNFACPGGAVNGAGGMFSLEFGSGEISPDEMNKIMVDEKLAEMVLADPKRVKRVLANRQSAARSNERKMLYIEELEQKVQILQTEDTTLAEQIKLLQRDSSAVATXNNELRFQLQAMEHHAHLRDALNDALTGEVHRLKIAAVELGIXDSCSFNAMGQQHNLMFKHQQ

SEQ ID NO: 121186 - protein, 225 aa, Triticum aestivum
  unsure (1)..(225): unsure at all Xaa locations
  Clone ID: PAT_TA_15604.pep
GTSFXQRCGNDELLQIINELSKKTQAIGKKQIESDAEILVLRATVKDMERKIQELQYQYGKLQLEYSAALLGEPRNILEGPSAHASGGHNGITWLPSLDSFYPTADRLVPLRPMSSARSYAAVAALNDHLFVIGGGDGDSWYTTVECYNRVSNEWMACPCLKQKKGSLAGATLNGKIFAIGGGDESRSFSEVEMXDPVLGSWIYSPSMQQCRFAPAAAELNGILY

SEQ ID NO: 121187 - protein, 182 aa, Triticum aestivum
  unsure (1)..(182): unsure at all Xaa locations
  Clone ID: PAT_TA_15605.pep
MARKGGERKKAVTRSTKAGLQFPVGRIGRFLKKGRYAQRVGSGAPVYLAAVLEYLAAEVLELAGNAAKDNKKTRIVPRHLLLAIRNDQELGKLLAGVTIAHGGVIPNINPVLLPKKALEKAEKESQSPKSPKRKAPXPAPAAKKTPKKTAADKRPPPTRKPRRDKKTARCQKTRAATRGLRD

SEQ ID NO: 121188 - protein, 128 aa, Triticum aestivum
  unsure (1)..(128): unsure at all Xaa locations
  Clone ID: PAT_TA_15606.pep
MLVETACILHMLDMELAAEALKGVKMELIDAAFPLLKGVVATTDVVEACTGVNVAVMVGGFPRRXGRKGKDVMTKKVSIYKAQASALETHAXAPNCKVLVGANPANTNALXLXEFAPSIPGKNISCLT

SEQ ID NO: 121189 - protein, 146 aa, Triticum aestivum
  unsure (1)..(146): unsure at all Xaa locations
  Clone ID: PAT_TA_15607.pep
MIPSFGWARRGLCSAGPLPRSVCAHWARGSPTQSGSAVRSSQACIRPCSHLSAPACRAAFPLPGPPLPPRSRGHLPRSSPLPPRSRYRPARLPPPRPQPRRRGRPPPPAPSSGXGSPPGPRSPWPRPRRPPPRVQPWLGVRVGAWP

SEQ ID NO: 121190 - protein, 142 aa, Triticum aestivum
  Clone ID: PAT_TA_15608.pep
MISAMSWVPRGAAKSVPIEAEPPTKEEIEEAMKKIALGREAGSDADDADGDEDDDAVMEVDGAEDEEVDEVAQAKAAAKALGTKSSSAAAVGDVSDGLAELNMDAYDEEEDGLELFSTGLGDWYYKSNEEDPYIIKNDDDDD

SEQ ID NO: 121191 - protein, 129 aa, Triticum aestivum
  unsure (1)..(129): unsure at all Xaa locations
  Clone ID: PAT_TA_15609.pep
PFARRLARRGPGAVTRRLLHTGPPAGPGVLASRLASRAVVRFRGPEAARFLNSLLTNDVLLSHGAPASSQPQRYAPTPNAPARAPPPRYAALLTPQGRFLYDLFLYXPAPRSQMLDRTGSAPQTGERPG

SEQ ID NO: 121192 - protein, 89 aa, Triticum aestivum
  Clone ID: PAT_TA_15610.pep
RERERERERERERERERERERERERELCRPVCDSPVDHDMLKREGEQIAFVLTSRRRRRSQHRLVLCAASTTQASSLDRFCSRRAGVHH

SEQ ID NO: 121193 - protein, 258 aa, Triticum aestivum
  unsure (1)..(258): unsure at all Xaa locations
  Clone ID: PAT_TA_15611.pep
SALVQSRKIDTKRPKKSRVQEAVYYYNIESILALIVSFFINICVTTVFAKGFYGSDKADNIGLENAGQYLQEKYGTALFPVLYIWAIGLLASGQSSTITGTYAGQFVMGGFLNLRLKKWLRAVITRSFAIIPTMIVALFFDTEDPTMDVLNESLNVLQXPFQFPFALIPLTTLVSSEQLMGSFVVGPITKVISWIVTIFLMLINGYLILSFYTNEVRGAVVRSSLCVVLALYLAFVIYLVLTRTTPYSRLRSSVSMSS

SEQ ID NO: 121194 - protein, 114 aa, Triticum aestivum
  unsure (1)..(114): unsure at all Xaa locations
  Clone ID: PAT_TA_15612.pep
QEQQQQQQQQQQQQQQQQQQQQQILQQILQQQLIPCRDVVLQQHNIAHGSSQVLQESTYQLVQQLCCQQLWQIPEQSRCQAIHNVVHAIILHXQHHHHQQQQQQQQQPPLSQVX

SEQ ID NO: 121195 - protein, 202 aa, Triticum aestivum
  Clone ID: PAT_TA_15613.pep
MLLRRLLHPSHHLRRGLQTLTTTTNAAAAPPTPHPLSAPLPFRRLPARLLSPRLLSTSGGDDDTRRPWAFTQDSGDPDPFADVDPAAAVPGEAPLGSSAVVEGPWSKDFRAEDSDKADVFEEIYKDAAAAAPAVRKAAPAEPWTWDLEGEKDDPFAARKDAAAAAPTARKAGPARPWTLDLEDEEDDPFARLCFDVGVGDRG

SEQ ID NO: 121196 - protein, 55 aa, Triticum aestivum
  Clone ID: PAT_TA_15614.pep
IVMVFSKVEDNSRTLLEAAMRQQNHAKLCHYITTTRELMEQLGAETTPERISSVS

SEQ ID NO: 121197 - protein, 156 aa, Triticum aestivum
  Clone ID: PAT_TA_15615.pep
YANHNRYLRTPESLRRRIPADRARVRCAAKLRRTKTRVSHKSIRSWVSSPVRNPAIPDNLPAPNRAQPRELQVCCDELIPGCDFLKYLGRQRAPCTFACQDDLEATAAPPRAVPPTTTRPARGLPASSCFSNSMGCNVILCYWRRSRGLGINCSMG

SEQ ID NO: 121198 - protein, 183 aa, Triticum aestivum
  unsure (1)..(183): unsure at all Xaa locations
  Clone ID: PAT_TA_15616.pep
DEVQTLSSTHKQTGWKSNTGYALRQYLITTAARKSSLADRALEHTPALRHPTTVRLXDRLRRYRPVLRIRPLPRQPLLRDIRLEFITERPLQKQLALGLQEDGRGVLVDLLRGSHLCAIHEEGGSMASRRTLNFGCVNIYEHLPAERNGCVSQTVHFPGIKGSACSDAHGTLLIWKRLRGHQP

SEQ ID NO: 121199 - protein, 137 aa, Triticum aestivum
  unsure (1)..(137): unsure at all Xaa locations
  Clone ID: PAT_TA_15617.pep
MAETYCDLHTADRLNALEAHLAGQTYIYGDGITNDDVNVFAAMPVKTSAEFLNAARWYDAVIAAASSMFPDQAFWARASLSTAAAAAAASTDEDDDDDMDLLRHQTQEDKQTLADRESXTPALNKDSGKSFVLIDNK

SEQ ID NO: 121200 - protein, 173 aa, Triticum aestivum
  Clone ID: PAT_TA_15618.pep
SWPQAVTWSPAATAWRRSPPRSPPWPSTRSGACCRRRAPRRRCCRRRRGRRGGGGGAGRRPRAPPARPTSSWHPLAPPLPSPARARTLAVKAAWVEGGREGKRKGGEIWGGAGRRRGASRTAPIYTPVSPRLGLRGAEQSLEDLSFRGEVPRPASARASVRIRQSEGVMCLTN

SEQ ID NO: 121201 - protein, 128 aa, Triticum aestivum
  unsure (1)..(128): unsure at all Xaa locations
  Clone ID: PAT_TA_15619.pep
TNSQLYTLFTEPSSGALYNGGRRSPPPHGPFGCPIPQTTGFPSMGGHGSVRPQDLTTLQSIGWWETKAKAFLTHSAIGQRPPGLVXAPNTAGFFKHSKTTYSAPGIGLQPAHSGHFLQKMRLGQTHKV

SEQ ID NO: 121202 - protein, 86 aa, Triticum aestivum
  Clone ID: PAT_TA_15620.pep
RSWIQFSGKTRFLAQPSLQAHHMLLHWDDLPSSTEVANPTLLDQKLSKKLCHINVGLIYFLNFPLFKAQECYAPLLPSIFNCPQFY

SEQ ID NO: 121203 - protein, 135 aa, Triticum aestivum
  Clone ID: PAT_TA_15621.pep
FMVVLDIPHDAASANGLPHLTQPSKSTPPSLPPFSWRLWTTDESRLSLSSTHILSYFSYIHTNYYGRWPWSVNSGVVCRGDVDLFKQKVHEKCSHWCFCTRAFRVVSDFTLVTDSAKRHSKCKKSYVKRSTTPLL

SEQ ID NO: 121204 - protein, 144 aa, Triticum aestivum
  Clone ID: PAT_TA_15622.pep
MAEAVSSSPGSPAAAAAAAYPYPVARRLHGAFVARDELPYSYPAAAAAPPPPAPLPQAQQGSSGGGGGKISPAVLFIIVILAVVFFISGLLHLLVRLLMKKQHRRRGGSAAAAAQGPGEADAALQRQLQQLVHLHDSGAGQGLH

SEQ ID NO: 121205 - protein, 202 aa, Triticum aestivum
  unsure (1)..(202): unsure at all Xaa locations
  Clone ID: PAT_TA_15623.pep
PACRPPPPHSSPTSAPSAARTHASSPSPPRSATSTRSSPSASPPATTPSTPPRPPXPPPLRRPPRTSPPAPPPLPRRPQPRPLHSQRPPPLPPVPLPGPPLPLPXTPSPSRSPPPRSTLPAPAAASLLAPLPRARCTGSPWPRGTRXTRSWRRPSPSSTPRCREAMTHARCSTQCRLRTRSSGTRCSPCCPARRPWRRSCGW

SEQ ID NO: 121206 - protein, 195 aa, Triticum aestivum
  unsure (1)..(195): unsure at all Xaa locations
  Clone ID: PAT_TA_15624.pep
QTPTSIAATEMSMRLAACALLLPLVLAALLHPADVVAVGDGTPDRGGGGFSLRLVPSPGWNRSIHVDDDGFVHLNEDATTALRPPMHTQIGGKYSVVTSVGTGAGRRTYXLALDMTSSELWMQCKPVQKPFAQQPPPFEPAKSPSFRHVPGNSRFCLPPAHGHRPTVQDPCKXRSIGLHGIDARSXLSNETLAFA

SEQ ID NO: 121207 - protein, 140 aa, Triticum aestivum
  Clone ID: PAT_TA_15625.pep
AEPGSASRGSPRGGGRRRSLNSGRRPRHVSLGGRDKLPDSYTAAAGAPTTTARVFEAQQGYIQGCRPDRITPREGLQPTLMPTGGASSSNGLVRFVRPVLMKNQALRRRCLVARPEHGAPEGHAAAIMQGGGGIALSPTP

SEQ ID NO: 121208 - protein, 252 aa, Triticum aestivum
  unsure (1)..(252): unsure at all Xaa locations
  Clone ID: PAT_TA_15626.pep
GATRPPTRPAARAAIADAKPLFDPELKIQRLKDAIFAQNELLARAKKRGAFASLIGAKSIPKPLHCLAVRLTAERIALPDKFADPVPPPAALEDPALFHYAIFSDNVLAASVVVRSCVANSQDPSKHVFHVVTDRMNLGAMQVIIRLMDLQGAHYEVKAYEDYKFLNSSYVPVLRQLESANLQKFYFENKLENATKDASNMKFRNPKYLSMLNHLRFYLPEMYPKLXKILFLDDDVVVQRDLTGLWKIDMDG

SEQ ID NO: 121209 - protein, 221 aa, Triticum aestivum
  Clone ID: PAT_TA_15627.pep
QKCKVVDLGIAKDTEESLMEHMDAALHSDADIILTSGGVSMGDRDLVKPCLAKMGKIHFEKIRMKPGKPLTFAEITSNDPTKPSKTALAFGLPGNPVSCMVCFNLFVVPAIRLVSGWSNPHLERVHVRISHPLRADPHRMEFHRAVIRWVLDDGSGRPGYVAESTGQQASSRLLSMKSANALLEVQSSDQILAVGALCQAILICDITSPPRNKRCGVYSPL

SEQ ID NO: 121210 - protein, 202 aa, Triticum aestivum
  Clone ID: PAT_TA_15628.pep
PVTYSALIPQLDSSFFQHVSNNNLLLTLISISIFPFFTNGALQPQHQHAHGGGCNPDERATLLSFKKGITSNDANILTSWQGQDCCRWRGVSCSNRTGHVIKLHLRNPNVALDTYGEYDVCGGASALFGEISPSLLSLKHLEHMDLSMNCLLGTNSQIPHLLGSMGNLRYLNLSGIPFTGRVPPHLGNLSKLQYLDLGQDGD

SEQ ID NO: 121211 - protein, 57 aa, Triticum aestivum
  Clone ID: PAT_TA_15629.pep
LILGMDQPNNSGITCLIKEVMLEATGVSEKQSVGRRQTTELSRTAEFVLMKRITSNG

SEQ ID NO: 121212 - protein, 77 aa, Triticum aestivum
  Clone ID: PAT_TA_15630.pep
MQEQGESSRPSSSDRSSSSGNHMGHKEGMESDDEIGTVPELGLGPSGASTSGRREADGPERAQSFTAQGSARRRGRT

SEQ ID NO: 121213 - protein, 67 aa, Triticum aestivum
  unsure (1)..(67): unsure at all Xaa locations
  Clone ID: PAT_TA_15631.pep
RIYTKYPWNLXFESLTTLFGVYGIRKIVFNLIRRDNGRCLXCSTPSSTTKWLKLSHWLFRARPWSNH

SEQ ID NO: 121214 - protein, 63 aa, Triticum aestivum
  Clone ID: PAT_TA_15632.pep
ERERERERERERERERERERERERERERERERERETERATQITEDILALSQAPNPGLGEGLLC

SEQ ID NO: 121215 - protein, 115 aa, Triticum aestivum
  Clone ID: PAT_TA_15633.pep
RHQFYRLLTFMLAATTKAVEYGARSHNRGPWRWCDPPTAYKGSPLTTCPSLVKLQRMSKNLPLPELRHLCLILVHVNKDMCTIWVLNRPRRFVYKDPRVLDQKAAPPLSHKESTS

SEQ ID NO: 121216 - protein, 160 aa, Triticum aestivum
  Clone ID: PAT_TA_15634.pep
LIWRWVAEGFIKCDKVESGLFVRGKSYFNELMNRSLIQPAEINYEGTVVTCRIHDMVLDLICSLSSEENFISILDNAEWNAPNPQRKFRRLSLHNIKAKVQNHQIESTSLSKVRTFAVFSPVTCDWLPSLSSFQFLRVLDLGNCVSHESSSGISLKYVGN

SEQ ID NO: 121217 - protein, 160 aa, Triticum aestivum
  unsure (1)..(160): unsure at all Xaa locations
  Clone ID: PAT_TA_15635.pep
MEAARAKDTKERLAGVERLHEALDAAARRGLSPAEVTSLVDTCVDLTRDANFPRPQGGLEALXAAAGLAGDQLXGINLKRALVPPPARQTRLLGEPGKAKAPFPKGPPRHSLSSLKRPSIGEGGFFFHTQTQNLNFSSKKKGAPAGKNIFICPMWEPLKY

SEQ ID NO: 121218 - protein, 116 aa, Triticum aestivum
  Clone ID: PAT_TA_15636.pep
MAPRAEKKWVPHLYVNNSDYICCHYIAPSSSGPDGGPDEQQQQRKASEIAGEVVAKLFVTSSKGPQKFMEAHGLEQWWSDGMELLAVSDSKKHEREGQSPVAESEGKPAIEGRSSA

SEQ ID NO: 121219 - protein, 175 aa, Triticum aestivum
  unsure (1)..(175): unsure at all Xaa locations
  Clone ID: PAT_TA_15637.pep
VRPRVRNVFEIASKFIKGDLDEEIQGSLGPVEVKNRTEEGTDRLESDGKGKEAEKPHSENSEKTDVEVESAHDTDRHESDCESKEAENSTSENSVKTDAEEESAHANQEEPTTSASDTNKGESVVDAQGNITVDEMGSAASSGDEVTIKSANDGPTRLTVNTTFDEMGSAXSSGD

SEQ ID NO: 121220 - protein, 94 aa, Triticum aestivum
  unsure (1)..(94): unsure at all Xaa locations
  Clone ID: PAT_TA_15638.pep
TRVSTVRLLCLYTGVVLDTAXKAHYCAITGIVFSPRTLPNCGAPAYILPTMPADMIVKLLFAPCQSLACATLVIILPYGFHIILTNIPFSTPWL

SEQ ID NO: 121221 - protein, 111 aa, Triticum aestivum
  Clone ID: PAT_TA_15639.pep
SAVCSTSVELAFCRGLSSPPLCTYVPWIVMRLPYCGIGWQAPPGVCFFFSPHARSCIRCRASPCCTGRLVHRSHHGLVMSRLYGQVVRGSPGAGPRGGFLLQGVCLPYKCW

SEQ ID NO: 121222 - protein, 124 aa, Triticum aestivum
  Clone ID: PAT_TA_15640.pep
ASGRATGLDQSERTHPVRGQEQGKEAAGSPAPPYYNAASPPCVGTPPAQHDTVEAAAAFTQVVHLAAAHSKAGEGAAIVGRGEVWRRGRKKRGRRLLLPSPWPDTSRTRTPRGVVVATEGAAMA

SEQ ID NO: 121223 - protein, 78 aa, Triticum aestivum
  Clone ID: PAT_TA_15641.pep
IVRESISYISCFFLVQSHIWNMRLNTVVAFCGVNKEDGVDTIDKETNTSNIHERSHSVLRYKDAEDITYVRHSNPCAV

SEQ ID NO: 121224 - protein, 284 aa, Triticum aestivum
  Clone ID: PAT_TA_15642.pep
MDGFRALIAAGATAVCCGVGAIWAFRSPSPPPPKKQQPIPSRCCVCASCGCCANTTFPSANGEMAVGGEMNKAPAPAPATTGASMMEQLVPEITTHALSYLDCTSLCRLSMTNSAMRRAANDDGAWKALYHKDFTAEQDTITPPNGWKAYYAATKAIMNVNAEFYNIIREGSLPAMSHFWLNSDYVKCVHATGELFTGYNAVMNSWGLLFNWGQDGGQGTDFQLRDVRARVLADVAWVNMKVHVDVDPGPFHVTNVYEFRNGRWYMVHHHSSLMADPAPHNLFG

SEQ ID NO: 121225 - protein, 107 aa, Triticum aestivum
  Clone ID: PAT_TA_15643.pep
SSSTPHHCLLAPPPCRHCHLVPPPSRHCHLAPPPSRSTGHPRRTLTPVPAASSSSQRRRRRSPSSSRGRVGKRRPRRPTAAPSRSQRPRRSLGSRRRRGSSRRVRRR

SEQ ID NO: 121226 - protein, 91 aa, Triticum aestivum
  Clone ID: PAT_TA_15644.pep
RSCHARPRLSPLSHPTEYYHGLSILCTANHHAHFHEGLSPSMMRKPPRDTVVHVTIRFAASSNLSHLDQAFRTKKLVRSTLYAPKPLIVVG

SEQ ID NO: 121227 - protein, 165 aa, Triticum aestivum
  Clone ID: PAT_TA_15645.pep
CHVASGQAWTHNGRAAGVLYVTTTGADTAAAPLHPSRWARIERLVNAVVDARENLSGERRWVCMSAPVRGRVHTERRMHQLMHDDRDYESGPAPTPVDEEHFCMGDRAATAARSAHRTQTRVTIDNWEERGYAIVKMTSRDRPKLLFDTVCALTDMHYVVFHATV

SEQ ID NO: 121228 - protein, 205 aa, Triticum aestivum
  Clone ID: PAT_TA_15646.pep
SDDTGDISGGGRREAMAGRRSRSPSLSSSPSSRSLSSFSSVSSPSRSRSPPDRGRRSSSAARRGRSPPPPREGAKGGRSTSPSPPPKKPSPPPPAPRKPSPAPVPDESSLVLLVSRLSRNVTEGHLREIFENYGEVVNVELSMDKAVNLPRGYGYVEFKMRADAEKALLYMDGAQIDGNVVKVKFAPAPGQKAAVLCRRLFPIPP

SEQ ID NO: 121229 - protein, 362 aa, Triticum aestivum
  unsure (1)..(362): unsure at all Xaa locations
  Clone ID: PAT_TA_15647.pep
MSCFGCCGDEDTQRAPDNRNQCPGSHPARNDAYRTADPTPKGPQPVKVQPIAVPTIPMDEIREVTKGFGDEALIGEGSFGRVYFGTLRNGRGAAFKKLDSSKQPDQELLAQVSMVSRLKHENVVELLGYCLDGNTRVLAYEFATMGSLHDMLHGRKGVKGAQPGPVLSWIQRVKIAVGAAKGLEYLHEKAQPHVIHRDIKSSNVLLFDDDVAKIADFDLSNQAPDMAARLHSTRVLGTFGYHAPEYAMTGQLSSKSDVYSFGVVLLELLTGRKPVDHTLPRGXRALSHGPPQRLGEDKVRQCVDSRLGGDYPPKAVAKFAAVAALCVQYEADFRPNMSIVVKALQGLLNARAAHPGAEHAGR

SEQ ID NO: 121230 - protein, 212 aa, Triticum aestivum
  unsure (1)..(212): unsure at all Xaa locations
  Clone ID: PAT_TA_15648.pep
MSCFGCCGDEDTQRAPDNRNQYPGSHPARNDAYRTADPTPKGPQPVKVQPIAVPTIPMDEIREVTKGFGDEALIGEGSFGRVYFGTLRNGRGAAIKKLDSSKQPDQELLAQVSMVSRLKHENVVELLGYCLDGNTRVLAYEFATMGSLHDMLHERKGVKGAQPGPXVLSWXQRVKNSCXGAAKGXLEYLHEESXXPHVIYRDNQVXXNVLLF

SEQ ID NO: 121231 - protein, 262 aa, Triticum aestivum
  Clone ID: PAT_TA_15649.pep
FFVSVARSVCHEFPPVSIQQLITIAMDRKNREKEMASVLLSSLSMELFSSEDIVKGFIMLLESAEDTALDILDASDELGLFLARAVIDDVLAPLNLDEIGSILPPSCSGAETLNMARSLASARHSGERLLRCWGGGTGWAVEDAKDKITKLLEEYESGGDVGEACKCIREMGMPFFNHEVVKKALVMAMEKKKECMLALLHECFGEGIITINQMTKGFSRVRDGLDDLALDIPDAREKFLSYVEYGKKNGWLVPSFGVAAST

SEQ ID NO: 121232 - protein, 314 aa, Triticum aestivum
  Clone ID: PAT_TA_15650.pep
QCRLRFAAKLIVGMPFKDLATVDSILLRELPPVEDAEARLALKRLVDISMGVLTPLSEQLTKPLPHAIVLVTLDELSSDANKLLPEGTRFAVTLRGDESYEQLDVLKSVDNITMLLHNIPYGEEKTGRVHAARRLFEYLETNGLNFPVIHHIDFPKSIDRDGLVIGAGSNVGALLVDGLGDGVLLEAANQEFEFLRDTSFNLLQGCRMRNTKTEYVSCPSCGRTLFDLQEISAQIREKTSHLPGVSIAIMGCIVNGPGEMADADFGYVGGAPGKIDLYVGKTVVQRGIAMEGATEALIQLIKDHGRWVDPPTEE

SEQ ID NO: 121233 - protein, 90 aa, Triticum aestivum
  Clone ID: PAT_TA_15651.pep
YRARLRLTNQDKNKYNTPKYRFVVRFTNKDVTAQIVYATIAGDIVMAAAYSHELPRYGLEVGLTNYAASYCTGLLLARRVLNNRELDGRD

SEQ ID NO: 121234 - protein, 111 aa, Triticum aestivum
  Clone ID: PAT_TA_15652.pep
APKIWCCIARPQLPPSCAHENHILTPTSAPHASSITYSCHPLAKIYSLASRRFSEYRIVACCRGAFSNLHILGRDSRSNHPHLGDISLDTLASKIISGDLIWWCGRGIEKR

SEQ ID NO: 121235 - protein, 143 aa, Triticum aestivum
  unsure (1)..(143): unsure at all Xaa locations
  Clone ID: PAT_TA_15653.pep
MWRPQRRELEEHLKRRTRSAGAFDPGLYRRHSHSHHVPVLLGEVLAAFRRPLPLRSFVDCTLGAAGHSLAMMEAHPEMELHVGMDVDPSALAIGQRHIEAFLVSRATXEGGEDALQGTLRAYTHVKNFKYIKHVVGGVDESLA

SEQ ID NO: 121236 - protein, 127 aa, Triticum aestivum
  Clone ID: PAT_TA_15654.pep
MPCPRPAVLLSAAAWLWLFLSAAGALADGGNGTVCLCTGPQCVPPCPVPGTTPPTTSPTQFPFCPQRPPAVGPFPWEQQPPASPRSVSGFPQDAGFLAAAAASPTRNPAAWLAVAAVCSALLLLLQQ

SEQ ID NO: 121237 - protein, 183 aa, Triticum aestivum
  unsure (1)..(183): unsure at all Xaa locations
  Clone ID: PAT_TA_15655.pep
MRTFIILALLAIVGSTVTTAPRGPVPQXHPLNPSHXQAQEQVALVQQQQFLGQLQTFPPQQPYPQPEPFPXQQPYLXLQRSSQSXLPYSQPQPLRPRHPYTQPLPLDWXRQQQILHDQLEQQQHHLLQQHEQLCLKEILXQHLIPCMDVGLQHRIISHGGSQDMHQSTQQLLHELCCHHLWQM

SEQ ID NO: 121238 - protein, 63 aa, Triticum aestivum
  Clone ID: PAT_TA_15656.pep
NLGPKTKNLVVGGGLKGFVFGVYNNTMKAVGSTNKLQVAIDKFKNLKKKEAETTPAENPSTQG

SEQ ID NO: 121239 - protein, 170 aa, Triticum aestivum
  unsure (1)..(170): unsure at all Xaa locations
  Clone ID: PAT_TA_15657.pep
MLRSGRPAVATAAALLLSPAPRLHRRFLSLTATPYPLYYDLLVHRPVKPPKSTPSDADAAQPALDRAQRKYLRKRRSRQLPDPDATTGTKPTTTSEMVELRPEVVDFPRLHAREEALYFHDAFAMPWEKDKHYRMLYRLEKKYFPXQSLDNAFVAXDAAAPAQPPSDAXL

SEQ ID NO: 121240 - protein, 247 aa, Triticum aestivum
  unsure (1)..(247): unsure at all Xaa locations
  Clone ID: PAT_TA_15658.pep
MHRHSSAQEAQAMGSNGGGAKPPAWEFHTTGPRNLSSPGRSAWKNPNYRRIAISCLVQAAYVLEFDRQENRTGETAIAPNWWKPFKYKLVRLLIDSRDGSIYGALLEWDQVAALSDWIMRRPVGAPKAVLALRGTVLKQSTVARDLEDDLRYFAQESLRGSVRFAGALEVLKSAIDKHGSNNVCVXGHSLGAGYALQAGQAVPXARVLAVPRLVSPPSVSLGLCLRKLQDKVDKVLKRYISGSSSNA

SEQ ID NO: 121241 - protein, 153 aa, Triticum aestivum
  Clone ID: PAT_TA_15659.pep
ERERERERERERERERERERERERERERERETERLRWCCRPPARWPTAETARCACSTAQNACRPAPSLGRRRPRRGPRCAPCDQSGRTRRCPSRGSSSRRRLRSGVRGSHRTPAYSRHVRPSPLSNSAAWLGGGPPCALLLVLGSASLVAFLA

SEQ ID NO: 121242 - protein, 139 aa, Triticum aestivum
  Clone ID: PAT_TA_15660.pep
REIERERLGEAPKPCSSPLAREAAPNPLPTPKCPPVSSIPLPTFPKCEPPDPRAPPHQSRMHGGRARRCCGWTIPARKPYTREWGMSTGRENLNKIRRRSKNRPHPGFFMRPTRRSRHRKTSLSMGAGIQSNNVSGGPG

SEQ ID NO: 121243 - protein, 105 aa, Triticum aestivum
  Clone ID: PAT_TA_15661.pep
YFTASLKPDWSGLTSPHSEELRHRSQPCKHPPMRVGPRPVQGILLRQGTCRCLRDASSDKSEAHCTIVIIEQRATVVHEADVVRGWLPWPRWWFVGLWLDLRGRE

SEQ ID NO: 121244 - protein, 152 aa, Triticum aestivum
  unsure (1)..(152): unsure at all Xaa locations
  Clone ID: PAT_TA_15662.pep
ARDGVDRISRLPVGILRNIVSRLPAKDAARTTALAKRWRRVWHSVPLVLVDAHLXPTAASWGAAAGPPSSARWASSPGTPAYNVSHXLAAHPGPFAFVYLAGNNMLYHPDKLELWLKLLAAKGVKELVFVNLASKFDDELPIPAELFKCTAL

SEQ ID NO: 121245 - protein, 73 aa, Triticum aestivum
  Clone ID: PAT_TA_15663.pep
ARPGQARPGEASERARVVFPFSSHTPLRVVERTHYIKRSNSSSTSKVGLNLAPPLAILHMGFEISEIAMGLAH

SEQ ID NO: 121246 - protein, 113 aa, Triticum aestivum
  Clone ID: PAT_TA_15664.pep
MHAVLTRTYTVKVKTSCALPARIVDSDSEAFGDAYRNEAYGARLPSAQVGRAFERCGTDSLRVYGVCGYCVCYLYLRRSIRDGWTHQWVQNTESCPATGEMSDIYISEHPLRT

SEQ ID NO: 121247 - protein, 175 aa, Triticum aestivum
  unsure (1)..(175): unsure at all Xaa locations
  Clone ID: PAT_TA_15665.pep
TLKRTVDRENQWRTSGTGSEESSSTNMSKKEAQTDHGKLERSTKYRLILILTMVFCQNDQSVSGSGTVGLRSPKAFKVYQAGPNHSSKPPQQFSXSQNMYISGTVVRIQSEDADTPRSSRSRCGTLEKTSKATLEDSATNLAEASAAIQAGFKKGYARERPAPNKHEEESREPRF

SEQ ID NO: 121248 - protein, 103 aa, Triticum aestivum
  Clone ID: PAT_TA_15666.pep
MASPLPFHILRFGDLLEETAPTCRRHAPLDACASGQITYMAPSCREHTASLTDFGGVGDRYTSNTGAFRKAGDPLFQNSRQGRWDGLPLTSPPHPLDLHPGPL

SEQ ID NO: 121249 - protein, 173 aa, Triticum aestivum
  unsure (1)..(173): unsure at all Xaa locations
  Clone ID: PAT_TA_15667.pep
CNRTRSRPRRCTQRRTTSTYPALSTISWGLHNYLYRLNALCNWMLDKLAGALXSNHXSGAHKIRECLPMILILRNRLXYALTYRDVQSMLMQXHIMDDGDVTTVKTYPAGMMDHDXIPNTAENYRLFYDTNGRFHLHSVMDEDAKIKLCNVRYTQFGQXGIPYLNTYDGRTIL

SEQ ID NO: 121250 - protein, 89 aa, Triticum aestivum
  Clone ID: PAT_TA_15668.pep
TCFSPFMTPHTMDHGTSSRTSCRSSPRVCGTHSYQQQHQSSIPQQHLRHQYRQHTREPCRSLSISLSLSLSLSLSLSLSLSLSLSLSLS

SEQ ID NO: 121251 - protein, 555 aa, Triticum aestivum
  unsure (1)..(555): unsure at all Xaa locations
  Clone ID: PAT_TA_15669.pep
VPRRFPRAYRAPARIPVADKTELPWNFELFKMPRRTEDAEPALPKECLEFDDNEEEEVEEEEIEHVGPGRVLGAQGEEAATAAVAADDAGVEGGPVGWGVRAGAGAWRDRHRKSEAVPLPQQDGPRDGSDKEKHAELLALPPHGSEVYFGGISSDASSDDLKKLCEPVGEVVEVRIMLSKKDSRGYAFVTFRTNDLALKAIEKLNKATFKGKKLRVSSSQAKNKLFVGNIPHSWSFDDFKKAVEEVGPGVLKVDLIKDPRTDRNRGYGFVEYYNNACAEYSRQKMTAPNFKLDTNAPTVSWADPKNGDSASTGSTSQVKSVYVKNLPKNVTQGQLKKLFERHGEIIKIVLPPXSKDGHDNRYGLVHFKRPPTWAMKAVKSTXEKYELDGQPLDCSLAKPPADKKDDTVSLPTAKAGPLLHAPLGYGMPRPDPYGAPPAYSAPPAYGAPPAYGGQPLLYAPGAPPGAAMVPMLLPDGRLVYVVQQPGAQQHFASPPPQVRQHQHFTSPPPQARQIGRHGGSGGGGGSGGSSRSGSGTKRPRGDDNNSSSRNRQRRY

SEQ ID NO: 121252 - protein, 191 aa, Triticum aestivum
  unsure (1)..(191): unsure at all Xaa locations
  Clone ID: PAT_TA_15670.pep
QIVYSRCRMAATTPMASMAISTIVVMLLSSAMAAHASGGGEKDNTSLVVEACKNISGEPFKVGFLPEFCASTLLSDHRSAEAKDCRDLALITVDILKVHAAAMVGKVDNMLRQGGRIXTKDKVAARALRLCRADYGGMVNTLQICHNIIQDFSRKGKHGPTPSELPECIEKTNHNIKDCTAEVCSTSVVGT

SEQ ID NO: 121253 - protein, 151 aa, Triticum aestivum
  Clone ID: PAT_TA_15671.pep
LYNAGQHFLKELVSLVSNDNDRCVAVIINLQKYSFGRFDSLTKTKTVKGLIAKIQNGQDCLHLVQNLMALFVDEGSVADEPSDQSQTTDENSEVGSIEDKELVGEGNADLLKSWVVNTIPFGLKNLKLTSKGSSLTDSEMIKCIEKNSGAD

SEQ ID NO: 121254 - protein, 224 aa, Triticum aestivum
  unsure (1)..(224): unsure at all Xaa locations
  Clone ID: PAT_TA_15672.pep
PPPFYASSSSATHLAPPPPPPPPPPPPPPLASVCLSNIPPPPPPPPPPMSFGAQTRHFAPPPPPPPPPPGLGVRGSIPPPPPPPPRLNGSAVAPPAPPPPPPKPSSSAPPPPPPPPXXXVQSFTTRPGAPPXPPPPPSTSYSTAPXPPPPXMTRSGAPPXPXPXXGARPGPXPXPPSSGAPAAPPPPPSTGGPTAASPTSTSAGRTRSTTTPSTSGRRRSPPPH

SEQ ID NO: 121255 - protein, 193 aa, Triticum aestivum
  Clone ID: PAT_TA_15673.pep
SNAAATAVASAHLSPPTSGAPRQDPANALVVPSAVPPTTLRVPGAVPREKKRWSFPLPRDGTNPTGPDRNGSGPDRISIHYSGASASGGITSRPPHGDGRPPAARQDLLPGRASQRRHLHGRALAPLPPTSASAPPSSSSSAQQPPDPVPLHHRALRRAPATSNKITPLATPPPRLAPGKTRSARRGLSWGHR

SEQ ID NO: 121256 - protein, 195 aa, Triticum aestivum
  Clone ID: PAT_TA_15674.pep
MKPAREKKSVVEEDQQGNGFDDLIPGFASSSPPKSRNTNDDNKKKPAVPASKSTASFVDDPFVVLERVSVPGSAYPSPGRFTDPLEDLDKSANAEGMNVDSAAAADSLFEDSSAFDQAPKSDPLFTSEMNGDTKDSHLQSKARESSSVQSSVKRNPASRSSLEDFGNGMAKPQSARYSDIHVDDSSERYSGNWYG

SEQ ID NO: 121257 - protein, 177 aa, Triticum aestivum
  unsure (1)..(177): unsure at all Xaa locations
  Clone ID: PAT_TA_15675.pep
PRRGEKKPFKKKIFGGERGEKLRQGVRKEGAAKQERGRVAVLKKEGGAVYRGLGERRGEQKEREMQERGRKNEAGGRPEMEXKRQKQEGRKKKGMDRGMQGNRKRDSEKDEMAIESMTGLGRRKEEGSVQGGEQKREKGKGREKERAEVKRALKRKRENFVRRSRGCEERNENKRPE

SEQ ID NO: 121258 - protein, 202 aa, Triticum aestivum
  unsure (1)..(202): unsure at all Xaa locations
  Clone ID: PAT_TA_15676.pep
MPGHALLSSMLLVVMAHLSRADGAVGTGKSKISAVFMFGDSIVDPGNNNNRLTEARANFPPYGQDFPGGKATGRFSNGRVPGDMLASKLGVKEFLPPYNGDDLELSDLLTGVAFASGGSGYDPLTSIPATATSSTGQLELFLEYKEKLKTLVGEEETTRVISEGIYFTAMGANDIANNYFSIPLKXINIDLPSYVNFLISSA

SEQ ID NO: 121259 - protein, 192 aa, Triticum aestivum
  Clone ID: PAT_TA_15677.pep
GLSIDPHLSLTYKAYNTMPAILAAMATARTTAAFSSAAIMLLFECVGAHAGGLGYKVKEVDLELETCKNASSTCRNTHLNDTQEYCLQTLRSHKRSSKAKDLRDLSLVDVHILKIHVAAVGGKVNEALQTANKGTDEALGLKCCQGVLRCPISSTLRSSATAMASGELSMDPQQADRRTRPGGPFRNLDPTC

SEQ ID NO: 121260 - protein, 81 aa, Triticum aestivum
  Clone ID: PAT_TA_15678.pep
MVAMSVGAVEALKDQAGLCRWNYALRSIHRSTKAKANVPGGASQVKKQLPASAAAVAERRRARKAEEGLRTVVYLSCWGLN

SEQ ID NO: 121261 - protein, 111 aa, Triticum aestivum
  unsure (1)..(111): unsure at all Xaa locations
  Clone ID: PAT_TA_15679.pep
KNIKKVTPEGSGGSLSFQKGGFPQIKIPATKAGGGPKKASSRYNALSLARFXHGEDGEACSXGAITSESSLSDSMTDSQVEDADKKDKEVQSKEQSSAQTDHNAEAERRGG

SEQ ID NO: 121262 - protein, 73 aa, Triticum aestivum
  unsure (1)..(73): unsure at all Xaa locations
  Clone ID: PAT_TA_15680.pep
MAEDGEEKLLATVQHIVQTLGSSDTMTGDILKVLXNYDGRLSLDKIYAERGAVVVAAGGGWGGGGGRERSIPT

SEQ ID NO: 121263 - protein, 121 aa, Triticum aestivum
  Clone ID: PAT_TA_15681.pep
DPSGRRGRRPPRPGTRPPSPHPPPARPLRRERAPLAQNSGRAGRRGSGHPYHPQPRSCPGRRGRRTRAVAPSGRRIRTCRRDRPARHFSGSDRWGRTCAAAGRRFSGSNRSRRTFAAEGKL

SEQ ID NO: 121264 - protein, 93 aa, Triticum aestivum
  Clone ID: PAT_TA_15682.pep
RTRGGDGGTTGRPASPQHQHITSLAAAVDRQLQTCATPPLLLLFAYCLSPRVRTPTRLLKICCLDAGVNTKNQQQNQYQKLTGMMHTAASIQV

SEQ ID NO: 121265 - protein, 102 aa, Triticum aestivum
  Clone ID: PAT_TA_15683.pep
SILPSCYWHHRHCSEFRPNASNITQPRQSGQDTLGRQPFHTTAIERPFHTTILSDHFTATIISSEPLTTPFTATTDRPTPFHTHTHTHTHTISQFAHTDLQE

SEQ ID NO: 121266 - protein, 198 aa, Triticum aestivum
  Clone ID: PAT_TA_15684.pep
QICQQAKHELHKPAGKLAPLPIPTAPWRDLTMDFVEGLPKSEGYDTIMVVVDHFTKLAHFVPLRHPFTATRVARVFWDNIVKLHGIPSSIVSDRDKVFTSVLWRELLASAGTKLLYSTAYHPQTDGQSERVNQCMEMYLRCAVHDTPTQWCRWLPSAEFWYNSSFHSSLGCSPFKALYGWMPTRAAWQHGRQHKHHCR

SEQ ID NO: 121267 - protein, 132 aa, Triticum aestivum
  unsure (1)..(132): unsure at all Xaa locations
  Clone ID: PAT_TA_15685.pep
DATAAEAAAAAPGVDEGERQGANGAGAPGGGAARRGGGPGPAAAAIRRDPAHPQGEGGGLVGDDRRQAALPPPAAPPQGRRGQAPETVPGADAAXGDQGPVHGAPEEAKEAPRPASNGGGGRPKLQEARLRR

SEQ ID NO: 121268 - protein, 87 aa, Triticum aestivum
  Clone ID: PAT_TA_15686.pep
YMSTHNPHHSSPTSTNSNHSPLPHHQNISYSNSTNTSKNITHHSNLTPNKKPHPRTAPQKLLPICLPPRYKKTKFPQTTISQTLQLM

SEQ ID NO: 121269 - protein, 179 aa, Triticum aestivum
  Clone ID: PAT_TA_15687.pep
NAKKKKNLGFVLRGPPLGFLRRLPPVDGSSAHASRDFRPLLRRWPGGAPEPIGLARTTAASGKRLAGSADRLSDLPDGLLHTVMSFLTARQAVQTCVLSRRWEDLWCSMPCLNIDEREFRTSASDSEDEDEAGPDCARFEDFVINLLMFHSAATLDMFRVHTVSRRKIKFADQWLRRGI

SEQ ID NO: 121270 - protein, 95 aa, Triticum aestivum
  Clone ID: PAT_TA_15688.pep
QISKPRHQVFRRWLLRSPVPWSCTYSYWHSLCIQMQGVVHNTQLRIQIASVELTEPVLNVAMPKATVMEYVHPHANALTADLNPVLMNVQKNSEP

SEQ ID NO: 121271 - protein, 190 aa, Triticum aestivum
  unsure (1)..(190): unsure at all Xaa locations
  Clone ID: PAT_TA_15689.pep
KSPPTHNKTKHPTPSHTHKPVPLYTPTRANPTPQHTPTTTTKTTPHKSPHNNPNPTHXQTKNQTQTHTTTHHIHNTPNTQPNNTTQQPPQHTRRTTKHSQPPHHKPTSNQTPHKQQNKTTQNQPHQTTPQPTTHQPTXTIHQSTKQQPKNTNKTSPTPSNNNTPTNYSNPPEQPTPCLGSAPLKNRECAN

SEQ ID NO: 121272 - protein, 107 aa, Triticum aestivum
  Clone ID: PAT_TA_15690.pep
ESTIFSWTHGVLHTSHVQKEHKFSLPSAGSKLGPKGKTHFFFNTIRHWFSLQSQSRINFVVLEGTNRGFNGRKTLCDARDNIGFWWANSFLLPGVGNKVLGQTWVLG

SEQ ID NO: 121273 - protein, 434 aa, Triticum aestivum
  unsure (1)..(434): unsure at all Xaa locations
  Clone ID: PAT_TA_15691.pep
AAAPRPPARPPRHPPLLFPRLPPPRPPPPAPRRSPRAPAAAAPTRSRTARPAAAAAAAAPAALVLRLLHPPNLRAALAALPPPFAHLSYLPFALDPQPPGPRLFCRACGPGSLCVVFLLLPLAPGYALCLGRFGMVGKHIXRLGLGGGXLRGPESLGIVVGIVYLVIAILFQHFNFTAXSIRLVEYNASXASVCFMILPGFMDDNLXAKPILGPIQGSLAFFNGNSLSFGGXSIIIPKPLASYVGVEVLELGWMYKLFMLLLAVFCTNSINIHAGLNGLEVGQTVVISAAVXSTWLLNFVHHSSTDDCSIFQVLIHNVMRIGSSKDLETQQAHAFSIYLVLPFLTTSLALLGFNWYPSSVFVGDTYTYFAGMTLAVVGILGHFSETLLLFFLPQVLNFLCSVPQLFHFVPCPRHRLPRFDTQTGLLTGTKDGXL

SEQ ID NO: 121274 - protein, 168 aa, Triticum aestivum
  Clone ID: PAT_TA_15692.pep
MKTFVILALLAIVATTATNAARDPAPQSQAQNPSQQQPQEQVSLVQQQQCIGQEQPFTPQQPYPQTEPFPSQQPYVQLQPFSQPRLPYSQSQAFGPQRRYAQPRPQYSQPQRPYAQEQQQQQQRLQQQQHQQREQQMLQQIVQQQLITCMDVVLQQHNIARGRSQVLQ

SEQ ID NO: 121275 - protein, 141 aa, Triticum aestivum
  unsure (1)..(141): unsure at all Xaa locations
  Clone ID: PAT_TA_15693.pep
GVRGAHRSGGQYPTGQPIQHPQGSLPPIRPDATRLRDATSALQELTFSPQGQRPLVHPAASLYLRGTPDDSAQVTADVNTGXHCIEKTMTXGKEYCERKINLLKSNFDELLEMATKKKSIADEMGMFLQAKLRQASPSSSS

SEQ ID NO: 121276 - protein, 111 aa, Triticum aestivum
  Clone ID: PAT_TA_15694.pep
GLRAILSPPMWGYILGAQQKLFSHSFSTKNESSNYIFATIENSPPGIMRGIHAPIIKVQRVSQNVPEISLKEPCLAPSTKVALYFVQPIILTQVVPVIEAYCNCGSNPQAF

SEQ ID NO: 121277 - protein, 181 aa, Triticum aestivum
  unsure (1)..(181): unsure at all Xaa locations
  Clone ID: PAT_TA_15695.pep
SPSNWLQQGKSSHPPLARNGGRRRPYLRPFFFDDEAGPDEEAEXDRSKQALDVVPRHPGVDHHQVPQRLPAHLGKTGRRRRHHQPLPSRSPSFSCPCGGRACEIWRGRSPCRWDGLAFRRCGAARLLRASVSSKRGSGAEERGRYRARAGGRGRGTKTTKRLRRRRRREGSGGEGGERERA

SEQ ID NO: 121278 - protein, 155 aa, Triticum aestivum
  Clone ID: PAT_TA_15696.pep
PLLFLPPAPPCPAPVQGQPHTAVISPPRPLPSSPPMGRRRQGRRAAPAPSAPPEPSPSPSAPSSSRTPGRPRPRRPTGSRSPPSPAPPSACSSPPPPLRFLRASIWYLHSSPSPPLTHPLAMRVGALFGQPLGLGPGRLVSSRNKVGSPFEAPLR

SEQ ID NO: 121279 - protein, 377 aa, Triticum aestivum
  unsure (1)..(377): unsure at all Xaa locations
  Clone ID: PAT_TA_15697.pep
MDGKGYTTPPTAPAPQAEAGAPPHSYPPTEHGKDAAAPQPGSQVSYPSMEHTMDGLDATAPQPGAPPHPSSPLTQQAMEMEGKYAAPQPGTGAPPPSSSPLAQQSMDGKDAAPAPPADAESAKWGTRQMGPPAAPGAHPENQQAAQWTASRGDQELPPYVXIMGGPEPAPAASARRTDTETKDSPMEHILDFFNVWSRKAEELSSNIWLNLKTAPSMSDAAMGKLSLGAKAITGGGFEKLYKQTFASGPDEHVKKTFACYLSTATGPVAGTLYLTNMNVAFCSDRPLSFTAPSGQTAWSYYKIMIPLAKLAAVEPVTAKESPPEKYIHIVTVDSHDFWFMGFVSYDKAVHHLGGAVSSSQHHGAAPAAAPAPAPTYE

SEQ ID NO: 121280 - protein, 141 aa, Triticum aestivum
  Clone ID: PAT_TA_15698.pep
MGKSKGRASSSGLAASLLPDAQGAAVPAVGFGGYHGASRVEPAGLHPIPSDDPDAPTRLPPDVDTQVLQHLRTLGRKDPTTKLKALSTLCVLCTQEPADQVVQIDPQWAFEYKRLLLDYNREVRRATNDTMSSLVTAVKKG

SEQ ID NO: 121281 - protein, 73 aa, Triticum aestivum
  Clone ID: PAT_TA_15699.pep
FPFLSRASRRRRFWRGRREKGVETRSETRMLCSVCFVHCEMNNGRSFGMFFRDVNESFAFCRSYPYCSLDPSC

SEQ ID NO: 121282 - protein, 294 aa, Triticum aestivum
  Clone ID: PAT_TA_15700.pep
MRMSLLRSASQHLRRRRGYSSTPAQPERKVAILGAAGGIGQPLALLMKLNPLVSSLSLYDIAATPGVAADVSHINTRALVKGFVGDDQLGEALEGADLVIIPAGVPRKPGMTRDDLFKINAGIVKGLCTAIARHCPNALVNMISNPVNSTVPIAAEVFKKAGTYDEKKLFGVTTLDVVRAKTFYAGKANVPVTGVNVPVVGGHAGITILPLFSQATPASNALSHEDLLALTKRTQDGGTEVVEAKAGKGSATLSMAYAGAVFGDACLKGLNGVPDIVECSFVQSTVTELPFFAS

SEQ ID NO: 121283 - protein, 101 aa, Triticum aestivum
  Clone ID: PAT_TA_15701.pep
VVEAKAGKGSATLSMAYAGAVFGDACLKGLNGVPDIVECSYVQSTVTELPFFASKVRLGKNGVEEVLGLGQLTQFEKEGLEALKGELKSSIEKGVAFANAS

SEQ ID NO: 121284 - protein, 377 aa, Triticum aestivum
  unsure (1)..(377): unsure at all Xaa locations
  Clone ID: PAT_TA_15702.pep
PGDASSPAPRRQHHTSVSADASARGRPKSSYGEAPRVLLPRRRLHPPAADSAEPRQHPRGRGVVGSARPVAQPLQLLPRVYPLCLHACPSTTAAAAAASQPMSRTLVQGPVGDDXLGYASRGAALGFGPPGVPLKPGLLTEDLTRTSGAIATSFYTEIARQGLHTLVNMIGRRLDCRRRIAREVFKNPRAYDEQKLRSVTPPQMLSXRPFFLVKPNXPLSGVYVIGPVLFVGINRVARFWGVNSXSVASLHHLACPAQDAGALGEXTEVVGAKAEKGSATFLIAYAGTVFGDACLKCLNGVADIVWWYFVQSTVTELPFIASNXWRLGKSGVEVVMGLGELAXLGSMEGLDSLKGELLSSIRSRGSSARRRAEAANM

SEQ ID NO: 121285 - protein, 120 aa, Triticum aestivum
  Clone ID: PAT_TA_15703.pep
KKPGPAKFLVGNFCGQSIAGLMGLFNPQSLGPSGFGTHLPYKPFTLAAGFCKLVPGNKAGLGKLNSRPKGKGPHGGCTGSPPGSLATVAGFRGNSPPCPPTLCGGSPLMYDFTSGKAKFP

SEQ ID NO: 121286 - protein, 84 aa, Triticum aestivum
  Clone ID: PAT_TA_15704.pep
MKVKILQWHAVASWTWDAQDETCGICRMAFDGCCPDCKFPGDECPIIWGACNHAFHLHCILKWVNSQTSTALCPMCRREWQFKG

SEQ ID NO: 121287 - protein, 161 aa, Triticum aestivum
  unsure (1)..(161): unsure at all Xaa locations
  Clone ID: PAT_TA_15705.pep
GFLGLGMTRKAVARKLLRLCFRRTGRHRTLGRXDELVATGAAAGDTPTDDVPXCRYTEALLYDHSXRLSPVPPHGSCARPMLQGPGYVHMPTAKAATACKIIDAGIREGLPSVAASSSGTTIPWVEAQWPILGGRYRGTNEDVVPVYTVLWKETNGCSSTQ

SEQ ID NO: 121288 - protein, 125 aa, Triticum aestivum
  unsure (1)..(125): unsure at all Xaa locations
  Clone ID: PAT_TA_15706.pep
MEAAEQIAVVWKQVRGPVIVPLLRASVMVCLAMCVILFVEKVYMAVVIVAMRLIGRRPERQWRWEPLRDDDPELGNAAYPMVLVQIPMYNEREVYKKSIGAVCXLSWPSDRSSAGRLTEPHQELC

SEQ ID NO: 121289 - protein, 200 aa, Triticum aestivum
  unsure (1)..(200): unsure at all Xaa locations
  Clone ID: PAT_TA_15707.pep
FPPQQPYPQPQPFPSQQPYLQLQPFPQPQLSYPQPQPFRPQQPYPQPQPQYSQPQQPISQQQQQQQQQQQQQQQILQQILQQQLIPCRDVVLQQHNIAHGSSQVWQESTNQRGQQWCGQQRGHIPEQSRRQAIHSVAHAIYXYKKPPPPNKNHHHHQPXRVRAMSLSQSSETLYXIGDSFFQPSQQNPQAQGSFXAQQLP

SEQ ID NO: 121290 - protein, 151 aa, Triticum aestivum
  unsure (1)..(151): unsure at all Xaa locations
  Clone ID: PAT_TA_15708.pep
ESRGGLLGKRCRKLPFLVWLGPRNGEEDAAGHCRARRRVRGRVRRRRRRPWALAAQRPRRGGGAGGDQPPQQDCQFHVGRPTGNLVXQHGLGPPDGKFGMGKNGWPGGVALESGILFGGGRSILGKVVPGGGRFGWGRARGKSFLVAPDWF

SEQ ID NO: 121291 - protein, 50 aa, Triticum aestivum
  Clone ID: PAT_TA_15709.pep
LIISGPISLISSVTNLHTNRSGHYHFVANTLQVLMPKYCNTVVQAQSKNI

SEQ ID NO: 121292 - protein, 161 aa, Triticum aestivum
  unsure (1)..(161): unsure at all Xaa locations
  Clone ID: PAT_TA_15710.pep
KVLEDFPWVHMPFEWLVQLTPPLKKRAFSVSSSPLAHPNQIHLTVSVVSWLATPFRRKHGLCSTWLAGLNPNEETRVPCWIHLGSLPPPDSSTPLVLIGPGTGCAPFRAFVEERAAQRARQPTAQILFFFGCRNEDDDFLHRDFWSHHAQDNRVLSLKEGX

SEQ ID NO: 121293 - protein, 118 aa, Triticum aestivum
  Clone ID: PAT_TA_15711.pep
RASIAALDEALTSARCSGGEHPIVTLVDGEEGFIVQHPAAGDGGFHRSPGGREALHWSADECSIAVSGGGASKLSVIAVPATAPLHRRGRSIAAPPPQDLQRWPVGEKTWSGLKGDHA

SEQ ID NO: 121294 - protein, 185 aa, Triticum aestivum
  Clone ID: PAT_TA_15712.pep
MKKFLVLALIVIAATTTAAEPFTAFRIASEPQHPSSPEQQPTLQPQEHPVPHQKLNPCRDALLHQCSPVADMSFLRSQVVQHSSCLVMWEQCCQQLKAIPKQSRCEAIHNVVHAIILQQQKQLVQGTFTQPQQQQPPRSTRTWVRLSQAQQPHTTGNLNKGWIVGRLGTWGDFRTGSRAMVRTVA

SEQ ID NO: 121295 - protein, 145 aa, Triticum aestivum
  unsure (1)..(145): unsure at all Xaa locations
  Clone ID: PAT_TA_15713.pep
VQQQQFLGQQQQHFPGQQQPFPPQQPYPQPQPFLPQLPYPQPQPFPPQQSYPQPQPQYPQPQQPISQQQAQLQQQQQQQQQQLQQQLLQQQLHACXDVRLQQSHIXHACSQASQQSHQLVDYYDLSNWRRSRSSRADQSCSMQSW

SEQ ID NO: 121296 - protein, 98 aa, Triticum aestivum
  unsure (1)..(98): unsure at all Xaa locations
  Clone ID: PAT_TA_15714.pep
MVAHVDPLPADTDNADAMDMFTRNIAADHALXTNDPTNGWEIKPYIGDAEPYIQIAGRARDLLNLVMTDADTPTWTTRNGTDWLRSVVDNLPDGTDTS

SEQ ID NO: 121297 - protein, 140 aa, Triticum aestivum
  Clone ID: PAT_TA_15715.pep
WVGGCAACLVCQFSKVLSYFRVRAVVWTGRRWSGPDRTEQHDGPDFWDRTGDDEARAGPSGPTNGHRRRGVRRAWLLWRGGSHARAPAARCALGGATVINELRALAIVVANHEPATLTPCTHGTCRSKRHARITHERCPF

SEQ ID NO: 121298 - protein, 128 aa, Triticum aestivum
  unsure (1)..(128): unsure at all Xaa locations
  Clone ID: PAT_TA_15716.pep
EIFTLAQNLDDAMADATSPDGELSGGAAVDDVMPKLARQPVPRQQTASXQALPVLCCRCCAEPIGAGTYDARPDTALRAWGPFETRKGARHTSARGPERLWNYGSPDLLITPRAGNRVHREIMNTKVA

SEQ ID NO: 121299 - protein, 235 aa, Triticum aestivum
  unsure (1)..(235): unsure at all Xaa locations
  Clone ID: PAT_TA_15717.pep
VREIYDIVVGIGELMVTTETESIRQQCMQILLQFFLNYPLSGKRLQQHIDFFLTNLKYEHASGREAVLQMLHDILTRFPQRIIDDQGQTFFLHLVVALANEQHQKVSSLIVTAIKKLLGRIGDQGKNSIFEYSLSWYTGEKQNLWSASAQVISLLVGNRSLGIXGKHLESILAVAKRIMESSCTASXGGVQLDLTXETDLPFWXKEAYCPILMMXNLLGHFPELYFKTKYRRRYG

SEQ ID NO: 121300 - protein, 124 aa, Triticum aestivum
  unsure (1)..(124): unsure at all Xaa locations
  Clone ID: PAT_TA_15718.pep
ITASVRSTXGEVSLRPRPAQMVGGELTSIAAIDRRRRRGPQRRRGITAGRAGPRTHPPPANIHQHGPRSRPVACSRRPPARTHPATPVPDPTMTSQIRPSCTPMPERRLRAAHLRRSRMDLFLF

SEQ ID NO: 121301 - protein, 149 aa, Triticum aestivum
  Clone ID: PAT_TA_15719.pep
KRDKSILNRARWTARKLLSRMWVHECRIWLRMGRSRTGVRRRVLGGGQWLHVTGGHARTMLMDDRWAVLSSMATSDSGDAPAALRCSTSTSVYGGDRGQLPSKPSERAVAGGLDFSQVLIATEGCGFIAGHGITPSFLLVAECKPGAHA

SEQ ID NO: 121302 - protein, 145 aa, Triticum aestivum
  Clone ID: PAT_TA_15720.pep
YALRSDCRSIVVRANPPPRLRPPPKPWALTVADDTRASACEVAVRPGFPSRGSNPLSRANCPCREDGPGKSPAAGACGPAVVSGGATRGRRCRGSVLSPAPFRFLAISPRSIEQLRKNHTGEGESWKEGRKLRMSGRVGGRVGGR

SEQ ID NO: 121303 - protein, 88 aa, Triticum aestivum
  Clone ID: PAT_TA_15721.pep
MKKFLVLALIVVAATTTAAEPFTAFRTAWEPHHPSSPEQQPTPQPQEQPVPHQKLNPCRDALLQQCSPVADMSFLRSQVVQHSSCLVM

SEQ ID NO: 121304 - protein, 312 aa, Triticum aestivum
  Clone ID: PAT_TA_15722.pep
MDPMDIVGKSKEDVSLPKSTMTKIIKEMLPPDVRVARDTQDLLVECCVEFINLLSSESNDVCSRDDKKTIAPEHVIRALQDLGFKEYVEEVYAAYEQHKLETLDSPKATKFTGIEMTEEEAVAEQQRMFAEARARMNNGAAKPKEPALEPQNQPQQPPQPHLQLHPQAQQPPQPQPQLHYPQSQQPLQPFTQAPPQQPLHPQLQQYTQAPPQQPLQPPLQLYPQAQPEQPLQPQSSGSTTGTCVISAAAPSATGTLLLQPPPQQSPQSQLQLHQQPQPTLVPPPQPQPQPLELQQPQPLTQLQAEHGLDWDS

SEQ ID NO: 121305 - protein, 154 aa, Triticum aestivum
  unsure (1)..(154): unsure at all Xaa locations
  Clone ID: PAT_TA_15723.pep
PIAIKFKEMLEAQKKAALENEMPVGPMPLPRADGHISYGGALRPGEGDAIAQYVQQGKRIPRRGEVGLSADEIQKFEDLGYVMSGSRHQRMNAIRIRKENQVYSAEDKRALAMFNYEEKSKREHKVMADLQRLVSRTIGQXTGPSHDPFATTDD

SEQ ID NO: 121306 - protein, 61 aa, Triticum aestivum
  Clone ID: PAT_TA_15724.pep
MRNIYLQWLLIPNSPGQKMHIMVSFVHNEYNLAYEATIGVEFHTRTLVIDHNFVWTQICYT

SEQ ID NO: 121307 - protein, 170 aa, Triticum aestivum
  Clone ID: PAT_TA_15725.pep
IYSRIPSSPILLCLGLRERLLLRRCGIPPQPIAVAMAPLPSPRRDTLPVRYELLRDFVFAPMASTCATSAGFAPRWKVAPVMVVVHQPDFVREEEVDRPDPDPPCTIAVPLPQCSSRCAATRILVISRSNLRLAFSSQSMTPPLFKMGSPSDLEQLSPSPSRMAWRARTA

SEQ ID NO: 121308 - protein, 107 aa, Triticum aestivum
  Clone ID: PAT_TA_15726.pep
AAGGSMVHPNVPCMLFTPICPHSLSFRPVILPDSARLELKIPDDARSNAWVSFDGKRRQQLSRGDSVHISMSEHPLPTVNKSDQTGDWFRSLIRCLNWNERLDQKAL

SEQ ID NO: 121309 - protein, 77 aa, Triticum aestivum
  Clone ID: PAT_TA_15727.pep
KLVKKIGWVHPRGKKKEPFSKGPKGPIYLGPKNIFHLEKEKTPGFFFPSPIKAHFFLKQWVFLIPGPKSHLKAIFLE

SEQ ID NO: 121310 - protein, 83 aa, Triticum aestivum
  Clone ID: PAT_TA_15728.pep
TTTQQPGCSSILLSTSSRVSTPGQTMSRSLCVAMSALGYVIRVSWLTPSALVSLGAHASLPARTQFARPPVGVRGLMENARQM

SEQ ID NO: 121311 - protein, 82 aa, Triticum aestivum
  Clone ID: PAT_TA_15729.pep
MADRGGERGVGERGGFGRGFGRGGRGDRGGRQCCSPRAPPNLLLLLSSSVFFFYVFDHQTYVAPLPETLAHRSEHARHAYGP

SEQ ID NO: 121312 - protein, 254 aa, Triticum aestivum
  Clone ID: PAT_TA_15730.pep
MAAVAAARAGAARAGFRRMFSVSAFAPPPPPTARPAAEPCNNLFVSGLNKRTTSDGLREAFSKFGQVTDARVITDRISGYSRGFGFVRYATVEEAGAPTTVRSAAFATDSSRHHTWRRSQHRAGAARAGFRRMFSVSAFAPPPPPTARPAAEPCNNLFVSGLNKRTTSDGLREAFSKFGQVTDARVITDRISGYSRGFGFVKYATVEEAGEGIKGMDGKFLDGWVIFAEYAKQREAQQPPQSAGTQSSGYQYPS

SEQ ID NO: 121313 - protein, 141 aa, Triticum aestivum
  unsure (1)..(141): unsure at all Xaa locations
  Clone ID: PAT_TA_15731.pep
GPFAPPRGQRRTRWRRPPPPRHPPSPPSPTPKPYPPPPPPEAHPLAPSLRPPPTPHAPYQXRAPAAVRSPPWSPPRSTTAPTCRRSGNTAPSATKSTVSRGRGTHELHYGGGPPTALPFRLGLEGTFTSRGADKRTSFLAL

SEQ ID NO: 121314 - protein, 316 aa, Triticum aestivum
  Clone ID: PAT_TA_15732.pep
LAGRSLGGSSDECHWADGFPFNLHIYQMLVEACFDSENGTVVDEIDEVMGLLKKTWVILGINQMLHNLCFTWALFNHFVTSDQVDIELLSAAENQLNVVVKDAKNAEDPDYCDVLISILSSITGWTEKRLLAYHETFNASNIVSMQGIVTIGVSAAKILLEDISQKHPVRRKQKTDVVRGKIETYIRSSLRTAFAQRMDEADSKRSSRNPVPVLAILAKDISDLASKEKNIYSPILKKWHPLASGVAVTTLHSCFGNELKQFMVGRTKFTQDTAQVLNAADKLEKSLVNNAVEDFLDSDDGSKSLIRQMPPYEAEN

SEQ ID NO: 121315 - protein, 284 aa, Triticum aestivum
  unsure (1)..(284): unsure at all Xaa locations
  Clone ID: PAT_TA_15733.pep
RRAVLARPTAAAALLRHAPAGARFSSLADCRALVRGLRDISEYLRAEKDTFSPLRRPLASDSLRATHDGEIVGVLNSVIQSHHRDLIRGIPXGLPFEISKTDGIPDITLTRSLKGEXIEVLVSMHQDEECNVGLQEDSNQEXKAETSPEEYSFPVRVIVSKADGSSLEXQPAQLNPDNIVIETLSMRQKKSTGAEEADDVVASEGTENDLAVYDEGPHFHELDKSLQEAFHKYLEVRGVTPMTAKLLRGHMMSEDSHLSPKEKSDVRRRRLVWLLKLWDFVKKD

SEQ ID NO: 121316 - protein, 100 aa, Triticum aestivum
  Clone ID: PAT_TA_15734.pep
EPQEAGHGGPLQGDDLLRDSEPAVPADCCCRATRRPRSSTSLVTSLGQAAPTTCLGSPIPRHMQAQRRRHGAVPQDRQRQHYKAVSPPLELDSSPATTTT

SEQ ID NO: 121317 - protein, 148 aa, Triticum aestivum
  Clone ID: PAT_TA_15735.pep
MHAPGEPGDLPYAVGCPAFTRELRQVQWPSKKNFKPDVPEKYDGKSHPSEFLSIYTIAVQAAGGRDDKILANYFPLVLKPNVKSWLMHLPDDSISSWADLCHQFVSAFTGGHKPHGQESDLHLLAQKEGEPLRKYIQRSAVYSTTSQM

SEQ ID NO: 121318 - protein, 172 aa, Triticum aestivum
  Clone ID: PAT_TA_15736.pep
LSPKLWYLRLSVIQAQDLRLPSPPDAAKAKQQHFGPTFPELYVKAQLGAQVFKTGRIALGSAAAGASNPSWNEDLLFVAAEPFDPFLTVAVEDVFSGQLVGQARVPLSTVHRRSDDRVEPPSRWLNLCGDEARPYAGRVHVRVCLEGGYHVLDEAANVASDVRAASKQLSKP

SEQ ID NO: 121319 - protein, 482 aa, Triticum aestivum
  unsure (1)..(482): unsure at all Xaa locations
  Clone ID: PAT_TA_15737.pep
MSMNLLKRVDECPSGLEMDLSSLSSDTRGGIENQPIWVTRLHIQAILTELDFISRIFEDVAHNLRFVLLAHKAPLNALVRCSKRNEHLHWLMKHKDLLCFEARRNSVLMLFSEGKXTMGELHEMLIDPSRLLDESFEYITQAKPSELHSGLFMEFKNEEATGPGVLREWFCMVSQALFSPQQVLFLPCPNDQRRFYLNGTSVVDPLHLKYFVFSGRVIGLALMHKVQVGIVLDRTLFLYLAGRSITLEDISAADPFTYASCKRILYMGAAEIDDLTLTFSRDVHTLGSRKTIELCKGGQDISVNISNREHYIDLLIKNIFVDSISEQLANFAKGFGDILANPKLREVFFRVFXLXDFDRMLGGXNNTINLKDWRSHTPIXNGYKEKDRHVNWVPGAVESMTVEQQRQLLFFWTSVKYLPSEGFGGLSSKLYIYKTTESADHLPSSHTCFYRLCLPPYPSLKVMQSQLQKITQEHVSCSFGTW

SEQ ID NO: 121320 - protein, 145 aa, Triticum aestivum
  Clone ID: PAT_TA_15738.pep
PSLQYTSFSVYFSPPPSQRFSTSRLLASPVVMVAMPRTTIVLSTIIFFLFSAHASGSDTGKPKATKLMVEACKKASINNPCNKSITQEFCLSTLQSDNRSAEAKDLRDLVLVTVDIFKSRVTAASRKIKQKLQDAKKGTSGNARS

SEQ ID NO: 121321 - protein, 156 aa, Triticum aestivum
  Clone ID: PAT_TA_15739.pep
MKPMVRSNSGGGSDRRGWLAWRKTKCGKNSNMPKQPPSAFFLFLEDFSLEYKLEHPNVKVSSVINKAGGDRWRAMSDADKASYCVMAEHRRAEYAKAMEAYNNPGEPGQHEVAHKVEPADVMYNQGEVGQREVVEHDALAPSTTTRSSLRMRCRMV

SEQ ID NO: 121322 - protein, 172 aa, Triticum aestivum
  Clone ID: PAT_TA_15740.pep
GAPALDPHGAPPLSPTPPSFLFCASVVHPRRPAASPASSSSASLPIPVTRAPEERSPSSTCTRNHRPPRPAGGPRRSPLIADLPILASPTSSPGPCLPDPASSSLGLPHDQPPRRQPDEPPEVSKSPCLDPPFAPLLPLSLLLDSIPLCFPTEEFICRHGASPPARIRHPES

SEQ ID NO: 121323 - protein, 75 aa, Triticum aestivum
  Clone ID: PAT_TA_15741.pep
STMARSHNNHYSSRHTRHLRILSKHTPMNDNKILRKRSESQLQYPESQHHDDHDSCPDEDDDYDDDNQNRPMTMT

SEQ ID NO: 121324 - protein, 377 aa, Triticum aestivum
  unsure (1)..(377): unsure at all Xaa locations
  Clone ID: PAT_TA_15742.pep
MPAAQHIERDQDLAMSSDELLQAQLELYHHGLAFVKSLALKAATDLRIPDAIHRRGGAATLSELASDTGIHPTKRSNLRRVMRVLTNTGVFSTVTQPSDSTKTAGDGAAYYKLTRVSRLLVERSPHNLSPMVGTIVNTLCWTSLLKMPXSGLLNGQEGDSAQSHSLVQLANGCTFWDTTKVDGGLFNDGMAADSRIAMKVLLNEHGRAFGEVKSSLVDIGGNHGATASAVARAFPHLKCTVLDLPHVVAAAPASDILTFVAGNMFEYVPPADAVLLKWILHDWKHEDCVKIMRRCKEAIPAKEAGGKVIIIDMVVGYPVTQPNHSKEAQVLLDIYMMGSDGMEREENEWSLIFSEAGFSDYKITPTNGIRSIIEVYP

SEQ ID NO: 121325 - protein, 125 aa, Triticum aestivum
  Clone ID: PAT_TA_15743.pep
RRRAPNPSLDPRPPRFTMALCSLAARMRVPAAAAAAAARLPSAPRVSPASGSRALPFSSSSSKSARDWYLLQRERYDSVTRELKNYSREVVWTERLAKLLNVVYVLGMPFIVGPLVLKGIAIRRM

SEQ ID NO: 121326 - protein, 160 aa, Triticum aestivum
  Clone ID: PAT_TA_15744.pep
SSPWLTALGITLTPLPSTLPYPYTPATTLARRGAGGCAPSTAPVTSRAGRKGTTRASVPPSPSCSTAAARRTVPRLCSHAGAASCADNTSTLLVYMPCSSSMDACMHGWLKINKSHFDRVGASWPTAMGSPPGLWRFCWLCLTVLPPLVVGLQLPVISHG

SEQ ID NO: 121327 - protein, 260 aa, Triticum aestivum
  Clone ID: PAT_TA_15745.pep
MAMDAERRQAELIEQFSAQAAALSSAPQLAALVLEATSHPALFAFSELLTLPALSKLTGTQYASSLDLLRLFAYGTLKDYKSNSSALPALLPDQARKLKQLSVLTLAESTKVLPYDQLMQELDVSNVRELEDFLINECMYSGIVRGKLDQLRRCFEVQFAAGRDLTPDQLTNMIETLSDWLGTSDNLLHHIQEKIKWADTTSELNKKHQKEFEDRVEEAKKSVKADNDLRGHDDFLSESGGIMDFEEDRIRPKRRRQPMA

SEQ ID NO: 121328 - protein, 161 aa, Triticum aestivum
  unsure (1)..(161): unsure at all Xaa locations
  Clone ID: PAT_TA_15746.pep
GRVKKRSKTPPPPPRSPPSAFTPPPPPPRPPPLSSAASPRRLPPSPDTPPSSAGGPRGLRPRRRPARRPPPGGFSPAPSGATPPLPPPGASIPPAARPSRAPAPLPPAPPARRPHPPLPPPPAASPPXSHQDGQQPGGPALAANSRIPSLGSHKILLFRTI

SEQ ID NO: 121329 - protein, 108 aa, Triticum aestivum
  Clone ID: PAT_TA_15747.pep
MPGAGGARRQGRPLESARIVRSRQLGVLDRDDQGVLLQIFTKPVGDRPTPFLEMIQRIGCMEKDERGEEYQKGGCGGFGKGNFSELFKSIEDYEKSLEAKQSAAVQAS

SEQ ID NO: 121330 - protein, 212 aa, Triticum aestivum
  unsure (1)..(212): unsure at all Xaa locations
  Clone ID: PAT_TA_15748.pep
LYQTFKSSTRLECMMQDXETLPPTAKVGFTVMDAWLAYAPVKNNPEDAAKVPKGNPFHSATSGEMAIYRANSLILRKAGAQISDPVVSTFNGQEVEVWPRVTWSPRWGLTFKDVKRKVHGNSSVSQRSVLVINGRNVVIDGLSLDGALIVNSVDEAEVKVTGHVENKGWTIQHVDHRDTSEMEETRIRGFKFEKVEQLEVNYTEPGKHCLSP

SEQ ID NO: 121331 - protein, 230 aa, Triticum aestivum
  unsure (1)..(230): unsure at all Xaa locations
  Clone ID: PAT_TA_15749.pep
MRPTPTTPAATGAAAVTPEHARPRRMVRFNPRSDRFHTLAFHHVEFWCADAASAAGRFAFALGAPLAARSDLSTGNSVHASQLLRSGNLAFLFTAPYANGWDAATASLPSFSADAARQFSADHGLAVRSIALRVADAAEAFRASVDGGARPAFSPVDLGRGFGFAEVELYGDVVLRFVSHPDGRDVPFLPGFEGVSNPDAVDYGLTRVDHVGGDXPGACPAPWAYGGGHG

SEQ ID NO: 121332 - protein, 522 aa, Triticum aestivum
  unsure (1)..(522): unsure at all Xaa locations
  Clone ID: PAT_TA_15750.pep
RKPWIQPRGTTDWLRSLSVGRALSSAPKKRARIAASMRRHHQACLDVVEEGRHGGGRAGVTKAAEGTXRSLLVTTTSRAPVHAFFAHHSMGKVPDGTDIQLKPKNIRKLAGIGAYLIGYRIRTTRFVDNLSIGVKKVNAQFWRRGXKNIAGNVEVLVEKCALTKEAMQYGHITAHRVNKLYTRFXNGFVIFIVEXLLNEKIXSKHAIFADIDXICTQHCILXRNLVCRGLEMLEGENTNPQXNRFYCGAXFQPVLTIRPLPHEIFSGLEMAKTTKNLCIVVRNVYXLAINRVVFPXLQGPHILVNLGHLQEQIQHCMLLFALLLPAIQRFHLQSWILALAVKDIYAAAFGLALPLNLLVDLXILDGCWPAGKDRGKDYVYEKGGKRNPDRNVQHVIDEYRKQTKNVPGGKPVTLSDQDILEMVFFPVVNEACRVMDENVVIRAADLDIASVLGMXFPSSRGGLIFWAXDTVGASYIHSKLSKWAEIYGDFFKPSSYLEERAKSGRPLGAPKTAQQAPTRSRM

SEQ ID NO: 121333 - protein, 134 aa, Triticum aestivum
  unsure (1)..(134): unsure at all Xaa locations
  Clone ID: PAT_TA_15751.pep
SAYEGRATKPKFSHLSVSPCPLPIPLPFPSIFRSRIGQHGEILSNHAEGTQPKGSLDVESIPMAARRRSSHADRPYGERRPRRPETYGAGRGSRGPATGRDRGLGREERGDMSEHLSKMVRAFHPEXGLTSDSD

SEQ ID NO: 121334 - protein, 145 aa, Triticum aestivum
  Clone ID: PAT_TA_15752.pep
MFRQERSTLVNRTDDFYNTNLSLGRPSSFRGKENVPPKRIVQPSRYRSSLYGCSERGQIMPHERKMYENITSLANVEGSKPAVLIDKTIATFGQLGNSKKIGGRVQAYVINVYCRHLFNENHPRNSLKHYFFHAASEYFLGKWKK

SEQ ID NO: 121335 - protein, 152 aa, Triticum aestivum
  Clone ID: PAT_TA_15753.pep
RSGNITRQEAVSMVPPLFLNVQPDHHILDMCAAPGSKTFQLLEMIHQSTKPGVLPTAMVVANDVDVQRCNLLIHQTKRMCTANLIVTNHEAQNFPGCSLAKFCPEACAESKLQRLEFDRILCDVPCSGDGTARKAPDMWRTWNIGMGYGLHR

SEQ ID NO: 121336 - protein, 342 aa, Triticum aestivum
  unsure (1)..(342): unsure at all Xaa locations
  Clone ID: PAT_TA_15754.pep
MATTALLLRAHHACRPPQAPRPAPPGRAAIVCRATASVSAGQALRSLAPPPRPELLSLDLPRYDPARSRPVDLAVVGGGPXGLAVAQRVAEAGLSVVSIDPSPGLVWPNNYGVWVDEFEAMGLSDCLDTVWPSASVFIDDHTSKSLHRPYARVARRKLKSTMMDRCIAHGVRFHQAKVAKVVHNEASSLLICDDGVAIPATVVLDATGFSRCLVQYDKPYNPGYQVAYGILAEVDEHPFDIDKMLFMDWRDSXHLPEGSAIKDRNSRVPTFLYAMPFSPTRIFLEETSLVARPGHSMDDIHNSMDDIHNSMDDIHNSMDDIHNSMDDIHNSMDDIHNSMDDI

SEQ ID NO: 121337 - protein, 286 aa, Triticum aestivum
  unsure (1)..(286): unsure at all Xaa locations
  Clone ID: PAT_TA_15755.pep
QSLQAEIIKLIEENSSQAGKLYDSREKEKSSEDDFSNLIGEAIRTDXLGXFVFKSLHDERTSELQALHDDFGCLHAAGNELYQEIRLMNKKLGDLQLENNYLEKELSXTLSICDGSSPEVGSARRPSVRRDTKLLKSGRKSLQESAVNVEQRKEVDNAGLEKSNEMLREELHKLQSEMQLLKNNEQPVIDVRSCDAEISKLLANMQIATANAALFKEKVLELIVACESSEISEIVQKEVLKEEISRRELLCAMHSKGPKLNACLKNWRNQEGLEGRPLWVDFSPGA

SEQ ID NO: 121338 - protein, 200 aa, Triticum aestivum
  Clone ID: PAT_TA_15756.pep
PRVRGAGRFHELHPQFVGYTRGKLHELVMKYFKSRELTLAINEVLDPWIAAKQPKKEIEMNFLNNSASRKILPEDAGSVKRARLLPNQSDEDINMYEDILASQNDDCVREDLCHDAALVEENSTNSVAGSDSWGLLNVHVLARIFHFLRADMKSLISSAATCKLWNTGVQYYRNTCRFVDSSSVGLHCTDSVFHGIMAGY

SEQ ID NO: 121339 - protein, 108 aa, Triticum aestivum
  unsure (1)..(108): unsure at all Xaa locations
  Clone ID: PAT_TA_15757.pep
MAGDRRGGSPTAERRRGIRRLLLPRGEASSSSSSSVPLPPPAAAEVGRRKGFAAAALRGLGCTSAAASQAYAPGAGSAAAAAVRSSADWHGRREERGRDKKGRERGGX

SEQ ID NO: 121340 - protein, 184 aa, Triticum aestivum
  Clone ID: PAT_TA_15758.pep
DFFAIRATYRDLLPPSSSNLASQAPHLLLVPGSRAMFHLPLRRRLRFRLPLHDFDPNPAAFYSFGCRIAMASPSHHELSFVHLLTGERFRLPYPPAPFCRLLLSRDLVLAFVPTVGRAVQYCRLGDVEWRVASCTEPYVLEDLIFLKGNLHALVRSEDVGGLCYRLAVANLSDKNTVKLMFLGR

SEQ ID NO: 121341 - protein, 98 aa, Triticum aestivum
  Clone ID: PAT_TA_15759.pep
VVARLLLPRMSCSMGQTTTTSDALVFQVPTAPEVPTGRPLQAAARPAPAPAAPLRRRSPPRGAGRGNSEKLFPRGILCCVPAFVPLNQWFTSFVHGLN

SEQ ID NO: 121342 - protein, 177 aa, Triticum aestivum
  unsure (1)..(177): unsure at all Xaa locations
  Clone ID: PAT_TA_15760.pep
QIXSTEKTDAXWKSFFQGKLTSPQWIKGGEAMAPVVAPTGGTVLVRKLATLSPKELFVGDIVLLKDPEKSDDLIVRRLAAVQGYEMVSTDEKDEPFVLDKDECWVMADNQELKAKEARDSRLFGPVPMTDIVGRVIYSLRTAVDHGPVDNSRVAMFQDSPVLAVELDVEEMVKNNKM

SEQ ID NO: 121343 - protein, 236 aa, Triticum aestivum
  unsure (1)..(236): unsure at all Xaa locations
  Clone ID: PAT_TA_15761.pep
MVSLSTWFRYAAHKFEYSISLSWKKYTVGQINSTEMTDAIWKSFFQGKLTFPQWIKGGEAMAPVVAPTGGTVLVRKLATLSPKELFVGDIVLLKDPXNPDDLIVRRLAXAMQGLDMVSXNERDEPYVLEQNANGVRADSQELKATEANDSRRFGPFLMTDIDGRPMYTXRSTHDHGPVGFGGGARRRSDGDEEENVDVDKPVVYHLPLIGFFCIFLFHFLWEDSSNYSLQVETARG

SEQ ID NO: 121344 - protein, 293 aa, Triticum aestivum
  unsure (1)..(293): unsure at all Xaa locations
  Clone ID: PAT_TA_15762.pep
KLGVTRARLAAFVRAYPACLHASVAVDLAPIVKALRGLDVDRQDIPRVLERYPDVLGLKPDGTISTCVAYLVGSSXTPRDIVPMATHYPFFLSMRVGTTIKPFCDYITSLGLPMRILARIIEKRPYILGYDLEEXTVKPNVEALLSFRIRKEVLPLMIAQYPSILGLPLKVKLAAQQYFFNLKLKIDPDGFARAVEKLPQLVSLHQNVILKPVEFLRGRGITDDDIGRMLIRCPQILLLRNELMKNSFYFFKSELKRPISELLEYPEYFTYSLESRIKPRYMRVASKGIRCSL

SEQ ID NO: 121345 - protein, 477 aa, Triticum aestivum
  Clone ID: PAT_TA_15763.pep
MGRSASVFQALLVFLITIIETQWSSVSGMYCADMASTVYRPHSVTITEFGAVGDGVTLNTKAFQNAIFYLNSFADKGGAQLFVPAGRWLTGGFSLISHLTLSLDKDAVIIGSPHSSDWPVIDPLPSYGRGRELPGGRHQSLIFGSHLTDVIITGANGTIDGQGAIWWDWFHNNTLNYTRPHLVELMYSTNVVISNLTFKNSPFWNIHPVYCSQVIVEHVTILAPLNSPNTDGINPDSSTNVCISHCYVRNGDDVIVIKSGWDEYGISFAQPSSNISISNITGETGGGAGIAIGSEMSGGISEVRAEGLRIVNSLHGIRIKTAPGRGGYVRNVYIANVSMHNVSMAIRINGNYGEHPDNNYDRNALPIISNITIENVVGVDVGVAGILEGIEGDNFSSICISNVSLSVRSRHPWNCSLIQGYSNSVTPESCEQLRTDCEETSICYDGGSSLAVGSRASIHNKPSANILLNSLLQLVSL

SEQ ID NO: 121346 - protein, 196 aa, Triticum aestivum
  Clone ID: PAT_TA_15764.pep
MGSYHYSSASQFFFAAGDPGPGPSPAARKPARTVRIPVTTPQDAAAARIQAAFRSRRVRRHVAAVRAADAEATRLERLLRRQETVDAVRGDDRERARFSEALMAVLLRLDAVPGHDRPVRKARRAVSRRVVGLQKVFDSVLAAPEADTYGVPASLAQVLEGIWGVEEAPAAPPPPAAAAAEEEARRSGWGRFFGVL

SEQ ID NO: 121347 - protein, 362 aa, Triticum aestivum
  unsure (1)..(362): unsure at all Xaa locations
  Clone ID: PAT_TA_15765.pep
GQWLSTNEKVMHVNQITGEAHARGEGIAXVIFKGPNLKLRTTVNVLKVNQIVVDAPAEILTNVAAPPDGYKFSVKLSDSAGHSTESSVNQINAPFDCKVEPSFVGFVEPWSDRAVKKSYCVFHPYSPAQLLPVKSNPKDGILHISVRANLKEDSMVTGSAHALFVKGFYIKEPGMLNLTPSCNHSVIIIGGNTDVELFWSAKDLMSVSLVDTNENIGGPSQVVYRVEALKRQPFADKVTIILPATGQTEELEVNYVTGDRTEPSSSSGLTTFGLILTCIIVPAGTLWVIMKLLEKPARQAPPRHAPAPAAGPSAAPDPASPAIGEFSPRTPQPFMEYVRKTVDDTPYYKRDARRRFNPQNTY

SEQ ID NO: 121348 - protein, 305 aa, Triticum aestivum
  Clone ID: PAT_TA_15766.pep
MADGNAPGSPASSLQSHRYAIKSSVHNTAASRRREQAIAIGKERREALMRAKRVCRAPLSGSDEATIEDGDMVIDEKADLETRTAQAVEELKSALSSQGKGAQKKKIEALRAVRRVLPPAQVPPIQVAIKAGAVPLLVQYLSFGSSDEQLLEAAWCLTNIAAGEPEETKSVLPALPLLVAHLGEKSSTLVAEQCAWAIGNVAGEGADLRSTLIAQGALWPLARLMLSSKGSTARTAAWALSNLIKGPDPKAAYELINIDGVLNAIIRNLEKADEELATEVAWVVVYLSALSEKAISLIVPRPRPR

SEQ ID NO: 121349 - protein, 82 aa, Triticum aestivum
  Clone ID: PAT_TA_15767.pep
NTPKFWWSLVVYRKHVAKGLLLPYHINIHCLTRWFSATLGTYDAVTSFQGYACDPTYHMQDVISPRLLASTLASCFCAIGGS

SEQ ID NO: 121350 - protein, 140 aa, Triticum aestivum
  Clone ID: PAT_TA_15768.pep
MGSAVRDHQQQLHPCDSLLLELNVIWDEVGEPDTVRDKTLLELEQECLDVYRRKVDQANRCRAQLRQSIAEAEAELAGICSAIGDPPVHVRQSNQKLHGLREELNAIIPYLEEMRTKKVERWNQLVHVLEEIKKISSEIR

SEQ ID NO: 121351 - protein, 211 aa, Triticum aestivum
  unsure (1)..(211): unsure at all Xaa locations
  Clone ID: PAT_TA_15769.pep
TALTSNNGNSGSTLDLTWSACGEERNTDILPSVHRLKGRHPHNTELHLLSSSTSPSLHPFPRPPLPLQTPGSHSHREGWSWGRRHSLEPARPLPRSAFSGSLGRSGLSPKSSVAETRSCPRLCSLFFVASDQKQPPFAFILRRPLRRPPSSRFGGNPIRRGSSWKGAASILVSPTVFQPPLYISNLLXNLLRLNFPFYFEFAPSXVXRFAX

SEQ ID NO: 121352 - protein, 195 aa, Triticum aestivum
  unsure (1)..(195): unsure at all Xaa locations
  Clone ID: PAT_TA_15770.pep
MRGVSMLTMARAAWAAVRYAVVVPLLQLAVYLCAAMSLMLFAERLYMGLVVAALWLRRRRRQRRSPSRNKGGDDGGAGDLESGAAEDLPLVLVQIPMFNEKQVCPLSIGAPCRLCGPADELLVHALGGSSPPACPAPRVPGCRRWPGKGVQIRYENRTNRSGYKAGAMREGLKXGYARDCQLVAGFNADFSRTRT

SEQ ID NO: 121353 - protein, 203 aa, Triticum aestivum
  unsure (1)..(203): unsure at all Xaa locations
  Clone ID: PAT_TA_15771.pep
MAAAKENYRVELRAAARQLGDRCLYSASADAWELLVGIEPDATPSQSAAMDTPSSSGAAPGGRLLHLHRSGGSSFRRRMRSGGGAASEAGTPLGGVSYVSTPIPDDDAFDAGADKYLLAKTYFDCREYRRAAHVLRSQVGRKGRVLRCYALYMAGERRKEEEXNELEGSLGKSNVVNQELVALERELSTHRRTGAXDSFGSVL

SEQ ID NO: 121354 - protein, 200 aa, Triticum aestivum
  Clone ID: PAT_TA_15772.pep
HHSANSRLADLAIMATSHMTTIIFSTIVIMLISSAIAAKSSGDIGGKPKPTPFVLEACKSASDNSRRYNYVSQEFCIFTLQSDNRSADAKNHRDLALIPVDILKGRVVTAGGNIKEVLHNTKNITSSMARHLRICELGYDATRSMLNLCGAFMRNYQGDNMSEYNDGPHSSELPVCVDQVNKVSDYCAFALFDMPGVGRY

SEQ ID NO: 121355 - protein, 205 aa, Triticum aestivum
  unsure (1)..(205): unsure at all Xaa locations
  Clone ID: PAT_TA_15773.pep
TRPXXWLRRGGNTSAKCPQGSEGFKHRHIINLYSSVHLWNDCYLKEVPAPRPGPRSSRLPPPQALPLRVSPLGARVEDASSRPEAAWRGLEVRGAALFRFCPEWFAPPFPLPVPGLEAQSLSGMVQWAALRRGGAESGAAHHPSLEVCTARPFLESRAAQHQFFXXRMAALSLAFKEMLAAQSQAIEERISQGIXXXXEAERALY

SEQ ID NO: 121356 - protein, 534 aa, Triticum aestivum
  unsure (1)..(534): unsure at all Xaa locations
  Clone ID: PAT_TA_15774.pep
ANLWEGPHSKPFKHSSRLFPSSATAACWGGLRPAPAKGVAARGIGYGFDYEIVRAGVGVRGDAPRAVRRGGGNHHYRXSVAGWACVDWTCVPFNPLLFVSGRVRXHNDKHHIKSLRLHFSSPEHDRKDVAEQTNNITSKIKSNLTNSMKAMGVDILTGFGKIVGKQRVRYGKVGFPEKEITAKNIIIATGSVPFVPKGIEIDGKTVFTSDHALKLESVPDWIAIVGSGYIGLEFSDVYTALGSEVTFVEALDQLMPGFDPAIAKLAQRVLINPRKIDYHTGVFASKITPAKDGKPVLIELIDAKTKEHKETLEVDAALIATGRAPFTSGLGLENINVVTQRGFIPVDERMQVTDADGNVVPNLFCIGDANGKLMLAHAASAQGISVVEQISGRDHILNHLSIPAACFTHPEISMVGLTEPQAREKADNEGFEVSVVKTSFKANTKALAENEGDGIAKMIYRPDTGEILGVHILGLHAADLIHEASNAIALGTRLQELKLAVHAHPTLSEVLDELFKAAKVNSGVSHSVNEPVAA

SEQ ID NO: 121357 - protein, 245 aa, Triticum aestivum
  unsure (1)..(245): unsure at all Xaa locations
  Clone ID: PAT_TA_15775.pep
MADPPSLASTATPQPDQLATSASIPQNANPQIPLPPIVSSAQVNPGSAATGGRSTDPPQLQAPSPTQAAEGAGGFGAIHRSGPASLAPTVGQPPRYATVGTTYGXQMAFPGGGGQLGQQPGLRAAMFGQGQPEGCCKGXGNAASAGXYGLQFQPTMIAHPGQRGVVQGVQFNTPTAQAQSMGASLMNQMRPNGIATPYGAQTQQRSAYHAQMMPQQPPGSSNGPVVQMLPTHQMQSSMASAVSHI

SEQ ID NO: 121358 - protein, 151 aa, Triticum aestivum
  unsure (1)..(151): unsure at all Xaa locations
  Clone ID: PAT_TA_15776.pep
MQGFPGGVPDPQQLQATMLAIEQACSLIQVHMNPAEAEKVLSSLHSSLMPYQACRFILGTPLLPCARLRAAGASRDAARWPRGGCAVLNRTCLFPYRLDCPSVHPGSPAGFLPSDVSPVAARLLKXXWLEFPDQEXXAIFFXXEQSIRGMH

SEQ ID NO: 121359 - protein, 93 aa, Triticum aestivum
  Clone ID: PAT_TA_15777.pep
LSCTPLLSKLFLTLGFVFNSRATFLMLYSGIRRNTYSRCSETLSHSGSDFEQLSIHLEPLIVPSYLTLDVFDMFNSRDNLMPIHGLTPRLSLS

SEQ ID NO: 121360 - protein, 177 aa, Triticum aestivum
  Clone ID: PAT_TA_15778.pep
RGPGGAEDHGGGCQFYGHRVVATRGHHPARSRESGQDLRAPGDQHPAASTGRLCQLDGPALWARRVPRRHGGWGKQQRGGAAVHPKPDGHVPDARRARRQRRAGKQLQPGELGGGHLLLAAPGRAGAQEAPLRHDDGGHRPAEMREGPWHLVPFIVPLCMRCCCCWIGGDCDLWMEK

SEQ ID NO: 121361 - protein, 328 aa, Triticum aestivum
  unsure (1)..(328): unsure at all Xaa locations
  Clone ID: PAT_TA_15779.pep
CTPAVQSRFPGYGIYAGTNPETFVRADGAFIPFADDFDITNVSTSVKGVGLIGDIKAIDLQSPIGSLIGKQVVKVGRSSGHTTGTVMAYALEYNDEKGICFFTYFLVVXENQQTFDLEGDSGSLIILTGQDSEKPQPIGIVWGGTAARGRLKLKSGQGPENWTSGVDLGRLLDLLELDLITTSEGLQEALEEQRITVAAANSTGTESSPVATTPQEAEKVDKIYEPLGINIQQLPRDGSANSMDQPFGPDEFRVDTVDGVNSNVEERQFIPNLMGMSPMRDEQGGNGELENNNLESSAEDICFSLHLGEREPKRLRSDTTTVDIDLQK

SEQ ID NO: 121362 - protein, 105 aa, Triticum aestivum
  Clone ID: PAT_TA_15780.pep
MDCQRLDVAKDCIGILSKSVFWQRSCWPATTRRTIQLSGGKNTRALFGVCLCSAAISQLTKGRNKEEESSELQSLAAEALMKDYKQRAPSMEALVAGMLKNMKLS

SEQ ID NO: 121363 - protein, 376 aa, Triticum aestivum
  unsure (1)..(376): unsure at all Xaa locations
  Clone ID: PAT_TA_15781.pep
MAKPPPSAAASAAGGRGPAHHRTRLLLLLLVAVAASAFTAGYVLRGGPVGPCDTRGDPVDVVAARAGGAASSPLGFMKSKLVLLVSHELSLSGGPLLLMELAFLLRQVGCQVVWITNQRPEGTNDVSYSLEHKMLNHGVQVLPARGQEAVETALKADLVILNTAVAGKWLDAVLKDNVPQVLPKILWWIHEMRGHYFKLEYVKHLPLVAGAMIDSHITVEYWKTRTHDRLNIQMPQTYAVHLGNSKELTEVAEDNVARRVLREHIREFLGVRSEDLLFAIINSVSRGKGQDLFLQAFHQSLQLIQXTKLKVAXVHAVXVXSDMSAQTKFXETQLREFVXKEXIHDRVHLXNKTLAVGPYLGAXDVLVQNXQALXXC

SEQ ID NO: 121364 - protein, 204 aa, Triticum aestivum
  Clone ID: PAT_TA_15782.pep
MKTFLILALLAIVATTTTTAVRVPVPQLQPQNPSQQQPQEQVPLVQQQQFLGQQQQQFPGQQQPFPPQQPYPQPQPFLPQLPYPQPQPFPPQQSYPQPQPQYPQPQQPISQQQAQLQQQQQQQQQQQQQQQQQQPRRQVCHQQSQQHYPSWQGWHPSSQPHPLDRRFLHPQLLPQLEEIMNLTILTLPAMCKVYNDTYCSYSIA

SEQ ID NO: 121365 - protein, 220 aa, Triticum aestivum
  Clone ID: PAT_TA_15783.pep
MARRAPRPRRTLELPDDVMEEIFLRLPADNPASLARIAGGCKSWRAMVSDPNFAPAYRRLRDAPPMLGFLYNYRSTDDEGAPYWTSHFRAAAALPPRVRRDRKHWRALDSRHGLVLFDTPEGDGHLVVSDLVTGERWKIDGHLTFPDACNAAVLCARDGCDHRDCHGGPFLVACVDSVVAGDRRIASAMVYSSVTGKWIDPTFLEHPNVIDGRGHSAVLG

SEQ ID NO: 121366 - protein, 426 aa, Triticum aestivum
  Clone ID: PAT_TA_15784.pep
TRQQMQPQFQQQSYLQNMNGTTIQGQAHSEFLQQQLQRCQSFNEQKPQLLQQQESNQQQSQGMQVPQHQHMQQQKNMANYQPAYSQLSPGPQSSPAALEFGTRFSQSQSFSDTNMSSLSPSGAPAMHNTLGPFSSETASHLSMSRPTAVPVPDSWSSKRVAVESLIPSRPQSTTHMEQLSSTPPSIPQSSALAPLPGRGCLVDQDGSSDPQNHLLFGVNIDSHSLLMQGGLHDENDSTAIPYSTSNFLSPSQHDFSLDQTLNSSGCLDESGYVPCSHTPDQVNQPPATFVKVYKSGTYGRSLDITKFSNYHELRRELGRLFGLEGQLEDPMRSGWQLVFVDREEDVLLVGDDPWQEFVNSVSCIKILSPQEVQQMGKQGLELLSSAPGKRLGGGGGGSSCDDYASRQESRSLSTGIASVGSVEVEF

SEQ ID NO: 121367 - protein, 218 aa, Triticum aestivum
  Clone ID: PAT_TA_15785.pep
LSPRQLQGTSRASVVAEEFRLEEDVEHDDEEEEEEFSAGTSEDIEEPQRHKKLRSQNGRGAKLRSVDEIQTGLRRSKRSSRPRINYQQYDFSDTDAEAGKAGKSDASDPDANSDAENGMELSTSSQGLQEEEDDGPEELKVSNGNNDKMSEDHAVAANKEQKEEQRQLQPESVEKMDAPSRESGNVGRTFLDLNELAPGGGFDEGPSLAMKDEDMDNS

SEQ ID NO: 121368 - protein, 164 aa, Triticum aestivum
  Clone ID: PAT_TA_15786.pep
GPGRLSSAEAPLGEEPPFRFRRSGRAAHLNCAGPALAGVTPSPRSRQTRKSAQHPSPPPPPKYKAASVAPGLAGATRAGTPTGSIRCCCALRVLQLLLAGTAAGPPAAEHGPPPSRDRHHALSSNDSASAPFPRLLLSAQVRILAQEANLLAGVGSCKERRVVW

SEQ ID NO: 121369 - protein, 157 aa, Triticum aestivum
  Clone ID: PAT_TA_15787.pep
HSFHRCNSAVENIDFASVHAYPDSWLPKASMEEKLRYLSSWVDSHHNDSEHILKKPVLFSEVGYLQHVDGNSTVDRDILLRVVYDKIYDSARKLQAGGGALIWQLMVEGTHMSHEDFSLVARDHPSTYKLITEQSCRFQLLVQGWLETLDWQCPVQP

SEQ ID NO: 121370 - protein, 205 aa, Triticum aestivum
  unsure (1)..(205): unsure at all Xaa locations
  Clone ID: PAT_TA_15788.pep
MPRSGALPLLAALVLALAAAAAASSGAAKGAPAATDFIRKSCRETQYPSVCMQSLSSYGKPPPRSPQHRARAARPVGAARARAASAYLGRNLRAGPPRRXGAKAAKGSPARDCLENMADSVGHLRDAAKELDXAWAGPGRRAFRWHLSNVQTWCSAALTDENTCLDGLSRGVDAGTRAAIRSKVVEVAQVTSNALALVNKVGSGH

SEQ ID NO: 121371 - protein, 152 aa, Triticum aestivum
  unsure (1)..(152): unsure at all Xaa locations
  Clone ID: PAT_TA_15789.pep
MGSFCSKGSAVDKSPSDTTLGPDRVIHHHERGAVNDERKTAADDAAAKRMHEQPPQQHQRPPQHQQPPQHLQPPQQHPRQQHQPPRLSAPQTPPAGAAAGAGSAPWDGVPSLARNPSQKGMGMAKAGAAKVXEVSSILGRAGTVGLGKAVDV

SEQ ID NO: 121372 - protein, 145 aa, Triticum aestivum
  unsure (1)..(145): unsure at all Xaa locations
  Clone ID: PAT_TA_15790.pep
MANAADPAADQNPKDAGGRVPEPWAGADGEVAEEEDEYEDEEVLHAPAAAALVPGGAPPAPRGLPPPPRRLRVHDVIIRGNAKTRDELIEAEVXDLLRSATTVQDLLSAAADASARFRGLDVFEAVNITLDAGXXELXGTNHGGH

SEQ ID NO: 121373 - protein, 168 aa, Triticum aestivum
  Clone ID: PAT_TA_15791.pep
MEVSLTSPNSASVVAMGTIQKTDRKAKAIDGQPLADCVEVLINVVLKETTELPRAQGKINRLGNAQARCIPWPRKNIMQIDRTTVLHSKVSSVCSQVSFNNSENVDPNKTTTGTQVTNHETGCSTSEGAVSNTLKRKKVSKTTRMKKATQAISATTGNNILRNSGRET

SEQ ID NO: 121374 - protein, 222 aa, Triticum aestivum
  unsure (1)..(222): unsure at all Xaa locations
  Clone ID: PAT_TA_15792.pep
MPTPPKLNKDPHNHYFDLRAAXRHVPQTHAWEGLHELPVGDGGVGAGEXAAPVVDMPDPLAAEAVARASEQRGAFLLQGHGLPRGPRARAVAASARSAALPRSAEWRAPRLRRPPDGSGRPLVPLFFAKSRGAGRRSPRPPSLRPVLPALWPAAGRGPTPSGSVSIPRVSTTPAKTAVNALAQNHSRIDLWPATIGISLERLRRKHTTGVAQSLNSGAKRPS

SEQ ID NO: 121375 - protein, 158 aa, Triticum aestivum
  Clone ID: PAT_TA_15793.pep
MEGEKNSSGDLMSSSKLVAEAPKTAYEKKSVEGIDKEKVAAASADILDSAAKYGKLEDKPVGQYLEKAEGYLKQYSSGGTEKEKTDAPAAADAPKPDAPKEAAPAPAPAAEEEKSSDGFGLDDVMKGAASLSGKKSGEEEKESGGGGGFMKMAQGFMK

SEQ ID NO: 121376 - protein, 156 aa, Triticum aestivum
  Clone ID: PAT_TA_15794.pep
MEGEKNSSGDLMSSSKLVAEAAKTAYEKKSVEGIDKEKVAGASADILDSAAKYGKLEDKPVGQYLEKAEGYLKQYSSGGTEKEKTDAPAAADAPKPDAPKEAAPAPAAEEEKASDGFGLDDVMKGAASLSGKKSDEEEKESGGGGGFMKMAQGFMK

SEQ ID NO: 121377 - protein, 88 aa, Triticum aestivum
  Clone ID: PAT_TA_15795.pep
HEEATLNLNAMNKLQTKKPWNLSFSFGRALQQSTLKAWSGKTENEEKARAAFLVRCKANSEATLGTYKGDATLAEGASESLHVKDYKY

SEQ ID NO: 121378 - protein, 160 aa, Triticum aestivum
  unsure (1)..(160): unsure at all Xaa locations
  Clone ID: PAT_TA_15796.pep
MAAPAPTVSKSPPALVPPAGPTPGGTLPLSSIDKTAAVRVMVDFIQVFQSAPSSADDQVAAMRQGFARALVPYYPVAGRIAEPSPGEXFVDCTGEGVWFVEAAAXSCSLADVNGLEDRPLAIPKXDLNPPXSRRPQXSRDQDXPRARLTXFSCXGYAXRL

SEQ ID NO: 121379 - protein, 125 aa, Triticum aestivum
  Clone ID: PAT_TA_15797.pep
SNPHLPKVCFSIVSIWSCTLSLGGRLLELTIGLGLTVSLGGRFLGLTLSLGGRFRGLHLPLDQPRLLHDLVFDGADVRAGGAEEAQAVAAGGRLDLQQHPARRAEVHGRLPHFSAAVLRSAAASC

SEQ ID NO: 121380 - protein, 173 aa, Triticum aestivum
  unsure (1)..(173): unsure at all Xaa locations
  Clone ID: PAT_TA_15798.pep
DWEHFTLRISNFSGELSSVYYSEHSGGGWVDACDLEFISGNKAIVYSSRNGHASYAHPGCYLQGSENLGVGLRNDVARSELSIDSSTRYKIISAEYLGDAVAEPCWLQYMREWGPTVTYNSRSEVDTVLSFLPFFLRFTAEAIFDSLPAELYEEEGPTGPXKEKNNWDGDERC

SEQ ID NO: 121381 - protein, 99 aa, Triticum aestivum
  Clone ID: PAT_TA_15799.pep
CNIQYYEAGARFAKWRAVLKIGPTEPSQLSINQNAQGLARYAIICQENGLVPIVEPEILVDGPHDIDRCAYVTEMVLAACYKALNDQHVLLEGTCPGGR

SEQ ID NO: 121382 - protein, 73 aa, Triticum aestivum
  unsure (1)..(73): unsure at all Xaa locations
  Clone ID: PAT_TA_15800.pep
GAANGLAMTGMXLFKAIAPAGAGIVFSWAQKRQHAFFFPGDQMVFFLLNIIELLGLVLTFRPFLAVPEQYERN

SEQ ID NO: 121383 - protein, 225 aa, Triticum aestivum
  Clone ID: PAT_TA_15801.pep
KFRVAVEDYKAALAMDPDHTMYNVQLYLGLCKTLVKLGRGKEAINSCTEALSIDEELVDALAQRGEAKLLTEDWEGAVEDLKEAAQKSPQDMAIREALMKAERQLKLSKRKDWYKILGISKTASAADIKRAYKRLALQWHPDKNVENREEAENMFREIASAYEVLSDEDKRVRYDRGEDLEEMGMGGGGGSFDPFGGGGGQQYTFHHGGGFPGGGFPGGFQFNFG

SEQ ID NO: 121384 - protein, 259 aa, Triticum aestivum
  unsure (1)..(259): unsure at all Xaa locations
  Clone ID: PAT_TA_15802.pep
MSAYCGKYKDELIKNAAYIGTPGKGILAADESTGTIGKRFASINVENVEDNRRALRELLFCTPGALQYLSGVILFEETLYQSTKGGKPFVDILKAGNVLPGIKVDKGTIELAGTNXETTTQGFDDLGKRCAKYYEAGARFAKWRAGLKIGAPEPSQLSIDQNAQGLARYAIICQENGLVXPIVEPXILGVGPHDIGPWAYATGNGLVGWFKALKKPEXLLEGALXKPKRGPPGFEPKRGPPGGLLGHPPGPLQGPALFG

SEQ ID NO: 121385 - protein, 289 aa, Triticum aestivum
  Clone ID: PAT_TA_15803.pep
MVDFIQVFQSPSSDSSSVDEQVAAMRQGFARALVPYYPVAGRIAEPTPGEPVVDCTGEGVWFVEADGSCSLGDVNGLGDRPLCIPKDNLTIRASGNPGETTTQGFDDLGKRCAKYYEAGARFAKWRAVLKIGATEPSQLSIDQNAQGLARYAIICQENGWVPIVEPEILVDGPHDIDRCAYVTEIVLAAVPAIVFLSGGQSEEEATLNLNAMNKLQTKKPWNLSFSFGRALQQSTLKAWSGKTENEEKARAAFLVRCKANSEATLGTYKGDATLAEGASESLHVKDYKY

SEQ ID NO: 121386 - protein, 243 aa, Triticum aestivum
  Clone ID: PAT_TA_15804.pep
MGISCTPDDDTREFVKVGNLKSAELYAHVKLAHGGTFTDIAMWVFCPFNGPATIKVGLASFALQKVGRHTGDWEHFTLRISNFSGELSSVYYSEHSGGGWVDACDLEFISGNKAIVYSSRNGHASYAHPGCYLQGSENLGVGLRNDVARSDLSIDSSTRYKIISAEYLGDAVVEPCWLQYMREWGPTLTYNSRSEVDTVLSFLPFFLRFTAEAIFDSLPAELYEEEGPTGPKEKNNWDGDERC

SEQ ID NO: 121387 - protein, 252 aa, Triticum aestivum
  unsure (1)..(252): unsure at all Xaa locations
  Clone ID: PAT_TA_15805.pep
YEAGAXRFAKWRAVLKIXGLTEPSQLSIDQNAQGLARYAIICQENGLVPIVEPEILVDGPHDIDRCAYVTEIVLAACYKALNDQHVLLEGXTLLKPNMVTPGSDAKKVAPEVIAEYTVRTLQRTVPAAVPAIVFLSGGQSEEEATLNLNAMNKLQTKKPWNLSFSFGRALQAEHPQRPGPGKTENEEKARAAFLXVRCKANSEATLGTYKGDATLGEGASETSTQGLQVRGCGRRQRKATRRASRSVVSSHM

SEQ ID NO: 121388 - protein, 239 aa, Triticum aestivum
  Clone ID: PAT_TA_15806.pep
MTRDEHEGEESDIVTSKCTSESVESSADVDDSESTGVTIMTRRRALTRSVPSDCDDAQSTGITIMARRPAPSSNMPSDEADAEATGIDIMSRHTAPSSSTDSSFNTEQGTAVRRLRLQSNLDAGSCSSVDGSSSCIIKHGSENKGLEAEIEEHVDTNFPDDAGNSHADEQMYMPDHEANSGMRLRKTAEKSDKENKQECGLQSHVRAPRKRGGFAARMILPVLSVALLVLVSVGIYGWA

SEQ ID NO: 121389 - protein, 359 aa, Triticum aestivum
  unsure (1)..(359): unsure at all Xaa locations
  Clone ID: PAT_TA_15807.pep
MSAYCGKYKDELIKNAAYIGTPGKGILAADESTGTIGKRFASINVENVEDNRRALRELLFCTPGALQYLSGVILFEETLYQSTKGGKPFVDILKEGNVLPGIKVDKGTVELAGTNGETTTQGFDDLGKRCAKYYEAGARFAKWRAVLKIGPTEPSQLSINQNAQGLARYAIICQENGLVPIVEPEILVDGPHDIDRCAYVTEMVLAACYKALNDQHVLLEGTLLKPNMVTPGSDAKKVAPEVIAEYTVRTLQRTVPAAVPAIVFLSGGQSEEEATLNLNAMNKLQTKKPWNLSFSFGRALQQSTLKAWAGKAENEEKARKAFLVRCKXANSEATLGTYKGDATLGEGASESLHVKDYKY

SEQ ID NO: 121390 - protein, 359 aa, Triticum aestivum
  unsure (1)..(359): unsure at all Xaa locations
  Clone ID: PAT_TA_15808.pep
MSAYCGKYKDELIKNAAYIGTPGKGILAADESTGTIGKRFASINVENVEDNRRALRELLFCTPGALQYLSGVILFEETLYQSTKGGKPFVDILKEGNVLPGIKVDKGTVELAGTNGETTTQGFDDLGKRCAKYYEAGARFAKWRAVLKIGPTEPSQLSIDQNAQGLARYAIICQENGLVPIVEPEILVDGPHDIDRCAYVTEMVLAACYKALNDQHVLLEGTLLKPNMVTPGSDAKKVAPEVIAEYTVRTLQRTVPAAVPAIVFLSGGQSEEEATLNLNAMNKLETKKPWNLSFSFGXRALQQSTLKAWAGKVENEEKARKAFLVRCKANSEATLGTYKGDATLGEGASESLHVKDYKY

SEQ ID NO: 121391 - protein, 359 aa, Triticum aestivum
  unsure (1)..(359): unsure at all Xaa locations
  Clone ID: PAT_TA_15809.pep
MSAYCGKYKDELIKNAAYIGTPGKGILAADESTGTIGKRFASINVENVEDNRRALRELLFCTPGALQYLSGVILFEETLYQSTKGGKPFVDILKEGNVLPGIKVDKGTVELAGTNGETTTQGFDDLGKRCAKYYEAGARFAKWRAVLKIGLTEPSQLSIDQNAQGLARYAIICQENGLVPIVEPEILVDGPHDIDRCAYVTEMVLAACYKALNDQHVLLEGTLLKPNMVTPGSDAKKVAPEVIAEYTVRTLQRTVPAAVPAIVFLSGGQSEEEATLNLNAMNKLQTKKPWNLSFSFGRALQQSTLKAWAGKAENEEKARKAFLXRCKANSEATXPGTYKGDATLGEGASESLHVKDYKY

SEQ ID NO: 121392 - protein, 358 aa, Triticum aestivum
  Clone ID: PAT_TA_15810.pep
MSAYCGKYKDELIQNAAYIGTPGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEAGARFAKWRAVLKIGATEPSQLSIDQNAQGLARYAIICQENGLVPIVEPEILVDGPHDIDRCAYVTEVVLAACYKALNDQHVLLEGTLLKPNMVTPGSDSKKVAPEVIAEYTVRTLQRTVPAAVPAIVFLSGGQSEEEATLNLNAMNKLQTKKPWNLSFSFGRALQQSTLKAWSGKTENEEKARAAFLVRCKANSEATLGTYKGDATLAEGASESLHVKDYKY

SEQ ID NO: 121393 - protein, 358 aa, Triticum aestivum
  Clone ID: PAT_TA_15811.pep
MSAYCGKYKDELIKNAAYIGTPGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEAGARFAKWRAVLKIGATEPSQLSIDQNAQGLARYAIICQENGLVPIVEPEILVDGPHDIDRCAYVTEIVLAACYKALNDQHVLLEGTLLKPNMVTPGSDAKKVAPEVIAEYTVRTLQRTVPAAVPAIVFLSGGQSEEEATLNLNAMNKLQTKKPWNLSFSFGRALQQSTLKAWSGKTENEEKARTAFLVRCKANSEATLGTYKGDATLGEGASESLHVKDYKY

SEQ ID NO: 121394 - protein, 358 aa, Triticum aestivum
  Clone ID: PAT_TA_15812.pep
MSAYCGKYKDELIKNAAYIGTPGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEAGARFAKWRAVLKIGATEPSQLSIDQNAQGLARYAIICQENGLVPIVEPEILVDGPHDIDRCAYVTEIVLAACYKALNDQHVLLEGTLLKPNMVTPGSDSKKVAPEVIAEYTVRTLQRTVPAAVPAIVFLSGGQSEEEATLNLNAMNKLQTKKPWNLSFSFGRALQQSTLKAWSGKTENEEKARAAFLVRCKANSEATLGTYKGDATLAEGASESLHVKDYKY

SEQ ID NO: 121395 - protein, 357 aa, Triticum aestivum
  unsure (1)..(357): unsure at all Xaa locations
  Clone ID: PAT_TA_15813.pep
MSAYCGKYKDELIKNAAYIGTPGKGILAADESTGTIGKRFASINVENVEDNRALRELLFCTPGALQYLSGVILFEETLYQSTKGGKPFVDILKAGNVLPGIKVDKGTIELAGTNXRTTTQGFDDLGKRCAKYYEAGARFAKWRAVLKIGATEPSQLSIDQNAQGLARYAIICQENGLVPIVEPEILVDGPHDIDRCAYVTEIVLAACYKALNDQHVLLEGTLLKPNMVTPGSDSKKVAPEVIAEYTARTLQRTVPAAVPAIVFLSGGQSEEEATLNLNAMNKLQTKKPWNLSFSFGRALQQSTLKAWSGKTENEEKARAAFLVRCKANSEATLGTYKGDATLAEGASESLHVKDYKY

SEQ ID NO: 121396 - protein, 162 aa, Triticum aestivum
  unsure (1)..(162): unsure at all Xaa locations
  Clone ID: PAT_TA_15814.pep
MAAAVRLFLRRRLATATATPPTPASILNPSSPTTPLTSRQKTRLAISLLKSSPPPPPDQILSICRAAALSPXTHLDRVALSLATSRLSTAPDPXRLTSSLLIPHHAHHAIXLWQAGLLPDPSPLPVIPSTVPQRSLRCIVAGTHEAVALPDFPSHGSTQAET

SEQ ID NO: 121397 - protein, 164 aa, Triticum aestivum
  unsure (1)..(164): unsure at all Xaa locations
  Clone ID: PAT_TA_15815.pep
MARCSNGLLGLLNAGVLVLALVVLGGGIWLSHRAATTDCERFLERPVIALGALLLALSLAGLAGSLCRASCLLWLYLVALFLLIALLLVFTVFAFVVTNRGAGXVVSGRGYKGIPASGGSPPPGRSGPPGAAAAPPAVSAPGRPRLAVPFPANGAGGSLPQEGF

SEQ ID NO: 121398 - protein, 318 aa, Triticum aestivum
  Clone ID: PAT_TA_15816.pep
MVTTYLSICERKRKPTALRPSMAPPAVRSWGELQHDLLVAIMSRVGAPDLLSGGAPRTCSAWWAAARDPLAWRRVDLRDWTARTSARRAAGAGATRGSISVQAALTGDLEVAATRADGRMEAVLLPEFADEEHLMFLAERSPNLHYFSFPTTCMTSDDFCMAITKLQSLKGMAVDESLVNYDVLLHVHQCCPDFLELKVFALYVDEDMASVICESLPRLKKLEIPNSDMSCAAIVKFLDCLEELEYLDISGYETSAISSSVLHKASRLKAFIWNSKFELGEFMDCSNCGEHNINPQEPCKCTMDNKVMDWLAGPSQTA

SEQ ID NO: 121399 - protein, 368 aa, Triticum aestivum
  Clone ID: PAT_TA_15817.pep
VRASSSGDKTVRFLDVFESKGAVETFQHSHDVLTLAYRPDGRQIACSTLDGLINFWDPFDGLLMYTIEGRRDISGGRLMTDRRSAANTGIGKYFTTLCYSADGSYILAGGNSKYICMYDIGEQVLLRRFQITRNLSLDGVLDFLNSKNMTDAGPLDLIDDEDSDVEDGIDQQTRGSLGHGLPGSMANRGRPIARTKCVKFAPTGRSFAAATTDGVLLYSVDESFIFDPTDLDIDVTPEKVEEALAENQQQRALLLSLRLNEDSLIKKCIFAVDPSNVRAICSSVPFKYLQRLIDAFADLLESCPHLEFILLWAQELCKVHGSYIQQNSRTLLPALKSLQKSITKLHQDLADTCSSNEYMLKYLSSAGK

SEQ ID NO: 121400 - protein, 80 aa, Triticum aestivum
  Clone ID: PAT_TA_15818.pep
PTCPRLRPPPAKWAPRDPSHLREPPSPCPHREHRRRAGCGRARQGDRRRHGRRRARGGRRPCGRGPPRGRSTRGRRRGGA

SEQ ID NO: 121401 - protein, 168 aa, Triticum aestivum
  Clone ID: PAT_TA_15819.pep
VREEEALVPHHELPNGTQPMEAAPAELATTVENQPTEDTPISRFTWTIDNLSRVNTKKLYSETFVVGGYKWRVLIFPRGNNVEFLSMYLDVADSAVLPYGWTRYAQFSLSVVNQIHNKFTIRKETQHQFSARESDWGFTSFMPLSELYNPSRGYLVNDTCVIEAEVAV

SEQ ID NO: 121402 - protein, 199 aa, Triticum aestivum
  Clone ID: PAT_TA_15820.pep
MEPSPSYALHLAVAALGPATRAAPPARYMHRKTLDQLLRFARSLDRDHRRRARLLPDGAEDSDPDREDAEEDDDGPPPHRDHDRRTLPIPPGLPPLHTGREGKPTISPAANKRVGSLVRPTTPKSSVPAVSTFESIEDSDEDVDLEPDSKNDDAVYVGTNGAIGSDPVPVKADQNGDIPATSMIRSHSATGSLHGIQLN

SEQ ID NO: 121403 - protein, 63 aa, Triticum aestivum
  Clone ID: PAT_TA_15821.pep
SDPPPCRPTPPSPPPPPPPPAPSSPAAAAPPPPSPPPSPGIGSSAALPRVSLRSDCYFSFRRT

SEQ ID NO: 121404 - protein, 123 aa, Triticum aestivum
  Clone ID: PAT_TA_15822.pep
ASSTLINKSQVVKFVCTSTHAGIYTQITEHCRGNQTNKTITTTANQRYRCRVCVHRSGTTKTRGSKSMIQMQPTSIYAIQNVFLQPFLFINGVVTRLTVVLSASRQAVWDQVRSSSSKESLSS

SEQ ID NO: 121405 - protein, 353 aa, Triticum aestivum
  unsure (1)..(353): unsure at all Xaa locations
  Clone ID: PAT_TA_15823.pep
RAAGRTDRRDGHPLRGTGSLPPSQPQLGSSAQHLNANPTQPSRRRRGAAAERKKRRRRWSLSAMASSSADPEKLMAKADKLTKLSFTRWNADWKSATALYEQAAIAYRFRKDNEKAKDAFEKASKGQEMISSPWDAAKHMENAGALAKELGLWNEVSDFYRRASEFYRECGRSQPASDALAKGASALEDKAPEEATKLYDDACTLLEEDGKEQMAFDLYRAAASLYVKLEKYSDAAAFHLRLGSAADKCNAVNSQCKAYLSAIIIYLYAHDFQQAQKCYNDCSKVQGFLNSDQNRCAMKLLFVFEEGDVEKIKGAXSSSALYPPGPWGIRGSARLPTGGLQAIKKDVGGDGRG

SEQ ID NO: 121406 - protein, 198 aa, Triticum aestivum
  Clone ID: PAT_TA_15824.pep
SVAFKAAASVYSRFIALSAEQLRQIGVYARKASYLHDLARKYASGILSDDNIVAMDDRSLAAMLTMVNGIGGWSVHMFMIFSLARPDVLPSADLGIRKGVQMLYGLEDVPRPSQMEKLCERWRPYRSVAAWYMWRLIESKAAQTAAAMPVVPPAMPAPSEEFMLQQHQQQHHHHQHQQQQQQAAIQMLDPVQMLPGLG

SEQ ID NO: 121407 - protein, 114 aa, Triticum aestivum
  Clone ID: PAT_TA_15825.pep
ACFCCFITSPLPHLIGLQLSDIIQMKLKKAIDAQLTNNGKYPIISKDDYQITSLDDILKQIRILSREVHNKGVFAHKADDSLLALPKECPPDPSGKEVEYPYALLEEWNKGKIL

SEQ ID NO: 121408 - protein, 192 aa, Triticum aestivum
  Clone ID: PAT_TA_15826.pep
MKTSKTVSMCTPVEETQGIHVFDILGYSKHRGMGHDLDSHIRSGIFSVDGHDWEINFYPDGFNGFGPFNGHGQDYISVFLVLLSKNTKVRASCDMRLVDQYTGFSSSMHKTEPRSFGPGDVTMLAPQTPFFMTRSEFEGSPYLRDDRLTIECIVTVFKMPHVTETKSFPKIDMPQPDMTVHVSKLLEGNDGI

SEQ ID NO: 121409 - protein, 343 aa, Triticum aestivum
  unsure (1)..(343): unsure at all Xaa locations
  Clone ID: PAT_TA_15827.pep
MSRVRDRTEDFKESVRVAALSHGYTESQLAALMSSFIIRKPSPKSPFTNAAIKTLESIRELEKFIVKHRRDYVDMHRTTEQERDNIEHEVGIFVKACKEQIDILKNRILEDERNRRANTWLGTRDETSRLDLIAHQHXGVVLILSERLHSVTAQFDRLRSLRFQEAINRVMPRKKIKKKPEIKPTEPPEQNLVLKSDVSKVEDREVSTAPLRVQELLLDEETRALQMELTNLLDTVQGPDTKPLKVPAPSQNMSINVRQKAXQTKLYYGQDAELRKEGEHGNKELPQGPQRNSSSGTYLLLLFFVLTCSVLFLDWYKNRRRVLTRATVHMEGGLDAKHEEKKE

SEQ ID NO: 121410 - protein, 158 aa, Triticum aestivum
  Clone ID: PAT_TA_15828.pep
MGGGVKAKEEYRFGSSKVSPAPAEEVAAAAAAKGKKSRAKKAAAPAPAAAAAKGKKSRAKKAASRIDLDKAEAVVYKADMKARESARVAKAKAEEAEEAARIAKAKAEEAEEAARAAKADAEAAAKAIEAADEAMLLYEKEMEWAQCEEELDASMFRG

SEQ ID NO: 121411 - protein, 146 aa, Triticum aestivum
  unsure (1)..(146): unsure at all Xaa locations
  Clone ID: PAT_TA_15829.pep
MGSDAEEVSQPASSPEYEQDDDDEDCYLSDQEDDALEESVLQVLEDGNLEDCHWSSSSVITKEYLRAAQREDLRKVMELLGLKEHHARTLLIHYRWDXERIFELLDQKGRDRLFSEAGIPLGTANNAGSPSATXEVTCNGLLRMMC

SEQ ID NO: 121412 - protein, 225 aa, Triticum aestivum
  Clone ID: PAT_TA_15830.pep
MGSSLPAKEANLFKVIVKSYETKQYKKGLKAADSILKKFPEHGETLSMKGLTLNCMDRKSEAYELVRRGLKNDLKSHVCWHVYGLLYRSDREYREAIKCYRNALRIDPDNIEILRDLSLLQAQMRDLSGFVETRQQLLTLKPNHRMNWIGFAVSHHLSSNSSKAIEVLEAYEGTLEDDYPPENERYEHGEMLLYKISLLEECGMLDRALQEMHKMESKIVDKFSF

SEQ ID NO: 121413 - protein, 106 aa, Triticum aestivum
  Clone ID: PAT_TA_15831.pep
PRVRGRKETVLDLAKFVDKGVQVKLTGGRQVTGTLKGYDQLLNLVLDEAIEFEREQDDPLKLSTKTRQLGLIVCRGTAVMLVSPTEGTEEIKNPFQEADGEQTAHS

SEQ ID NO: 121414 - protein, 134 aa, Triticum aestivum
  unsure (1)..(134): unsure at all Xaa locations
  Clone ID: PAT_TA_15832.pep
PIEAVNQRTDSLVSVCTDALLSCWCQHLMDPGRGFANPFLASGRGRSLRFDLGRVRSVLYYSNTYHKSFCTFDKKLAICSGVYHMFFHWCFVSTYLRYTLCIHLLCSLTNVYAYPRKKNTLAASILHSSXIKIR

SEQ ID NO: 121415 - protein, 197 aa, Triticum aestivum
  Clone ID: PAT_TA_15833.pep
MAATAAAAAVRPSLPITPPRRERSAACCSLAPATSARSTRLPPSSRWRCTVVTHPRSRRLHGPRCSQAEVASSTVDDDEACELVRGTDVVIGQGDDESVRAYLLEAVKNNNGTCVLFLSDVFGFEDSATRDFAYRIACHGYNVLVPDLFRGNPWKKSLPMGGAQAPLAGPAPGPGAGLIDACRSGRVADSRGSHGRL

SEQ ID NO: 121416 - protein, 333 aa, Triticum aestivum
  unsure (1)..(333): unsure at all Xaa locations
  Clone ID: PAT_TA_15834.pep
MSRPDDGHRSFFPVGNPFRVILPGGPHLPRKLQALLKSYEDALALSLRKLKPENALEVLTLSWMRLAVDCLSELHANIGTLITELELPVSDWDEKWVDIYLNSSVKLLDICIALSSELARLDQGQLLVKYVLHVLDPKGGVPSLEQLKRAEVLLKEWMDKVDTTRPRLDSCSMALQELAGSLCLMKVKNSAKGKVLMRALYGIESVTVFTCSVFVAALSGSPKPLVELHVPHKFGWSQAFNDLHATISGEVKRRLSRGSVSAVKELEEVEACARKLHALTRTAQLENENDNVACAVSLSKQMVMPVSTGQKGDPRCNLKPADDSSPXCEAIMT

SEQ ID NO: 121417 - protein, 306 aa, Triticum aestivum
  unsure (1)..(306): unsure at all Xaa locations
  Clone ID: PAT_TA_15835.pep
PNHARRGGRRLRPIRKRGREKGTGDGTTGWDEEVEYRLPRGHRPVEDLDTEGLEQAPVDTRQAASNVGFRLLQNLGWKSGKGLGKNEQVILEPIKAGIRDAKLGXWGMQEQDDLFTNEDNVQRKKQNVELEHGEGADQERXLGVRANVEQKIWSEVMEIQKIFFCSLCNKQYKLAYEFEIRLSSYDHNHRKRFKEMKEIQSGDSGNRDDSPKREPRSKEKELAKFAQLADAHRKQQKEKQEQPDISGEQATPKNLPTPGNQDQRRTLKFGFSKMTPSKAPVGNMSKKPKIATKVPSVFGNDSDEEA

SEQ ID NO: 121418 - protein, 145 aa, Triticum aestivum
  Clone ID: PAT_TA_15836.pep
AESYCIVHDYQCTIKSTFCLVKAGAVNPLVKILEGEEREADGAVLEALATLVQDEIWENGSRAIEKASGVHALLRVAEAGELTSQDKAIWILERFFRLEEHREQYGGIAQALLIDLAQKGDPVLKPMIGRILAHLQLLQTQSSYF

SEQ ID NO: 121419 - protein, 149 aa, Triticum aestivum
  Clone ID: PAT_TA_15837.pep
MTSNMRPLNSKKGEVPSHGRENCGVSDQAFHGKCQSCDGVGKPSYPRANGVSLKESGTCNFSCDHANALLVDGPKGSPARPGHIDSAVCAQHGCHDAKIACNDLQQESDREQAGDTLDDLFFFNDEEDDDIDWEPSARLAENRWFCLNC

SEQ ID NO: 121420 - protein, 226 aa, Triticum aestivum
  Clone ID: PAT_TA_15838.pep
MQDRDMEQTDEAVSASPARLLTPAGEQQGDAATWLDLTLGVNGSQPAAAEDPSSCSDEEPAAKHRQEQPPPPPPAAAAAPTTPHKVFSCNFCMRKFFSSQALGGHQNAHKRERSAAKRSSSLSYHHAHHQRMVMAGLPLEAHAAIVRALRVNPAGSAVHKPARQEATAPRLHDGVVGPWPPLVYEEVLGSTSWPGSFRMRTQTEPPSSEQQLLPEQTKKMDLSLRL

SEQ ID NO: 121421 - protein, 151 aa, Triticum aestivum
  Clone ID: PAT_TA_15839.pep
IQSCLFKLNMILPSSLKKLDLACCDGTDSGHPAASGLGRGAAREAPRPPRWRGLKSIGGAAAVDKIKKVNIVGCPELMEIQQPLCRCSLTFLVRLAWLALLMMRSELGTAYTGNRFHRAYSAQRWTAASSQRRMTAACARTCCWRSPRITN

SEQ ID NO: 121422 - protein, 328 aa, Triticum aestivum
  Clone ID: PAT_TA_15840.pep
VIQRVLLPRVPTTQEEEDVLPPKDFVAALPVREGWSEPLVQYKNYWFRPRLLEQILLVQHAFVPRADDIILATQPKCGTTWLKALAFTIANRSRYGFSDHPLRTRHPQHVVPFIEIPGAGPNHTDIHTLPPPRLLATHMPMSLLPPGTRSVGCRLVYLCRDPKDALVSRLHFENKVLQGTNLSMDSAFSMFCQGFSPYGPFWDHCLEYWRESVARPDNVLFLKYEEIKSDPVPAVRKLAKFLGVPLTEEEESSGVAQEVVKLCSFETLTSLQVNQVGGVRHGDKFFLSNSVFYRKGEVGDWANHMSHVMGEELDRIVQQKLEGSGLVF

SEQ ID NO: 121423 - protein, 149 aa, Triticum aestivum
  Clone ID: PAT_TA_15841.pep
ASARAGAIAALSRAKAWLPELDPADIALGYPSLKEDGNPFDEKDFTTCVRDIRPVATQIGNDTDLTKCQPGYDKENQRIPTPHYDNVSLIPPIRKHTFAPEVDPTGLIDDEAKFEALSGINWASSSFQDKAAGGEAEKDNPEASSQLKE

SEQ ID NO: 121424 - protein, 400 aa, Triticum aestivum
  unsure (1)..(400): unsure at all Xaa locations
  Clone ID: PAT_TA_15842.pep
MPRPWREVLASATKCWSAEEDDEAADARNYRPPNSEFSRRLASFRRLSALANGPATPTDGKDDEDNPDGVGEMGVGTMQQLHSFSLSELRGVTHDFSSGYLLGEGGFGAVHKGFVDAGMRPGLEPQPVAVKQLNIAGHQGHRERQAEVIFLGQFRHQHLLKLLGYCCEDEERLLVYEFMPRGSLDNHLFKRISATLPWGTRLKVAIGAAKGVAFLHGGKQPVIYRDLKASNILLDSDFTAKLSDFGLAKMGPXEGEETHVSTRVMGTHGYAAREXVQTGHPGXRATGRAWAEGALEALTGGRAMEHVPGRTARAEQTIKVVEWTRAYLASSRRRRGATDRTVSERYARRGAGAVGYRAGAGAARGARGRGGAGGLVSAHGWRGRAKGTARSMGRCYRRAH

SEQ ID NO: 121425 - protein, 133 aa, Triticum aestivum
  unsure (1)..(133): unsure at all Xaa locations
  Clone ID: PAT_TA_15843.pep
IRSRARGRRRGPPWLKTVQRVLLNCTYTTLDYAQTGXLIAAVFFFKMMEXWWYQSAEERMSXAPTVYPPPPPPPLPKVAKDGLPLPTDRTLCPLCCQKGNNPSVLSVSGFCXFCYSCIFKSGLSXIXRCPRDV

SEQ ID NO: 121426 - protein, 181 aa, Triticum aestivum
  unsure (1)..(181): unsure at all Xaa locations
  Clone ID: PAT_TA_15844.pep
QCPFFEELHAVFTERAKNMQRQLLQSESGTSVKKKLKRPSGDQSSGESDENEYGVEVSDDEKPVISKKRKAGDKGQPSQRMAENSRAGSSSIHDLLQEFLVQQQHVDMLWHETMERRAQERLIFEQEWRQSMQKLEQERLMLEQSWIEREEQRRMREEARXAQKRDSLMTTLLNKLLQEDL

SEQ ID NO: 121427 - protein, 223 aa, Triticum aestivum
  unsure (1)..(223): unsure at all Xaa locations
  Clone ID: PAT_TA_15845.pep
GCWGHFDEAEQFIASMPFKPGALVWRSLLESCSKQSNMTLRRRAMNHLLALEPQDPSTYVLASNLYSESAKWHCSENTRLEMREKGIRKIPARSWTFYDNAIHSFFARDRSHPQSKDIYAGLDVLTLECIKAGYEPDTTFVLHDVEEYQKRHFLMYHSAKLAATYGLLMAGSGKIIRVVKNIRMCGDCHSFLEHASAATGKEISVRDXNGFHVFRAGICSCRD

SEQ ID NO: 121428 - protein, 118 aa, Triticum aestivum
  unsure (1)..(118): unsure at all Xaa locations
  Clone ID: PAT_TA_15846.pep
LPSSSVPLRYSPSPLCAPELAPRASADSEVDPSLAPLPPRRXSEKTPAFIMLLPLAPPPPPPMLASPWRRLNPVVAPEDIPSWPCAAAWCCCCCCCWSGDMACCAYIIDDRAAISDCG

SEQ ID NO: 121429 - protein, 171 aa, Triticum aestivum
  unsure (1)..(171): unsure at all Xaa locations
  Clone ID: PAT_TA_15847.pep
MGWRATSVHEPLSVSGVPVPCCVARAACEGWGCALFLLLFDPATYLGYSLDIGKEHVNLVDDQLQKLLYSGQLDQKEVDRLAXISMAGLAAEGLEYDKVVGQSADLFTLQRFLNRTKPPLGKAQQQNLTRWAVLIAASLLKNNKAAHDALVSAMSQKATVLGCIEAIENAS

SEQ ID NO: 121430 - protein, 382 aa, Triticum aestivum
  Clone ID: PAT_TA_15848.pep
ISGFHSNTHIPVVVGAQMRYEVTGDALYKQIATSFMDMINSSHSYATGGTSAGEFWADPKRLAATLSTENAESCTTYNMLKVSRNLFRWTKEIAYADYYERALINGVLSIQRGTDPGVMIYMLPQAPGRSKAVSYHGWGTKYDSFWCCYGTGIESFSKLGDSIYFEEKGETPALSIIQYIPSTFNWKTAGVTVTQELEPLSSLDMNLQVSLSFSGKNGQSATLNVRIPTWTSASGAKATLNGKDLGSVTPGSLLSVTKQWNSNDHLSLQFPIALRTEAIKDDRPEYASLLAILFGPFVLAGLSSGDWDAKTGSAVSDWITAVPSSHNSQLMTFTQESSGKTFVLSSSNSSLTMQERSAVDGTDTAAKRHGASQDQARHHGPT

SEQ ID NO: 121431 - protein, 128 aa, Triticum aestivum
  Clone ID: PAT_TA_15849.pep
SYLQRCERMLMVLVINSQRGHHLPAPPQPTGPSTCSEHTGQQRRPRPPPRRGGAPSPSRSCSGPWRSRTPAHRQTLPGGVRPRLRRWRSRPRHPHDASSRPPPPSPRGASSLLRQRRAAQLPPRGLPR

SEQ ID NO: 121432 - protein, 167 aa, Triticum aestivum
  Clone ID: PAT_TA_15850.pep
GRPTRPRSISEAPSAPWPANKGKRCQHCGSSETPQWREGPKGRATLCNACGVRYRQGRLLPEYRPVASPTFVPTKHANTHRKVLQLHRTRQSNDEHPSPLPADSVTNLPPIRDELPTTSTAGLASEDPTDAPGYTDNPINVPSSLDSLLLDGPSAPLIVESEDFAIS

SEQ ID NO: 121433 - protein, 93 aa, Triticum aestivum
  Clone ID: PAT_TA_15851.pep
FMPERFLGRAVDYRGGDFELIPFGAGRRMCPGMPLAIRMVHLVLGSLLHRFKWRLPTEVERSGIDMCEKFGVTLTKAVPLRASGTPKLVDDNR

SEQ ID NO: 121434 - protein, 112 aa, Triticum aestivum
  Clone ID: PAT_TA_15852.pep
VHVIRHDAKKPAGAAKEIESYFDCSASDLVLVGDRYFTDVIYGNRNGFLTVFTEPLSFVGESYIVRKVRKLEAYIINYWYKKGHRPIKHPLLPDARTIVKFDPCEGPVSPRA

SEQ ID NO: 121435 - protein, 159 aa, Triticum aestivum
  Clone ID: PAT_TA_15853.pep
PDGLPDDLVEFNVSYNNFRPPVPSSLLKFPDSSFHPGNELLVLPRSASPNSPEGSGGRKHGMKRGILYALIACVIVFVTGIIVLLLVHWKISNWKSSEKGKGQNKNSATQGQDASQRRAEIPSSEMHDVSLGSSPSAEYGGVSVPRGGMEGQHEAQCVD

SEQ ID NO: 121436 - protein, 150 aa, Triticum aestivum
  unsure (1)..(150): unsure at all Xaa locations
  Clone ID: PAT_TA_15854.pep
RTSRGVLRTXYILFFPQATSXSREEGQEIMDLADLSTPLPPWFTEEDLDAYAALFEKSGFRYPLQIPGRSLHRMTKHVDPKFQVPVFMVMGERDYCFKFPGFEAAMRSGVMNTFAPDLKITYIPEGSHFVQEQFPDQINDLLLGFLKDHP

SEQ ID NO: 121437 - protein, 160 aa, Triticum aestivum
  Clone ID: PAT_TA_15855.pep
PLHNSSRRSSVWRMCACNGWLVFWWLRCRHPSIRRRSGSAAAHLPSRGPPRHHHPSSSLSIPFPSSSPSPLPALCQNAAASRRLGLVAPTDRGPTAPIRMRSPTSLLRQHYIPPPPTSFINLPLFLEAPPSPSGHLMLPSRPRLAASSPRTNRIFSCLSS

SEQ ID NO: 121438 - protein, 154 aa, Triticum aestivum
  unsure (1)..(154): unsure at all Xaa locations
  Clone ID: PAT_TA_15856.pep
PNAGITVWPLAAGRDSVRTVEEGERREGGVTRTGTGRKPLERRLPPGQRSVVKWASPLRXVKGRGQGCIDRRDGDKXPATGAVELXGRIAAQCXPYEPNYRPSXMGTLARVINYAVVRDQAGRGLMIVTDERAAVYVWGEVAAVAGCSSCEPPT

SEQ ID NO: 121439 - protein, 167 aa, Triticum aestivum
  unsure (1)..(167): unsure at all Xaa locations
  Clone ID: PAT_TA_15857.pep
XPIXLXGKNLXKVPRXEHXWXGXXHGXGVXLAKGCCXGRKRAAXXPVEKAWEKQHLLPGGPSPFPAGDVAPSSRRTACARRGDWRGPPSQHWHATPEPSHPASRRRRDPRHPAAWLLADMATPAAAGSQARPRRLPARSRRHAPTAPSGAQQWPTRQALRPVAVSNP

SEQ ID NO: 121440 - protein, 158 aa, Triticum aestivum
  Clone ID: PAT_TA_15858.pep
MCKIYTLSECFPNGALTSSVIPVGGYPGCPGVALPTPLSVALWAFAPGRPSSVATWWPRIWPDDRLTFGRLRGAPLRPRLRPGPIAAFLSSVSCKETNGTINPGSNLQKDHHLRIGEGRAGAACAVESWGGSTHLLSSSTPRPRNNFSNYWTELCVTN

SEQ ID NO: 121441 - protein, 154 aa, Triticum aestivum
  Clone ID: PAT_TA_15859.pep
QEVSPNTKHAYWLIPKLPREAIDKESLPAPYFTILTTNYTTGISKCWSRTMLIHMSSMRMVFHHGKILLMECIPLGLECSIHQKFKWRCSRAFAHPRVLQVYVSITTTPSTWNDFFSEAVFMKEIRITGDILRNAVLRYNIKSLRQCFFVARTH

SEQ ID NO: 121442 - protein, 196 aa, Triticum aestivum
  Clone ID: PAT_TA_15860.pep
MNNLEQGLSAELRDVREETSNINAELIKGFLDMGGVGRQNISVKYMGQLSERPFLLACLQKLLRQEAEAGAAGLWNRRQEQVPRPEGYPSKTDPGGGISEGTINDDDVKLQELRATWGEESYKALVKALVNSFLELKECGKLSDRTIVAQLWNFEEDRKATLSESVEYVCNKVKSLSNENVRTSTRGKRGRCGGRA

SEQ ID NO: 121443 - protein, 148 aa, Triticum aestivum
  unsure (1)..(148): unsure at all Xaa locations
  Clone ID: PAT_TA_15861.pep
MGESNENIQFSWGKKRAKGGAKMDTQFYGSFTFDNVKYSLYDCVYLFKNGESEPYIGKIVKIWQQNEAKKVKILWFFTPDEIRNYLRGPVAENEIFLASGDGTGLADINPLESIAGKCTVVCISKDERNRQPTXXXXXXADYIFYXXF

SEQ ID NO: 121444 - protein, 109 aa, Triticum aestivum
  unsure (1)..(109): unsure at all Xaa locations
  Clone ID: PAT_TA_15862.pep
XTPRSARHSSSVADWFSAPPEDWRLQQSSNHFKILTWDATRLRIDVVTFTAPNNVIFHISEYTGPNQTTLATNRSFLLVSSCAESRGHQSNSPIVVCTSSIQDSLAGIN

SEQ ID NO: 121445 - protein, 152 aa, Triticum aestivum
  Clone ID: PAT_TA_15863.pep
PPPLSPTPAALSSPATSSSAAGHQPLPSPSLPSLCPRSTNPWCCRRIRDQARLLLVVVARAALRRIHSGHAADLQRLRLIHADPRCPEPSPGDFLRHPLASAVPPISGAVCSPSPRSDVILLRALKPHAHRPEPHSPLLAPTVVNWPPRPPS

SEQ ID NO: 121446 - protein, 372 aa, Triticum aestivum
  Clone ID: PAT_TA_15864.pep
RHEGCIHCSGQSRENWHWFLEQLKYSLSASHDITFISNGENGLWDEVSLVFPDSHHGYCMDFLIEAFKRQLDDAWTEEVRDAMVELLKRAIFSCTIDEFNQYMEQIKSESDKLAEWLLEIKPERWSDALFMGSWYGQYSCNISNTVVDWIPTRYELPVVQLVDTIRCKLMEMMYTRRESCNEWPDGLTPVANQKLQEEVSKAHSLNVMPTESDGDGNLFKVCDDSVNVVNIETCDCTCRKWNISGLPCMHAIAVFERTGRYAYDFCVEYFTTKRYRSTYSMSINPIPDVTLTDNSQSPATLPFPIQTRRRVGRPKEKPADPRITIKRAVRCSRCKGYGHNKATCKIPISGEALPALPPAELSDVHNKVESCS

SEQ ID NO: 121447 - protein, 174 aa, Triticum aestivum
  unsure (1)..(174): unsure at all Xaa locations
  Clone ID: PAT_TA_15865.pep
MXNATVWXKTFTDLFDYFPLTALVESEIFCLHGGLSPSIETLDNIRNFDRTQEVPHEGPMCDLLWSDPDDRCGWGISPRGAGYTFGQDISEQFNHTNNLRLIARAHQLVMEGFNWAHEQKVVTIFSAPNYCYRCGNMASILEVDDCREHTFIQFEPAPRRGEPDVTRRTPDYFL

SEQ ID NO: 121448 - protein, 307 aa, Triticum aestivum
  Clone ID: PAT_TA_15866.pep
MSSPHGGLDDQIERLMQCKPLPEAEVRALCEKAKEILMEESNVQPVRSPVTICGDIHGQFHDLAELFRIGGKCPDTNYLFMGDYVDRGYYSVETVTLLVSLKVRYPQRITILRGNHESRQITQVYGFYDECLRKYGNATVWKTFTDLFDYFPLTALVESEIFCLHGGLSPSIETLDNIRNFDRTQEVPHEGPMCDLLWSDPDDRCGWGISPRGAGYTFGQDISEQFNHTNNLRLIPSAPRGATDRFHWAHEQKVVTIFSAPNYCYRCGNMASILEVDDCREHTFIQFEPAPRRGEPDVTRRTPDYFL

SEQ ID NO: 121449 - protein, 173 aa, Triticum aestivum
  Clone ID: PAT_TA_15867.pep
TSSSSRSCSSPHLAVSRSFTSAPRLSSTCAASAHPRTRARRQSALAAASLAAPRSSSGSCSPATHGPPHPWPRAHIGHGNPCGDGHITPSSSSRRTSHSICGAAHPPPSPSCRNNGDDSMVSQQTAVVANIGHGSSKSNNGGSKKTESDAIPTNQNLVVAKIEAYSSIPKRRW

SEQ ID NO: 121450 - protein, 185 aa, Triticum aestivum
  Clone ID: PAT_TA_15868.pep
MNWRSEHIWVELLKGSRKRGNFFWACILFLGSLGFLSVGISSYLGKNIISILPSQEILFFPQGVVMSFYGIAGLFISSYLWCTILWNVGSDYDSFFERPPGQVFFRWGFPGIKRRVFLRFLMRDIQSIRIQVKEGLYPRRILYMEIRGQGIIPLTRTDDKFFTPREIEQKAAELAYFLRVPIEVF

SEQ ID NO: 121451 - protein, 256 aa, Triticum aestivum
  unsure (1)..(256): unsure at all Xaa locations
  Clone ID: PAT_TA_15869.pep
IRHEVLFSSVHLVPKEISYTLHALPTVVLEPPGSASSPSAPPMARASPPXLAVAVAVSAIIPAPMLAAAPGLGGCMPGRCGSLTVSRPFGVVPGSEENRCAQMGFQVHCNDRVPYLGYYEPGFGLRILHIFXSNGSLLVSDAHKLRGFAGRSSPQGCHVPTADTATKVGHPFSISPLNQNLVFYNCTKPPAPWTARRAGLLDTXCARNNTFVRAGGPYNASRRVLTAGYALGLQRHPPLPASGSELPDYQASMGFP

SEQ ID NO: 121452 - protein, 225 aa, Triticum aestivum
  Clone ID: PAT_TA_15870.pep
ECASRLYVEGVCEELEWLPFYYEDVPTAIVDTQGREEMPKRELISRVLNVCTYWMTSFIKYSSWLENPLNVKAARFLSKGHAMLSDCMTELDIAKYAGPSGRSCHAPRAGVDAARRPSFLESLDRLVAAWGGLVDLRLVFLLSSSSPGLEDLLAPPPDRELCRRLKKEAEFLEASFRAKAEYLEADTISRVLPPAGEGEHGKTGSMVNEVLTPQKPVNRMENNRR

SEQ ID NO: 121453 - protein, 313 aa, Triticum aestivum
  Clone ID: PAT_TA_15871.pep
TSVNMGGGEISFHGASVKAEQNISKGIVCASTELANENIPRHSNTTKRVQMPSAPILRATYNKIGPQDFSNHIRTNYPSISDEKLGILLRARNARGLANISEMRRSFQSSMFTFADKLINCIAENCSCCKANGRKQCILKSENQNSCTNLANTPMQEKIDNSFVTPVCNKVSPRLAGQLPNDGSSSANSSIARKRGVVFSPAIQTESSKKVCLRLDDPLQAVSHSAVDTVNNSSLSGKQDTRREVANTIYSFFDDLTASIVMYYVEQRPSSGYVTFGTTNDTAPAKIQITKCNIARDPWAIRSVPMPPAVPVL

SEQ ID NO: 121454 - protein, 123 aa, Triticum aestivum
  Clone ID: PAT_TA_15872.pep
SPHGLSHLNPRHLYPARGRGTAGRTSTHQTVRSQQPRLEQATRDSTSTPKATSSRFNRLPTKSRQSTLDARRSYAQLLQSTSEEVTRNHFRSAAPACERVPGKLAPSGCNRHLFVFCQQIVPC

SEQ ID NO: 121455 - protein, 157 aa, Triticum aestivum
  unsure (1)..(157): unsure at all Xaa locations
  Clone ID: PAT_TA_15873.pep
ARVICARGSYGQRGQQRRGRRPGPPSSELRPRPRPPPPXPPPPQQPRAPPFRCFFPXPALPPAPPHPPPPATLPRXTRPSSRRRXRPPGAPPGAPPPPPLGPPRXAXPPGPQPKFPALPALPLLPPLGXCPSPSRSXPSLPFSLSTAPNSPXPFXYP

SEQ ID NO: 121456 - protein, 239 aa, Triticum aestivum
  Clone ID: PAT_TA_15874.pep
MAVEAMAEKNTGAGVAGGVAPESGDRRSRFRRICVYCGSAKGRKASYQDAAVELGKELVERGIDLVYGGGSIGLMGLVSHAVHDGGRHVIGVIPKSLMPREVTGEPVGEVRAVSGMHERKAEMVRSADAFIALPGGYGTLDELLEVLTWAQLGIHKKPIGLLNVDGFYNFFLSFIDMAVSEGFIQEDARHLVISAPTAKELVLKLEEYVPDYEIGLVWEDQGQITHGFAPELEPGIASS

SEQ ID NO: 121457 - protein, 90 aa, Triticum aestivum
  Clone ID: PAT_TA_15875.pep
DTKTNPGIPPALLARSRATVRGIRMVSESFKTEGSTEAAGLRIAAQYIGAFSGLVTGTNTMLLSPADAGNPGDNDCPGAPRYTTTRTSRN

SEQ ID NO: 121458 - protein, 261 aa, Triticum aestivum
  unsure (1)..(261): unsure at all Xaa locations
  Clone ID: PAT_TA_15876.pep
CCVELFKRVQAQLRARGTXREDKKPEPAKSQGERGSVDSLLNLLRTHSVDQKPMNSDEKEQNLMMLMRSSDSGNKQSSRIFGTLHDAQEGQKPPPATFQGSPSSFRRTGPVPGVKFQLVTNPTAGAKPVVNGMTDAVLEPKTPLEEETAQDEPDSASPYEPDSVIAPEDASLDDFVVSDDESDVLDTDEPDEYLEPFDNADDVTDSIPSHDDSLEGSPSVEASDLSSLKVMELRELAKSRGLRGYSKMKKSDLVALLSDVS

SEQ ID NO: 121459 - protein, 207 aa, Triticum aestivum
  unsure (1)..(207): unsure at all Xaa locations
  Clone ID: PAT_TA_15877.pep
STHASDKIKTGTKGDASALRPTLMTAVPAILDRVRDGVRKNVDAKGGVATTLFDIAYAPRLAAVHATAHAAWGLEKLVWDMLVFQKVHAILGGRIRFILSGGAPLSGETXRFINICLGAPIGQGYGLTETCAGGTFSEYNDTSVGRVGAPLSCSFIKLIDWVEGGYLTSDSPMPRGEIIIGGPNVTKGYFKNEAKTNEVYKDDERGM

SEQ ID NO: 121460 - protein, 141 aa, Triticum aestivum
  unsure (1)..(141): unsure at all Xaa locations
  Clone ID: PAT_TA_15878.pep
MLAVSSARCPARDAVEQCAEAAPVETVGGAVVVADLDIDFDFTVDDIDFGDFFLRLEDGDALPDLEVDPADIFTDLEAAAAGVEELQDQQVPCAELLAAVEDVGSVSSAGGVIAVENAAFAEAXLGDGKRGCSQAEVDESM

SEQ ID NO: 121461 - protein, 371 aa, Triticum aestivum
  Clone ID: PAT_TA_15879.pep
EFGTRIGYVRDPPVWQPSEDVGDLLTVHFTYSDTIWPWTGYLALHMQVKDEGSQFSGIINGNVTLSIYSPAAEGESSPRSSTCVLYLKVRVVQTPVRSRRILWDQFHNIKYPSGYVPRDSLNVNNDILDWHGDHLHTNFHILFNMLRDAGYYVETLGSPLTCFDASNYGTLLMVDLEDEYFSEEIQKLRDDVVHKGLGLAVFAEWYHVDTMVKMTFFDENTRSWWSPLTGGANIPALNELLAPFGIAFGDKILSGDFSINGEQSHYASGTDIVQFPAGGFLHGFELQEDPKTAQNSSTPDTQNSQSQEKSKLSSILGMLEAGEGRIAVYGDSNCLDSSHMVTNCYWLLRKIVEFAGQWTQEILSFSQKQLG

SEQ ID NO: 121462 - protein, 124 aa, Triticum aestivum
  Clone ID: PAT_TA_15880.pep
ATVTPSVLSKRSMSHLPHQHLDSVARTVLWRIGSSSLTWTGFFKSIASMAYFKQLQLQDKSPAWLRPASWLQRLGPEMVACPAPYPLLPPSGAQRRAPDAGARSAGRCPPGLAAHFRRCYCPCS

SEQ ID NO: 121463 - protein, 188 aa, Triticum aestivum
  unsure (1)..(188): unsure at all Xaa locations
  Clone ID: PAT_TA_15881.pep
MPSPILPAKEVEEVVTANEEVTDIIVQRVPYWDPPTVRALDAXKLTTWSLYRALIGEFTASLILLYVSIATVIGYRNQSSAADERCTGVGYLGVAWSFGATVSVLVYSTSGVSGGHINPAVTFALFIAGKVTLVRSVLYVAAQAPGLLAWHPGYEQPHFAPLPGVSSGGSGKFWTCLPKARPTTRFPW

SEQ ID NO: 121464 - protein, 207 aa, Triticum aestivum
  Clone ID: PAT_TA_15882.pep
NSARAQELTGISYRMVTDGYTQRMVQAFEYGGDPDRALEIWFFELDVDWVLQMREQHVLRRKLPDMSASSLQDLVGRWIRALTVIVFNIRNLAVAVHKMPPIAVAQFGKASVSAMLVFVNAILTVPKTHKLRAVVDMFICVSSVSYYMFTTLVISPEAKSIFSEIGGSLEGEGNRLLKALCSMMEEVRTFIEDDTPGLSKSPGKGEV

SEQ ID NO: 121465 - protein, 313 aa, Triticum aestivum
  unsure (1)..(313): unsure at all Xaa locations
  Clone ID: PAT_TA_15883.pep
MWWRAVARARRRIPGARPVSTAAAGKSGREVVVPRFGGPEVLQLRQGVPAPDLKPGEVLVRARAVSINPLDLRMRAGYGRCIFEPLLPLIIGRDISGEVAATGTSVSSFYIGQEVFGALHPTAIRGTCADYAVLSQDELTSKPSTLTHVEASAIPFAALTAWRALYGTAGISKGQRLLVLGGGGAVGLSAVQLAVAAGCSVSATCGAQSIEQVLAXAGAEKAIDYATEDAESTVTGKFDAVLDTIGVAETERIGINLLRRGGHYMTLQGEAASLADRYGLYVGLPAATATLLKIQIHILFQGIKYWWTYMXLI

SEQ ID NO: 121466 - protein, 204 aa, Triticum aestivum
  unsure (1)..(204): unsure at all Xaa locations
  Clone ID: PAT_TA_15884.pep
QISPLLPPIPPVPPWIQVNRGRDRNIWYQICQIISKNPPSPRVSSATPPKWSKRVDELAATLKLIQEQNASIQKAVATSTALFEEIKPSVLRSGGSGRPNARAVPSPILRSGSGAGVRREXWIPXIKAIPAXGASKPDRFFRRLNSTARRGICACALRPQAPPPPPRRPPPGAANRGSDYPRSTSGHGYVTTVQISFSSSCACT

SEQ ID NO: 121467 - protein, 348 aa, Triticum aestivum
  unsure (1)..(348): unsure at all Xaa locations
  Clone ID: PAT_TA_15885.pep
MLQEHTKSRGARRAGSEQEKAIMVHPVAEADERSPFGRLTAEEYYARHGVTHSSSTFVNPRGLRIFTQRWVPSGDAPILGAIAVVHGFTGESSWMVLLTAVHFAKQGFAVAAVDHQGHGFSEGLQAHIPDITPVLDDCEAAFAPFRADYPPPLPCFLYGESLGGAIALLLHLRDKPRWXDGAVLNGAYXGVSPRFMPPWPLEHLLWAAXAVAPTWHVAFTRGNIPGRSFKVEWKRALALASPRRTTAPPRAATALELLRVCRELQARFEEVELPLLAVHGGDDTVCDPACVEEMHRRAGSKDKTLRVYPGMWHQIVGEPEENVEQVFADVVSWLKARAAAGPHSAVVG

SEQ ID NO: 121468 - protein, 150 aa, Triticum aestivum
  unsure (1)..(150): unsure at all Xaa locations
  Clone ID: PAT_TA_15886.pep
MDVADIASPSGQQEQGHRTVSSEPPKRPAGRTKFHETRHPLYRGVRRRGRVGQWVCEVRVPGIKGSRLWLGTFNTAEMAARAHDAAVLAXSGRAACLNFADXAWRMLPFSRRSFGFTAAEIKRLPWRLQRNHSRVPQQQKFVHGVWVTQS

SEQ ID NO: 121469 - protein, 256 aa, Triticum aestivum
  Clone ID: PAT_TA_15887.pep
RPIESSNSQVSEKGVLQILLDLRFIGDILSGGKNSSANPSETKIKQDNAKTTFRRKQSQFQADSATIEPINKLINKFSQRLDPIDWATYESYLWENEKQSYKRCVVLFGFLVQLNHMYTGAAQKLPTKTNTDSNIMRCSQVPRFKYLPISAPALASRTPKSSLQSPSDDSTSRNPWKSSYSNGERSTISEYDNNASLGSAAPLLKSFVTQVGSKFGENTSRWGSMLSDGQVGLSDILPGPAAGFFSSFTSGARYDS

SEQ ID NO: 121470 - protein, 128 aa, Triticum aestivum
  Clone ID: PAT_TA_15888.pep
MSRRFSGMATDLFCTHRILFALLEKGGITIIRELESRGSVQKLAKILLKASGGELLNDILADIMDRYSKHDSKESLRRTIMEHDEVFRQQVHELHRLYRVQKALMAELRGEKHSFQLRTEDTREMVQG

SEQ ID NO: 121471 - protein, 164 aa, Triticum aestivum
  Clone ID: PAT_TA_15889.pep
DDTVLSSLTRSATPSSSSSLIIKKRPRTVRPRVRPRVRVDPPVPRKLRSAIIKRVGQAVPSSPRHAKKRRHLSAISAQIFQMDRETRTDETMPSNSFTKEEEVLADTLLALSQIAPPSEPKADTATEQDISNTNVASTSCSEGVITPTGAIKEDDRITLLPTDA

SEQ ID NO: 121472 - protein, 285 aa, Triticum aestivum
  Clone ID: PAT_TA_15890.pep
MGARRRLALLALAVALAAAAATTGHAGVTSPYRRKLEATADMPFDADVFRVPPGYNAPQQVHITLGDQTGTAMTVSWVTASELGNGTVRYGPSPDKMEMSAQGTHTRYDYFNYTSGFIHHCTLRNLKHGVKYYYAMGFGHTVRTFSFTAPPKPGPDVPFKFGLIGDLGQTFDSNSTLSHYEANGGDAVLFVGDLSYADAYPLHDNRRWDSWARFVERSVAYQPWIWTAGNHELDYAPEIGETVPFKPFTRRYRTPYRAVGSTEPLWYLGQVASAHIIVLSSYSSY

SEQ ID NO: 121473 - protein, 278 aa, Triticum aestivum
  unsure (1)..(278): unsure at all Xaa locations
  Clone ID: PAT_TA_15891.pep
IRHETISLLEEAGLDPVALDLTGSRTDHTDTNSIATXLEEYSKPLIDYLSKLPENEKVVLVGHSCGGASVSYAVEHCPKKISKAVFLTATMVKDSQRPFDVFSEELASADVFLQESQYLLYGNGKDKPPTGLRFDKQQIKGLYFNQSPSKDIALATVSMRPIPLAPIMEKLSLTAENYGTVRRYFIQTLDDRMLSPDVQEKLVRESPPDGIFKIKGGDHCPFFSKPQSLHQVPRAVPRFLAPRALPPGKPGSREEAPPEPRDLSMTVGIHGVLHENRQ

SEQ ID NO: 121474 - protein, 203 aa, Triticum aestivum
  Clone ID: PAT_TA_15892.pep
MEAAMDGGSARATMSIFGESIGGRRADKNRAQENLSSEMKQRAKSDMDKLNERKASVDNERAGAESELSRARAMAKELERQIDQTKAKATSQRSGLQATWTRKNGRRGSAQYPEVSQELERVRGLPPNRSLQVKSAAEAKAKAESDVVATVCKIQSNLQAADEMKRRVDEANEEHVLVELARIEAERERRELEAQHVAEAERF

SEQ ID NO: 121475 - protein, 322 aa, Triticum aestivum
  Clone ID: PAT_TA_15893.pep
MDSAAASSLVVSPASDDRFWDGLRTRVDTIIEDRRLVASAASTCAAASGRPKRLREDSLMLVRGLDSVAASLAQLSDTLTAAQKGVNALAMCSSQARERESGEEEPDAKRHCTASTEFATLEAQKDVNEGSDNGAGDAKPREGPDGDAVLASAEVAQSTNLKRARSLAVSMAGRAANLARELTTIKSELRFMQERCGLLEEENKRLRDGYDSGGGAAPEEDDLVRLQLEALLAEKSRLAQENANLARENQSLVQLVEYHQLTAQEEEEEEDHLLTASYEEAIMQGMRLDFSSPLGKFDGEGELDGVPATPGSKLGALVSPDE

SEQ ID NO: 121476 - protein, 206 aa, Triticum aestivum
  Clone ID: PAT_TA_15894.pep
MMAEEPAMDFDDGGFGGGAEDNLSMPLGDFMAFLESEPGDDGEDPPQPEANQGSLEAPVDTTGFANGFESHEEFLEDEMQANQGSLEGPVDTTGYANGFENHEEILEEEGFWSNFSHIDPSQYQMEAMVEQGDGTFDDSDAKPYGLLGSDLSGNCRTTNHNNQPLPRDTLNHINAAEEANASPYKVLSNCSYVGEQMYFGKAQVKA

SEQ ID NO: 121477 - protein, 191 aa, Triticum aestivum
  Clone ID: PAT_TA_15895.pep
MDASLDFLELEAHLVFDLGDADSKRWMSLADCCSSYLPAEDSLSGLDSSCYNDPTSSPDGASTRASKNIVEERDRRRRLNEKLYAIRGVVPNITKMDKASIIQDAVAYIEELQEQERRILAEVSDLEAGGCTAVVVKSEASTGSEGVEDAGVGFSTRKKMRRTASSSSINDTVTSPATHPILLELEVRPIA

SEQ ID NO: 121478 - protein, 198 aa, Triticum aestivum
  unsure (1)..(198): unsure at all Xaa locations
  Clone ID: PAT_TA_15896.pep
MSPYAVLVAVLLAFCYAVRKARGGGGSSRLPPSPPSRPLLGHLHLLGRLPHRSLRDLHARYGTDGGLLLLQLGRRRTLVVSTAAAAADLYKNHDLAFASRXPSAPVDKLTYGSINVSFSPYGDAWRRSKKMAVVHLLSPRRVDSFAPVRAVEVAALVAGARRAAEAGEIVELRELLCAYSNAVVTRAANGAARATAEN

SEQ ID NO: 121479 - protein, 227 aa, Triticum aestivum
  unsure (1)..(227): unsure at all Xaa locations
  Clone ID: PAT_TA_15897.pep
GASKAHMPTAPCSESAPAGISPSPEAREQAAGCSNKSFATEFPNKPSSTMEHNRIIHTDRAAASRSYWVVKTTGSTTVVIVLIHKEESLLLFXQHPSPSPGNWAIRLSRILQXGDHRSAARVEGESDVALQPLVRVTGQQVGDAEKEVNATGGENSPADLPHLEPQNVAAVPSQAALPMPKENAATQPSRPFXNKLKGRXQQSSXDPXLXRNSRRKXFXXPPXLTXX

SEQ ID NO: 121480 - protein, 78 aa, Triticum aestivum
  Clone ID: PAT_TA_15898.pep
HSLKLHHLSASNNGYDPARELVLFTAPSYLPAADLYLCRRSMETQEGDAHRSESDAHKVKGRGGFVALPFIIANEMLE

SEQ ID NO: 121481 - protein, 157 aa, Triticum aestivum
  unsure (1)..(157): unsure at all Xaa locations
  Clone ID: PAT_TA_15899.pep
MSFRSIVRDVRDSFGSLSRRGFDIRILGNGRGRSHGAVHELHDPVPVIQSSCWANLPSELLRDVIERLEASEATWPCRKNVVACAAVCRTWREMCKEIVKNPEFCGKITFPVSLKQPGPRDGTMQCFIKRDRSTQTYYLYLCLTXXVLVENGKFLLS

SEQ ID NO: 121482 - protein, 193 aa, Triticum aestivum
  Clone ID: PAT_TA_15900.pep
NKSWSSRACRSTLVYPKASAPASRDVERRILVRAFGADIGLTDPTTGLKGAVDKAEEIVSKTPNAYMFQQFNNPANSEIHFQTTGPEIWEDTLGTVDILVASIGTGGTITGTGRYLKMMNRDIKVIGVEPAETSVISGDKPGYIPSILDVQLLDEVVKVTTAEAVDVARLLALKEGLLVGISSRAAAIAAINV

SEQ ID NO: 121483 - protein, 177 aa, Triticum aestivum
  Clone ID: PAT_TA_15901.pep
EIPAFSGGVKQLLGAPKHRKGKESSTMVSLADTCYGQVDLKITQFVITSYSLDPTAGVPRHLRASTHQAATRERGPSRCRSCSLRFSRRWGRASSTGEQRRGVAAAASRAPPDEHRDGEEEEAMRRREGERKRRLKGEQRRRCGRERRQRRGREWRLVVRVRVWRGVERGRAELRSA

SEQ ID NO: 121484 - protein, 242 aa, Triticum aestivum
  Clone ID: PAT_TA_15902.pep
VRGRVGGRVGEMVKQDNRRQLSAKAEQLEHELSELKQALSDKQEQEQAMFQLVMRVEQELKFAEEARISAEQDAAAQRYAANVLQEKYEEAMASLAQMENRAVMAETMLEATLQYQSSQQKALSPLPSPRASAQDDSFPVPHSGSLIFLRPSSHASGDKNKGKQNNASDCTDAKLTDAHEQREEAPSIDDEKHGETQKPDGEWTVESPRGNDKAESPKKDRIHIITNDMNGRHGQLQEIQLD

SEQ ID NO: 121485 - protein, 45 aa, Triticum aestivum
  Clone ID: PAT_TA_15903.pep
KSVSNFYEKAIQYFTKLNSFRLFFKIKASLIKSYFSSTSYKFFKE

SEQ ID NO: 121486 - protein, 205 aa, Triticum aestivum
  unsure (1)..(205): unsure at all Xaa locations
  Clone ID: PAT_TA_15904.pep
MYFRPPPKGPEWGGDAEAGQAARPLYPMMLESPQLRWAFVRKVYTILSIQMLLTIAVASVVVFVRPVALFFVSSPAGFGLYIFLIILPFIVLCPLYYYYQRHPVNLLLLAPLXVAISFAVGLTCAFTKGEVILESAILTAXLVVEPDRRTPFWAASRGHDFSFLGPFLFAAVMILMVFALIQAFFPLGRISLMVYGGLAALVFCG

SEQ ID NO: 121487 - protein, 60 aa, Triticum aestivum
  Clone ID: PAT_TA_15905.pep
MSASRFIKCVTVGDGAVGKTCLLISYTSNTFPTDYVPTVFDNFSANVVVDRSTVNLGLWD

SEQ ID NO: 121488 - protein, 197 aa, Triticum aestivum
  unsure (1)..(197): unsure at all Xaa locations
  Clone ID: PAT_TA_15906.pep
SASRCIKSVTPADGAAGKPCLLISYTSNTFPTDYVPTVFDNXSATNVVVDGSTVNLGLWDTAGQEDYNRLRPLSYRGADVFLLAFSLISKASYENVTKKWIPELRHYAPGVPIILVGTKLDLRDDEQFFVDHPGAVPISTAQGEELKKVIGATAYIECSSKTQQNIKAVFDAAIKVVLQPPKQKRKKRKSQKGCSIL

SEQ ID NO: 121489 - protein, 147 aa, Triticum aestivum
  Clone ID: PAT_TA_15907.pep
MANAVSGVAVSEECVRAFQELRAGRAHRFVVYKMDDAVQQVVVDKVGGRDAGFDDLAAALPADDCRYAVYDLDFTVGDATAKGADGEAPRSKIFFISWSPASAEVKSKMIYASSNEGFKKELDGTQIDVQATDPSELTLDILKDHAT

SEQ ID NO: 121490 - protein, 147 aa, Triticum aestivum
  Clone ID: PAT_TA_15908.pep
CRALQRLCSHSRPFIQSWFLPRPVCIRANTCKLVIPLCYLISLEEESWLYPFGFSGYTSKRTRSFAYPVNSPTSCWSLSVFLLGGLATFVISHSRCGLWFNFSGEFMGGVDMKIERRLKRFFDCLGGNTFYLFFCVCRAVCTVKHCK

SEQ ID NO: 121491 - protein, 143 aa, Triticum aestivum
  unsure (1)..(143): unsure at all Xaa locations
  Clone ID: PAT_TA_15909.pep
ADTVQYRLERMSDELDDLEXRRGLFTRAELAEVVRRRRXXEFRLRRHSPRKADFLDYIAYLLRVDALRDLRKRAIIRATPNPTHSDEDXDTNEDCKKRKKRKKKWAKSISDFAGVLRVLDVYRMATVRFKGDLDLWFRYLEFC

SEQ ID NO: 121492 - protein, 71 aa, Triticum aestivum
  Clone ID: PAT_TA_15910.pep
MCKCSPLFYIALEKDRRCSPPAYLPTCPRVHCCWAPVNQRRIVRAVRINDRRSNHSRILVVVDVVQCTSSC

SEQ ID NO: 121493 - protein, 227 aa, Triticum aestivum
  unsure (1)..(227): unsure at all Xaa locations
  Clone ID: PAT_TA_15911.pep
YFTLGVKQMICCCNKMXDATTPKYSKARYEEIVQGVSPXSLKKVGYNPEKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHXXGQIGNGYAPVLDCHTSHIAVKFAEL

SEQ ID NO: 121494 - protein, 152 aa, Triticum aestivum
  unsure (1)..(152): unsure at all Xaa locations
  Clone ID: PAT_TA_15912.pep
MSGAALVAIAASIGNLLQGWDNATIAGAVLYIKKEFQLENNPTVEGLIVAMSLIGATIITTFSGPVSDWVGRRPMLILSSLLYFLSGLIMLWSPNVYVLLLARLVDGFGIGLAVTLVPLYISXTAPSEIXGRLNTLPQFSGXXXMFLSYCMV

SEQ ID NO: 121495 - protein, 43 aa, Triticum aestivum
  Clone ID: PAT_TA_15913.pep
EPRADVEVPAEPRPGQADYWGRHHKGFAVDVVPHEMKRHAPFP

SEQ ID NO: 121496 - protein, 362 aa, Triticum aestivum
  Clone ID: PAT_TA_15914.pep
HVDPAPCINQSLAGITDLRQMVSIQGDPSHRIAAYLVEGLAARIVASGTGIYKALTCKDPPTLYQLSAMQILFEICPCYRFGFMAANYAILEACKGEERMHIIDFDIFRASQYITLMQFMKDDANKPRHLRITGVDDHETVQTTVGGLKVIGQRLEKLAEDCGISFEFRAVGADIGDVTPAMLDCRPGEALVVNFAFQLHHLPDESVSIMNERDQLLRMVKGLQPKLVTLVEQDANTNTAPFQTRFREVYDYYSALFDSLDATLPRESPDRMNVERQCLAREIVNILACEGPDRVERYEVAGKWRARMTMAGFAPCPFSSNVIGGIRSLLSSYCDRYKFEEDHGGLHFGWGEKTLIVASAWQ

SEQ ID NO: 121497 - protein, 268 aa, Triticum aestivum
  Clone ID: PAT_TA_15915.pep
CFTQCCDASVLLNATDGKQKVGPNLTLRRVALDLIERIRSAVHTACKDNKVSCADITVLATREAVFKAGGPRFDVELGRRDALAPAPAQINKLPGPSFPVPLLIQSFKGRGLDVADLVALSGAHTFGVAHCSLFQDRFKPGFGNPPIDPKFATMLKDKCANDFDRKKTQSLDVRTPDAFDNQFYMDLVAKQGLFRSDQGLIEDPATKALAAQFSLDQRAFFEQFAKSMTKMTNMDVLTGKQGEIRNDCAVPNKRVTAHGDKEGHAADL

SEQ ID NO: 121498 - protein, 164 aa, Triticum aestivum
  unsure (1)..(164): unsure at all Xaa locations
  Clone ID: PAT_TA_15916.pep
ERYRAFCRKLLHTKENVKLRCWVAFQSTAAPVESQCEGAADXHPLLMDHPGNVTRHDHTIDIPRNDLMSPSTSRXDCPAHLGPLNHNRGPSNEVPPVPESSGTTGMPDFRSASFVRRDQVNRQQNPLNSGLWISIELIVNVSQIIAAVTVLSVSRNEHPRAPLF

SEQ ID NO: 121499 - protein, 247 aa, Triticum aestivum
  Clone ID: PAT_TA_15917.pep
NLWKLVCKNCYRVVFLKPSILGTHIDGHIVDCAFTVAFNPMFDPLLQATRDATNTGIKEAGIDARLCDVGAAIQEVMESYEVEINGKVFQVKSVRNLNGHSIGPYQIHAGKSVPIVKGGEQTKMEEGEFYAIETFGSTGKGFVREDLECSHYMKNFDVGHVPLRVAKAKQLLGTINNNFGTLAFCRRYLDRIGETKYLMALKNLCDVGIVQPYPPLCDVRGSYVSQFEHTILLRPTCKEVISRGDDY

SEQ ID NO: 121500 - protein, 114 aa, Triticum aestivum
  unsure (1)..(114): unsure at all Xaa locations
  Clone ID: PAT_TA_15918.pep
RPVISLSSPSRSPLSPPPAPPLDSGHCWHASPPYLPPTAPPRADLPSPPARFAYPSSRARESPSPYAXSMPPPPTPAGSGDFHQGATGFRAPLSPGLHPVWPDPPGVAPTLTHG

SEQ ID NO: 121501 - protein, 224 aa, Triticum aestivum
  unsure (1)..(224): unsure at all Xaa locations
  Clone ID: PAT_TA_15919.pep
RPTRSCRCECPALIRLLRPKDNDGYIAEHHEQHNYSLSPTYCQTIHWPSHKHIDAYSGDSVEQLRQNNVNLAKVHSIIGSFFXSVEKVPFTKRALKNLCGKISREQAEDDVRKTMEVFADLGSQDPHFTYRVQADNEGRISTLMWANGSSRLQYTFFSDVVTFDTTYRTNMYNMPFGLFIGVNNHFQSIILARVLVCDKKVETFEWVFTEFVRMMGGSSPKTIL

SEQ ID NO: 121502 - protein, 125 aa, Triticum aestivum
  Clone ID: PAT_TA_15920.pep
RPPRPAAASSLSCRRRLHLPSCRRRRLSLGRAVLCRRPSALIRPRRRSSPSRRTRQEEGSSASSPPLRFSPPHVLDWAQVTTIQEHGLHDLHGGRGGARREEDSDGGRRSKVGAPGSTLACRWSG

SEQ ID NO: 121503 - protein, 55 aa, Triticum aestivum
  unsure (1)..(55): unsure at all Xaa locations
  Clone ID: PAT_TA_15921.pep
MGLTFTKLFSRXSFAKKEMRILMVGLDAAGKTTILYKLKLGEIVTTIXTIGFNXE

SEQ ID NO: 121504 - protein, 330 aa, Triticum aestivum
  Clone ID: PAT_TA_15922.pep
MPKCTPQSARFAFPKIKTQTNPNSIRLPLASRPRLINFSLPAFVLGLFSPCFAGEGMVGSPTKRRAIRRPLEKAGMVGLAVLATATAALLLLLVCSASLRYSAAVDHALAAPRKLWSGGVSIAAQVSPSPSPERGAAAMAAGEEECDLFDGSWVWDDSYPLYDSKDCPFLDGGFRCSENGRPDASYVKWRWQPSRCDLVRFDAKFMLEKLRNRRVVFVGDSIGRNQWESLLCLLSSAVPNKKSIYEINGSPITKHMGFLIFKFSDYNCTVEYYRSPFIVLQGHAPAGAPKVVKYTVRVDAMDWMSGPCKWSSADILIFNTGHWWNYEKTI

SEQ ID NO: 121505 - protein, 375 aa, Triticum aestivum
  unsure (1)..(375): unsure at all Xaa locations
  Clone ID: PAT_TA_15923.pep
MKTSGFEWVSPDETDRVPYRAEEVKELSESHDLCISGDCFEMLQRTDAVVQVIPHVKVFARVAPEQKELVLTTFKTVGRMTLMCGDGTNDVGALRQAHVGIALLNAEPVQKAGSKSQSSKLESKSGKLKKPKPANESSSQLVPPASSSAXAPSSRPLTAAEKQREKLQKMFDEMNDESDGRSAPIVKLGDASMASPFTAKHASVAPTLDIIRQGRSTLVTTLQMFKILGLNCLATAYVLSVMYLDGVKLGDVQATISGVFTAAFFLFISHARPLQALSAERPHPNIFCAYVFLSILGQFAMHLFFLMSAVNLASKYMPEECIEPDSEFHPNLVNTVSYMVNMMIQVATFAVNYMGHPFNQSISENKPFKYALYSA

SEQ ID NO: 121506 - protein, 282 aa, Triticum aestivum
  Clone ID: PAT_TA_15924.pep
KLKPATMRPIPHSRQQQIHPFMGFPEANVHETSQAKPNLPVAPPVKHHNSAPASTTAHRKSTSGPSHAQSIIQLNPLPMKKHGCDRLPIQVCSEEDFLKDVMQFLIQRGHHRLVPHGGLAEFPDAVLNAKRLDLYNLYKEVVSRGGFYVGNGINWKGQVFSKMRNHTVTNRMTGVGNTLKRHYETYLLEYELSHDDVDGECCLLCHSSAPGDWVNCGLCGEWAHFGCDRRQGLGTFKDYAKTDGLEYICPHCSIANYKKKPPPPQKVANGFANTVLPVSRNV

SEQ ID NO: 121507 - protein, 94 aa, Triticum aestivum
  Clone ID: PAT_TA_15925.pep
FKRMLSLTVRPLALIYLGSTMIPNIWMAFKFTGATTGLALGFMFPALVALRLDKEGECLGRGERLLSLGMLGLAIVVSVVGVVGNVYSLRSKSE

SEQ ID NO: 121508 - protein, 210 aa, Triticum aestivum
  unsure (1)..(210): unsure at all Xaa locations
  Clone ID: PAT_TA_15926.pep
QESARGTTSARRRISRSTGGRRRSSTDGHSRPFFSSGFSDQIGSVTPPARGRRRKLEHRLRCPLPLQIRDGSVSRASTASPTARSPGATCRRSHFAGTRSPTTASLSSARCRASPAKPRAERRPWPPDARAPPAKDPPASRPPPRHPHLAGXPAPNPIQAPRHPSGPRPAVLQPERFKPPRAPSRGEGVPATSLFKQRQTRPTLPWLLRR

SEQ ID NO: 121509 - protein, 159 aa, Triticum aestivum
  Clone ID: PAT_TA_15927.pep
LPEPTTTWSDARDTAATSTDDHHHQTGRAAAAPPAAKGGTTISITIVLLALLVASVAAFLLSSPTGVGGGSRPGAEPVEQAVGHGGVPGFNSRLDAFRTWAKLTWMKLQRPHSDDHRYDAGGNGLPGSAAEATKKSLEMGKETAEQAAATAPRGWPRTR

SEQ ID NO: 121510 - protein, 183 aa, Triticum aestivum
  unsure (1)..(183): unsure at all Xaa locations
  Clone ID: PAT_TA_15928.pep
MFKKFSSEDISGQNQVKASVQRRIRQSIAEEYPLLEPLLEDMLPKKSPMIVVKCQNHLNLVVVNXNVPLFFNIRDGPYMPTLRLLHQYPNIMKKXSKVDRGAIKFVLSGANIMCPGLTSPGGVLDNEVEEETPVAIMAEGKQHALAIGFTKMSAKDISTINKGIGVDNMHYLNDGLWKMERLE

SEQ ID NO: 121511 - protein, 161 aa, Triticum aestivum
  Clone ID: PAT_TA_15929.pep
MDPSAAEPAPPRAAPGRGADPAERRRRWCGITVRGALVMLFPIAVSFLFSFIFGIAGLLLGGLSSNASVSMPSTCRILSTGLDIRSSKVCELGLLNYKAKHVFYPSSNRRFRCHDDYYWASVFEVEYTEYFSGQTSYAMAEAPKPPLPPACRPEATQQIRQ

SEQ ID NO: 121512 - protein, 101 aa, Triticum aestivum
  Clone ID: PAT_TA_15930.pep
SVGRFPCTCRRPWRCLVRSGSSGGFAVVYCLSPLPAGKGRMLTVVQIAFTHDESPPLLYRREAMEGDATAVYALRFLRFCLASVSCILSIGISSRAAQAEC

SEQ ID NO: 121513 - protein, 170 aa, Triticum aestivum
  unsure (1)..(170): unsure at all Xaa locations
  Clone ID: PAT_TA_15931.pep
NPQWIQIVNFRKPSSPLIEYKRTCELHEVSYYDSFKLQREVHDFNSNVYRRXWNLAGLWDEIIEMLRRRELPDAFEGREEWVNLGTSYRRLVEPLDIANYYRHSKNEDTGSYLSKGRPRRYKYTQKWREQSHRIPLGSSLESCFWAMSEELQAEMINGKSFEDLKDRVGE

SEQ ID NO: 121514 - protein, 153 aa, Triticum aestivum
  unsure (1)..(153): unsure at all Xaa locations
  Clone ID: PAT_TA_15932.pep
RVRFKTFHELNGKMVEVKRAVPKELSPGPSMRSPAGGINYVMNRANSFLNGAAQGYSPSPVGGYGMRMDARFGLLSGGRSSYPSFXGGYGIGMNFDPGMNPGIGGSSNFNNSVQYGRQINPYYSGNSGRYNSNISYGGVNDNSGSVFNSLARN

SEQ ID NO: 121515 - protein, 247 aa, Triticum aestivum
  unsure (1)..(247): unsure at all Xaa locations
  Clone ID: PAT_TA_15933.pep
KLVSKNPPDIVLYFDRLDLQSRDYGDVPLLQTISKVFGASVWFHCIXVLTHAASAPPDGPNGIPLSGYDMFVTQRSHXVVQQAIRQAAADVRLMNPGALVENHSACRANRSGQRVLPNGPVWKPQLLLLCFASKXVLAEANSVLKLQDSPAGKTSSTRVAPLPFLLSSLLQSRAPLKLPEEQFGDDDDLEDDLADDYGSDDGSDYDDLPPFKRLTKVQLSKLNHAQRKXYLEELDYREXKLFYKKQA

SEQ ID NO: 121516 - protein, 178 aa, Triticum aestivum
  unsure (1)..(178): unsure at all Xaa locations
  Clone ID: PAT_TA_15934.pep
HCGTPAQRNRNAPYSIPEIEEKSLEYNTGDEGYFGKRSGEAAERFAGNRSLPQGGGMGCRGPSYSPRKSRGPSIKRFLQTGPLGPRGKRILNXGKRRKAFSEKGKRTXPASTSPLILTWRSGAGLEWLPRWGPRGGGLLAGLLLPPPAHSRCRDKAGGPTRIPDDSGNLSRRSTYRRA

SEQ ID NO: 121517 - protein, 176 aa, Triticum aestivum
  Clone ID: PAT_TA_15935.pep
TSRKFMAKIYIPVVNWFLLASCLGFILLFRSTSDVGNAYAIAELGVMIMATVYVTLIMLLIWETNIIKVISFLITFLSLELIFFSSALSSVGDGGWALLVFASGLVMIMFIWNYGTKLKYDSELKQKLSRDLMRKLGPNLGTMRAPGLGLVYSEFVTGLPFWAFLTPPASPKRRGL

SEQ ID NO: 121518 - protein, 199 aa, Triticum aestivum
  unsure (1)..(199): unsure at all Xaa locations
  Clone ID: PAT_TA_15936.pep
MQDKDFRVLYNLSLENAEQRKLDVAALYAKKLLKLENGSELRSWLLVARITSAQKRFEDAESIVNAALDQTAKWXKEILLQTKAKIQAANGQFKKAVETYTQASLLSSQLRKEKFQLLGILYYRARTDDGSMETEAWYNLALLYXSLSQWRDTELCISKIKAISAYSPLAYHATGKLLEARGFLKEALGAYSKALDLEP

SEQ ID NO: 121519 - protein, 232 aa, Triticum aestivum
  unsure (1)..(232): unsure at all Xaa locations
  Clone ID: PAT_TA_15937.pep
IYYYFERNPTQAWMSLGGXLLCATGSDAMFADLCXFSWFRSVQLTFVCLVLPCLLLGYLGQAAFLMENLTPNEPGFSSXSCPGQVFWPVVFIATLAALIASRTMTTAIFSIIKQATALGCFPRLKIIHTSRKFMGQIYIPVMNWVFXLVSCLAFVTTFGXSLMRLGNAYGIAELGGMMMTTILVTXIMLLIWQVNTLSFXAFSTSSLGPGSIFFPPGXGNVPXALSLGAYTK

SEQ ID NO: 121520 - protein, 238 aa, Triticum aestivum
  unsure (1)..(238): unsure at all Xaa locations
  Clone ID: PAT_TA_15938.pep
MDISSFVTSLLTSFVIFVVLVLVFTWLSRRPGNAPXYYPSVLLRGLDPXEGRGRGTRSPVGWIRQAFTASEADVVAAGGVDAAVYLVFLSSVLAILCGSXGIVLLPLLLPLAATDHALENSAGFKNGKEVQNFTIIERLALGNVQKKSMRLWAFILSVYWVSFVTYLVLWKSYKHVSNLRAAARSTSDVKPEELAVLLRDVPIPPPDQTIKDSVDSYFRVLHPDTFYKAMVVTDNKEA

SEQ ID NO: 121521 - protein, 224 aa, Triticum aestivum
  unsure (1)..(224): unsure at all Xaa locations
  Clone ID: PAT_TA_15939.pep
LGNYKGTTRHFEKKTNPEWNQVFAFSKERIQASVVEIIVKDKDFVKDDYIGRVMFDLNEVPKRVPPDSPLAPQWYRLEERNGHKVKGELMLAVWMGTQADEAFPEAWHSDAASIPGDGLASIRSKVYLTPKLWYPPRPVIEAQDLIPNDKTRFPEVYVQAMLGNQALRTRVSPGRTLNPMWNEDLMLVAAEPFEEHLILSVEDRIAPGKDDVIGRTVISLXXXX

SEQ ID NO: 121522 - protein, 668 aa, Triticum aestivum
  unsure (1)..(668): unsure at all Xaa locations
  Clone ID: PAT_TA_15940.pep
STHASGKILGCHLQLLNAIRTGGYLPDRVINLILQYLTNSLTKNSMYQLMQPQIDIILFEIIFPLMCFNDNDQMLWDEDPHEYVRKGYDIIEDLYSPRTAAMDFVSELVRKRGKGNLQKFIQFIVEIFMRYNEASIEVKPYRQKDGALLAIGTLCDRPWPPPPYKAELERMLVQHVFPEFSSHVGHLRAKAAWVAGQYAHITFSDQDNFRKAMHCVISGLRDPELPVRVDSVFALRSFVEACKDLDEIRPILPQLLDEFFKLMGEVENEDLVFTLETIVDRFGEEMAPYALGLCQSLAAAFWRCMASSEADDEIEDSGALAAVGCLRALSTILESISSLPHLFIQIEPTLLPILRRMLTSDGQDVYEEVLEIVSYLTFYSPTISLDMWSLWPLMMEALNDWAIDFFENILVPLDNYISRGTEHFVTCKDPDYQQCLWKGLSSVMTDQNMEDSDIVPAPKLIEVFFQNCKGQVDHWVEPYLRLTIDRLRRAEKPYLKSLLVQVIANVFYYNPSLTLAMLHKLGVATEIFNLWFVMLQQVKKSGKRVNFKREHDKKVCCLGLTSLIGLPANHIPAEALERIFKATLXLLVAYQEQVAESKRQNAAAADDVDEFDADEEENEEDEDDGENXGVDDEDXDEVNSLNIQKLVQVCFVILSRVKFAFEDLIGMV

SEQ ID NO: 121523 - protein, 192 aa, Triticum aestivum
  Clone ID: PAT_TA_15941.pep
GCSLFILYPPPLDVSPLNKGRESTVWGVSLMLGYLGFDGFTSTFQDKLFSLFHTSIHNQIFYTTMCSCVISLSGLILQNHLLPAVDFMVRHPDCFYDVLILSTVATASQFFISYTIRTFGALTFATIMTTRQLVSILLSCVWFVHPLSWMQWVGAAIVFGALYAKTFSRNKLQKAAVVSSPSQGSVPNAANS

SEQ ID NO: 121524 - protein, 93 aa, Triticum aestivum
  Clone ID: PAT_TA_15942.pep
LYSSRIFSVTINSQLSKSIYILARPSHYTLSLFWTNTILYRPNNRRHGKCFCNMMFFFVRCSVYLVSLIQKLESVEMFMHGTIEPSISRFGDA

SEQ ID NO: 121525 - protein, 351 aa, Triticum aestivum
  Clone ID: PAT_TA_15943.pep
MQGGSSGIVYGGLKYQARCITDVRADAGSTTFLAGTLSLKEENEVHLIRLLPGENELVCDGLFYHPNEIWDLKSCPFDHRLFSTVYTSGEGYGASVWKIPELYGQSNSPQLEQLFTLDDHTDKIRCVLWWPLGKHDKLISIDDRNIFLWNIDPSNKSAKVISQGSADMLPNLRGGAWDPHNHNAVATITDSSLHFWDLRSMKRSNAIEHAHIRDVDYNPKKQNIIATAEDEFGIRLWDLRMLKHPLKDLPGHSHWTWAVRHNPEYDELILSAGTDSAVNLWLAKVGTDDSGPESPSGSPTRQEEPLLHSYTDYEDSIYGIAWSSHDPSLFASLSYDGRVVLESVKPHLQRK

SEQ ID NO: 121526 - protein, 175 aa, Triticum aestivum
  unsure (1)..(175): unsure at all Xaa locations
  Clone ID: PAT_TA_15944.pep
MCVVQVFQTLTKXGTVYAEVPKLEQGLPFLKVMDNGELEGVGPLVSSPKPEKKEHLLELLDAKAGDLILFALGEQSTANQVLGRLRLFIAHKLDVIDTSAHSILWVTDFPMFEWNSDEQRYEALPLPFSSPLLTGSYASARPHGRSGFSSGLGALHVRELAFCCFFKRLQLFVEC

SEQ ID NO: 121527 - protein, 186 aa, Triticum aestivum
  Clone ID: PAT_TA_15945.pep
MKTVDELKGDLSEIFNEPSDCKPRARRPHPLKQDGYSQPLTAYHPAVKHSGYASRLSRSGQVAPHGHGLPLPRYGRRSAYSYIRSGQLEMRPCPHQCHHSCRPPCCSSWKQEPAPQKPPAMETKRRPASRNLCRPVLRGAPFVLCSNCLRLVQLPTDFAIPSRGTRRLQCGSCAQVLSYSYRDPNR

SEQ ID NO: 121528 - protein, 188 aa, Triticum aestivum
  Clone ID: PAT_TA_15946.pep
MGSGSFLKVLVSNLDVLAGPIVSLAYPLYASVRAIETKSPIDDQQWLTYWVLYSFITLFELTFAAVIEWLPFWSYGKLFFNCWLVLPYFNGAAHVYEHFVRPMIVNQQVVNIWYLPKKEGSDKPDDVISAAQKYIEQNGSKAFETLVNKFKTTNARRSILEEVEAERRARAERELAARDVNPFFHPNY

SEQ ID NO: 121529 - protein, 194 aa, Triticum aestivum
  Clone ID: PAT_TA_15947.pep
MGSGSFLKVLAKNFDVLAGPLVSLAYPLYASVRAIETKSQVDDQQWLTYWVLYSFITLFELTFAPILEWLPFWPYGKLFFNCWLVFPCFNGAAYVYEHFARPMFVNRQIVNIWYVPRKDKLSKPDDVLSAAEKYIELNGPEAFEKLISKSTSTKPSKFRSTRRSILQEAEAEKMGKAERDSWGENPFYDKNYRH

SEQ ID NO: 121530 - protein, 190 aa, Triticum aestivum
  unsure (1)..(190): unsure at all Xaa locations
  Clone ID: PAT_TA_15948.pep
MWSSSLMKVLLSNVHALGGHIVTLFYSLYASVRSXAIETNLSMDGNEWLTGCLICLLLCLLVTFXQQIEXLPLWFYGKLFVNCQLVLPYFNGAPHVYEHFVXRPMIVNQQVVNIWYLPKKEGSDKPDDVISAAQKYIEQNGSKAFETLVNKFKTTNARRSILEEVEVERRARAERELEARDVNPFFHPNY

SEQ ID NO: 121531 - protein, 156 aa, Triticum aestivum
  unsure (1)..(156): unsure at all Xaa locations
  Clone ID: PAT_TA_15949.pep
LSDSMETYTTDDALSAMGFGRFQALVLAYAGMGWVLEAMXELNLLSFVGPLVREEWKVSAQDESLLSRGPCAGRPSGPGACGLVAHRRGRSPVSPVAPLLSRRLRCLGPRSPVGLCFCALRRLAGVGVGGGHVFSSWFLEFVPAQNRGTCVVLFSL

SEQ ID NO: 121532 - protein, 188 aa, Triticum aestivum
  Clone ID: PAT_TA_15950.pep
MVLVLALGDLHIPHRAPDLPAKFKSMLVPGKIQHIICTGNLCIKEVHDYLKSLCPDLHITRGEYDEDARYPETKTVTIGQFKLGLCHGHQVVPWGDLDSLAMLQRQLDVDILVTGHTHQFKAYKHEGGVVINPGSGTGAHSSITYDVNPSFVLMDIDGLRVVVYVYELIDGEVKVDKIDFKKTATMHG

SEQ ID NO: 121533 - protein, 426 aa, Triticum aestivum
  unsure (1)..(426): unsure at all Xaa locations
  Clone ID: PAT_TA_15951.pep
PANVIRGYLGCSVLNDQKKRRVRRSRSYSSSPARSGSSRSRSRSRSRSKSRRRRPDGTRHDASRDRVVQGSGNCQDPQNEKRSVEDVYSDEDAVADDYEKNVELKEMESPPSKDAHETGEILPVSCESPEVEEDLELILRQKALENFRKFKGAVAMVGKTENSGAAAEVLTDSPRNTVTKFPEARSAVAPFQRQGSNLGVGHSTRSPEFEDFENGRSPWKQETTHRDRSPGILEAGDTCGPTQQLGSGLEEIRSTSHITSHDGRNGGSVMQRLGSTPASSGSISQRLGISSVVSPVQARPRVRSVVSIPSREXGLDGSTFTTIPTASENPASVESSSEVRHFPAEINKLEGIDGDDRKIGEASVPESSVLSTDAGKSQAAGTEDKDASQFEKRTFSRMHDGETVQVSYKVYIPATSPRLARRKLQR

SEQ ID NO: 121534 - protein, 88 aa, Triticum aestivum
  unsure (1)..(88): unsure at all Xaa locations
  Clone ID: PAT_TA_15952.pep
QEFGTRLHLARRQQHQHFGRLHLETQSGGTRVQPYVQTPDPDSATSGXSLLAKLNSISAMPAYKEKSHEELRWEDYQRGDKRWTKTLL

SEQ ID NO: 121535 - protein, 154 aa, Triticum aestivum
  unsure (1)..(154): unsure at all Xaa locations
  Clone ID: PAT_TA_15953.pep
MPNKRQREARKRFREANPGLCPPAPXPPPDGTKKKKSKKSLFKKGEEGGSRRRSTRSGXSKHPLRVPGMRPGEQCFICKGTDHAAKNCPEKSYWDKNKICLLCRERGHCMKNCPDKGDGDLKKFCYNCGESGHSLSKCPEPIDNGGTNFASCFV

SEQ ID NO: 121536 - protein, 143 aa, Triticum aestivum
  Clone ID: PAT_TA_15954.pep
EADHRKNPAMGTCDHVLAMVNDLHVIFGKGPRALAVPNDAEGHAPMWKKKSLFWDLPYWKDLDVRSSIDVMHVTKNLCVNLLGFLGVYGKTKDTPEAREDLQRLHEKDGMPPKQYEGPASYALTKEEKEIFFECLLSMKVRST

SEQ ID NO: 121537 - protein, 136 aa, Triticum aestivum
  unsure (1)..(136): unsure at all Xaa locations
  Clone ID: PAT_TA_15955.pep
MNALEGAGAPASEAEVQQEVTAMSQTNIFRPGIDVTQAVLLPQVTWRRQERTEAVGXWKAKVYDMHHVMVSVKSRRVPGAMTDEEFFAACNENDTESEGFDDVLTDEEKRQLESALKMDSSEAVGYGQSDTFVGPR

SEQ ID NO: 121538 - protein, 274 aa, Triticum aestivum
  unsure (1)..(274): unsure at all Xaa locations
  Clone ID: PAT_TA_15956.pep
HAPAGTPVRSRDVFRGCRSRLGLLCLRPGWPIGGLRTEVLHYRGEALPHLLCRPRNVMEVQKCVQVLQDKQELAETQNELAKLQIVYEDPAQKSEGTAPSVFMARENDGSFPGAKHELALVPLHQVNQSPAMQFQSCNGLILQQLVPVSLSTQQDQQHLNQSTVYRAQNQCQPERRQAQTFQPAPQSMQPQAQNPQPQTVVEVPPITSQAPEFYIQAQHHWQHQTVQDVHSQAGPPQQQPQPQVAQQQQYHNMQQVPAXXVQLQTSSPXXXSAX

SEQ ID NO: 121539 - protein, 95 aa, Triticum aestivum
  unsure (1)..(95): unsure at all Xaa locations
  Clone ID: PAT_TA_15957.pep
MMHRMATVPAPAAETAASTARTVKDVNPHEFVEAYSAHLKRSGKMELPEWVDIVKTARFKECXLLNANWXLXKVASMGREXLPXXXIXXGGFTXY

SEQ ID NO: 121540 - protein, 339 aa, Triticum aestivum
  Clone ID: PAT_TA_15958.pep
PRVRLRTDPQGAVNFALMMSQMEGGCPLDYNTITDLFLRRPTRPEATAFLLDVLKPNLEEHAFLQPKVLEINLVTYPNVADAILANGMFSHYDRPRIAQLCEKAGLYLRALQHYAELPDIKRVIVNTHAIEPQALVEFFGTLSKEWALECMKDLLLVNLRGNLQIVVQAAKEYCEQLGVDACIKLFEQFKSYEGLYFFLGSYLSSSEDPDIHFKYIESAARTGQIKEVERVTRESNFYDAEKTKNFLMEAKLPDARPLINVCDRFGFVPDLTHYLYLGRDHANIEGYVQKVNPGNAPLVVGQLLDDECPEDFIKGLILSVRSLLPVEPLVDECEVDAAA

SEQ ID NO: 121541 - protein, 113 aa, Triticum aestivum
  Clone ID: PAT_TA_15959.pep
CGVRGTLPWMAPELLNGSSNLVSEKVDVFSFGIVMWELLTGEEPYADLHYGALIGGIVNNTLRPLVPESCDPQWRSLMEQCWSAEPTERPSFTEVVKRLRAMATSPTKAPPQK

SEQ ID NO: 121542 - protein, 164 aa, Triticum aestivum
  unsure (1)..(164): unsure at all Xaa locations
  Clone ID: PAT_TA_15960.pep
MDAGSAVEAGRQEGTPTGPAAPFGRSSSSSGLGAKGGATPQSFDGALRELKDLQSQLHQAADCCEKAFLNTEKKQLILXSTKSYICDAVVAVIVHLGTVSSKLEHQLEDKAEITQTEQKFSFLKQRLLTCEQYAISLQLLAVRADTGALNITPLLQLLKEPGKC

SEQ ID NO: 121543 - protein, 143 aa, Triticum aestivum
  Clone ID: PAT_TA_15961.pep
MTLLLLHALLLASAAAAAAAASEAGDAAGGGATAGGNATTAQGLCNGAGCQPPPQPLPIYGGPPPSPPSTTPPSPGMQAPCPPVTPVCCGGQNTPQQPYYQAPPIGYLPYYNESASSVLVPPTPVAAVAYYVIVPCLLLWVVV

SEQ ID NO: 121544 - protein, 167 aa, Triticum aestivum
  unsure (1)..(167): unsure at all Xaa locations
  Clone ID: PAT_TA_15962.pep
HEGQIHVADNCHHQLNKILADLDQHNIMEKSSCLDLEXMADFVLQDVVVAAVSQVLIACQXKGIRVSCNLPERFMKQLVYGDGVRLRQILSDFLSLSVKFSPVGSSVEISAKATKNSIGENLHLIDLELRIKHQGLGVPAEXMAHMFEEDEPQQSEEGLGLLVSRNL

SEQ ID NO: 121545 - protein, 87 aa, Triticum aestivum
  Clone ID: PAT_TA_15963.pep
YFSFCSVLLASDCFLPDTPIQMTAAAMASTLKRAYLSIYNWVQVLYYVLLDSLPGRARRQLRGVSILRRPPSVSIIDQLSVTCRRVF

SEQ ID NO: 121546 - protein, 264 aa, Triticum aestivum
  Clone ID: PAT_TA_15964.pep
MAFLVERCGEMVVSMEMGSGAPAPRAGGGVAGKPVPAPFLTKTYQLVDDPCTDHIVSWGEDDATFVVWRPPEFARDLLPNYFKHNNFSSFVRQLNTYGFRKIVADRWEFANEFFRKGAKHLLAEIHRRKSSQPPLPSMVPHQAAYHHHYHLGNTFSPPPPPPPAAHHHHHPVYQHFQEEPAAAATSHGGGNGGGDFLAALSEDNRQLRRRNSLLLSELAHMKKLYNDIIYFLQNHVAPVTSPSSVASQRHMPLPGTAAVATSNS

SEQ ID NO: 121547 - protein, 151 aa, Triticum aestivum
  Clone ID: PAT_TA_15965.pep
RRTQFTPEESPSWKEEPSPSSPRLVLFLPARHGRAQRRRRRRQGPCRDAQPLGAPVPMAVWIWARRLSARCSVDLTASRLFSSLLLSSLLFSSREGEGLGRREGGGHERRRGLREGDGAAAMRLRRMMRLSGRVGGRVGGRVGGRVGARLA

SEQ ID NO: 121548 - protein, 178 aa, Triticum aestivum
  Clone ID: PAT_TA_15966.pep
SNPAPPACLASWLYGGRQAALLTMYLTSGVSSRRWRGVSSAGRSVPASQIHVAPISCSCQTAHTEASFAAARLLLSGDNSTGGGSTTDGRHLLVILLAYPAPPPTCAAATEVNTAAYLCRSQGLGRPLRPPARSLPPLRPLLLLPSSSASAASASGGAAPDLRPGSPNLLLCPPMCCC

SEQ ID NO: 121549 - protein, 184 aa, Triticum aestivum
  unsure (1)..(184): unsure at all Xaa locations
  Clone ID: PAT_TA_15967.pep
RERERELGHSFDAPLASTFVDMYAKCGNLDDACRMFDRAPMKNVALWTSMLCSYASHGXXRMAIELFNRMIAEKIKPNEVTLVGVLSACSHGRLVSEGEHFFKLMQEEYGIVPSIEHYNCMVDLYGXLDCSTEAHNFISEDKIKHESIVWKTLLSACRVPQDVEHAKLASESLIQLEQCDAGSY

SEQ ID NO: 121550 - protein, 152 aa, Triticum aestivum
  unsure (1)..(152): unsure at all Xaa locations
  Clone ID: PAT_TA_15968.pep
ACYDLHAGVVAQLPAAAAGPSSKMVRLVPAMYVLGDSTLDVGNNNYLAGPNVPRANMPLNGVDLPGGARATGRFSNGYNVADFIAMKLGLKESPPAYLSAGATPHRLGPQRSXPAGVSYASAGAGIXDSTNAGNNIPLSKQVRYLGSTGRGG

SEQ ID NO: 121551 - protein, 138 aa, Triticum aestivum
  Clone ID: PAT_TA_15969.pep
MAAAAAAGDLRSEYLEVLLSRRRERQVPMTVEQGSPVKEPLYQGNGPLGLREAMESCPRKEVENFQEKLVEENFYLMTESGEQGRLPVLLLKLNDTAPERKPVVVILHSSYKCKEWLRPLLEAYASRGYIAVTIDSRY

SEQ ID NO: 121552 - protein, 214 aa, Triticum aestivum
  Clone ID: PAT_TA_15970.pep
TLGASQTKIRRPSHIPCPSRKPRHVPHREGSRLALTLRSSAAPFSTISPAAAAAASLASKEAPAAAAASSAPKEAAAAGDPSPAPPSGARSSFRLLKAGIFTAVTAALGATGYVTYAYSVDEVDQMTREFRKNSKLPISEDLSGFEKFKATAYSETVKVPAAAIDLYLDVRSQIEDQIQGFVEPSSEKLLPDLPPQEQHVFTIVLDLNETLVYS

SEQ ID NO: 121553 - protein, 106 aa, Triticum aestivum
  Clone ID: PAT_TA_15971.pep
RRKRPQRSCSPKAPVEAQKQKTFLRGVQCFTVHGYRDKTAIMRHWFDATEHTDKWFMFTEEEEKVIKGHVAPRPQLKRKNKKHTLAGHNALPISSSMKTQTPVSTV

SEQ ID NO: 121554 - protein, 145 aa, Triticum aestivum
  unsure (1)..(145): unsure at all Xaa locations
  Clone ID: PAT_TA_15972.pep
KTQALSPCGLGDILCGKAHKWVSNGTELCRLAGFSVQVSDASPSEVVETFCYGGKASLDSISDTWTSSKDRPVLHGMASWDLEDFKRWAKEMLVGERISWAVGGMVLTAGLIFIQQKRGXSRRRKQASVAQTVRKKWNRELTRSN

SEQ ID NO: 121555 - protein, 235 aa, Triticum aestivum
  unsure (1)..(235): unsure at all Xaa locations
  Clone ID: PAT_TA_15973.pep
FGTRLLRVPQAGTQPTAVIPHGPAAPPPPSDEWRFPPQVEDRLAAEEQRPAPRQPVAPPLFSDTMTASPLFLGASTATATDRGGGAGESSGPALDFLTLSKDEVRVQEPQQDSDSDDDRDSGADIARLMALIGLSPPPWFGDDGGDSGGCDCSGGDGFMANVVGVVGPKCEKEKRRVDGWIQHYYGDGGGGECREPARLAHLLVAKASWSWXGEGPEDRAAIAFPSAVKEFLDRD

SEQ ID NO: 121556 - protein, 167 aa, Triticum aestivum
  Clone ID: PAT_TA_15974.pep
MDERSSGSVDADGFPSSRREGFGHSKSTTATSSRFRGQDHAFVRSYSDRLLKCDLTLDMLSENEKMKIIEKLVKIQKDGTLEVDVTRSALVASELSEIDAFGSVPRDVEEVGCGFSKSVPKLKIAILVVGTRGDVQPFIALAKRLQEFGHHVRLASHVNFRPFVKSA

SEQ ID NO: 121557 - protein, 262 aa, Triticum aestivum
  Clone ID: PAT_TA_15975.pep
DHHAGDLLHTKLGSGSTGLRSGHPGRIAPPHLTELRLGSGERPSSPSHPPSPPARKRRQRLTASHHQCPLQFGTNKVRLRRAPPARPPAPGGRCVAGCIAKQLGSSHGGVLSCSALRWRPWCTLIASHHCSVKARAVITTTSPPGSTPSCLLLRVQCTPCRIAVCHPISRSRCCPRRRRRRHQRLAVQWLRASSAGCSSLHPGWVIRAIHSALRGRWAYSSLACGSSVSVCATLQCVCLCHAFYLLHCHRALVCSSSGFHDL

SEQ ID NO: 121558 - protein, 222 aa, Triticum aestivum
  Clone ID: PAT_TA_15976.pep
MEGMRRFVNPLKLNVQKMELELTCPVCLKLLSAPTMLPCCHTCCSKCATPQAMNGHSCAICKLAYHPQDLRHASQIEALVNIQRSISSTVSSMSLQLGTQPDIHVAKATSQGTPESGTTSSYNLDASKLPCNQASGPADENAGGVQAMDPAPGNRTNDVAVEPTVIVQTGPCGSQTPVGSGDLECDSNDLEGELITSGSPPQSTLKRGPNVTDDSTRGLKRQ

SEQ ID NO: 121559 - protein, 187 aa, Triticum aestivum
  Clone ID: PAT_TA_15977.pep
MASKGLLVFALLLAAAILVASTEQTQAKKEEKKAGVEGYGGGGGYPGGGGGGYPGHGGGGGGGYPGHGGGGGGGYPGHGGGGGGGYPGHGGGGGGGYPGHGGGGGGGYPGHGGGGGGGYPGHGGGGGGGGGYPGHGGGGGGGYPGHGGRGGGSGCQWGCCGNGYHGCRCCARADEVPEPMYRAEVRN

SEQ ID NO: 121560 - protein, 218 aa, Triticum aestivum
  unsure (1)..(218): unsure at all Xaa locations
  Clone ID: PAT_TA_15978.pep
MRHVVLNDGGARGCMNHVRFVAGHPPRTLRTGLIPIFPHERVHSCRAPTAPRRSATDQHSRPHVRGSHGWLPAPGTSRASNSRRRRGLGRHLHPRPRRPPRTRQPPPPLRXPARRPQPPRPHSPGPGHPPPPPYPPRPDPPRAGVPESRRPPPRRPLGSPPPPLPPIQRPPPPACPRRPPPSRRTLPPPSPSSSCPASVCSWGGGTTIAAAARTRVDT

SEQ ID NO: 121561 - protein, 226 aa, Triticum aestivum
  unsure (1)..(226): unsure at all Xaa locations
  Clone ID: PAT_TA_15979.pep
MEACASTSRVLLPAPPRASLRAAARPRRAAAGAGAGAGTGYSQASYYTSLGLFVLSVPGLWSLIKRSVKSKIVQKTFVXREGQPTAPSLVAGEILSFFTRNSFAVSDRGEVITFEGSMTPSSAQAALLTFCTVISLGSVGLVLSIAVPEGGNNWFWLMTLSPLAGVYYWTKASRKEEIKVKMVLSDDGNNVSEILVRGDDVQVEQMRRELKMSEKGMIYVKGIFET

SEQ ID NO: 121562 - protein, 212 aa, Triticum aestivum
  Clone ID: PAT_TA_15980.pep
RHESAMFSPDLENDKPYVGIIKGIIASDGSLSVSAQWFYRPEEAEKEGGDPRELFYSFHIDEVPAESVMHMCVVHFIPEHKQVPSKKEHPGFIVQQVYDHREEKMYKITDKDYEDDKQHQIDLLIMKTIDRIGRLPDRDPEDIPGDNTDKLSRRGLRKRPLKPKDVPRDASTGISEQFRREDTPVNDNLKYFAILVRHEVITGNQYRDWWLD

SEQ ID NO: 121563 - protein, 364 aa, Triticum aestivum
  unsure (1)..(364): unsure at all Xaa locations
  Clone ID: PAT_TA_15981.pep
MSSLNSLFNRSSPFGTKCKTCLNLIISRIKLLRNRREMQLINMRKEMVQYLQTGQESIARIRVEHIIREQNILAAYEIVELFCEFVLARVPIVEAQKECPIELREAIASIIFASGRCSDLPELMHLRNLFTTKYGKEFVAAAMELRPDCGVNRTIIEKLSVKAPSAESKLKVLKAIAHEYNLDWDSSNTEAEFNKKYEDLLDDSGSSVRQGQTPAIESSPASSISKDKPSILPVNDTSKNRTPESPKSPAVSSRAYAATKSNVASQEHQPPAAERSSCAGPGSXSDVLEKGPEAAIAAGHPPLPPAPCPGARVYKPYYTRCSRPLSSPGCRPPPGPRAPLFPAHPYVWPPDCFLGACTLFQKKK

SEQ ID NO: 121564 - protein, 110 aa, Triticum aestivum
  Clone ID: PAT_TA_15982.pep
MAKTYPVVSAEYQEAVEKARQKLRALIAEKNCSPLMLRLAWHSAGTFDVSSKTGGPFGTMKKPAEQAHAVNAGLDIAGRMLEPIKEEIPTISYADLYQLAGVVAVEVFGG

SEQ ID NO: 121565 - protein, 97 aa, Triticum aestivum
  unsure (1)..(97): unsure at all Xaa locations
  Clone ID: PAT_TA_15983.pep
KCFTNPSHASHWWCIPSWPAHRIFHHVSXMLDKSNSQAVALYPMKLYFSRTKNCTGIQFSEVAMFPDVQPLKCHLFFFTAFSTLPSSSYFIGLIDPI

SEQ ID NO: 121566 - protein, 137 aa, Triticum aestivum
  Clone ID: PAT_TA_15984.pep
CLSSPPTGTSCRHHATRKKPTRQPGLPPCTAGNQPRMRTGLPPSAAADPSDAMANGRSRHRRGSSSNVLAWRIWPPLLQVTLLPPFTSYRKQLQARSSQGSNRQGRQGCLPPQPGTTQRGGRGCLPPPPGSNQRRGR

SEQ ID NO: 121567 - protein, 82 aa, Triticum aestivum
  Clone ID: PAT_TA_15985.pep
TTLLMPKPLSALISCFCVCKFSSLVSYSSYLSCTMFNSLVVVVSMVVASFCLIASVSMASIHSGFPANAPTHCSPSLPPLLL

SEQ ID NO: 121568 - protein, 184 aa, Triticum aestivum
  unsure (1)..(184): unsure at all Xaa locations
  Clone ID: PAT_TA_15986.pep
IMHSDQLRYLDKAATVTXSEDYCEPERMKDPWRLCTVTQVEEVKCILKMLPIWMCTIVYSVVFTQMASLFVEQGTTMDTNIGSFHVPAASMSVFDILSVLAFIAIYRRVLVPVMARLSGNPQGLTELQRMGVGLVIGMGAMVVAGVVQVERLKRVAAPDQPSSLSVLWQVPQYALIGASEVFMY

SEQ ID NO: 121569 - protein, 104 aa, Triticum aestivum
  unsure (1)..(104): unsure at all Xaa locations
  Clone ID: PAT_TA_15987.pep
HAPPPCAAESISVSRRVHVLKVSSRNKEXXTNXDYKIDLGINISCLQXSPLTKNLQGTFCWGTSATSGVSCLVWSSVSSSSDRHITSGAATPRGSLGTPILVRN

SEQ ID NO: 121570 - protein, 75 aa, Triticum aestivum
  Clone ID: PAT_TA_15988.pep
VFKTNLHGVLGMEQAPCVVVQTPRPPYASANVAAYLKAHLGGRTTIEPLPTEGHLPHLSAPSLLAQVLRRALARF

SEQ ID NO: 121571 - protein, 156 aa, Triticum aestivum
  unsure (1)..(156): unsure at all Xaa locations
  Clone ID: PAT_TA_15989.pep
MLRSTHPLSPSSGGSGGSSAPASSSGEAMVGGAPSGAKLLQILNVRVVGTGERVVVLSHGFGTDQSAWSRVLPYLIREHRVVLYDLVCAGSVNPDHFDFRRYNNLDAYVDDLLAILDALRIPRCALVGHSVSAMIGILAXSIRRPDLLRQASSFIG

SEQ ID NO: 121572 - protein, 297 aa, Triticum aestivum
  unsure (1)..(297): unsure at all Xaa locations
  Clone ID: PAT_TA_15990.pep
MLRSTHPLSPSSSSSAPASSSGETMVGGAPSGAKLLQILNVRVVGTGERVVVLSHGFGTDQSAWSRVLPYLIREHRVVLYDLVCAGSVNPDHFDFRRYNNLDAYVDDLLSILDALRIPRCAFVGHSVSAMIGILASIRRPDLFAKLVLIGASPRFLNDSDYHGGFELEEIQQVFQAMSANYEAWAKGYAPLAVGADVPAAVQEFSRTLFNMRPDIWTSAAWSVFKXEPRGVLGMVQAPCVVVQTTRDVSVPANVAAYLRAHLGGRTTXEPLPTEGHLPHLSAPSLLAQVLRRALARF

SEQ ID NO: 121573 - protein, 194 aa, Triticum aestivum
  unsure (1)..(194): unsure at all Xaa locations
  Clone ID: PAT_TA_15991.pep
CMNLNGXEAMLFIGLNAAISVRVSNELGSGRPRAAKHAVASVIAQSLLIGLLAMALILAYRNSFAALFTGDRAMQAAVGRVAYLLAVTMVLNSVQPVISGVAIGGGWQALVAYINLGCYYAFGLPLGFCLGYLLRLGPQGIWAGMLCGTALQTAVLLAVIWNTDWEDEAAQANERISAWAGESKQLVHGDAGAG

SEQ ID NO: 121574 - protein, 137 aa, Triticum aestivum
  Clone ID: PAT_TA_15992.pep
FSLPGPVCVHPLRPLDACSTLLVGTSLILSPPHLSPPGTKMAHQRRISQFGSVITNYCWMLLASSGFFLGVFAVTTIAPVHPRLMIPVPGTADCSTACPIDCVCSPSTSTTVADRLKYDIAIWNRFLIAFCLSAVYL

SEQ ID NO: 121575 - protein, 187 aa, Triticum aestivum
  Clone ID: PAT_TA_15993.pep
CVGQVIVDTSNEIGGDGDIPHAAIGGARRMQVPEPSMQHRVMIEAVENHMPEVVIVDEIGTEAEAQACRSIAERGVMLIGTAHGERLANIIKNPVLSDLVGGVETVTLGDEEARARRTQKSILERKAPPTFPFLIEMRERHYWVTHRTERSVDMLLHGKKPLVEVRKRDNEFEVVIERWATYDGDGL

SEQ ID NO: 121576 - protein, 134 aa, Triticum aestivum
  Clone ID: PAT_TA_15994.pep
TSELTYLSPTLRLLLLGSHPWMRPESSLVEHGERQHAPRRVRLRRRRHRHGHLVAGAAAVAIAVAVAVAAGAARDGGVRLVAAWHQEMRVHVVLRVRDEVVPLRRHGPRDEDLRRALWGGRCYMGRGGWGWGRA

SEQ ID NO: 121577 - protein, 172 aa, Triticum aestivum
  unsure (1)..(172): unsure at all Xaa locations
  Clone ID: PAT_TA_15995.pep
RTDARLANNGLPLDIQKLRCRVNYSFTXKFTPQIEELGRRVDSXLRKNGPFLVLHLRYEMDMLAFSGCTEGCTREEADELTRMRXAYPWWXEKVIDSYVKRKDGFCPLTPEEIALVLRALEIDRSMQIYIAAGEIYGGERRMASLTSAYPSVVRKETLLEPSDLRFFQNHSS

SEQ ID NO: 121578 - protein, 202 aa, Triticum aestivum
  unsure (1)..(202): unsure at all Xaa locations
  Clone ID: PAT_TA_15996.pep
GRPWRPAPALLVPSPWPPGPPRAPPLAWRGAARGRPPLSCPSTPSSLPFRPNCFQFPRPCHTGVVAHRRRAYPRIEATARHGARKENAKVRNRRLQKKYNGTTTKPRLSVFCSNRQLYAMLVDHHAQKILFLXPGTLQEEIRGDPPCSTVQAARRRXGEELVQACIELDISQVSCYDRNGFARGEKMIAFEDPVAQHGFLPG

SEQ ID NO: 121579 - protein, 95 aa, Triticum aestivum
  Clone ID: PAT_TA_15997.pep
KYEWSMSLDTPFRTGIYSIWENMGFLLLFLSIYQHIDPPLPVRAKWHTEAKEEKFIRTMDKVNTIFCTQFFLLCGAHVIIYCDVALCLKTPNCDH

SEQ ID NO: 121580 - protein, 134 aa, Triticum aestivum
  unsure (1)..(134): unsure at all Xaa locations
  Clone ID: PAT_TA_15998.pep
IIWIDGRSQEHEEREEEKENATNSIMFVPSIQEKVPWSSSNSSVYARIGALDIGGSASGQPSIATASDDAGSELLPLSDPWQMAAGRRFGRRTAGRGHSAAGRGARGDQHAHGRGHCDADAPPVVLTTPWGRXA

SEQ ID NO: 121581 - protein, 134 aa, Triticum aestivum
  Clone ID: PAT_TA_15999.pep
MGYASKRLHASVLAVEAGQDAVIRMLLYQRADETVAPYKGRTVAEFTRRISDWRNDLSGCGAKDEGVKVLDRHQGAERRTISNILGAGVDSLGYQRTPAEALRILYGSRNEQVPGGFLPQGANGTIARGFVQLA

SEQ ID NO: 121582 - protein, 78 aa, Triticum aestivum
  Clone ID: PAT_TA_16000.pep
QCYPLLFYGRAEQNCGHPKPAAEEADECAHSITAYLNLVSGDCYGDNTVASSIEGITRFVVGLRQPLKNFRGKEVQSL

SEQ ID NO: 121583 - protein, 226 aa, Triticum aestivum
  unsure (1)..(226): unsure at all Xaa locations
  Clone ID: PAT_TA_16001.pep
LINLNIDCSIGDLAALESLVSSLVLKGEISSNTMSALWRYFCFNINGVRPVQCRGALSILCMAAKSSPSILGTHLQDIVDIGFGRLAKEEPLLARTACLALQRLSEEDKIKLLSTSTRVFAALQSLVTSFSLPEKIWYGATDKAISAIYTLHPAPEIFAAEIAKKSLSSVFSALGMDGVSNGVELETQNSSTITELSAMKLGRFLFVISHIALNHLXYIETSVRKS

SEQ ID NO: 121584 - protein, 152 aa, Triticum aestivum
  Clone ID: PAT_TA_16002.pep
MIRLQTYAVFSLLATITSVYYAFSSREQFYPAMVYLSTSKICFVLLLNTGLVAMCVAWQLVKRVFLGTLREAEVERLNEQSWREVVEILFAVTIFRQDFSVSFLAMVAALLLVKALHWLAQKRVEYIETTPSVPMLSHIRIVSFMLFLLVVD

SEQ ID NO: 121585 - protein, 166 aa, Triticum aestivum
  Clone ID: PAT_TA_16003.pep
MARRSGAFSRLAVVVVAAYCLPAATPGAADWIRGSATFYGGSNAAGTMGGACGYGNLYSTGYGTDTAALSTSLFNDGAACGECYQVQCDQGSSPNCKPGVTVTITATNLCPTDYSEPNDDSSWCNPPRKHLDMAQPAWERIGIYRAGIVPILFQRVSCSRSGGVRF

SEQ ID NO: 121586 - protein, 145 aa, Triticum aestivum
  Clone ID: PAT_TA_16004.pep
APPLSGSVPSPGAVIRVTVRAPRPTVAVAVWPFARGPPPGRHDLLEFSPSRFLPGGLHESVDVKGGDYELIPFGAGRRICAGLSWGLRMVTLMTATLVHAFDWTLVDGMTPEKLDMEEAYGLTLQRAVPLMVQPVPRLLPSAYTM

SEQ ID NO: 121587 - protein, 105 aa, Triticum aestivum
  Clone ID: PAT_TA_16005.pep
EKGRDVWFGHGVMQLQPEQPAAGRKALLYVPTGERMTSLELLERRLGAHGWERYYENRDIVQLHRRDGGIDLISLPRDFTKFRSTHMYDVVLKNRDSFKVVDVPT

SEQ ID NO: 121588 - protein, 55 aa, Triticum aestivum
  Clone ID: PAT_TA_16006.pep
RKPSSYCLRTSRSTMNYSRIIGEAPMRMMKPSVMVSRLDLVVLELAAAGIVFRRP

SEQ ID NO: 121589 - protein, 49 aa, Triticum aestivum
  Clone ID: PAT_TA_16007.pep
TSIVAFLVLQFRIRLVGCWWSLASLEWKGNSWSKREVHISPFLGIIFIL

SEQ ID NO: 121590 - protein, 87 aa, Triticum aestivum
  Clone ID: PAT_TA_16008.pep
RRRGCRRSRGAGAGGAGPRRGGQPRSKLARTSATRSRRGGRRHGRAGRAALGRSPGAPVGDPARRTAPRPAAAGGDCTGRPSHFRRT

SEQ ID NO: 121591 - protein, 173 aa, Triticum aestivum
  unsure (1)..(173): unsure at all Xaa locations
  Clone ID: PAT_TA_16009.pep
SAAMSDEWGRPMVFLSGVPGSFYGRLFPRTSVHFICSCSSLRGRAHVPPGLFDEAKAPINKXXKMYISSTSPPAVSVAYRRQFQRDFSLFLKSRAAEVFPGGRMVLAMLGRQTDDCVDRRTTFLWELLSESFAALVSQGLVEQDKVDAYNVXPFYAPSLHEIEVEVRLEGSFS

SEQ ID NO: 121592 - protein, 255 aa, Triticum aestivum
  Clone ID: PAT_TA_16010.pep
MDSEDDTRDSADEDFYSGGEAGLALSDDGDADYDFADRDSDDSDDLISHRQQQNYSVLSETDIKQHQADDMNRVSTVLSISKSEACALLRSYNWSVSKVHDEWFVDEARVRTAVGLPEKQNEMPNERELTCGICFESCPRESMGAASCGHPFCGVCWRGYISTAINDGPGCLMLRCPDPSCSAAVGQDMVNLFASDEDKGKYERYLCRSYIEDNRKTKWCPAPGCEYAVEFVVGSGSYDVSCGCSYGFCWNCTEE

SEQ ID NO: 121593 - protein, 173 aa, Triticum aestivum
  Clone ID: PAT_TA_16011.pep
MCNHREKRDRGTCDQHLASELDSAAAPMATTPEGLQKALEDALAEINAMRLEVEATKAELAAEKEKLGLVPAATALPVRSRAPINYPQLTRSNYTLWAMQMRVAMHSAGVWSATSSEDVDHEMDRDALLAIYHAVPEDVLASLAGKDTAKQAWEAIKVVNVGHDRVRETNLQT

SEQ ID NO: 121594 - protein, 175 aa, Triticum aestivum
  Clone ID: PAT_TA_16012.pep
GSLLSPVKISPFSPSSVRSSPCRRRLRSPPYRPPPFLRLHHLLLPRLLVPSCCRRLPSSPPDSPLQLGRLIFFAAAPPLPLPPCSTGGAGVAAAPHDSGRGRAPARACGELSTGSGRPRSTRLRQRQARGPCRRGCAGVVLSSPIHSSRFLSFSFLCTLFLTNRGGRIRMDPRCR

SEQ ID NO: 121595 - protein, 61 aa, Triticum aestivum
  Clone ID: PAT_TA_16013.pep
GESKQGETWERVTQIRDKFEYDRKRRMRERAFAPMNMENNFGQQNWKRPETRTGQVFTRQT

SEQ ID NO: 121596 - protein, 222 aa, Triticum aestivum
  unsure (1)..(222): unsure at all Xaa locations
  Clone ID: PAT_TA_16014.pep
MLRCVYTQRRWAHRRGGFVTGGTGWSQKARPAAVMGAKKSEWWAVDGELHEIGEGVPHRERFAIPRDNLPNRRRKQMREQFMRRTRLVLKDSEHETWCKKYMELYQELRENWERLYWDEGYSKKIAEDRANYDSAEEDDLDFSPYSRRRSSSVEPNKDLGSGESKQGDTXERVTQTRDKFEYDRERRMRERAFAPMNMENNFGQQNWKRPEARTSQGFPRQT

SEQ ID NO: 121597 - protein, 143 aa, Triticum aestivum
  unsure (1)..(143): unsure at all Xaa locations
  Clone ID: PAT_TA_16015.pep
LNCPIFLKHGTHLKYLALSGCHLVEDPLEMLARHMPKLTYLRLNNMHXASTLALSANSFPNLKXLVLKCMHDVSELNISEGALPCVEGLYIISLPKLDKVPQGIESLRALKKLTLQCLHKDFISQWDTNGMHQKTLHVPEVYV

SEQ ID NO: 121598 - protein, 220 aa, Triticum aestivum
  unsure (1)..(220): unsure at all Xaa locations
  Clone ID: PAT_TA_16016.pep
KIPLAYDEEKKAWFLERELPEGRYEYKYVVDGNWVCNEHGTAGLGRAPAVALAYMYWILGYNLNEGHQLLQSKRPRFPKLEAIKLATADILTGLSKNCITLKWKNGSCSSVEISGLDIGWGQKIPLAYDEEKKAWFLERELPEXRYEYKYVVDGNWVCNEHEMKTKPNADGHVNNYIQVARDGTSDEEKAMRERLTGPDPDLTKEERLMIKEYLEQYTEQ

SEQ ID NO: 121599 - protein, 151 aa, Triticum aestivum
  Clone ID: PAT_TA_16017.pep
SSEGFSALVAVGLFQHNFLLITIATFFIVAFALAASLLAHPFSLLILLGVLAAWCFLYIFRASDQPVALFGRTFSDRETLLGLVVASIVAFFFTPVASLIISGMLVGGAIVAAHGAFRMPEDLFLDDADAASGNSAAQGLLSFLGAPGSRV

SEQ ID NO: 121600 - protein, 152 aa, Triticum aestivum
  Clone ID: PAT_TA_16018.pep
MRLFMHDVLTGPGATAVEVVNGTGPSLFGGEPPLRFGHVVVIDDALTEGPDPASSPVGRAQGTYVFASMHDPALLFCMNVVLTAGPYSGSTFTVVGRDNIVEPLRELSVVGGTGRLRMATGYVLWRTASWQLRKNAVLDLDIFIHVHAYARA

SEQ ID NO: 121601 - protein, 455 aa, Triticum aestivum
  unsure (1)..(455): unsure at all Xaa locations
  Clone ID: PAT_TA_16019.pep
ISRWVAKMEHVIGGKFKLGRKIGSGSFGELYLGVNIQSSEEVAIKLESVKSRHPQLHYESKLYMLLQGGMGIPQLNWSGAGGECDVTVLDPLNPNLQGSXSVHKPLMRLHQSTGLGGQVVIAVENCEKXNKSLKSKKMSVAVMSVGTWILSAPDXSLISKINDVVLHKMPRNAYSEGGSSNLGMNDXEHCYFNVCYFESLKKMFYTILMGLDRLHGLAVLAQLMLMLNQTLAETPFKXTSFHYCRSLRFEDKPDYSYLKKLFRDLFIREGYQSDHIFDWTVSRQLAENNRLRPSGRTAGLVGPSAERAERIAARQDGPDRFSSSVETFARRTGSGSGHHGENTKHRTLFDSLLAPKMAADSDKRRPTSSRNGSTSRKALLSSSRPSSGEPSDPTRTSHLIPTSSGSSRPSTTQRLHQSTGLEARSSSLSKTARNVHDDPTIRTFERLTISADRRK

SEQ ID NO: 121602 - protein, 194 aa, Triticum aestivum
  unsure (1)..(194): unsure at all Xaa locations
  Clone ID: PAT_TA_16020.pep
PRVRASRQNQSLASPVRSPVSSRSRRRRRTPIQPRRRRSPRPPVPSPPTXIPLPRHRKGRQGKGRERERSDPRRHXARRPRPDPRPSTDGSRRRKSPSPRPSPATLRNGSTAHRRAAPAAPDQFGFRGWWTRPCCCRRRLAAPHWPSQASSVNDGLERSREFPLGHRDMLLHLLRWTTSNIASSCTYGLKKKRK

SEQ ID NO: 121603 - protein, 190 aa, Triticum aestivum
  Clone ID: PAT_TA_16021.pep
MSIRMLNQNAEVMNKSAALAMNIGAAKGLQDVLKTNLGPKGTIKMLVGGAGDIKLTKDGNTLLKEMQIQNPTAIMIARTAVAQDDTSGDGTTSTVLFIGELMKMSERCIEEGTHPRFLVDGFEVAKKATLEFLETFKTAVVIGDQPDREILKMVARTTLRTKLYESLADQLTDIVVNAVLCIRQSDQPID

SEQ ID NO: 121604 - protein, 542 aa, Triticum aestivum
  unsure (1)..(542): unsure at all Xaa locations
  Clone ID: PAT_TA_16022.pep
MSIPMLNXNAEVMNKSAALAMNIGAAKGLQDVLKTNPGPNGTIQMRGGGAGDINLTKDGDRNLKEMQIQNPKAIMIARTAVAQXDDTSGDGTTSTVLFIGELMMMSERCIEVGTHPRFLVDGFEVAKKATLEFLETFKTAVVIGDKPGWEILKIVASTTLRTKLYEXLADQLTDIVANAVLCSRQSDQPIDLFMVEIMHMWRKFXYDTRLLEGLAFDQGSRHSDWIRXPDMKRSAENWYILTANVSLEYEKSEINAGFFYSNAEQREKMVTAERRQVDERVQKIIELKNKVCAGTDKNFVVINQKGIDPPSLDLLARAGIIALRRAKRRNMERLVLACGGEAINSVEGMTEDCLGWAGLVYEHVLGEEKYTFVENVKNPHSCTILIKGPNDHTIAQIKDAVRDGLRSVKNTVEDEAVVLGAGAFEMAARKHLIDNVKKTVKGRAQLGVGAFADALLVIPKTLAENSGLDTQDVIVSLENEHDRGLVVGLNHNTGEPVDPEMEGIYDNYSVKRQIVNSGPIIASQLLLVDEVIRAGRNMRKPT

SEQ ID NO: 121605 - protein, 304 aa, Triticum aestivum
  unsure (1)..(304): unsure at all Xaa locations
  Clone ID: PAT_TA_16023.pep
GDKREEFYLTYWIGKNSILEDQHTALQITNTIWNSMKGRPILGRIYEGKEPPQFISLFQPMVILKGGISSARGNSVQEKALPDETYPGTGVALVRINGTSIHNNKTVQVDAVSTSLSSTNCFVLQSGNSMFIWIGNTSSYEQQQWAAKIAEFLKPGVAVKHCKEGTESSSFWSALGGKQDYSNKNATQDVVREPHLYTFSFRSGKLEVTEVYNFSQDDLLTEDVMVLDTHAEVFVWMGQCVDTKEKQMAFEIGEKYIEHAVTFEGLASDVPLYKVSEGNEPCFFXTYFSXXSTRSLIHGNSFQX

SEQ ID NO: 121606 - protein, 192 aa, Triticum aestivum
  Clone ID: PAT_TA_16024.pep
MKHLLLPSPLPLLLHGPASKPLLLHVRQRHRHALSAAPDGNSGDTSTAASEPPPTDTQPSPPPSAPPSTNSGTTSVKTRLRSRNQARRVQEPYLPPVEVKMMRGKGKANASAAPRREKEKRKKTWDEMSLGEKAYELYVGEKGALFWLNKFAYASIFIMAGAWILFRFVGPATGLYQLDAPPLAPTDVLRGS

SEQ ID NO: 121607 - protein, 288 aa, Triticum aestivum
  unsure (1)..(288): unsure at all Xaa locations
  Clone ID: PAT_TA_16025.pep
EEYDPARPNDYEDYRKEKLKRAKDAEMKKELDRRRREDQERERERELREAEARLREEQSRASSLNISSEEAWKRRAAMSGAGGGATPQRASSPPHGDASXFSIPGSSSSGLGLGAGGLVPAAQRMMAKMGWKEGQGLGKQEQGITAPLVARKTDRRAGVIVDESSSRRPRSANFEGQPTRVVLLRNMIGPGEVDDELEDEIASECSKFGAVLRVLIFEITQANFPADEAVRIFVLFERTEDSTKALVQLEGRYFGGRIVHATFFDEGRFERNELAPMPGEVPGFRLNL

SEQ ID NO: 121608 - protein, 115 aa, Triticum aestivum
  unsure (1)..(115): unsure at all Xaa locations
  Clone ID: PAT_TA_16026.pep
XXYXNKFGDQFKCKTNGKLPSTAHKFSYFXRTPSLSILPSTHKVFEHHVLVIFLTIQSFSSHQHPSCCHFLTPPSTSDRLKHRCGCPTKNQRQPQVRSAQERGGQHPSAVMAPPW

SEQ ID NO: 121609 - protein, 77 aa, Triticum aestivum
  Clone ID: PAT_TA_16027.pep
LLMVLDVFVVVFFLSWVNMSCPCHYKCSIATCHFILYDVGDSEFCVVECDDQFLAHLFASYFSFSCLAEDISAHQHA

SEQ ID NO: 121610 - protein, 103 aa, Triticum aestivum
  Clone ID: PAT_TA_16028.pep
MEKVAESVDAGAAAQLQLKLFGSWAGSYTHRVQLARRLEALASAYAEGDLGNNSDPLRRLSPLYKKVPVLVHDGRALAQSVIILQYLADALPSSRPLLPADAY

SEQ ID NO: 121611 - protein, 194 aa, Triticum aestivum
  Clone ID: PAT_TA_16029.pep
MADPRMFPSGSNGPEDHAPGRRKYNPYQDLNMPYNYKNLYDLPTSPEFLFEEESAVQRRSWGENLTYYTGIGYLSGAVGGAALGLRDAAAGAEPGETAKIRANRLLNACGSSGRRYGNRLGVIGLMYAGMESGMVAARDQDDWINSVAAGLGTGALFRAANGPRSAAVAGAVGGVLAAAALAGKQLAKRYVQAI

SEQ ID NO: 121612 - protein, 70 aa, Triticum aestivum
  Clone ID: PAT_TA_16030.pep
MRLLVGIVRLVALMLMLVVGLSVPHAVGVGAITLHDTRTHGEQWAEERMQMRSYMTMDYTRVKRRTPKHN

SEQ ID NO: 121613 - protein, 97 aa, Triticum aestivum
  Clone ID: PAT_TA_16031.pep
GTRRHVRSYISEANIVVKEETSPAKEMLDVTSFRQRAEALEGLLELSADLLEDNRLEELAIVLKPFGKMKVSPRETAIWLARSFKGMMNDEASRTSM

SEQ ID NO: 121614 - protein, 253 aa, Triticum aestivum
  unsure (1)..(253): unsure at all Xaa locations
  Clone ID: PAT_TA_16032.pep
MPFFFFFFFHDNGFLRRHPLPHPCPAPRRVPRRHARSGGADCRCRLPGARGLTTGGRRNGTGCRWTSTARLCPAVDHIVANVTAERFRDHPATGPAVLRLFHHDCFVEGCDASILIAPAGKAAGEKVERDMEENRNLPQYGFDTVEMAKAAVXAKCPGVVSCADXILALAARDAVQLAGGPYYEVKKGRKDSKVSLAGKVRGSLPXPTPPWTELLRVFAGXAPGAGELVALSXAHTNRFAHCAHSWRSTNTGA

SEQ ID NO: 121615 - protein, 147 aa, Triticum aestivum
  unsure (1)..(147): unsure at all Xaa locations
  Clone ID: PAT_TA_16033.pep
GDPPKSAREPNSVQKPKREGCGRPPQCLARGAPAAGVCPCRWNSLLEGLSHGKPILXAWPLHSDQPWNAGYVCGXFKAGIVMRPWEKSRETLPAKEIQEVIKRAIDSDEGIAAQSAAKALAEDVRAAVANGGSSWADMEEFVGRITK

SEQ ID NO: 121616 - protein, 163 aa, Triticum aestivum
  Clone ID: PAT_TA_16034.pep
PGGRAPIGVLFDLLCADPESPGILPVLFGGFPPVFFPPGEGEVGVRGTSTIPRKGPPSSLPGTGKMGWIWPRPVHLPWGDPGGKVTRPGICLSLPSLPWVRLLWTSQSRLPRYGRALAPACLFLLALSSRPGYLFDYPCPAFAWTVCSGLLRSLSLAGAASPF

SEQ ID NO: 121617 - protein, 56 aa, Triticum aestivum
  Clone ID: PAT_TA_16035.pep
QLLHSRALSPRRSRAAPEPSRPRTTARPLDCSSPVSCRSRCPLREGASRGRKVGKG

SEQ ID NO: 121618 - protein, 76 aa, Triticum aestivum
  Clone ID: PAT_TA_16036.pep
MDFFRRKCTCKKSGCLKKYCDCYQGGAGCSINCKCDDCKNPYGKKVGVILDGKSILATPTPGPTPIERNGTGSYLK

SEQ ID NO: 121619 - protein, 51 aa, Triticum aestivum
  Clone ID: PAT_TA_16037.pep
ALHCIVWRLALRRCTPLSNFLITRVGTAGREALHGVVWRLRGGRHTKRSAT

SEQ ID NO: 121620 - protein, 305 aa, Triticum aestivum
  Clone ID: PAT_TA_16038.pep
MSCLAASSATPPASRPTAQRLFVAVAAPPRWRSVEPHRAVWRSEGPRALTMLRRCSPAGDSRAPGDGSLSSFCIIEGPETIQDFIQMQSQEIQDNIKSRRSKIFLLMEEVRRLRVQQRIRAAESRCSSSEENEMPEMPSTIPFLPYTSPKTMKQLYLTSFSFISGIIIFGGLIAPILELKLGLGGTSYEDFIRNMYLPLQLSQVDPIVASFSGGAVGVISALMLVEVKNVRQQEKNRCTYCHGTGYLPCARCSASKMLLGTKRFSLSTTERCSNCSGAGKVMCPTCLCTGMAMASEHDPRIDPFD

SEQ ID NO: 121621 - protein, 87 aa, Triticum aestivum
  Clone ID: PAT_TA_16039.pep
QNHEFTMRVKKGGGEGDNGRRLAFLKLLWKLLLLSLKLAIMAYYSFTAATDAPSDRNERRTVALLEKRETVSERRHAWLLVQAARLI

SEQ ID NO: 121622 - protein, 61 aa, Triticum aestivum
  Clone ID: PAT_TA_16040.pep
FFFFFFLRVRLYITAKVIPTMSSQRQTIDPKPAYKRLKNFLPSLANVHMKASPNIFSQHKK

SEQ ID NO: 121623 - protein, 184 aa, Triticum aestivum
  Clone ID: PAT_TA_16041.pep
CIPPAFVTIASLALGATAAPVAASPLDIGNGHMQLQINIDLTGKDAVAANAIDAQQLFAFSSTHFVHAVPEEVVNGTEPTGGLAGASGTFNFGINSASNMICYNITLHNFQGEFDSPATTATHIHEAARGACGPPRISFPNPEFVEGSETVRNSAGCIKGPFTTGVMVEGKDSGEGFYVSMIEA

SEQ ID NO: 121624 - protein, 102 aa, Triticum aestivum
  unsure (1)..(102): unsure at all Xaa locations
  Clone ID: PAT_TA_16042.pep
TSRNARESSELSSSGHQCYLSVQNPFINSSPLSPRQRKGLIQRVTMXALQHLKCVNESEDGLNDTAGSLPPYEEASDNERDHGPSKKTKSQPTARRTLVFKD

SEQ ID NO: 121625 - protein, 75 aa, Triticum aestivum
  unsure (1)..(75): unsure at all Xaa locations
  Clone ID: PAT_TA_16043.pep
ISRGGSVYGWRTYGIVFGGALAVLLEVYDSPPYKGYADAHSLWHASTXIPLTYLWWTFVRDDAEFRTSTLVKKAK

SEQ ID NO: 121626 - protein, 209 aa, Triticum aestivum
  unsure (1)..(209): unsure at all Xaa locations
  Clone ID: PAT_TA_16044.pep
GDYCNQVAEGARNGISQITAFNEKCPCSHIVVNGYSEGAHVAGDVLGGPGGMPIRLDRPRQQLXLQAKAVAAALLWGDVMHTANQPYNVLDGADKQSNGRKPEDLARLNRYAPVLRSYCAAGDPVCAGGNVVADHLDYFELYTDDASSWVVSKIDSVAPLPSCGATSSSSSAAASSATSAAVTQSSAVVPTSSAVATASATPTKAESSA

SEQ ID NO: 121627 - protein, 103 aa, Triticum aestivum; identical to SEQ ID NO: 107316
  Clone ID: PAT_TA_16045.pep

SEQ ID NO: 121628 - protein, 89 aa, Triticum aestivum
  unsure (1)..(89): unsure at all Xaa locations
  Clone ID: PAT_TA_16046.pep
PAGAVGDYVGEILERSFTLNFVGNRLFYAGVPLLLXWIFGPLLAFLSALVMIPILYNLDMVHVAADRGTKEHSCGCVNGKAKGNGCMQV

SEQ ID NO: 121629 - protein, 398 aa, Triticum aestivum
  unsure (1)..(398): unsure at all Xaa locations
  Clone ID: PAT_TA_16047.pep
SCNSLLASFVRRGSSMDAMKMYEFMKGKGLATGHTYTLILKAVARTEGYMSALQMFSEIEECAESRETLDVIVYNTMISACGRAKDWRQVEKLWGRLAENSLSGTLMTYDLLVSTFVAXGQPELXLPPYEEILRDGLVPSGDLLKALIAPCTKEGRWEFALXTFRRMLSAGMKXPNIIVFNPVINSLGKAXGEDELAFRMYHLLTSSELEPDQYTWSALLSALYRSGRCWDALELFQGIKSKHPSVLNSHLYNIALMSCERLGQWEHALQLLWMMEKSGLXISAVSYNHVIRACEVACEPKVVLKVYRRMTHERCSPDTFTHLSVIRACIWGSLWDEVEDILEEVAPDSSIYNTVIHGLCLRGKIRLARRVYTKMRSIGLTPDGKTRSFMLQHIASAE

SEQ ID NO: 121630 - protein, 52 aa, Triticum aestivum
  Clone ID: PAT_TA_16048.pep
MLTFSTATWTPALIWTRPATSALRLRSALKLLDAEFNPSNVQFRDTGSTLVP

SEQ ID NO: 121631 - protein, 164 aa, Triticum aestivum
  Clone ID: PAT_TA_16049.pep
MATPATTPATMRAVQYDACGGGAVGLKHVEVPVPSAKKNEVLLKLQAATINPVDWKIQKGDMRPLLPRRLPFIPVTDVAGVVVDVGPGVKGLTAGDQVVAMLNSFNGGGLAEYAVASANLTVKRPAEVSAAEGAGLPIAAGTALQALRSIGAKFDGTGKPLNVL

SEQ ID NO: 121632 - protein, 325 aa, Triticum aestivum
  unsure (1)..(325): unsure at all Xaa locations
  Clone ID: PAT_TA_16050.pep
MRAVPYGACGGGAAGLNHVEVPVPSPQXSEVLLKLQATTINPVHWKLQKGDVRPLLPRSLPFILATDVAGVVVDVGPGVKGLTAGDQVVAMLNSFNGGGLAEYAVASANLTVKRPAEVSAAEGAGLPIAAGTALQALRSIGAKFDGTGKPLNVLVTAASGGVGLYAVQLAKLANLHVTATCGARNMDLVKSLGADEVMDYRTPEGASLQSPSGRKYDGVVHCTIGVSWSSFQPLLSDAGRVIDITPNFSAILTSALHRVTFSKKRLVPLLLSPNKADLEFLVGLLKEGKLKTVIDSKFPLSDAGKAWQSSIDGHATGKIAVEIES

SEQ ID NO: 121633 - protein, 93 aa, Triticum aestivum
  unsure (1)..(93): unsure at all Xaa locations
  Clone ID: PAT_TA_16051.pep
MGRVIRNQRKGRVLYLYTANTRLNKNPAQFRTLDXLQRNGYIRGCRXEIVHDSGRGAPLARVTFRKXFTSSSRTPRPFIRPTEGQCTLGPVSI

SEQ ID NO: 121634 - protein, 96 aa, Triticum aestivum
  Clone ID: PAT_TA_16052.pep
GAQLAAGGRAITLHVRVPRNLELCGGPDQIKPISFSPLLSFFLFLFLFFVAINGITWILVGCVTQGGDHSSFTGRLVGYPYIYVELEDANVGVRGC

SEQ ID NO: 121635 - protein, 121 aa, Triticum aestivum
  unsure (1)..(121): unsure at all Xaa locations
  Clone ID: PAT_TA_16053.pep
DPPPAGPIPTAAPVHLSPLSLPIRSAPLRRPVSPIPPXPPSTLLSPPPHPSPSLPDRAGRPWLSGLPRLVAAVRAPLSSHRPHQGPLPLGLRGSTAPRCRRVPTLADYIKAQRGSSSPAPA

SEQ ID NO: 121636 - protein, 202 aa, Triticum aestivum
  unsure (1)..(202): unsure at all Xaa locations
  Clone ID: PAT_TA_16054.pep
RVDARNVYHAHKHEFQVNRHTFNILLSGWKSSEDADAFFAEMREHGIDPDLVTYNSLIDCHCKNRGVEKAYKLLDEMRGNEIAPDVITYTSLIGGLGLVGQPDKXARDLLKEMRELGCHPDVAAYNATIRNFVIAQRLGDAFALIDEMASRGLMPNATTYNLFFRFYYWAYDIGSAWLLYERMRSERCFPNTQXSCMFIIRL

SEQ ID NO: 121637 - protein, 146 aa, Triticum aestivum
  unsure (1)..(146): unsure at all Xaa locations
  Clone ID: PAT_TA_16055.pep
GEDIYTEYSPLGVCGAICPWNFPLVLSTGKIAPALMTGNCMIVKPSPFXPYTALKFVELAQEILPAGVLXFRSAEQPSSVVQIVALHPTFAQGSVSTRAPIRYGKRKCSIGKTILAKRTLQGGRYTTSEAWVGNRFFPIHSFPRIV

SEQ ID NO: 121638 - protein, 71 aa, Triticum aestivum
  Clone ID: PAT_TA_16056.pep
TISSSFMYFSCTAAVVTKPVKSAAAILLYSTALRHRREYIACSCNNSQDTTLPCPDVKSKMTSKITSTILF

SEQ ID NO: 121639 - protein, 531 aa, Triticum aestivum
  unsure (1)..(531): unsure at all Xaa locations
  Clone ID: PAT_TA_16057.pep
MSASAAPEKAAGSGGELLYCGATNFDAINRKLASGMQGNLVSPTRLRSLMGVDIVSVASGCTACHCVALGADGRCYTWGRNEKGQLGHGDTLQRNLPTVVSELSKYKIIKASVGKNHTVVVTDDRKSFALAPRPFGQLRAGSLKNEIEASPVPCLVTEVTGVACGADFTVWLSSVEGSTILSAGLPQYGQLGHGTDTEYNTKDSSVKLSYDFFPVPGAIATLSEKTIXVKVACGTNHTVAVDSSGFVYTWGYGGYGRLGHREQKDEWQPRLVEIFQRHNVLPPNAILSAGSANCACTAGGGQLYMWGKMKTTGDDTMYPKPLMDLSGWNIRCMASGTMHHVVGADDSCISWGNAQYGELGYGPMGQKSSANPKKVDSLEGMHVTGVGCGFGLSLIIVDRAKAGDKLDQLDIYDGDASTPVEETVEPKVTKKAPASANSKSNKRKKTKDLSESEEEDEDEDDSEDDENGDARGAKGKRGRKPSGRGRGRGAKKATPEPKSSGRGRGRPKKTESPAESSGRGGKRGRGRPRKS

SEQ ID NO: 121640 - protein, 131 aa, Triticum aestivum
  unsure (1)..(131): unsure at all Xaa locations
  Clone ID: PAT_TA_16058.pep
SSSSPLLRSTPPPPPMAPPARNLNPNPNTNNPDPPFDMGILFGSPPTAAPTFPAAVGPPPPFGPPPPPAPFSPPPAAXPPPPPPLPPHAGSSSPYAXAQPSPSPCTAQPSPSPCTAQPSPSPCPAPSPFQI

SEQ ID NO: 121641 - protein, 69 aa, Triticum aestivum
  unsure (1)..(69): unsure at all Xaa locations
  Clone ID: PAT_TA_16059.pep
AEVFFLGQLRQKNLXKLVEQCYEDEHGMLVYKFMSIGSPKTHLFKSINCSLPWMTRIKIDKDEDCYWRG

SEQ ID NO: 121642 - protein, 156 aa, Triticum aestivum
  Clone ID: PAT_TA_16060.pep
ARGGSRLWWFQVCSEVAYFQVAPKNDSVRSAQVNTRYNLDLCKNVYGEGVYPDVFMTNLYYGGTTSKIVFTNGSQAPWRHASQQKSSEDMPSYIIKCSNCRHGTDLAGRPRPPFMSVGGAPNCTSPEAVNSVREQIVKHIDLWLSQCLEPTKGVVR

SEQ ID NO: 121643 - protein, 102 aa, Triticum aestivum
  Clone ID: PAT_TA_16061.pep
LAPCPSPVLHAMAMLKKNTNSLMCCGFAAALMVVMAATLLVFSCDAREEMDDLAASFVPASCYSNYFPHCTDHRCKKFCGGAREPPVPGSLLQRPKQLLLPR

SEQ ID NO: 121644 - protein, 89 aa, Triticum aestivum
  Clone ID: PAT_TA_16062.pep
SGSADDQCGVNSNSADILLMALYSVTINRSLYTIVTHDFIVCQVSQNLWFSTDIQKHRVSTEANLCIVMGVASMFPVLSRSTYALFFTI

SEQ ID NO: 121645 - protein, 113 aa, Triticum aestivum
  Clone ID: PAT_TA_16063.pep
MHRSAGVAMAWNVFRFCTALRGLGSIMILLVLAIVGVTYYAVVLCNYGPALLLGGAATLAALAVLLLFHFLLAMLLWSYFSVVFTDPGSVPPNWNLDFDEERGETAPLSSSDF

SEQ ID NO: 121646 - protein, 216 aa, Triticum aestivum
  Clone ID: PAT_TA_16064.pep
AACQDCKRKSSARTRRQDYICFSIDFSCAMEEVEAANSAAVESCHKLLALLSQQQDPALLRSIASETGEACAKFRKVVSLLSNGGGGRGGHARGRFSRRRKPVGFLSQKGFLESSSNTPLGMLMSGSAATPSPSAGSAGQLRPQGRRAAAAATQPRFCSCSSSKSAHQFWPSKDGPANCLCSSSLVPTAHKVPSSKAAEFSGPNVQEEQQWDQPEV

SEQ ID NO: 121647 - protein, 142 aa, Triticum aestivum
  Clone ID: PAT_TA_16065.pep
CCGSPPPHPRNLLHSIQLSKNNHFSNAPQLPRSSQRLQAPFASTVRPPLAAHERASPPPRLRCVRLVRLAERSRRERPAVKARPSSSRSLFLCCCPQDYKIPRLSCCRCCRWRCSREGGHRKEIRRGRNGKKKIKAGGFWSS

SEQ ID NO: 121648 - protein, 234 aa, Triticum aestivum
  Clone ID: PAT_TA_16066.pep
MSRQNSFSFTGSVSEVRHGDDAKYGGPSTMSEYGSKQRRKSNDPGRDISFQVLEKFSLVTKFARETTSSLFRENHSSGSHAYGRQKQEYVLDNRASDKYTDQLITPNDASLTSDSVESDESLLVWGKKRGKPLSVEEWRAFLDPEGRIMDSKALRKKIFYGGVDHVLRKEVWKFLLGYHEYDSTQAEREYLAAMKQEEYEAIKSQWKSISTTQAKGFTKFRERKGLIDKDVVRT

SEQ ID NO: 121649 - protein, 151 aa, Triticum aestivum
  unsure (1)..(151): unsure at all Xaa locations
  Clone ID: PAT_TA_16067.pep
RSVPTAKLANQVHLLLSTRSDDEPLKKVTSTHWPNQEPTTEASTSSGSSLPSEAEPSNQLTAPLLTPGVCEGAASAVAPARSSRRPVAVVPAGHRRPPLSSSASPGEYDLMRNGSKRAAVIVLGRKDERQIGKKRRGILSXKIKEXLGKEQ

SEQ ID NO: 121650 - protein, 324 aa, Triticum aestivum
  unsure (1)..(324): unsure at all Xaa locations
  Clone ID: PAT_TA_16068.pep
ESPHLTNIASVVHPXGEVDVEDVPKPARLARIVPXPGLDEFKTRAIAERGKDASSQTGHVIHXRRGPSGQLYNYASAAKGAKVLDFNKEAKGASNILDKDKDKYLRNPCSVEGKYVIIELSEETLVDTIAIANFEHYSSNLKEFEMLSSLIYPTENWETLGRFTVANAKHAQSFTFPEPKWARYLKFNLPKXRGRGRGCTLSMLEVYGMDAVEKMLENLIPVESKNAESDDKSKEPIEQPPLKEPSGGKDSSQEPLDEDEFEVEDDKPNGDSSRNGVHDQIVETRTLQAGRIPGDTVLKILMQKVQSLDVSFSVLERYLPGRPL

SEQ ID NO: 121651 - protein, 145 aa, Triticum aestivum
  Clone ID: PAT_TA_16069.pep
MVTFTGDDVRALFSHSTHQHALKPVDTEKLFRCDGCKQLGDELRLRCEQCDFDLHVCCAQAPARIEPSMLEGRALTFFNSRPATATHAGGIIPLCDVCGDPVRGFLYHNGVHDIDLHPFCAILPKRTTWGKDDGVHAGTPQRRPA

SEQ ID NO: 121652 - protein, 296 aa, Triticum aestivum
  unsure (1)..(296): unsure at all Xaa locations
  Clone ID: PAT_TA_16070.pep
RAELFSETAQRHTGTFTNDYLNANVFLPQPGRPFLSLQAQNFPNDTVNSTSIINASTYHASASQARSTHDYSHPFPAANVLSARRLPYENRFVDFSNSQTNRPFLLGCPPPSQSXGSAAFQQNSPSRRYYSDPITRTEPPTAPPLPTTRQHGTPSSGFHANLPQQHVVHSASSSVGFPHHXFTFNHPGQVVQAPSNSIRDVALSARNTDNRMGSAVLGNSNASPSGRCXKKRSGPVKLTPGAKHVLVPSDSTGDGDSAPVYSRVSFESTEHKCCMSSRTEGAMIPFGGTFALVAVP

SEQ ID NO: 121653 - protein, 135 aa, Triticum aestivum
  Clone ID: PAT_TA_16071.pep
PRALNPPTIPAIEGLKATASPAGTVSYHVEQMGPEACDRLRFPAVVRVQNHGPMDGRHPVLLFLRWPNATDGRPASQLIGFRSVHLRADEAAHVEFEVSPCKHFSRAAEDGRKVIDQGSHFVKVGDDEFELSFMA

SEQ ID NO: 121654 - protein, 607 aa, Triticum aestivum
  unsure (1)..(607): unsure at all Xaa locations
  Clone ID: PAT_TA_16072.pep
RAARFNRRRPXMTGKYXAVSGRPRLGGGVAGAPCAAVLRPPARPPRLPPSEGQNWKGVTRFPFDAKVTEQDLADTYNPPFNSCVEDGGASGIMCSYNXRINGVPPGAXHNLLSTTARGRLGASTGYITSGLRAPWPIIHDVQGYAKAPEDAVADVLKAGMDVNCGGYIQTHGVSAYQQGKITGEDIDRALRNLFAIRMRLGLFDGNPKNNRYGNIGADQVCNKEHQDLALQAAQDGIVLLKNDAGALPLSKSRVSSXPLAVIGPNGNNASLLLGNYFGPPCISVTPFQALQQYVKDATFVQGCNAAVCNVSNIGEAVHAASGADYVVLFMGLDQNQEREEVDRLELGLPGMQESLVNKVADAAKKPVILVLLCGGPVDVTFAKNNPKIGAIVWAGYPGQAGGIAIAQVLFGEHNPGGRLPVTWYPKEFTAVPMTDMRMRADPSTGYPGRTYRFYKGKTVYNFGYGLSYSKYSHRFASKGTKPPSMSGIEGLKATASAAGTVSYDVEEMGAEACDRLRFPAVVRVQNHGPMDGRYLVLLFLRWPNATDGRPASQLIGFQSVHLRADEVGHVEFEVFPCKHFSRAAEDGRKVIDQGSHFVKVGTPLTRL

SEQ ID NO: 121655 - protein, 395 aa, Triticum aestivum
  Clone ID: PAT_TA_16073.pep
RLGRGTRLHPDLGWTELSALAHHRSLPAHNLFDETPLSSDPMAEASGDGSMEDKISALPDELLIHVLSHLRSREAVHTCVLARRWRDLWQSVPCIDVSFKEFADMAAENDFEPEVVFKKFVNHLLMLRERVDPEEFHLQYSLAVGVGPRSAKSDEANLWIRHALQYKAQTVKIGNHSEPLQLLPSVFTSTYLKRLHITNAQLILGFFDRLRKGCPALEYLFLSTCDIEDLDIFSDTLKVLILSDAIGFSFSFEHDAQVSISAPSLISLSVEECPSGARLPILKNMSSLETASVLLSEGDITTCDADGIRQFLGGLSGVRSLDFYYGDRQLEVKNNHGWCPTFNNLTNLTLDRWCMHADLYAMIVFLPHSPNLKKLTLKLNEPPSRSPMTADTTSL

SEQ ID NO: 121656 - protein, 133 aa, Triticum aestivum
  Clone ID: PAT_TA_16074.pep
SLLDFLKHLLWRECYSQSSEFASDSYFPYVTLNLFANALAGSLLSAIAFPFFPLMTPCPDPAEPPPSVGIAAATPLSLDNARAESSRWHTYGCARVKDLPASHVAVSSTCSAAGAQVTEIAASGESGRKAGRT

SEQ ID NO: 121657 - protein, 201 aa, Triticum aestivum
  unsure (1)..(201): unsure at all Xaa locations
  Clone ID: PAT_TA_16075.pep
MASGTDEKAKMESLTSPAAFVEGGVXDACDDACSICLEAFCESDPSALTGCKHEFHLQCILEWCQRSSQCPMCWQPVSMKDPTSQELLEAVQWERNIRTNQTQNTTIFHHPALGDFEVQHLPVVGNDAELEERILQHLAAAAAMGRSHQHGRREGQRNRSGSHGRPQFLVFSAHPNTPAGSVSSSSTQGEGADDLRILVPR

SEQ ID NO: 121658 - protein, 389 aa, Triticum aestivum
  Clone ID: PAT_TA_16076.pep
MASGTDEKAKMESLTSPAAFVEGGVQDACDDACSICLEAFCESDPSTLTGCKHEFHLQCILEWCQRSSQCPMCWQPVSMKDPTSQELLEAVERERNIRTNQTRNTTIFHHSALDDFEVRHFHVVANDAEIEERILQHLAAAAAMGRSHQHGRREGQRNRSGSHGSPQFLVFSAHPNTPAGSVSSSSAQGEGADDLRILVPRVGDLPPHANPIEEAGNQSPGVLTYDAEQDAVVSSGNSTPVSSPRFFNRRHSSGQSTPVGNDRAGPSDVQSFSDSLKLRLNAVSSKYKESITKSTRGWKERLFSRNSSVSDLGSEVRREVNNGIASVSRMMERLETRGSGRPSYSPTTSTSEVCLTTEPSNERVTESNSNTTTSTSNTSTPCVTMSGSN

SEQ ID NO: 121659 - protein, 196 aa, Triticum aestivum
  unsure (1)..(196): unsure at all Xaa locations
  Clone ID: PAT_TA_16077.pep
RTRGIIKELVAKIYVXHEYSFRMVEHKWFNILIEXMNPNYPPIGRKAIKSECMQVFHIEKXEVLKSLLKGVDSISLTIDLWTSNQTISYMCVVAHYIDEDWKMQTRVLAFIELDPPHSGNVIADALYACVTEWKIENKIASVTLDNASNNDGAVDALKAKFLVRRGADFDAQYFHVRCCAHILDLVVQDGTKVLDP

SEQ ID NO: 121660 - protein, 245 aa, Triticum aestivum
  unsure (1)..(245): unsure at all Xaa locations
  Clone ID: PAT_TA_16078.pep
GYVNRILGQPSLIRESSMRKFPLPGLKALKPSSASLFGXGAAFENVILHPSLKRRIEHLARATANTRSHDAPFRNMLFYGHPGTGKTLVAREMARKSGLDXAMITGGDVAPLGSEAVTKIHEIFDWAKKSQKGMLLFIDEADAFLCERNSTHMSEAQRSALNALLFRTGDQSRDIVLVLATNRPGDLDAAITDRIDEVIEFPLPGEEERFLLLKLYLNNYMLKDDDKSSPWSTLLKKQPKKVDAA

SEQ ID NO: 121661 - protein, 81 aa, Triticum aestivum
  unsure (1)..(81): unsure at all Xaa locations
  Clone ID: PAT_TA_16079.pep
RGRGRGGSXGGRACWLQSEDWERCKQKVARAVETVNGTPAVAEPGQGRLRMVAEMIQKQLPLCLPQLQRRTTFGWLNCFMR

SEQ ID NO: 121662 - protein, 78 aa, Triticum aestivum
  unsure (1)..(78): unsure at all Xaa locations
  Clone ID: PAT_TA_16080.pep
PTCLAALIGAQKVMKQHESSGAPPPLLSXRMKVGCIKILVKQTXFPKXKTGGXVVLSKTNGDXXKSQITPLWVQKXGQ

SEQ ID NO: 121663 - protein, 112 aa, Triticum aestivum
  Clone ID: PAT_TA_16081.pep
TGVSSVEQSIVARDPVAMALYAVVVTVCAPIWEEIVFRGFLLPSLTRYMPLPWSILLSAVAFALAHFNVQRVLPLIFLGVVMGGVFARSRNLLASMVLHSLWNGFVFLDLMK

SEQ ID NO: 121664 - protein, 189 aa, Triticum aestivum
  unsure (1)..(189): unsure at all Xaa locations
  Clone ID: PAT_TA_16082.pep
EKLAAPNLNSVRGYEVIDAIKADLEKACPGLVSCADVVALAAKYGVLLSGGPDYDVLLGRRDGLVANQTLANNNLPSPFDHVSGTRQRFXDVGLNTTDVVILSGAHTIGRSRCVLFSGRLANFSAANSVDPTMDPALASSLQQLCRGGDGNQTAALDARSADAFDNHYFKNLLAKKGLLSSDQGLVSSP

SEQ ID NO: 121665 - protein, 264 aa, Triticum aestivum
  unsure (1)..(264): unsure at all Xaa locations
  Clone ID: PAT_TA_16083.pep
AHRAKAGGDVACAXSGRAGWEGEGETEGGLQAQGALGGGDRSPRSRPLWLHRRRRSWTMCRTSVCPRPSSSSSGMTSVDSSPPPPLPATLPLMPALPAEEGFGGAAPVANLASAHVVRQPQALRQVVSWVTVEDVTSIWRDGEAPYAAACGGDQAPTFVSDQVRPRHVDKRGFQPGKCPVGRTPTLPWPHRRVASQVRGGARRQGMAPPVPGVGAHVAGFNLVGXXRSRYACPPPEGSLAGPPLRRGGRLKRLGGVTSGGGPTL

SEQ ID NO: 121666 - protein, 256 aa, Triticum aestivum
  unsure (1)..(256): unsure at all Xaa locations
  Clone ID: PAT_TA_16084.pep
AAASTQPDMYQAMSAAAFQNTTKQVSPTLLQFQQPQNIAGRSALLSSQILQQVQPQFQEMHHQNINDSAIQGHNQSEALQQQLQRCQSFNGQKSPPPQQQESHHQHQQQQSQCMQTPQHQQMQEQKHSPDFXVYQMGCLVFSQLSSTNQSPPSTLQTVSAFSQQQNLQDRNISSLSPSNVPSMHDTLRPFPSEAGSNLQGVPRTTPLPVSDPWSSKRVAMESVIPSSSHVNSSHIRQLDSAPSNIPQSSSLAPLPG

SEQ ID NO: 121667 - protein, 138 aa, Triticum aestivum
  Clone ID: PAT_TA_16085.pep
PGEGPRRTGAQQPYATGRPNTYADREQTAGTKRTEARRLFPHHASGCSFNALLPDQLIRGRGRRAQLLGERQHSGQSATTGRDAWSPRRRTSLCPEREGRGGRLAAAKRHGSVGRRVRHAGGGTEQRGQPPAVGTWGG

SEQ ID NO: 121668 - protein, 182 aa, Triticum aestivum
  Clone ID: PAT_TA_16086.pep
MGELRVGGRRREGEDTAGDDSFSESMAASLDSGASSGSLCSSIMSSLTDDDDDAESSPVAGDPTPSPSPSDAMRLDGGGGGPLYELAPLLAHLPVRTGLSKYYKGKSQSFTSLSDVECLQDLAKKTTAHTGRKASRSSTSPLHVQGPRSKTIGKKKKAPPRGSSGRLPSRAAWSRGLFAQKR

SEQ ID NO: 121669 - protein, 365 aa, Triticum aestivum
  unsure (1)..(365): unsure at all Xaa locations
  Clone ID: PAT_TA_16087.pep
WERLQDSIGTGPSLDNDGNLKGMKDILLLGYWDLPHHLKTCLLYLCIYPEDYKINCEELKWKWMAEGFLDRRWGRLDEVAENCINELVNRNMIQPIDIYGDGIVKYCRVHDMVLDLLISLSDEENFATVLNGRGRVSRPRKIRRLSVQASGRGHQGAVGAVTETTVHVRSLTAFCPAXQIPHLVDFHALRVLDLVGCYRLENKHVKHIGSSRQLRYLRIGRSRITELPGEIGKLQHLETLDLXTVIHFQRLPSTVAELRKLLRLFVSRNTQLPAGGFRSLQALEELSFQETDDPVRFEEVNESGNDLRYLRTGGEIAKRLSVAPCCTYPCSKFLKIESIFRVGKWFPGNGSLKNLVETMPYGSGI

SEQ ID NO: 121670 - protein, 106 aa, Triticum aestivum
  unsure (1)..(106): unsure at all Xaa locations
  Clone ID: PAT_TA_16088.pep
NRLLRPPAPLIKKQRLSPARRPRAPPAALASPPAAPAPXGPARLARPPPPPPPPGAAGGAAGGPGRRGPGGPPGPPRPPRRRPRPPLPPLHARYAGNSARPTARGL

SEQ ID NO: 121671 - protein, 161 aa, Triticum aestivum
  Clone ID: PAT_TA_16089.pep
MAPTASGSLLALSVIVLVTIASTLLLAPVAANDIDALTALRSGLKDPNGALTTWDPQLVDPCTWFHITCDDHKRVTRIDLGRQNLSGPLAPELGQLDRLEYLEIYGNQLTGPIPKELVGLSNLKNADFSNNNFCGPIPTSGPFRHIPRSSFANNPRLGRKC

SEQ ID NO: 121672 - protein, 180 aa, Triticum aestivum
  Clone ID: PAT_TA_16090.pep
MAAHVEPLVVGRVIGDVVDMFVPTMPVTVRFGTNDLTNGCEIKPSIADAAPSIQITGRAGDLFTLVMTDPDAPSPSEPTMKEWLHWLVVNIPGGSDPSQGEEVVPYMGPKPPLGIHRYVLVLFQQKARVLAPAPGGDTAASAMRARFSTRAFAERHDLGLPVAAMYFNAQKEPANRRRRY

SEQ ID NO: 121673 - protein, 182 aa, Triticum aestivum
  unsure (1)..(182): unsure at all Xaa locations
  Clone ID: PAT_TA_16091.pep
MAAHVDPLVVGRVIGDVVDMFVPTMPVTVRFGTKDLTNGCEIKPSIADAAPSIQIAGRAGDLFTLVMTDPDAPSPSEPTMKEWLHWLVVNIPGGSDPSQGEEVVPYMGPKPPLGIHRYVLVXLFQAAKARVLAPAPGGDTAASAMRARFSTRAFAERHDLGLPVAAMYFNAQKEPANRRRRY

SEQ ID NO: 121674 - protein, 143 aa, Triticum aestivum
  unsure (1)..(143): unsure at all Xaa locations
  Clone ID: PAT_TA_16092.pep
NENSSLSHSQTKLPPQWLSRRSLAPATRAEAHRISSSSRAPAWATCSPSPASSPPSRAKATSTSPSXPRCRRSRRPRPSISPPSSPPSPPSGASTSTSCRWMTPPSPARTPSSCGGSPCAAPPTSSGRSSPAPRHAPRASSPT

SEQ ID NO: 121675 - protein, 105 aa, Triticum aestivum
  Clone ID: PAT_TA_16093.pep
MAKDYPASPKAQHLQESKKQRLTYVLVVSALCVAFYVLGAWQNSTMPNPVADSAISRVDCDTVAQRDGSVPSFAPASENVLDFDAHHQLNLSETESVVQQFPACP

SEQ ID NO: 121676 - protein, 101 aa, Triticum aestivum
  Clone ID: PAT_TA_16094.pep
MYRPGSPHLITTYNEREEVTPRELSIRVPAILRSKDEEGVKGCRVAGAVNNYTSQLLTYGSSSQSPSCKSSRQYNLTEALLFLSHFMGDIHKMLAFIHVLS

SEQ ID NO: 121677 - protein, 166 aa, Triticum aestivum
  Clone ID: PAT_TA_16095.pep
MASATQQHRRRRAILQLAALLVLVSPAAAAGGACKSEKFPAGKSYETCADLPALGAALHWTYDAAASSLSVAFAAKPASGAGWVSWGINPTGDGMKGAQALLAFKSGATYVVNTYNLTGYKPLSATSTPIAFKATGLAADEGAGGKVRLYGTLQLPKGMESVNHIW

SEQ ID NO: 121678 - protein, 145 aa, Triticum aestivum
  Clone ID: PAT_TA_16096.pep
SPDSIKDITETINAVGNLNGPSEYKDYHVGISFGTFLTVGGFLNFMLTGSTSAIRFGFVLGFALLALGISSLRSQRAGGRQPRLLLKGQAAIASVIFFKDLSVFFRYGWFPNVFAVLLSGMVATFYIHRIVTGGHKGRAESSSDN

SEQ ID NO: 121679 - protein, 179 aa, Triticum aestivum
  Clone ID: PAT_TA_16097.pep
MSWLARSIANSLLSPDSPEADGEDPRASGSTSPGSPPRGVREDLSELTDALAHRFQGLASFLAAPTPAGSGGAPRGLNPSEIAGRFRLGLARLPGRQAVADLAKNASSLLHPDEYWGGSEAAGATEDVVAFARDAAMRPELWLDFPLLPDDADSDDFDISDAQQDHALAVESMAPELAD

SEQ ID NO: 121680 - protein, 243 aa, Triticum aestivum
  unsure (1)..(243): unsure at all Xaa locations
  Clone ID: PAT_TA_16098.pep
MVRQNPDFLLDGSGKMLFTAVLMMLKAGCGKKELYDXFMDFPNVSVEDFTSNLRRGMLFLAEIGICHEDVNKFVLSHGLILGXSAPLKMPNSIVTNLNVGKRRLRKIILXETPKLLMSYTLGSKVSQLPKIDPFEASFXSRIKFLKSIGLSEGSEDMKKALKTFRGKGDELQDRYVFXVIRAGPDPYDVVTGLKPAPQVRHPKIXVLASRLSFLVLPPRHSLGDLLLSGLRAFAGDPTLASLK

SEQ ID NO: 121681 - protein, 170 aa, Triticum aestivum
  Clone ID: PAT_TA_16099.pep
MPGMEEAEDYASCAFSLTCPEDGAELGDGVVDDGDLFLFYAGGGAADDEDGDNEYVEQLVSKEASFCSSSDSGDADCSSAASEDWFLQARLAAVKWILETRGCFGFGHRTAYLAIAYFDRFFLRRRVDRAAMPWAARLLSVACVSVAAKMEEYCAPALSELDAGGGYEFC

SEQ ID NO: 121682 - protein, 84 aa, Triticum aestivum
  Clone ID: PAT_TA_16100.pep
VMVIASTFANATYERLPLEDEASADAWAMAHDPLMAGGIHGHGHGHGMPDPSAAMPMFNMPPNNGHLGGGGDGFPWAPHSRAPY

SEQ ID NO: 121683 - protein, 270 aa, Triticum aestivum
  unsure (1)..(270): unsure at all Xaa locations
  Clone ID: PAT_TA_16101.pep
WSRRRCPAWTAARVRRGGCGTPYTITKSRESWTDPEHDKFXEALLLFDRDWRKIEAFVGSKTVIQIRSHAQKYFLKVQKXGTGEHLPPPRPKRKAAHPYPHNKASKKAPEADLPQHPPPCIKGVLYLWMHLLSLQTQLQSKRHFLPWDHVLTQPYSPRHTQDLGRAKYSPXSQEGPSWDRPQSDAIEQEIWPTSHAIEQEIVLPALHAMPDFAQVYNFLGGVFDPDTTGHLQKLREMDPIDAETVLQLMKNLSVNLSSPDFETHLSIQHP

SEQ ID NO: 121684 - protein, 110 aa, Triticum aestivum
  Clone ID: PAT_TA_16102.pep
STFCTGSWHEPVLKVVLYKPFIHPHSVLLPFPSPSPLFFPSSSRVHHKFCPKFVKICRPPSIQMITKVSNFVLSSLIARLALALVYIVINLWVLVIWEELYVVVFDLYAI

SEQ ID NO: 121685 - protein, 114 aa, Triticum aestivum
  Clone ID: PAT_TA_16103.pep
MSEFLELEARDGVRMTWNVIPGTKQDAASCVVPVSAMYTPLNPNPAIPVLPYAPLRCRICRSILNPFSVADFGSKMWLCPFCFQRNHFPQQYSAVSQSNLPTELYPECCTVEYM

SEQ ID NO: 121686 - protein, 507 aa, Triticum aestivum
  unsure (1)..(507): unsure at all Xaa locations
  Clone ID: PAT_TA_16104.pep
DDVFEIIAQAQVIGEKVDXHFRWLDRAYRRELLRVYTTNIEQIYRRFIGEQRNKLTKLIEDKIRWSNFCAFWLAIDPRTRHRMSREKTDTILKALVKHYFVEKEVTXTLVMDFLYTDMKALEYQSKGKXRENINSXLDELPAPMVSVDMDIFVLAGDVITVLERAALEPLPCQPVSTKDDTCAQSRMKDGSSGEVNKISMEREERRLTELGXKILETFVLSHIFSGIEVAYQEAVALKRQEELIREEEAAGLENDMKGKRGGGANEKDKRAKKKQAKQKVRNRKVKDKEREDKSEARILERLNDEIAVDDSDGLPSKQAEEVALKVGLTLEEGASDGPDHLDSSRPMNGKRVSSMEANSSAFSADSTAMNGIHSKINNLPDSRNHLSPNRGKNQRNKGISIISYAEEDDCLPSSSVTGSSDRNSSGCGTAPKLDRDTVLLTLKDRLRELGQRLHEKNIEGRKLFKAHFEAMESQTKTNGSSSSSSTEKPPDVLKSPEHSPELTNDVK

SEQ ID NO: 121687 - protein, 280 aa, Triticum aestivum
  unsure (1)..(280): unsure at all Xaa locations
  Clone ID: PAT_TA_16105.pep
MASPTKLDMAGHGDEVTRNKKVVLRRYVTGYPTAEDMEVVVTSDVRLRVPEGSAAAVVVKNLYLSCDPWMRGRMTKHDDGDAVPAEDFVLGEALVNFTVGEVVDSTHPEFDAGDLVWGMSAWEEYTLITQTEGLFKINHPELPLSHYTGVLGLAGLTAYAGLFEVGKPKQGETVFVSAASGAVGQVVGQLAKIAGCYVVGXSAGSDEKVSLLKSKMGFDDAFNYKSEGDNLGAALGRRLPDGIDVYFDNVGGATLDAALLRMRPGGRVVACGMISQYNLS

SEQ ID NO: 121688 - protein, 139 aa, Triticum aestivum
  Clone ID: PAT_TA_16106.pep
VRGGTRPLRSWAMLVTFSHDESLVGVGGAVLTGGAELPYNTTEDAGNATSFSGYPQTDLLTPIATAGDITQIQASVGLVGTLFAGPRGLVPEPVPTALTLHDPDYNCPAGTNGTRTMLTTCWLLTPEARANATVPEGNA

SEQ ID NO: 121689 - protein, 216 aa, Triticum aestivum
  unsure (1)..(216): unsure at all Xaa locations
  Clone ID: PAT_TA_16107.pep
FFFGPREIAGLRQRAPPHMSRSSRFELVAALLXWLGRTAALGYGADEEVRLSFIVNAXRGRRDVPLPEGFYGNAFAYSVAATTAGELCAGGLGYALELVKKAKSAVTYDYLLSVADLMVLRGRPLFALSRTYIVSDVSHAGFKSVDFGWGEAVYGGPAKGGEGPIPGVTNYFSKXRTAKGEEGTVVPIXLPQGTPMEXFQAPRSVSPDSNAQSCRT

SEQ ID NO: 121690 - protein, 167 aa, Triticum aestivum
  Clone ID: PAT_TA_16108.pep
MLMRLLLVVALAVAAAAAEQRATYIVHMAKSAMPAEYADHGEWYGASLRSVSTGRAAAAKMLYSYDTVLHGFSARLTEQEASDMAGMDGVLAVNPETRYELHTTRTPEFLGLAGSEGLFPQSGTGGDVVVGVLDTGVWPESKSYNDAGLGEVPSSWKGSCMAGAVFN

SEQ ID NO: 121691 - protein, 210 aa, Triticum aestivum
  unsure (1)..(210): unsure at all Xaa locations
  Clone ID: PAT_TA_16109.pep
MDANADARSSSSPMHIVIFPWLAFGHMIPLLELAERLVARGHRVSFXSTPRNLSRLRPVVGVHFVALPLPRVDGLPEGAEATSDLPPSPGNLAELLLQGRRPPRRPILRLPRRGQEANWSSSTTSITGNGRRRRPRRPLRDVPPLRRRPAPPLLPAASLRGRGPKVPALRASTLPAPLPVLPDRRPAVLRGVRPRGHASAAGRPGQAVRP

SEQ ID NO: 121692 - protein, 186 aa, Triticum aestivum
  Clone ID: PAT_TA_16110.pep
MAPAQQVQVPVQASPPAILSVLETTLVAPSPSAGAAPLESSLPLTFFDVLWLNSPPVERVFFYRLAADADVPAILSNLRTSLPQALHAYYPLAGRLRLTPGTADRYEIYYQPGDGVTFTVAEYRDDVDIDELVVDKPREVCKIGPLAPPLPKGGPVLALQATVLQRGLAIGVAVHHAACDGALSTR

SEQ ID NO: 121693 - protein, 198 aa, Triticum aestivum
  Clone ID: PAT_TA_16111.pep
MGHHSDDEYSVAGDKPEVEFMDFQNDNTLQDYQSDDGPVVVTAPFPFLNGKPKSVLRPETSADAICIENTSCEPVDLWSVRIFSSNPEDSYVLSMMRPPLNDSDEAAKKAFLGLTSVEDRTLQPGQTLTIWLSCMPKDIGLHTSIVHVDIGDEKIERVAFLLADDNVSMALSSDKPYSRRQGSQRKQFECNTFVPGSR

SEQ ID NO: 121694 - protein, 192 aa, Triticum aestivum
  Clone ID: PAT_TA_16112.pep
LVPDQSRRLPSARPTHTASATHHAAATGCRAAPAPSSSSGSSVSARAAPTPPALSAEFSASSIITHRRCAESATESRTSSAARPPLLAAAAASFSSASRARDCDRRSARSRLSLPSPLPFSSAPPVLPNLSLGRCKAGSGPKSLAGGGRSQLRSRSADGGRPRRRLWWSSAPGAAISSIPSSAEAPGPGLVW

SEQ ID NO: 121695 - protein, 216 aa, Triticum aestivum
  unsure (1)..(216): unsure at all Xaa locations
  Clone ID: PAT_TA_16113.pep
SLVMAVRRPKVARELIQKWQNEQTEVSMPLNIEVMELDLISLDSVARFADTWNARMAPLHVLINNAXXIFTIGEPQRFTKDGYEEHMQVNHLAPALLSXLLLPSLIRGSPSRIINVNSVMHTIGFVDAEDMNLTSGKHKYRSWLGYSNSKLAQVKFXSIFHKRIPADAGVHTVCASPGIXHTNVATGDLPKXXCXWGIXLIPYXTFSSKGSTVLFW

SEQ ID NO: 121696 - protein, 157 aa, Triticum aestivum
  Clone ID: PAT_TA_16114.pep
MSDMESVATLMESTSLKIQQLQRAFAELESQSAVTMNFKWKQLEDHFRGLEQSLKKKFDELKKQEKEFQETVAKSEKMLEQQEAVVVAKELTSLERLQEKRDAALAMIFGKSKLSLNTNYITPMNKPQSNYTVGTLDVKWPKHSPQGMRECKMAMLL

SEQ ID NO: 121697 - protein, 539 aa, Triticum aestivum
  unsure (1)..(539): unsure at all Xaa locations
  Clone ID: PAT_TA_16115.pep
MSDMESVATLMESTSLKIQQLQRAFAELESQSAVTMNFKWKQLEDHFRGLEQSLKKKFDELKKQEKEFQETVAKSEKMLEQQEAVVVAKELTSLERLQEKRDAALAMIFGKSKLSLNTNYITPMNKPQSNYTVGTLDVKWPKHSPEGNARTQDGNAAVKPRSELAILCEEMNVKGLHKFISDNRKNLTSIREEIPSALKGASQPYVLVLDSLEDFYSGDNLVLDGKKDGDLLGVRRTCLMLMESLVQLQADDITGLLSEGQMFATNVKDRAKKIAFEWKSKLDSLDIDASNGNCLEAHAFLQLLATFGIFSEFNEDELCKLLPSVSRRRQTPELCRLLGLSQKMPGVIGVLVDSARPIDAINLAXAFGLTEQFEPVQLLKAYLREAKKVSHAKNGKMSPGAQNEMNERELSALKAVIKCIEEHKLEEQYPVDPLQKRVIQLEKAKADKRRAVEAAKPQSKRPRANGSLYAPRVTSFPEKSFYQATPERHPYPYERQFVYGAEAHHHPTMMNAAPYTISPAHTPYYGNGYPVQYQVPYIH

SEQ ID NO: 121698 - protein, 222 aa, Triticum aestivum
  Clone ID: PAT_TA_16116.pep
APRRTPRARSGAPPHKARKQDAGPAVSSKQASPPSPPPIGSGRSRRMVNGLAQRVAMGERALGTQTRWRRLPRYSSFSRGSARTGFAPDPAGSPASPWPDAAPAAASKKQPRQHVILVHTAQTVHRKQIPPNNSVRCIRSAVGIRAGRKDSYRVDTIRFVAVCFPCLWTPPLRCAPSAPLRCSLSDFVVSAPPPLVHRVSSRPLCPLAVYRPSFCFWIYINT

SEQ ID NO: 121699 - protein, 122 aa, Triticum aestivum
  unsure (1)..(122): unsure at all Xaa locations
  Clone ID: PAT_TA_16117.pep
VGTCPRWLACSNPYVCGATQGSSILAPPSSRTILLASFAPRARTRHLVILAHSTMVHCFSIRSLLLFSSYVVRSFFFLVGIMXGRLESELXLXLCVRWLRLTVWLCLNDTVFWSLXELXFVX

SEQ ID NO: 121700 - protein, 256 aa, Triticum aestivum
  Clone ID: PAT_TA_16118.pep
MAAVVGVLALQGSYNEHMAALRRIGAKGVEVRKAEQLLGIDSLIIPGGESTTMAKLANFHNLFPALREFVGTGKPVWGTCAGLIFLANKAVGQKTGGQELVGGLDCTVHRNFFGSQLQSFETELSVPMLAEKEGGSHTCRGVFIRAPAILEVGQDVEVLADCPVPAGRPSITITSGEGLEDQVYSKDRVIVAVRQGNILATAFHPELTSDSRWHRLFLDMDKESQAKALAALSLSASSNDADVGSKNKAPDLPIFE

SEQ ID NO: 121701 - protein, 124 aa, Triticum aestivum
  Clone ID: PAT_TA_16119.pep
YNKKSLKKFFPNDESKQTFFCLDGQVSPPILPFNWQRDCRKQQRYNQQLNLVASMIEGREKGSGLTRHRHRILLYGGMRYLVHHIIIQLLVGTRKFLLGFAIFILVRLFICRGYSLGSAVILVV

SEQ ID NO: 121702 - protein, 165 aa, Triticum aestivum
  unsure (1)..(165): unsure at all Xaa locations
  Clone ID: PAT_TA_16120.pep
MSMTSSKHVFGSYGIMALLFFSAALVTADLSAEFYDESCPDALDIIEDAVRAAVSKESRMGASLLRLHFHDCFVNGCDGSVLLDGATGEKNAVPNKNSLRGFELVDDIKAQLEEACAPRXVSCADILAVAARDSVVALGGPXWDVELGRRDGTTTSQDAANSDLP

SEQ ID NO: 121703 - protein, 76 aa, Triticum aestivum
  Clone ID: PAT_TA_16121.pep
MAAKAISSPVPVEWYPTLAVVMVSVGLMLTASFFIYEATTSRRNRSLAKEIVTASIASVFLGFGSLFVLLASGVYV

SEQ ID NO: 121704 - protein, 76 aa, Triticum aestivum
  Clone ID: PAT_TA_16122.pep
MAAKAISSPVPVEWYPTLAVVMVSVGLMLTASFFIYEATTSRRNRSLTKEIVTASIASVFLGFGSLFVLLASGVYV

SEQ ID NO: 121705 - protein, 76 aa, Triticum aestivum; identical to SEQ ID NO: 121703
  Clone ID: PAT_TA_16123.pep

SEQ ID NO: 121706 - protein, 157 aa, Triticum aestivum
  Clone ID: PAT_TA_16124.pep
ERRRKHGLLHLRPHGRHLQASEEHHMSPRATKCSEAIIAFLNDGDHAAGDVQGDRGLVTPRGLIKHTEDSTKGMREAWEQTKETRDRQEAANQRAGFLEQGFGAAWTEGAHTDVVLEPGNGPPIPAHKAILVSRPPLSAFEVLALVPDVYTGRAFRA

SEQ ID NO: 121707 - protein, 142 aa, Triticum aestivum
  unsure (1)..(142): unsure at all Xaa locations
  Clone ID: PAT_TA_16125.pep
XXXFXGXGGGGCFFFXXGXXGXXXXXXXFFFFFKKKKXXGGXKKFXXXGXXXKKKXFFXPKXWVFLKKKNPSXKPPXQXFXQNXXFFSXIKYNSXLQWREGFSXIXNLSKTITICPFRTVGKLIPVFLIRCVNHVRSKTTAA

SEQ ID NO: 121708 - protein, 141 aa, Triticum aestivum
  Clone ID: PAT_TA_16126.pep
EIVLSVDQYLRMNNYVFFSMDGAPATSSSVGMFLRLCLLSLHRVRIFHCDGATSRGISATGCTRCSSTVPPPHRERVSHNLGLALGVPEASDTSRDGPVLLPAKSTAGRGAARLRRAELAATDPILPPAKTTAPGRAACRR

SEQ ID NO: 121709 - protein, 121 aa, Triticum aestivum
  unsure (1)..(121): unsure at all Xaa locations
  Clone ID: PAT_TA_16127.pep
RTVGLDDGHHRVIATKEYLPAWGPAGTAPCASGEFSDRELVRLLPRCSHPFHPPCIDTWLRAHVXCPICRSVVVVPSSLPAAATDAEAEGRQVEEHQVFDEMSPSESLPEGSRFRCLVHSK

SEQ ID NO: 121710 - protein, 226 aa, Triticum aestivum
  unsure (1)..(226): unsure at all Xaa locations
  Clone ID: PAT_TA_16128.pep
SSLLYLHEEWEQVIVHRDIKASNVLLDNQNELDRLGXDLVLAGIYDHETAVETTHIXGTMGXYLAPELSRAGRPTPFSDVYAFGVFLLEVTCGRRPIFIDEQNNRVLLVEWVLEHHHNGSMLDTVDARLRGEFNTEEVTIVLKLGLLCTYPSPNARPLMRKVLQYLDHDQSPPDLSPGYXSYLMMAXMQNEGFXPNNIPSSRNNGSPTVVGVNLKRFPKRGRLTQF

SEQ ID NO: 121711 - protein, 309 aa, Triticum aestivum
  unsure (1)..(309): unsure at all Xaa locations
  Clone ID: PAT_TA_16129.pep
MAGRYDGGNPFEEEEDVNPFSEQTRGKAGGQSNYGGGGAFYMPNPRNVAPSSNSRLSPLPPEPADFSATVDIPLESSKDLKKREKELQAREASTSRIQKELKRREEAXAARAGIVIEEKNWPPFLPLIHHDIANEIPTHLQRMQYFAFASFLGLVCCLFWNVVAVTSAWIKGEGVKIWLLAIIYFISGVPGAYVLWYRPLYNAMRTDSALKFGLFFLLYLFHIVFVVFAAVAPPAVFEGKSLAGILPAIDLISVNALVGIFYFIGFGLFALESLLSIWVIQQVYMYFRGSGKAAEMKRDATRGAMRAAF

SEQ ID NO: 121712 - protein, 90 aa, Triticum aestivum
  Clone ID: PAT_TA_16130.pep
MASDVQMGGGAAEAETFAFQAEINQLLSLIINTFYSNKEIFLRELISNSSDALDKIRFESLTDKSKLDAQPELFIRLVLDKPSKTLSIID

SEQ ID NO: 121713 - protein, 216 aa, Triticum aestivum
  Clone ID: PAT_TA_16131.pep
PQSAAAKQSLPSTSHSVFASEQPSREWYMNGASGVDMMLNGGLGHGLRNMSLENANSAKQQFMHANHQQSFVSNPVELAANGWGGTWGPGGASSSQAGASAHGTFRGGGWSSSEPSSALSHADWRSNAPAPCDYTSIDWSLDTTLLNPAAKSEWLSDTWSTMFMGGRSTRPAGGNLGLGGAGGMNGLHESSSGLPMEPAPSPRPYEWPSFCRGGSS

SEQ ID NO: 121714 - protein, 237 aa, Triticum aestivum
  Clone ID: PAT_TA_16132.pep
AAATHDTTPYHALYGGPYSSAGRQQHASAYHHAAQVSPFHLHLDTTHPHPPPSYYSSMDHSKDSYAYGHSVKEVHGGGEHAFFSSDVTTDRDHHHHHHQHQHHASAGGNGQWQFKQLGGMEPKQHNPTSLFPGCGGYGNNAAYAIDLSSKEEDEEKERRQQQQHCFLLGADLRLDKPSSGHGDSADQKPLRPFFDEWPHEKTGSKGSWMGLEGETQLSISIANELPITTTSRYHHGE

SEQ ID NO: 121715 - protein, 149 aa, Triticum aestivum
  Clone ID: PAT_TA_16133.pep
MAEETETEKQLFSPSDVSLHASTKDCWVVIHGKVYDVTKFLEDHPGGEDVLLHASASGDATEAFEDVGHSTSAISMMSSYLIGSIEDFVPPSATKDATVGGSDVLPDSRTMKRNKGSPAPNTFLDFVLPLCMLVMAFAAWYYLTFVAES

SEQ ID NO: 121716 - protein, 129 aa, Triticum aestivum
  unsure (1)..(129): unsure at all Xaa locations
  Clone ID: PAT_TA_16134.pep
TLPQNRPKTRTPSTRXRRGAATPPRHVGEDKLRGRAATPSRTRRNELPSQTRATRRSGHSRPDRRATATGLSRKPLEAGLVQIRAETSTYMAGRGAATPPWPPKRRRRSKVRSASQQAAPRRRKRRQPL

SEQ ID NO: 121717 - protein, 340 aa, Triticum aestivum
  unsure (1)..(340): unsure at all Xaa locations
  Clone ID: PAT_TA_16135.pep
NAXRPPPPTXCGAPGGPPVTAPRVRMRDGRFLAYAESGVGRDGARFKVVYSHRFXSGSRMDSPRASQALLEELGVYMVXAFDRAGYGESDPDPRRSLESAALDIQDLGRRARXLGDEFHLICSSLGCHAGWASVKYIPHRLAGVAMMAPVINYRWSGLPRGLARQLYRRQPLGDQWSLRVAYYAPWLLHWWMSQPWLPTSTVVSGSGSFPNALDEKNRLMALSTGMFQKRAQAATQQGVQESFYRDMAVMFGRWPEFEPTDLGEAPPFPVHLFQGDEDGVVPVQLQRHICRRLGWVGYHELAGVGHFLSAVPGLGDRIIGTLLPGPAGNSSTAVGSVCAY

SEQ ID NO: 121718 - protein, 147 aa, Triticum aestivum
  unsure (1)..(147): unsure at all Xaa locations
  Clone ID: PAT_TA_16136.pep
ALATNEPHLTQHGAEAKMQFFPSPPKFTDXLEERKYLKERLALAFRIFGKYGYQEGVACHITLRDPVNPHTFWVNPFGLAFSMIKASDLILVDHEGKVIDGGPNRLLNTAAYIIHAAVHKARPDVMCAAHSHSLYGRSFCALGRPID

SEQ ID NO: 121719 - protein, 130 aa, Triticum aestivum
  Clone ID: PAT_TA_16137.pep
LCSSVTASGKVADSKCGGCGSGCGGGCGSAGCGSGCGGNMVIKSSHEGNTKSGGCGSGCGGSCSGLVVEGSKIGHAKSGWCGSGCGGGCGGMLIEHSKTSCTKSSGCGSGCGGGCGSMFMEGSKTGFTKS

SEQ ID NO: 121720 - protein, 159 aa, Triticum aestivum
  Clone ID: PAT_TA_16138.pep
MEEPPLYKFGPYKIDAREVFHATPLSYAMVNLRPLLPGHVLVCPKRVVKRFADLSSDETSDLWVTAKEVGAKLEQYHKASSITFAIQDGPQAGQTVAHVHIHVIPRKKGDFEKNDEIYDATDVKVKEKEMKEKLDLDVERKDRSMEEMAHEATEYLALF

SEQ ID NO: 121721 - protein, 199 aa, Triticum aestivum
  unsure (1)..(199): unsure at all Xaa locations
  Clone ID: PAT_TA_16139.pep
LPLVPPILVAMVAHPKPXPLGNLRKVLSGGAXPFSKELIEGFREKYPQVEILXGGYGLTESTAIGASTDSAEESRRYGTAGLLSPNTEAKIVDPETGEALPVNRTGELWIRGPYVMKGYFNNTEATQATVTPDGWLXKTGDLCYIDEDGYLFVVDRLKELIKYKXYQVLRRSWXLLLINQKFXTRCYPFPDRIXQSPMA

SEQ ID NO: 121722 - protein, 246 aa, Triticum aestivum
  Clone ID: PAT_TA_16140.pep
MEFLGLLALAIAAMVGVVAGDDSTWSNGRATFYGGNDASGTMGGACGYGNMFSAGYGTNTAALSTALFNNGQSCGACFEIRCAGSGSCLPGSAVVTATNLCPANYALPNNEGGWCNPPQSHFDLAEPMFTKIAQARAGVVPVQYRRVVCVKTGGIRFTITGHSYFNLVLITNVAGAGDLTAVYVKSPSTGWLTMSHNWGANWQNGAMLNGQPLSFRVTTSDGRTITSNNVAPSGWSFGQTYAGSQF

SEQ ID NO: 121723 - protein, 272 aa, Triticum aestivum
  Clone ID: PAT_TA_16141.pep
RPLRAVTAAAAAAQPEERRVVDGSSRRGSSVTANDFLPADKPVAYDRVASLTKRAPSMRKQASSVSKDSAVSGRTSFASEFSGFGDSDSYSSASDDGYSVKELVVDSDSDWFHSEKDFSAGVHDAASLRSYKAKVLKAMESLEEVDMLQLSFRDSSATTVSPGSVAQASPDSVKYPEDMWSRTHSPEAEYKEDDETGTPREAEEAEAKIVEGEGSSIDMSDDDDDDRSSSSKKKMIAAPVYDAEFAVENSLEHSEKEIITINDHSYEAISDA

SEQ ID NO: 121724 - protein, 163 aa, Triticum aestivum
  Clone ID: PAT_TA_16142.pep
AGGVAPRRKSTMISCSRMALLRSPLVQDDASSTTVAKKPDERGKALPPAQGNSQFQTEHTHLIRRPELRQTILQTSSQNEQGVTPYLIYSNKKPNNNNKTEQLLRAQPSPAAGTQAEEREREGEGRSKSQAPGRTTPEATVKRETRRRNTIFACSLIKTRSSK

SEQ ID NO: 121725 - protein, 181 aa, Triticum aestivum
  Clone ID: PAT_TA_16143.pep
RHGHAGPFLQQPMAPPPSAPPHRSHEEFNFDCLSEVCNPYRSCVGGVPRHGVAHAAGQALAQFPLHDAMAEDGPSGGNLHRGGGASSSPVPFVFGAGGARESPEMIRGVLPGAHARGKLNGGTTSKNLMAERRRRKRLNDRLSMLRSIVPKITKMDRTSILGDTIDYVNELTERIKTLEEE

SEQ ID NO: 121726 - protein, 228 aa, Triticum aestivum
  Clone ID: PAT_TA_16144.pep
MARERREIKRIESAAARQVTFSKRRRGLFKKAEELSVLCDADVALIVFSSTGKLSQFASSSMNEIIDKYSTHSKNLGKTDQPALDLNLEHSKYANLNDQLAEASLRLRQMRGEELEGLSVDELQQLEKNLETGLHRVLQTKDQQFLEQINELHRKSSQLAEENMKLRNQVGQIPTAGKLVVADTENVVAEDGQSSESVMTALHSGSSQDNDDGSDVSLKLGLPCLPWK

SEQ ID NO: 121727 - protein, 134 aa, Triticum aestivum
  Clone ID: PAT_TA_16145.pep
LCVLHIECMNIIVNVAVTSKQEECQEALLAAHKLVHLSGRSDEMFEELTNILQSKASYFSGMYGLEPPSCPVASTKRKKGKSLKKTPARSDDVDGNRSSTSGILSNEELTAVGGAAWQLNPRVRGRVGGRVGGR

SEQ ID NO: 121728 - protein, 78 aa, Triticum aestivum
  Clone ID: PAT_TA_16146.pep
MITQSWAAAAVVANGGAGRRGDEKKAAPGCDVEALRKCLEENKGDGAKCQAHIDAFRSSCSVSPTNTSDYRPTVQKET

SEQ ID NO: 121729 - protein, 271 aa, Triticum aestivum
  unsure (1)..(271): unsure at all Xaa locations
  Clone ID: PAT_TA_16147.pep
MCIAAWIWQAHPQHQLLLLLNRDEFHSRPTKAVGWWGEGSMKILGGRDVLGGGTWMGSTKDGRLAFLTNVLEPDAMPGARTRGDLPLRFLQGNKSPLEVATEVAKEADEYNGFNLILADLTRNVMVYVSNRPKGQPATIQLVSPGLHVLSNARLDSPWXKAIRLGKNFREFIRKHGDDEVEAKDIADRLMTDTTRADKDRLPNTGCDPNWEHGLSSIFIEVQTDEGLYGTRSTAVLSVNYDGEASLYEKYLESGIWKNHTVHYQIELPMRT

SEQ ID NO: 121730 - protein, 307 aa, Triticum aestivum
  unsure (1)..(307): unsure at all Xaa locations
  Clone ID: PAT_TA_16148.pep
MGTSDLDRQIEQLKRCEPLAEAEVKALCLKAMEILVEESNVQRVDAPVTICGDIHGQINDMKELFKVGGDCPKTNYLFLGDFVDRGFYSVETFXVVMALKVRYPDRITLISGNHESRQITQVYDFFDECLPKYGFVNVATYCTEPFYYLSFSALIENKIFSVHGGLSPAITTLDQIRVIDRKQEVPHDGAMCDLLWSDPEDAVDGWGLSPRGAGFLFGGNVVSSFNHSNNIDYICRAHQLVMEGFKWMFNNKIVTVWSAPNYCYRCGNVAAILELDENLNKQFRVFEAAPHESRGVPAKRPAPDYFL

SEQ ID NO: 121731 - protein, 146 aa, Triticum aestivum
  unsure (1)..(146): unsure at all Xaa locations
  Clone ID: PAT_TA_16149.pep
FDDEYVIVGSANINQRSMDGGRDSEIAMGXYHPGYLASTNRRARGQVHGLRLALWQEHLGQAAATVDLLQPSSLACVRRVNEVARQHWDMFASDAPPQGDLPGHLLAYPIGVGEGGELVETTAFFPDTKARVLGNKSTYLPPILTT

SEQ ID NO: 121732 - protein, 199 aa, Triticum aestivum
  unsure (1)..(199): unsure at all Xaa locations
  Clone ID: PAT_TA_16150.pep
IPSPCLLLRRPWRPPPCLPEPSTATPFAPRTLLLRGRPPSPAASPGGGPPPSSSSRPASXPPSPSSPPAPALAAKEGPPDHRAGGLRVHTCGPGAPPPRARGAPSGPRPIIGPGPLRPHAPQLLRGAVPRALAPAGDPVFPTAPFVLRPIAAWITAGAPGPSPPQRARLPAACPRASAGPGNLYHLLKSLRKWGIQTPS

SEQ ID NO: 121733 - protein, 175 aa, Triticum aestivum
  Clone ID: PAT_TA_16151.pep
PPELHERFVDCVSKLGGADRATPKGILKLMNSDGLTIYHIKSHLQKYRMAKYMPAPSSSSSSSEGKQHERRAAGSDTQHELDPKTGMHITEALRVQLDVQRRLHEQLEIQRKLQVRIEEQGKRLQKMFEDQLKVSGNTAPAAGPDVVLFPAAAETPSEQEEDTMFVDVIDDDDEV

SEQ ID NO: 121734 - protein, 145 aa, Triticum aestivum
  Clone ID: PAT_TA_16152.pep
MMACRLRLHQLRLVGVRPTCCSPSRDFAAVKSQKIQPPEKKKRLDEACLERYQQYSRTYIQSWILQGKVHVNGRVVNKAGTQVSDKSVIEIKAEIPKYVCRAGHKLEAAIKEFGVDCDGQIALDSGLSTGGFTDCLLQHGASHVY

SEQ ID NO: 121735 - protein, 150 aa, Triticum aestivum
  Clone ID: PAT_TA_16153.pep
QRRRRGLLARQLACASMLALLRAGRTAAACYLGFAVTLPHAIHARTSPSARFGLPCRWCASVIVPVTQICRRSSSGTPWTGWPLPPLLRRHRGRLLTATSTCCRVSLWWSIGCDLNPPQWIRRRWCALGSSRTRFNSSNSGSAILDKGRG

SEQ ID NO: 121736 - protein, 160 aa, Triticum aestivum
  unsure (1)..(160): unsure at all Xaa locations
  Clone ID: PAT_TA_16154.pep
DLMFFLVGALALLSENTRYLPLTEGALCLXAATAYTAELLLFYFHSTTHQGLEGYYHYLLVVLVGLCVASAVLGALLPASFPADLASGLLITLQGLWFYQTAFTLYGPMLPEGCHRDAGGDLDCHGHAAGERAEQLADFQLFAYVFLVFAYALGCYAVAA

SEQ ID NO: 121737 - protein, 164 aa, Triticum aestivum
  unsure (1)..(164): unsure at all Xaa locations
  Clone ID: PAT_TA_16155.pep
ARGRRVKHPPPRVPLGCYSYTAYLSYFWANDVLTRDAXLXIKDGTVDEWVRCHSGDLPYAVDIGSSIKYHRNVTAXGYRALVYSGDHDAIVPHLGTQAWVRSLGFPVVDDWRASRLDGQSAGFTIAYSNNMTFATVKGAGHTAPQYEPERCYAMFSPWVLHQPL

SEQ ID NO: 121738 - protein, 228 aa, Triticum aestivum
  Clone ID: PAT_TA_16156.pep
SHLLYLSRHYSFLQAIVFGSRIHLKRDTDRAATGRRQTVAAKKSGSQMGVVVGRDVARDMGRWYESASFPNFFQPRDGRDTRATYELMEDGATVHVLNETWSKGKRDFIEGTAYKADPASEEAKLKVKFYVPPFLPIIPVVGDYWVLYVDDDYQYALVGEPRRKSLWILCRKTHIEEEVYNQLLEKAKEEGYDVAKLHKTPQSDPPPESDAAPTDSKGTWWFKSLFGK

SEQ ID NO: 121739 - protein, 130 aa, Triticum aestivum
  Clone ID: PAT_TA_16157.pep
WASSARWLPLVEFGTVSCCRLRRALGPSLLLIEPTSPVAGASSSRPSRCLTNVVRSLLSLRATTHQAGFNITCFSVFSTLDMRRPKRRRRVMILQAMAGAEQQEQGRSIVYIVLAELKDFLSKNFYQTTF

SEQ ID NO: 121740 - protein, 230 aa, Triticum aestivum
  unsure (1)..(230): unsure at all Xaa locations
  Clone ID: PAT_TA_16158.pep
NXTSVGRVGAPXPCSYIKLIDWAXXGYLTTDSPMPRGEIVIXGPNVTKGYFKNEAKTSEVYKDDERGLRWFYSGDXGRFHXDGCLEIIDRKKDIVKLQHGEYVSLGKVEAALAMSPYVENIMIHADPFHSYCVALVVAAQNELERWALQQGLAYTDFADLCQKQEAVVEVLESLTKAAKQARLEKFETPAKVKLIPDPWTPESGLVTAALKLKREVIRKTFEDDLAQLYA

SEQ ID NO: 121741 - protein, 632 aa, Triticum aestivum
  Clone ID: PAT_TA_16159.pep
GRSGHAAKALNSSASADEASASNVVMLSGFSIPKLVLQIVTVETLLRLNKPNELAAFKDIAFTVYNKARRIPRFVSTSDMFQSPTYMSRPQSTMMHTASPGPTLWKECLAPRMSGQTLSRETEFDASMRSVSWDNSWQPGRAVGLPDPSKIPELCAQDDRKYAFEPLFILAEPGAVDYNDTMESSRFGVDASSSRAYSSISGGTDSGASPLLEGSENDSATSLHCCYGWTEDWRWLVCIWTDSRGELLDSLIFPFGGISSRQDTKVLQSLFIQILQQGCQIMSSSPEASNTRSRDVMITRIGGFLELEIQEWQKAIYSFGGNEVKKWPVQLRRSIPDGIPPNSNGPTLQQQDMGLIQDRNMPSSPSTLYSPHSKSSFTKGQSGNKKQILVEQSGMDSSRGSLHLVRSISLVAVSQDSSLHLACQADLMATRPTSGEGNQSSTGSASSYLDGFAPVKSIGSMSASYLLVPSPSMRYLSPATLQLPTCLTSESPPLAHLLHSKGTATPLAMGYVVSKAVPPVRKQLTKEDSRHSVLSVSIVDYYGGTVQDKMSRGSKQAVRHETSARDYETDMHNVLEAVAAELHSLSWMTVSPVYMERRSALPFHCDMVLRLRRLLHYADRHLSQPTDKGDVS

SEQ ID NO: 121742 - protein, 136 aa, Triticum aestivum
  unsure (1)..(136): unsure at all Xaa locations
  Clone ID: PAT_TA_16160.pep
LLMPGLFSAEPTQSELDTPDTAWLXRGRMFDRFFRLGMPAGASRDXPLVNPFGPGSPSLEPTCVGRMLVVAAERDLFRDRNVQYAERMKAMGKDVELAVFAGQEHGFFGADPASEADRELVRVISRFVQRDGDRPA

SEQ ID NO: 121743 - protein, 171 aa, Triticum aestivum
  unsure (1)..(171): unsure at all Xaa locations
  Clone ID: PAT_TA_16161.pep
VRLHAASAPERVTFCSVRQNDQRHLVLAHLFDKPCFLGLLAVQADSLSDFHANTHIPIVVGGQMRYEVTGDPLYKEIATFFMDVVNSSHTYATGGTSVSEFWFDPKRLAETLTTENEEFCTTYNMLKGSRHLFRWTKEIAYXDYYERALINGXLSIQRGXDPSVMIYMLPR

SEQ ID NO: 121744 - protein, 179 aa, Triticum aestivum
  Clone ID: PAT_TA_16162.pep
MAVQARFLSHAFPHDLNAYRSMDAAAPGNSQFLDEHAGCAPAVACIGNNTVLSDLPRSELTCNDNCGFAPRKRARMAGDEPAGLADLARQRLLLQQAAAMHGLMLPCDAQSRAVGSGAASTSGRVANAAGLNTLLYNQGVEMDALIRLETERIRAGLEEARRRHARAALATVERAAAGR

SEQ ID NO: 121745 - protein, 157 aa, Triticum aestivum
  Clone ID: PAT_TA_16163.pep
LVHVYTAAALRMNQLCVVKLVLTVAEQYLRHVHHTLRFGRWGLVVGMLLLARRRCSSLSSLLLPPPALLLADGGTRGCEDGNRRGTSWDGRIWSSWRESGRIWSSWRESGRQPRGPGVAAALRVSRGRTRGRGARVCLCSCVSLFERPRVRPRVRGR

SEQ ID NO: 121746 - protein, 367 aa, Triticum aestivum
  unsure (1)..(367): unsure at all Xaa locations
  Clone ID: PAT_TA_16164.pep
MAGAAPDRAALTVGPGMDMPIMHDSDRYELVRDIGSGNFGVARLMRDRRTMELVPVKYIERGEKIDENVQREIINHRSLKHPNIIRFKEVILTPTHLAIVMEYASXGELFERICKNIRFSEDEARYFFQQLISGXVSYCHSMQVCHRDLKLENTLLDGSPAPRLKICDFGYSKSSVLHSQPKSTVGTPAYIAPEVLLKKEYDGKIADVWSCGVTLYVMVVGAYPFEDPEEPKNFRKTIQRILSVQYSIPDNVDISPECRHLISRIFVGDPALRITIPEIRSHNWFLKNLPADLMDDDSMSSQYEEPEQRMQTMDEIMQILTEATIPPACSRINHILTDGFDMDDDMDDLESDSDLDIDSSGEIVYAM

SEQ ID NO: 121747 - protein, 178 aa, Triticum aestivum
  Clone ID: PAT_TA_16165.pep
HEEVVVGDKHVFQVFRKHCKMVVTNALLGQKLVNARRLGFVFRRKQILKGAAQEEHDCIPDEHYVQTLFSIKGLEDELERRTLTYTSWNQSTLDPKDQMTWHPTTFEYDAASPEQINAIKSIDHVNYEVEHRTEWCQSNGTSVPCFLFARKFSYGAAMHLLEDGAFGLLKSAQLLVNF

SEQ ID NO: 121748 - protein, 228 aa, Triticum aestivum
  Clone ID: PAT_TA_16166.pep
DHRAGRTEEGGWWPTHSKLLGALPATQIARARIPEPKMDLCLPPTFAYLDRRAGMPAEKMPGPVVAAEWTCTNRGGHKNNDSVLNNPTNNFLLMLPPLFCEECHRVNPAGYCSDIPHISIRHVLLDFLVRNQGDYNTSVAHAFLTAVDAMRTIHEAFTFRAEPGTELDDGHLFTTYMRIFKTAFGYETGPCAHLRFKRPECIAYILQNHGVRIDCSSMQDGYRQRAHT

SEQ ID NO: 121749 - protein, 129 aa, Triticum aestivum
  unsure (1)..(129): unsure at all Xaa locations
  Clone ID: PAT_TA_16167.pep
IRPPRLLLPSAHASVRTPQPPRAPPLPARRALTPTLRSFASRRPAPLCLLMDPATPFSDARADAYAEFNGETGVDDPEFADAEAEAGGEDAGFDGPRELPEELSRGVVCLECVTSAEGRAAGEGXTCRV

SEQ ID NO: 121750 - protein, 129 aa, Triticum aestivum
  unsure (1)..(129): unsure at all Xaa locations
  Clone ID: PAT_TA_16168.pep
HTAPNYPMVCAGYTVWKTLRILYAPAIRACRGLTSRTHDGXWRWLHXPNPDKIGAXGALSPRMGWDWEEEEEQSKVIAMPALEHLVLRNCKLTHLPPGLACDRRYDLRTMRLQDLTLLEYVENFPSVVE

SEQ ID NO: 121751 - protein, 260 aa, Triticum aestivum
  unsure (1)..(260): unsure at all Xaa locations
  Clone ID: PAT_TA_16169.pep
MAIHRRREPLLPALAAAALLLLLLAGPAAADDASSDDRGHDASPGCNNKFQLVKVKNWVNGTQGTTVVGLSARFGSPLPRTINEAHRTFAALTSPPDLCSNSTAKLTNSIALAAPGGCPFTXKAEFAQAAGAAGLVIINDDEELYKMVCGDNDTSLNVTIPVVMVPHSAGKNLKDLLDHGARVEVQLYSPNRPVVDLSACFLWLMAVGTIVCASLWSEFVACEQIDEHYNQLTRQPGPNSGTNNTQDKEILEITAKGAGV

SEQ ID NO: 121752 - protein, 159 aa, Triticum aestivum
  Clone ID: PAT_TA_16170.pep
GPHSMPTRPNPVNHRNIRILPPLHGAIMDFSRLYEGSNVVDEHRDMRLDIDSMTYEELLALEEHIGDVNTGLAKSHIVDKLKTSLYVPGATCVSNQSSEPSTENEACIICQEEYEAEDCVGILDCGHRYHAECLKQWLTVKNLCPICKTTALSAGRRSG

SEQ ID NO: 121753 - protein, 294 aa, Triticum aestivum
  unsure (1)..(294): unsure at all Xaa locations
  Clone ID: PAT_TA_16171.pep
EHLKKAGVKLKSYEAILSDVERLAEKGAKLWLDSSSVNAAIVSVFRSGCDRYMRKRGKTGRQIGKEASSDAPAPPGRGGPFLDLIGRYKASPVTLAKSVKNEAEIRGMKNSHLRDAAALAEFWCWIEEEVRNSVALTEVQVAENLLGFRRRQDGFIETSFDTISGYGANGAIIHYRPTPDSCSSVGSDNLFLLDSGAQYVDGTTDITRTVHFGEPSPRQKECFTRVLQGHIALDQAVFPERTPGFVLDVLARSSLWKIGLDYRHGTGHGVGAALNVHXXPQSISYRYGNLTALQ

SEQ ID NO: 121754 - protein, 181 aa, Triticum aestivum
  Clone ID: PAT_TA_16172.pep
MPTIIIKVDLDCGRCHAKIRKVLERIREKGEFIIDDIKYDEKKNHVIVSGPFDADKLGDKLCCKACNIIKEIETVEPPKKQDPEPPPATDKVKPPGPGKDETVKVKQQPPPPPPPPPKIVEVPVPYPCPYPYPFPAGPSGCCCHQGHGGCQCWQNPPPPSYPCGGYMMVCEEDPSGACTVM

SEQ ID NO: 121755 - protein, 135 aa, Triticum aestivum
  unsure (1)..(135): unsure at all Xaa locations
  Clone ID: PAT_TA_16173.pep
LGCLVRTPLADRADHEWIPLPESPIRSTDHAGWPPGRAPPRDPAGGQVDSDEPSSAVASDSHLHPPPPPALLLANRVGCTTKRGMCFTWWTVPCFLILKGKLPGKATXGAQRPSTMLDIPPEHNFLRYKKFSGRA

SEQ ID NO: 121756 - protein, 83 aa, Triticum aestivum
  Clone ID: PAT_TA_16174.pep
ATAAWTPSSPSSSTTSTPSSSAATPWTKYEPIKLYDHRVIKNGDHIACICVHACMHASSRVFFISVYRLYPYICVYGVHACNT

SEQ ID NO: 121757 - protein, 421 aa, Triticum aestivum
  Clone ID: PAT_TA_16175.pep
MSARRFLNILVSDCQKFTYMLRRFDLSHNQFFYPTPEEAAEHAKVVPPLTGMPDKSTLSANSSAGAGHNKKKKPMYIRPPAPMVNMKPSICAKTRYDRWGEMDCFPLTETKLFFTDSSARIFRFDADTHCIDTMPSLHTPKSDPLSFSIPPNPTTSKEGEGEGGGLYIMDRILRPNKEGQVQFESISYRRRCNHSSKAWHCDALPPPPFVHDPAYKQASICSYALVGGHTICISIRGVGTYCFDTLACEWSKAGNWLMPFHGRAEYDPELGLWLGVSERNIHLPCVADISGVLRGEEPLPEHTRIWEDTDMPEGWYPHSQCPTEVVSLGSGRFCVTNFVETKEFDERCGDSVVDDIFAVFTGMELVLPGNDNDEGKANSNSKGDSKGNANGNGNGIAGVRMIKHKSRSCRSRGTNLIKSVL

SEQ ID NO: 121758 - protein, 288 aa, Triticum aestivum
  unsure (1)..(288): unsure at all Xaa locations
  Clone ID: PAT_TA_16176.pep
MKRASVICQCAWRQSIARRQLGKLRLANVERERLDELCRLHEMVDVLQQAVEDAEVRVIAEREAAVKAIAEAPPVIKETVVWVEDADKVNSWNAEVDRLKGLLGAEMQATIDAENALAKAELRNEKLARLLGVQEIKNKTLQDSVKRMEEKASDLEAENRMLRQAVASIPSVKSPSSENHRAHDLQATPLNEKTTNGAVKPVIVDRNGDIHDDDNAELPGLXNDAEAEKQQXXLLIKCISEDLGSQTGRXIAAYXIYRCLGHWRYXKXQNTFXDAYQXINAAXEAQTQ

SEQ ID NO: 121759 - protein, 155 aa, Triticum aestivum
  Clone ID: PAT_TA_16177.pep
SHVSGISASVQSPTGSSGRPGRYEIEPKKDVEPENCPFWWARSPENILQQDTYLALAASFVILRLLYLLFPRIVSAAKWAWRRHTLFANLMGVHEYFFTYLEQARQKLSRLYPSKRGNLQEGARNATAWASKSLASVSIGEPSTIGRTNSTNELR

SEQ ID NO: 121760 - protein, 108 aa, Triticum aestivum
  Clone ID: PAT_TA_16178.pep
AWRIESEFLLVLGSNISVLPPLSSPSPFDPLNAHSARGLRFFAMFCLIRRAVPCIDFLRDLKGSLYLGLLSSLLRTSYRLPFSSPEEFAQLTSLKKYAAFLRGTLQMS

SEQ ID NO: 121761 - protein, 64 aa, Triticum aestivum
  Clone ID: PAT_TA_16179.pep
HEALLHLSHRLSWCTYFSQPCIYYDSAIKQDLCPFFSSKYTRVALIARLHDGFKEDPAYDRIRI

SEQ ID NO: 121762 - protein, 127 aa, Triticum aestivum
  unsure (1)..(127): unsure at all Xaa locations
  Clone ID: PAT_TA_16180.pep
NSISISISDHICPTGTLFTLLMIYAAILTYNISCLRTSGPLPRPVLTNPNPLHHPRVLPAQNGQCRIHARPERTRPLTSAGIEAARRPRERRPRRFWVHAAAPRSKVAIAGYXMHVKSSWQSMLQLA

SEQ ID NO: 121763 - protein, 276 aa, Triticum aestivum
  Clone ID: PAT_TA_16181.pep
MGGPLGAIIGRYPSAAAGTGGDDADHPGGGGGTVSLGIIRHDRRCRDLAFLVLFAGFWVAMIGNSSFAFNQGNPLRLTYELDYKGNVCGDRHGDPDVHELEVRYWLDPNQVYQSGVKGSKANLADAKAICLMECPTPAPDGLNFVCDYPEGDVRLSVDDWINRDYNYFDVLTPDMRNSSLQLQGPCYPVIFPSVNVYWSCQYIARASNVSLTHWQQMGGVNIEQNMLIDKTIHKAIDSRSAVLKRYVADIGKSWPVLIVCGALLPLFLSVIWLLMI

SEQ ID NO: 121764 - protein, 91 aa, Triticum aestivum
  Clone ID: PAT_TA_16182.pep
QFLIALGSREGGGREEKGAACERKGRQCGSRKAKSFGALSYFLLYIRLSSSEISPMYEKPARKGALPQLATPLFCFESARPLFGAASRVAG

SEQ ID NO: 121765 - protein, 177 aa, Triticum aestivum
  unsure (1)..(177): unsure at all Xaa locations
  Clone ID: PAT_TA_16183.pep
IPRAAGREIAQFIANCDVCRRVKAEHQRPAGTLQPLAIPGWKWDKVGMDFITGFPRTKRGNNAIFVVVDRLSKVAHFLPVRESITASQLADLYISRIVSLHGVPLEINSDRGSLFTSHFWESFQTAMGTHLSFSTAFHPQSTGXVERVNQXLEDMLRACVISIRMDWEKCLPLPSCL

SEQ ID NO: 121766 - protein, 59 aa, Triticum aestivum
  Clone ID: PAT_TA_16184.pep
FLTVSLSSFSQCNRRKRRSDESRVNRRSCIVYRRGQKQLTRMFLREAERLLELSAEEQI

SEQ ID NO: 121767 - protein, 150 aa, Triticum aestivum
  unsure (1)..(150): unsure at all Xaa locations
  Clone ID: PAT_TA_16185.pep
PPWELVIWSTLEILFXDNNQNFDQTFFLFRANMAHNDEAGWGGEAFWELSQEMEEEPHRYEDAAEDTDPDYTTPSGVGDDTTDGGAADATTDDGGARTDGSQPKRQRKDRRPNMLGTVREEFTEVTSGGHHNGAQRISQWVRGTAWVHSP

SEQ ID NO: 121768 - protein, 72 aa, Triticum aestivum
  Clone ID: PAT_TA_16186.pep
EDALVTFLQANVDVFAWQASDIPCVPRKVIEHHLAVCPDARPVQQNVRKQALEQQKFIIGEIRKLEAAGLVR

SEQ ID NO: 121769 - protein, 148 aa, Triticum aestivum
  unsure (1)..(148): unsure at all Xaa locations
  Clone ID: PAT_TA_16187.pep
CSFPTFSILSSQVSLCLLIHHYHHVCHVIHFQTGCVPSCKFHPFPLPHFQSTVFHRCVLSVHPRLSQSTPSFPSFPFLGARLFPKSPHLSSIPSTVPAMFLSGDSXEXTTXLQVNILIXSSRXXNQXSXDKSFPXXSXSXEPXIXXXL

SEQ ID NO: 121770 - protein, 134 aa, Triticum aestivum
  unsure (1)..(134): unsure at all Xaa locations
  Clone ID: PAT_TA_16188.pep
TELVWSACLPSPSPPAPVVGLRVGRGLVPWSGTGPAVPVGNVLKGGPSNCPFGDLNTHTPSYPYIFPXACMYTGLLXDTLPCAGFVTTRYCDXRCILYPLTDNEGIVGMNDLQLXRAARQCGTKLRGPYXSXXA

SEQ ID NO: 121771 - protein, 54 aa, Triticum aestivum
  unsure (1)..(54): unsure at all Xaa locations
  Clone ID: PAT_TA_16189.pep
LYFGLXXSAGSFFTESPPRPRSFVRSKRMSYICFLISTYSFTSSYTRIVILKHT

SEQ ID NO: 121772 - protein, 225 aa, Triticum aestivum
  unsure (1)..(225): unsure at all Xaa locations
  Clone ID: PAT_TA_16190.pep
MKKLHANGXLDSLDFESLETCKSYHMGKMTERPXFSKMEQESNLLEVIHFDVCSPMSAEACSGYRYVLXFTDDLSRCXYIYLMKHKSELLKGSSXFQSEVEDRRDKRIKCLXYDHRDEYLSYEFWHTIKTLXGIVSQLIPPGTPXCDGVSEHHNCTLLDMVHTMMSLIELPLSFMGXALETTAFTLNRVARNSVETTPVKRNLSCLGIKFGGSHGESSRERSDQQ

SEQ ID NO: 121773 - protein, 77 aa, Triticum aestivum
  Clone ID: PAT_TA_16191.pep
LGHLSSEVIATLEQAGRGRTRGGEHADAEERRMTQGWHATIVPPCCPSCHHMIRPPLIRGHRNFGTTGSFALRATRY

SEQ ID NO: 121774 - protein, 100 aa, Triticum aestivum
  unsure (1)..(100): unsure at all Xaa locations
  Clone ID: PAT_TA_16192.pep
LFLWGPRQNSPSTLVNSKINSKGATHTQHTAPPNLGTLLPLRSHPPHVSLLHSYPQIPHLTPTENPSSPSSSXLRKTPSSPSSSXXLQLXSAFVTLSNPW

SEQ ID NO: 121775 - protein, 75 aa, Triticum aestivum
  unsure (1)..(75): unsure at all Xaa locations
  Clone ID: PAT_TA_16193.pep
DNLCMYRTYVFILLRMLDLSRFNKSRVGDDGVPVILQYRPSDLYXTDRKETVTIYPHSSPHLQIRLSLIHPLLPQ

SEQ ID NO: 121776 - protein, 156 aa, Triticum aestivum
  Clone ID: PAT_TA_16194.pep
GNITPEISQKKFQRLAQDLGFLDRTDQREERGDGGLGPGDRRDGAVRAADAGAAVHAAGARAGGGVRQHAHQRPLHPHPRRPLLRARHHLPHRRRRPRLHRLAGRARPPPASIGSSSSAGFSLRSVCLQSYQRWLWGLVIRFGGTVLNFSFIVTRC

SEQ ID NO: 121777 - protein, 78 aa, Triticum aestivum
  Clone ID: PAT_TA_16195.pep
NCTKATGVLQLCDSGHPEGPLSLPECRLTSVPANSGTPYVLFSAKVMLKFSMNFSMTLLKIGHMGYLRLMHGPGYLST

SEQ ID NO: 121778 - protein, 239 aa, Triticum aestivum
  unsure (1)..(239): unsure at all Xaa locations
  Clone ID: PAT_TA_16196.pep
FCNCAGGTSSGFSLDVFPEEFPGMPPDRDIEIXIELLPGTGPISKRPYRMPAKDLEEIKKQIKELRDKGYIRPSSSPWGSPVLLVEKKDGSLRMVVAYRGLNEVTIKNKYPLPMINDLFDRLQGAKVFSKIDLRSGYHQLKIREQDIPKTAFTTRYGLYEYTVMSFGLTNAPAYFMNLMNKVFMEFWDKFVVVFIDDILVYSKNEEEHKEHLRLVLGKLREHQLYAKFSKCEFWLKEVA

SEQ ID NO: 121779 - protein, 57 aa, Triticum aestivum
  Clone ID: PAT_TA_16197.pep
CKRNGTIYLNLVSDANDIMLSTISSQLTCKQSIVSFFLRRSSFPNQNGHEGTRVGSR

SEQ ID NO: 121780 - protein, 124 aa, Triticum aestivum
  unsure (1)..(124): unsure at all Xaa locations
  Clone ID: PAT_TA_16198.pep
PAVRSDAGGGSIAANTTHCFSSSGLTSITRIIHHLRRGICAEDIATMLKFVTSVVHVFDKKHLREPNVVDITKLLXLEEDGFXSMLDLIDCMHXRTVEPLLGLQGQYQNHTGEPTIMPEAVASL

SEQ ID NO: 121781 - protein, 77 aa, Triticum aestivum
  Clone ID: PAT_TA_16199.pep
LLLLEIFLVLRFVLEYCLCNAQALCLIAKLSLECCGMRHHELFTVPPENNASYCFACRSNASDLLVKKIILFCCFRA

SEQ ID NO: 121782 - protein, 129 aa, Triticum aestivum
  Clone ID: PAT_TA_16200.pep
DSSPFPLDLELLSHALPPSSIGLHPSFCHCSIVFSMEGTSRKRPHYSCPDLKDDVVGELIDRCDIITSASMAGSFKTILDSTNNIITRNPRVEERFDPPYLLCYKPVRMGADDGGLALCKLMPLDNDTV

SEQ ID NO: 121783 - protein, 115 aa, Triticum aestivum
  Clone ID: PAT_TA_16201.pep
WRGGRPDWMQLSSPVQVRCHRPPLGGSAGRGRRGWLGEVGRMSGAARRGGNDRGRSDPVVAIVGLVGRRPAVAWDGPAEPGRGRRRRLPGAWAATRGGVGSGRSGGAAAPTRPRT

SEQ ID NO: 121784 - protein, 117 aa, Triticum aestivum
  unsure (1)..(117): unsure at all Xaa locations
  Clone ID: PAT_TA_16202.pep
LTKVLMDSGSGLNLIYEETLQKMEIDWNRIEQSSTTFRGIIPSREARCAGKITLDVVFGTPENYKSEGITFQVAPFSSGYHALXGRGAVTKRPAEGPYGHMPGTMPGPTGNTGLARG

SEQ ID NO: 121785 - protein, 87 aa, Triticum aestivum
  Clone ID: PAT_TA_16203.pep
TGFPSQHLVARMPARAAPRLPLPHQLVAYGHLRLPSLPVPPLWPGGPFGTVHFRPLRRVLYYYSVACGVARMDFHSIIGFYYKRNSS

SEQ ID NO: 121786 - protein, 104 aa, Triticum aestivum
  Clone ID: PAT_TA_16204.pep
AQDSLYIPRVDSVARTFRILVTFVIVFEVRGISFFQYHELLMAEVLLNQNITTRVLLMSSPFYIVNLPVLPFCMGYLEEMLSFARHTNQASTTQKDIVLQVVLS

SEQ ID NO: 121787 - protein, 179 aa, Triticum aestivum
  unsure (1)..(179): unsure at all Xaa locations
  Clone ID: PAT_TA_16205.pep
APADLRGRRPSLAMINFVLLISRQGKVRLTKWYSPYTQKERTKVIRELSGLILTRXGPKLCNFVEWRGYKVVYRXRYASLYFCMCIDADDNEARISLKLSIIFVEILXDRYFGSVCELDLIFNFNKAXYYVLDEILISGELHESNKMNVARLIAAEGXLVEAAKEEPGCISNIIAQATK

SEQ ID NO: 121788 - protein, 84 aa, Triticum aestivum
  Clone ID: PAT_TA_16206.pep
EGVRGVAEGVQGVEGAAGGGSRRWCSGAGASTRLCLLAEVEDGGELGWASAALLGQVGALGGLRVSGRSSTFSPCFQITGLAWE

SEQ ID NO: 121789 - protein, 139 aa, Triticum aestivum
  Clone ID: PAT_TA_16207.pep
RPSSLLYSQPNCSLPRRQSRHLREAGAVERFCRREKRRGHQVGAATVAHGTSVSCQLLSSSNGGLLGGGSKGATRQVVGVLHATFLVFTNNIGCSCCPRTRFPPPLLHRVACLLGAALSIAIAITTLLLTLLLPFFRTD

SEQ ID NO: 121790 - protein, 280 aa, Triticum aestivum
  Clone ID: PAT_TA_16208.pep
MTLVRARPEFVRGRVGACKADGEGNRVIGGVEMMSPPGEAYVDSLFDLEPPGRGKRLGEEELVTLCSEVMSAGTDTSATALEWVMMHLILDPAAQERVYDEVVAKAGKTARITEADVEALPYLQAVVKETFRRHPPSHFVLSHAATRDAELGGYRVPADASVEFYTACVTENPETWPDPDAWRPERFLEGGEGHDTDITGTRALRMMPFGAGRRICPAATLGVLHIQLTLANMIRELRWTPPAGEGPPDPTETFAFTVVMKNSLRAGIVERNQPPPVAAN

SEQ ID NO: 121791 - protein, 186 aa, Triticum aestivum
  unsure (1)..(186): unsure at all Xaa locations
  Clone ID: PAT_TA_16209.pep
IARYIASCHVCHRVKAEHQRPAGTLQPLAIPEWKWDKIGMDFITGFPRTKXGNNAIFVVVDRLSKVAHFLPVRESITASQLADLYISRIVSLHGVPXEINSDRGSLFTSXFGESFQNAMGTRLSFSTAFHPQSSGQVERVNQILEDMLRASVISFGXDWEKCLPFAELTYNNSYQSSLGKAPSEVL

SEQ ID NO: 121792 - protein, 52 aa, Triticum aestivum
  Clone ID: PAT_TA_16210.pep
LQHIYRGNRVPQRTDSVLNLAQWDAKTEGKDFANASDYLETWDDSARSPGDP

SEQ ID NO: 121793 - protein, 167 aa, Triticum aestivum
  Clone ID: PAT_TA_16211.pep
AATEKGQKVTYNGYIEEIWELDYGPSLKVPLFRCKWFKLTGGGVKVDEQYGMTMVDFNNLGTLDEPFVLAKDVAQVFYLKDMSSKPRKRKDKKTISTSCDDPKRHIVLSGKRNIVGVEDKTDMSEDYNMFGEIPPFKVNTDPSIKLNDEDAPWIRHNRKQAGTQGKN

SEQ ID NO: 121794 - protein, 89 aa, Triticum aestivum
  Clone ID: PAT_TA_16212.pep
PCSYIKLMFLCIPHQSLMTRQTGKGTTPHLKNAASASRHDSQETGMLDEDSERSSVVDYSISPTLASQVLALTWPRDMWLHVAYGVSRL

SEQ ID NO: 121795 - protein, 313 aa, Triticum aestivum
  Clone ID: PAT_TA_16213.pep
MPRYDERDRYGGNTRLYVGRLPSRTRTRDLEDLFGRYGRVRHVDMKHEFAFVEFSDPRDADEARYNLDGRDFDGSRMIVEFAKGVPRGQGGGGDRDRGRGGDREYMGRGPPPGSGRCFNCGIDGHWARDCKAGDWKNRCYRCGDSGHIERDCQNSPKNLKRGKSYSRSPSPRRGRVRDRSYSRSRSRSYSRSVSPRRDERRSRSPRDSRSPRRSPRDSRSPMKSPRGSRSPMRSPRDSRSPRRSASPVKGRARSPTPPGSRSPAPRENSRSPMKADSPNNMSPAANGRSPSPRDGEDNGNHRAPSGSASPGGG

SEQ ID NO: 121796 - protein, 324 aa, Triticum aestivum
  Clone ID: PAT_TA_16214.pep
MPRYDERDRYGGNTRLYVGRLPSRTRTRDLEDLFGRYGRVRHVDMKHEFAFVEFSDPRDADEARYNLDGRDFDGSRMIVEFAKGVPRGQGGGGDRDRGGRGGDREYMGRGPPPGSGRCFNCGIDGHWARDCKAGDWKNRCYRCGDSGHIERDCQNSPKNLKRGKSYSRSPSPRRGRVRDRSYSRSRSRSYSRSVSPRRDERRSRSPRDSRSPRRSPRDSLSPRRSPRNSRSPMKSPCGSRSPMRSPRDSRSPRRSASPAKGRARSPTPPGSRSPAPRDNSRSPMKADSPKNMSPAANGRSLSPRDGEDNGNHRAPSGSASPGGG

SEQ ID NO: 121797 - protein, 120 aa, Triticum aestivum
  Clone ID: PAT_TA_16215.pep
CIFNIGSSGSSRPNQCRSCRLLLPPMASYAATEASLPPLLPPRASPAATVASHRSQTSDPRTPLRVCIHCRVFPFLGLAVVHRLGSLGAAWSMWSRNDFHRKSTVCGEADSWVQGRGKKR

SEQ ID NO: 121798 - protein, 120 aa, Triticum aestivum
  unsure (1)..(120): unsure at all Xaa locations
  Clone ID: PAT_TA_16216.pep
CRKLIGSIPNNLRNLTKLTALYFGQNQLSGQIPQDLGYLVNLKVLDLCQNTFSGSIPIXFXNLTKLTILSLXGNRLSGQIPQELGQLVNLEELELNTNTLSGSIPITIGNSNQLTRLYLF

SEQ ID NO: 121799 - protein, 165 aa, Triticum aestivum
  Clone ID: PAT_TA_16217.pep
SDAWVVVPQGRDRSSVALSAFRPRTRGKVPLPVRSKSFKKSRGASCSLPLLLLIGAVQFLVIGKPFPSLLMDSSTRRAFFNLAEEEFIPEPQVSCDFNDTRSDYCEMAGAIRIRGSTSEVFVMTPRRGTTAGDVVGDNATWIVANATSWKMQPYTRKGEARIMNG

SEQ ID NO: 121800 - protein, 85 aa, Triticum aestivum
  unsure (1)..(85): unsure at all Xaa locations
  Clone ID: PAT_TA_16218.pep
FGLNWLHLAGIFCGSEPPWMKARSKAYLLVSTRQTTFIMNILRFEAIFWAKTIMEKIRLLVLPIRYXVCGGARHISPLRRAHIEK

SEQ ID NO: 121801 - protein, 398 aa, Triticum aestivum
  Clone ID: PAT_TA_16219.pep
AYKGFADSIRLLLFLGAYRGRQDKEGCTPLHWAAIRGNMESCTVLVQVGKKEDLMVQDNTGLTPAQLAADKSHRQVAFYLGNARKVHERGCGGNNYFGKLSKLGLAPVLWCIIIGLIVAYIHSVIAGQYNSNMTLLFGFFSWLGVFLAIAGLVMFYRCSRKDPGYINKNTRDSQTQRDDEPLLKRGLDNPELLAGNWSQLCITCKIVRPIRSKHCSTCDRCVEQFDHHCPWVSNCIGKKNKWEFFMFLILEVSAMIITAATAVIRVAGDPGSPASFDGWLNYSAMNHPWVVSFVIMDLFLFFGVITLTVVQASQISGNITTNEMANAMRYSYLRGPGGRFRNPFDHGVRKNCSDFFLKGYNEDIEKVEQTSHPDEEMAIIHMTRGAVSQNGDERATSC

SEQ ID NO: 121802 - protein, 294 aa, Triticum aestivum
  unsure (1)..(294): unsure at all Xaa locations
  Clone ID: PAT_TA_16220.pep
VGAVAFFYLLLSLWAQDATTADLGLTRSDFPREFVFGSGTSAYQYEGAVAEDGRSPSNWDTFTHAGRMADKSTGDVAADGYHKYMEDVKLMSETGLEAYRFSISWSRLIPSGRGAVNPKGLEYYNNLIDELVNHGIQVHITLHHVDLPQVLEXDEYGGWVXSPKIVEDFTAYADVCFXESGNRVASWXQLWDEANIRVLGSYGNALFPPWAVAQIHFXSNKVHRWGTLASEPYIAANNTLMAHASVFRRYKRXIQRLFGCNTSKDWDKYPTGFHGQSRSEQPIKILVQTILHQV

SEQ ID NO: 121803 - protein, 110 aa, Triticum aestivum
  unsure (1)..(110): unsure at all Xaa locations
  Clone ID: PAT_TA_16221.pep
MAYRLPLAGVRASNYEARELPSNSYLXLGGPYGKFVPFIIAGEGGFGEHKQLKXGTNLFLLNKLGXSDIDRDHQRGDRLRLKAEKVVGHDKRVDKAPPPEIAEHWEGMSP

SEQ ID NO: 121804 - protein, 126 aa, Triticum aestivum
  Clone ID: PAT_TA_16222.pep
KQERGGTTPPYSPGRSRRTESLEPDDDTTVAATHRRRSLGGSSRRSRRAAPQGGVPPPPRDPDAKERPRRRRPPPGLSPAASSGDGEGRWGGGGGCRWRPIWIRLCRLGGDVGDGCVLLGHWRRLD

SEQ ID NO: 121805 - protein, 149 aa, Triticum aestivum
  Clone ID: PAT_TA_16223.pep
MGVAQSSPDEPVPDLASMLDACPGPTERALLAAVLDGDVPRLKDLVRAMDVEDRANLADMDILEGVGLLGLASYTRKMKVCEYLVEELGLDVNAGGFRGGPPPLGCAALCGEFFAARYLLNHGADPNKIDGTGFAPLHCAAKNGHECVL

SEQ ID NO: 121806 - protein, 148 aa, Triticum aestivum
  unsure (1)..(148): unsure at all Xaa locations
  Clone ID: PAT_TA_16224.pep
PPPPRPPARPRRRPPPPPPGPRPGPRPPRRPPLPRCPRPPRPRGPARPGQRARGVPGAPVPRAAARGAPRPRAAAAPPGPXAPVPRAAAPAAPPPRPRAPPPGPCPPRPPRLVVGGAAAPTVTGPAPAPQAGRLVASCRLRPGALAPH

SEQ ID NO: 121807 - protein, 252 aa, Triticum aestivum
  unsure (1)..(252): unsure at all Xaa locations
  Clone ID: PAT_TA_16225.pep
FVVVLVGAKVGVSFDQDLHCFSRIGGGSTFHRPMGIDGTRSPGGETVADFKRLLRRAFRLDRVVASHDGAASLGKPRLLIISRKSSRRFLNERAMAHAAAAAQFDVRIAEPDNHTDMPNFARLVNSADVMXMGVHGAGLTNMVVLPSRAVLLQVVPFGGLEWLSRVTFKDPAKDFDVTYMEYNVSLEESSLKDLYPKDHFYLKHPYDVHKKGWNAIKTTYLDKQSVRLDLDKLTRTLQHARSLLPSPSPSSH

SEQ ID NO: 121808 - protein, 141 aa, Triticum aestivum
  Clone ID: PAT_TA_16226.pep
KVSKVAGRRHLLGHQGLLAAAGCGLGLAARQVFSTQMGLSDQDIVALSGGHTLGRCHKERSGFEGAWTANPLIFDNSYFTELLSGEKEGLLQLPTDKTLLTDPAFRPLVDKYAADEDAFFADYAEAHLKLSELGFGEAGCC

SEQ ID NO: 121809 - protein, 501 aa, Triticum aestivum
  Clone ID: PAT_TA_16227.pep
TNFATFIRLLHNVNKQILDLALQDLDRVHDKSKEMSKGMRHLTKIFPNKVTIQPPQDEVELSRWNQMLDQDIEILKANDNTSKIRSFLTRIDLECSDLETIYVKDRTLTNECIDTIVGFALSHQLKHLTATNPDPSIDLQFSLSSESLKHGVDMLESIQSGPKTSNKRKSLKDIATENEFEKRLLADVIPPDEIGVTFEDIGALESVKETLKELVMLPLQRPELFSKGQLMKPCKGILLFGPPGTGKTMLAKAVATEAGANFINISMSSISSKWFGEGEKYVKAVFSLASKIAPSVIFVDEVDGMLGRRENPGEHEAMRKMKNEFMVNWDGLRTKDKERVLVLAATNRPFDLDEAVIRRLPRRLMVNLPDASNRRKIISLILAKEDLADDLDLEAIANLTEGYSGSDLKNLCVTAAHLPIRELLEKEKKERALAEAENRPLPQSCSSSDVRALRISDFKHAHEQVCASVSSDSTNMNELVQWNDLYGEGGSRKTTTLSYFM

SEQ ID NO: 121810 - protein, 136 aa, Triticum aestivum
  Clone ID: PAT_TA_16228.pep
QPPSSAWLASSGSHAYPATHTHATSTHNARTHMNAWLISNILLLSHDLAVVEVVAAPVIVVVIVVTQSADPTCRNDAGCTVLHHDSGNIRRAPSPPATHAWRPSAPRTSRAHPTRLRVTHLPRLSPEPSRPLRHHA

SEQ ID NO: 121811 - protein, 130 aa, Triticum aestivum
  Clone ID: PAT_TA_16229.pep
MAEPVANAAAPAPAPGRLRNAFGGVLCAFTLILIGVLAFSIRLFSGIKYESVIHEFDPYFNFRVTQFLSKNGIYEFWNWFDDRTWYPLGRVIGGTVYPGLTLTAGSIWWLVNALNIPLSVETVCASLLQY

SEQ ID NO: 121812 - protein, 100 aa, Triticum aestivum
  Clone ID: PAT_TA_16230.pep
AGCDPGCGLQWLLGRRFVVGRFVLVSGRNYISGLSRIGRRRCAGVCNLSWKHRPGAVLLPSPRGHGFGSCAPSLSHGHGLGGELKSVGSGDGDIFTSFYS

SEQ ID NO: 121813 - protein, 256 aa, Triticum aestivum
  Clone ID: PAT_TA_16231.pep
EKALRTTVLSDTSHGVKKCIEIALKCVEADRAKRPTIAEVVDELSKIDTTIIDELNKIDTARSSTIEQVTNLRCRPAVNPGVFSGVGAKDGSMISSCSSRATRASSDSVLLSANIKCPILPSASVKIFSYDNLRLATRRFRANSVPGEGGFGCVCKGWIDENTLSPCEPGTGIPVAVKRFGPESSQGHQEWLAEINHLAHLSHPNLVKLFGYCLEDEYRLLVYEFLPHGSLENHLFRRGSCQPLSWNMRMKVALGA

SEQ ID NO: 121814 - protein, 73 aa, Triticum aestivum
  Clone ID: PAT_TA_16232.pep
VRYKSGRLVPEYRPAASPTFVLTQHSNSHRKVMELRRQNELVHLRGGVGGGVVSASSGSGGAAEHMFRDYGVC

SEQ ID NO: 121815 - protein, 315 aa, Triticum aestivum
  unsure (1)..(315): unsure at all Xaa locations
  Clone ID: PAT_TA_16233.pep
RDCGMVAAARWIARGITPCLLQAVTQCPEYQIKIVGHSLGGGTAALLTYILREHTEFSTTTCVAFAPASCMTWELAESGKHFVTTIVNGADLVPTVSTASIDVLRSEVTASSWLNDLRDQIQQTRFLNAVYRSATALGTRLQSFSGARARVXAGAGALLCPVSSKTLVVMKQAQNVAQAVARSRSALSSWACMGARRRPVGVIAVSQDEMTAETHVKTTVDSESFVVEQHVTEVVEELQYAATSISVHEETEEEALMSEHETSREHTEEEITDGELWFEFDKDRDRQAEVEARTRAEEAAAAKEIMEEESAVLKN

SEQ ID NO: 121816 - protein, 188 aa, Triticum aestivum
  unsure (1)..(188): unsure at all Xaa locations
  Clone ID: PAT_TA_16234.pep
MAPLVDDVTAEILLRVRPDEPEHLFRAALVCKPWLRVLCDPGFRRRYRTFHGAPPLLGLLHRTQVFHGDPAARFASTTSMPDFPHPGSDGRRTRPLDCRHGRVLIHMLQDPEGDLLVWYPVTGDRHVVPEPDIDWMIYTAAGFCAXAGCDHLDCHGGPFRVVFLATDDHDEVVKASVYSSVTGAWSAP

SEQ ID NO: 121817 - protein, 167 aa, Triticum aestivum
  unsure (1)..(167): unsure at all Xaa locations
  Clone ID: PAT_TA_16235.pep
MWGHGCRRAIEASTAPSIRSPLSPRTPFYPRFYHSPSSHYCSGKFPLELGMKQSISIDWRRADDGRGTPREACRVREPLWIIFEVSGDIRLETYLRVSSHXCIDGRGXRVRLTGKAPLASELVMSGHCIWEELLFRKNAETYATAATAVLVHVLTTLAGNCEGKIYM

SEQ ID NO: 121818 - protein, 235 aa, Triticum aestivum
  unsure (1)..(235): unsure at all Xaa locations
  Clone ID: PAT_TA_16236.pep
MGGGNCNPKDFGAAAYWEARYSSPSTGGKGGGGGGFFDWYQSYSALRPLLRACVPTSSRVLMLGCGNSLLSEDMVKDGYQNIVNIDISSVVIEQMKEKHMDIPQLTYMQLDVRDMSFFGDGSFDCIIDKGTLDAMMCGDDAPHGAYKMLAEVARLMRPGGIYMLITYGAPKERLTLLNQVRCRWEVELYIMPATPEYQLKWSNGAAHAMMEXVALTVDGQLPPDYVLKXPESHFT

SEQ ID NO: 121819 - protein, 146 aa, Triticum aestivum
  Clone ID: PAT_TA_16237.pep
MDLASVNEELAEIDGQIADIFRALQNGFQKLDKIKDANRRSRQLEELTDKMRDCKRLIKDFERVVKDEAGSVDPNTAKFLNERKQSLIKELNSCVALKKQHASENKRVDLFDAPSGEDAFGEENVLLASNMSNQQLMQHSWDSWRT

SEQ ID NO: 121820 - protein, 136 aa, Triticum aestivum
  Clone ID: PAT_TA_16238.pep
RPSSFHPPSPSPLQLGAPAVLAKLFDRGEMEDKRKAVANNEERRQRQRREREAEAVEDTATSGRTPTAGGNGTSQELPRVTAATTPALGPPPGASSQFDNGRPQHAQIGNAGAPQGHGSTVIDQQRLRDQPFFSRA

SEQ ID NO: 121821 - protein, 135 aa, Triticum aestivum
  Clone ID: PAT_TA_16239.pep
YPRRQLLLPFSQLAAAYHQQFLPFNQLAALNSPAYVQQQLLPFSQLAAVSPAAFLTQQQLLPFYLHAAPNVGTLLQLQQLLPFNPLPSASPAYRRHPPYHWLAAPAHSSNLGFDKPNKVSYQQPIIGRCPLLDCL

SEQ ID NO: 121822 - protein, 183 aa, Triticum aestivum
  Clone ID: PAT_TA_16240.pep
MAPAYLATIPALRRAARRAPAALFSSGIVAGDKPVLVRDFVRSALYDPNHGYFSKRSGPVGVLDSAIRFHKLDGRNAYMKHLDKLYKMHDISWFTPVELFKPWYAYAIAASILRTANLSVPLKIYEIGGGSGTCAKCVLDYMMLNAPPKVYNNMKYISVEISSSLAEKQLETVREVQPFCQSS

SEQ ID NO: 121823 - protein, 262 aa, Triticum aestivum
  Clone ID: PAT_TA_16241.pep
SDEGGLVTSVAQLVDGDNPNLHLREDDVVLCVLPMFHVYSLHSILLCGLRAGAALVVMKRFDTVKMMELVERHGITIAPLLPPIVVEMAKGDAMDRHDLSSVRMVISGAAPIGKELQDIIHAKLPNAVLGQGYGMTEAGPVLSMCIAFAKEPSPVKSGACGTVVRNAELKIVDPETGLCLGRNQPGEICIRGRQIMKGYLDNPEATAETVEKDGWLHTGDVRFVDADDQIFIVDRLKELIKYKGFQVAPAELEAMLIAHPGI

SEQ ID NO: 121824 - protein, 137 aa, Triticum aestivum
  unsure (1)..(137): unsure at all Xaa locations
  Clone ID: PAT_TA_16242.pep
RARGGTRPAPASRHQPSSALGLYPQQLGGATLRRAAVAQATRAAHRHGLRSRAAALRRPASCPVRRRRHQAWRPSSPHACTSTASALTQRTAASRPACVNGHGLLFRELLCPSVXRPQHFLLQRSAVTTATKQYRGV

SEQ ID NO: 121825 - protein, 789 aa, Triticum aestivum
  Clone ID: PAT_TA_16243.pep
DGSHGSREQDILENGVGLGELQPKEKYWIKRDSDLAGVRKREISSSAKHDRHTASEEQKMHVPPSSVSTANAAPALQAPVVIEEHWVQCDICQKWRLLPYESDPDTLPKEWKCSMQLWLPGMNRCDVGEEETTNALNALYVIPPPANGIPSVGHPHAASSGPATANTFSINGHAEQSRKRKSFPGDGSALVDSSHPTQASAYSTITQPPPRVRSTADTNHYPSRPRARSKSPDVSTEKKKSKSKNRGSYSDGGDLVERSKKHSKGKGKREMDYGEYKASKKIKKEERHRSSRDRNPECDLASGDVPDEAKAFLAKAKSLGEKGDISSLKQKSVARSDRLEKSKRDKDEDIALPEDRDKEQYQTSDVQRSDVSSKKRIVKEWEESQHSSIAQVSRGTTVNHSSAAKETHKDQNLKETKSKPIKSEELYSTTDSKLGKGLHSNQISSYYGGHVNNELVEDSTHFAGKRGPSEVLDKRSSEHALDLAGAASSDVPTTAIASSSSKASGSQKKKNNSQVAKTSPIESVSSSPPRNSNIDKFSQNRIVEKDGPMNANPGTMPSSVKYLNTPRVRVDNVRQAKKSKESLLASEPVLHGSSQGNSDKDDELVQSTQGHASERFSLRKGLDDDQQHASGRKDSTVNGSSTARGYNHLHSGDKNNLRTDGSLVQPRTAASGSKGDLIASESKKTAAPIQDRNGLTHCALDGNPKPEVPSGKDKSYPKSNKQDMEKPKAQIAPSPLKETHSTPVKSNASKLTPQSRRSSDENGGQQRVAKQGTSNPTDGKDGNSTAYAL

SEQ ID NO: 121826 - protein, 167 aa, Triticum aestivum
  unsure (1)..(167): unsure at all Xaa locations
  Clone ID: PAT_TA_16244.pep
RAQRLRASTLFLAPLDPCPLLPRSPEDPRPSCAPASQAPARLPALTAAGQPPXRPGTPRARLSPTCRTRTVRQQDAGGGQPTRGGGPVLVMLPLVAMGPRGQVSPPRPLAVSLMAPRSAGWEGGVVDVWWGLVERDGPGRCLEGTQRSTGDRRRAQMESQKGGLGSR

SEQ ID NO: 121827 - protein, 110 aa, Triticum aestivum
  Clone ID: PAT_TA_16245.pep
MDSQFGALERGGSRQRRSPVLARPNTTKRHIQQQRANAADKKVVMPNYFSIEAFFVLACLTVSLLILPLVLPPLPPPPSLLLFVPVCLLILLMVLAFMPTDMRSMATSYL

SEQ ID NO: 121828 - protein, 152 aa, Triticum aestivum
  Clone ID: PAT_TA_16246.pep
GTRSTSPPETTTKPTHPLPSSFHSERGADGHGTLLPAAAAHRPRASKAARRRQRRRPPPRRRRQRQRGPAGVRGPAPAPAAAAPARGRAGAGPAPPRRRGGRRVPAARPAAPASPGGRRRGGGRPAGPRRAAAPPGARGCQGPPRVPLGGGP

SEQ ID NO: 121829 - protein, 338 aa, Triticum aestivum
  unsure (1)..(338): unsure at all Xaa locations
  Clone ID: PAT_TA_16247.pep
QVGYSLMIAPVYTAEVSPASARGFLTSFPEVFINFGILLGYVSNFAFARLSLRLGWRIMLGIGAVPSVLLAFMVLGMPESPRWLVMKGRLADAKVVLAKTSDTPEEAAERLADIKTAAGIPLDLDGDVVAVPKNKGSSEEKRVWKDLILSPTKAMRHILIAGIGIHFFQQSSGIDAVVLYSPRVFKSAGITGDNRLLGTTVAVGATKTVFILVATFLLDRIGRRPLLLSSTGGMIVSLVGLATGLTVISRHPDEKITWAIVLCIFCIMAYVAFFSIGLGPITGVSGSAPFPLHVRALGCSLGVGRQTAXTRXVISMTFISXSKXMNRGVPSSSAGNRF

SEQ ID NO: 121830 - protein, 142 aa, Triticum aestivum
  Clone ID: PAT_TA_16248.pep
GHRDSPGDGERGPPSTTHRRHRRRAHPCSRRRRAPSPCSPTATPPPVAPDTRRGHGREDVPAPPGRRTSSRCPSVVPVVVVGLRLAAVQPPPRRRAVTCFYRLDPSAERVDLCARHYRSLAFCSCQVSLCFRWYKVCSCTIA

SEQ ID NO: 121831 - protein, 257 aa, Triticum aestivum
  Clone ID: PAT_TA_16249.pep
MIYTAIDTFYLTDEQLRDSPSRKDGIDEAAETTLRVYGCDLIQESGILLRLPQAVMATAQVLFHRFYCKKSFARFSAKRVAASCVWLAGKLEESPRRSKHIIFVFHRMECRRENLPIEFLDVFSTKYTELRHDLIRTERHLLKEMGFICHVEHPHKFISNYLATLEAPELTQEAWNLANDSLRTTLCVRFKSEVVACGVVYAAARRHRVPLPEEPPWWTVFDADEAAIQEVCRVLAHLYSLPKAQYIPVYKDNDSFS

SEQ ID NO: 121832 - protein, 311 aa, Triticum aestivum
  unsure (1)..(311): unsure at all Xaa locations
  Clone ID: PAT_TA_16250.pep
AAASTEELGVARRAADAVALRICNEVLFPTRSPPEWWASELAALSPVSFHRVFTALRCRRAGPEVLVAAATAYAELLLADGKASDHRALLESVVAVLPSADDAPLPAAFLCRLLHDAVTTEASAKTCRDLELRLAAVLDQATAGDLLAFAFDGAGERVIHTESLRRVIAAFVERESGAGRNRRASLSGAAALGAGALQKVAKMVDEVAAEIATDESLPISKFVGVAGAVPKDARATHDCLYRAVDIYLKAHPELDEIEREKVCSVMDTLKLSYTARLHAXQNKRLPXQAVLNALYYXQLKLRXAGVGTTLG

SEQ ID NO: 121833 - protein, 138 aa, Triticum aestivum
  Clone ID: PAT_TA_16251.pep
MRAHSRRLDVPAALSFFAGMRRSATLPDAHTFACVLRACAGCSRPGAAKILHGIASSSGCSSHPIVRSALVSAYSKFLLVDSARHVFDGLREPDLVLWNSMMSGYGYRQMSLEGLQLFSAMLRTGEEPDDYSMVSLVS

SEQ ID NO: 121834 - protein, 119 aa, Triticum aestivum
  unsure (1)..(119): unsure at all Xaa locations
  Clone ID: PAT_TA_16252.pep
MASHIILPPDGDDDEQQRREDEENDGGGSGSGGDGEQQQQGGGNAKAAVPFSAXCVRISRDSYPNLRALRNASHASLXPDAAYVEISEGDFGYVLDDVPHLADYIPRRPHLPTHYKTPQ

SEQ ID NO: 121835 - protein, 149 aa, Triticum aestivum
  Clone ID: PAT_TA_16253.pep
PNSLAIARTTGSGRWDSADRYDRHGRRSSSASSQSQAPPPSTRSSPRPLARPRRRRVLQGKAMEESLCHATELAQAVANALFSLPATAPSSASRRPPIAYPTRSIYQREDVVGTLSGGARHCTIDRKRLGGAQSHHRLCPGRSAELNLL

SEQ ID NO: 121836 - protein, 215 aa, Triticum aestivum
  unsure (1)..(215): unsure at all Xaa locations
  Clone ID: PAT_TA_16254.pep
HALINRAMEITSSMMVKPVPHPLVGEKVALTIFDRAAADVFVPPAFPLPXAPAPSNEXLKEGLLKAVAPYPHLAGRLTVDQLGRRFLHVNNEGVILIETTVQANLADVLVEGRMLTRVDHLYPTIPQREEKIGAAXLQIQLNRYKCGGLVVRICSHHHTAXGHSMSMFFTAWATAVREGEDFTMPTPFLDRAKTVVPRSTPTPVFDHRSLEFTHG

SEQ ID NO: 121837 - protein, 131 aa, Triticum aestivum
  Clone ID: PAT_TA_16255.pep
MTWCNSFNDVRAVENNLASAAAVAAAAAKKQQHHQQQASSHVSLVRTCPACGHHAQYEQLQAASTIQDLPGLPAGVKFDPTDQELLEHLEGKARPDTRKLHPLIDEFIPAIEGENGICYTHPERLPGVGKD

SEQ ID NO: 121838 - protein, 401 aa, Triticum aestivum
  Clone ID: PAT_TA_16256.pep
NGEVVTPVSSQWRLYLDDSVGKEVNLQIERGGVPLTVKLEVEDLHSITPNHFLEVSGAVIHPLSYQQARNFRFKCGLVYVAEAGYMLSRASVPRHSIIKKFAGEDIENLDDLIAVISKLSRGARVPLEYVKYTDRYRNKSVLVTIDQHGWYAPPQLYTRNDATGLWNAKLAIPLESPFVVSHRAGHMDANLNSISPLTESSPMDLKCQHESENTADGCIKMQTDEEIAVDGSHSGEDSIIEKKRRRVDEEIAAEGTISSFGDLDDIKDGASGHPSSVEGSDLARTISSNASLAEQVIEPALVMFEVHVPPICMLDGVHSQHFFGTGVIIYHSDCLGLVAVDRNTVAVSISDIMLSFAAYPIEIPAEVVFLHPVHNFALVAYDPSALGAGASVIRAAKLLPE

SEQ ID NO: 121839 - protein, 191 aa, Triticum aestivum
  unsure (1)..(191): unsure at all Xaa locations
  Clone ID: PAT_TA_16257.pep
MTSRSGPGAMARRRTGRRSITAEIRRPRMGAGGRGGRPRPRELFVCNLPRRCGVDELLELFGPYGTVLSVEVSRDAETGISRGCGFVTMRSLAEARTAISALDGFDLDGREMFVKLAAHVVASRRNPSLSHTPPMKDHIFESRYKIYVGNLAWSVQPQHLREHFTQCGTVVSTRLLTDRKXGRSRVYGFLS

SEQ ID NO: 121840 - protein, 102 aa, Triticum aestivum
  unsure (1)..(102): unsure at all Xaa locations
  Clone ID: PAT_TA_16258.pep
MAPTVMASSATSVAPFQGLKSTAGLPVSRRSXGASSGTSXXVEGSRSSSVGQSKGIKXFETCPXLQXLTTEAXLKQVDXXIRSQXGXCXQXKKGWXNFRKQP

SEQ ID NO: 121841 - protein, 410 aa, Triticum aestivum
  Clone ID: PAT_TA_16259.pep
LHELDDFCLLQAQFLLDGSSGSGMWIVPITSGCGAYDTEKKLLLKLKHDKLVIGSQCGDRKKGGNFWTKLNINGTGFYRVKYDDELAAALQNALETKKLSLMDKIGILDDLYALSIARQQTFASLLHLLYGYPDEADYSVLSHINTVTASIAKVSADAIPALAGDIKQLLIKILLSPAEKLGWDPKKGESHLDVMLRPLLLTALVQLGYGKTINEGVRRFNIFTRDRGTSLLPPDTRKAACLAVMQNVSSSNRSGYDALRKIYKESAEGEERSQVLGILSSCRDKGIALESLNLIFTNEVRNQDAYVLLRGIQSEAREISWNWLKENWERISRTFSGSLAANFVKNIVPLFTSNEKAAEISKFFATRTKPGFERTLKQSLETVRISARWAEGIRSEPGLAQTVRELLAKP

SEQ ID NO: 121842 - protein, 227 aa, Triticum aestivum
  unsure (1)..(227): unsure at all Xaa locations
  Clone ID: PAT_TA_16260.pep
ELKGEYMSPSDLSGHGTHVASTIAGGQVSNVSYGGLAAGVARGGAPRARLAIYKVLWGARGSGSHAGVLAALDHAIDDGVDVLSLSLGQAGSELFETLHAVQXGISVVFSAGNGGPVPQTAWNAVPWVTTVAASTIDRSFPTMISLGSKPKLMGQSLQNNASINISDFQTLVYARSCSMQSLASSNITGKIVLCYAPAEAAITPARLALPIVINCTMQAGAKGLIFA

SEQ ID NO: 121843 - protein, 129 aa, Triticum aestivum
  Clone ID: PAT_TA_16261.pep
SLASQGQRRRRGAAPLAVSRRRSYRRPPAPSVTSRPLPRSRPASGRRQARRGCAAAGSDLARVGKAFQGTRFARWWRYAGSPWPWSASSRVCRGGWRRAFGERTADEIKELPLPSFDLSRLSRGVRFHG

SEQ ID NO: 121844 - protein, 200 aa, Triticum aestivum
  Clone ID: PAT_TA_16262.pep
PYPWRASSLLVVSQMESSSSSSGARSSSHGGPPGYSLNPSPIPYREQPLAYEPSEDCPCHKKAARWISWSNGNPGRRYLTCQRSRVGGCRWWRWIDDPTTPFLRQLLVDLRDAVNNLRRENTQLRGVNADLEMGIEDRSTQNNALRDALRKMKEQNQALEEKLGQTEGPLNVKNNGHQKRMLFSVVLIVMIVFLVSKLAA

SEQ ID NO: 121845 - protein, 171 aa, Triticum aestivum
  Clone ID: PAT_TA_16263.pep
KIELRFPHTGCKGMRGESIPFSGKPATHLPRSISSFSHQRRVMNRGEFLSSLVQQMIWSGTGDGGTSSIMSSLKPCHEEQEASPKLPSLSSPSMLFSQQFPHSPSGLGHINGGTSLLSLHDGSTGTQESHMPESWSQIILSGGLVGGQERGGYSATTALLSKGLENWGDHQ

SEQ ID NO: 121846 - protein, 278 aa, Triticum aestivum
  Clone ID: PAT_TA_16264.pep
CFDSEGGDDHERQGTVWTAPAHVRAALAGASVDAPRDKAFNVLLALGNIAFSYTFADVLIEIQDTLKSPPAENKTMKRASLYGLSMTTVFYLLLGCTGYAAFGNDAPGNILTGLAFYEPYWLVDVANVCVIVHLAGAYQVFAQPIFARLESYVACRWPDAKIINATYYARVPGRPSSSVPVAPLKLVLRTVIIMFTTLVAMLLPFFNAVLGLIGALGFWPLSVYFPVSMHIARLKIRRGEGRWYWLQAMSFVCLLISLAASIGSVQDIVHNLKTATPF

SEQ ID NO: 121847 - protein, 284 aa, Triticum aestivum
  Clone ID: PAT_TA_16265.pep
CLFHAVHDLANLPHVCCHLLSVTWNGVRPGGEKIYHVFDNQFPVAIKRLQFDKQLSMENVRKLITEADGYQPHLIAPEQGYRRLIESCLVSIRGPAEAAVDTVHGILKELVHKAINETHELKQFPTLRVEVGNAAFESLERMRDESKKNTLKLVDMETSYLTVDFFRKLPQDVEKGGNPSHSIFDRYNDSYLRRIGTTVLAYVNMVSSTLRNSIPKSIVYCQVREAKRSLLDHFFTELGAREIRQLSKLLDEDPAVMERRTNLAKRLELYRSAQAEIDAVAWSK

SEQ ID NO: 121848 - protein, 271 aa, Triticum aestivum
  unsure (1)..(271): unsure at all Xaa locations
  Clone ID: PAT_TA_16266.pep
GLSLDDDARILPVNGGSICRPPSHLPRPTLQGQRDPKTCCGHRLVALRRTPSAEAGPSAPAGLGRSGPSANKVYPGYNSIWALFLIQRIFPLVGLPPVATTIFFGANDAALLXGRTSQRQHVPVQEYKQNLKTIVNHLKDCSKSMVILLITPPPIDEDGRERYARSQYGEDARRLPERTNEMAGVYAGQCIELAKEMDVQCVDLWSKMQATEGWQKLYLSDGLHLTPEGNALVHKEVVQTLRGAGLKAEDMPHDFPHHSKIDGVYPERAFQ

SEQ ID NO: 121849 - protein, 208 aa, Triticum aestivum
  unsure (1)..(208): unsure at all Xaa locations
  Clone ID: PAT_TA_16267.pep
SAALYSSIITGSMLCGRAVSMLXLNRLGRRVLFIEAGAQXIASIVVVATIXALKFGHGEELSKGVSTVLVVAICLFVVAYGWSWGPLGWLVPSELFPLEMRSAGQSVVVCVNLFWTAAVAQCFLAAMCHLRWGVFILFAALIVVMSIFVILLLPETKQVPIEEIWLLFDKHWYWKRVVTKDPKYQGHHQRQEMAAAAAGAVKPVGTSE

SEQ ID NO: 121850 - protein, 137 aa, Triticum aestivum
  Clone ID: PAT_TA_16268.pep
MPEAPARAAGGGGGASAPADVDVVTSSGRRKIAAHSSVLASASPVLETTLERRLQRLRESGKGGRAVVRVRGVTDHVAAAFVRLLYARSRRGEGDVDQDVERYAEQLLVLAHAYRVPWLKRWSPEAAGSRLPPGTVV

SEQ ID NO: 121851 - protein, 250 aa, Triticum aestivum
  Clone ID: PAT_TA_16269.pep
VNIAIWFLLMAAEIHRSQSLLDMDAFIAHERHAHALTEERANSPQNRQRSIRDVFCINLSADPSSEQLTAYYAESNARSLNISSLRVPGRLRDGTLIEVPVTAATPKNIEDTSHHIVAFHRESDRAVAEVLVEDYSGYVVASRFIPPKVKKATVRFCHIGGAKLAARFQPVHPTKYGPAYAHLDKVRLGVGIVPQMVTFLEKLSKNPEQAATQYGYIMLATLYVLVSEGRRFWVIQEWNVANIQGFKQEL

SEQ ID NO: 121852 - protein, 248 aa, Triticum aestivum
  Clone ID: PAT_TA_16270.pep
MAPPSPPAASTKNADAAWYDKMEACVTPLPEVSDASEVAGGAVKKWPQRLTAVPPRVSRGTVKGVTAKAFQQDTELWKKRVRHYKAVINQFEQKGRYRNVLDMNARLGGFAAALASYPQWVMNMVPTVANSSALGVVYERGLIGSYQDWCEGTSTYPRTYDLIHADSVFTLYKNRCEMDTILLEMDRVLRPEGTVIIRDDVDMLVKVKSVADGMRWDSQIVDHEDGPLVREKILLVAKTYWTAKNQDQ

SEQ ID NO: 121853 - protein, 233 aa, Triticum aestivum
  unsure (1)..(233): unsure at all Xaa locations
  Clone ID: PAT_TA_16271.pep
EAPRAKGGCWLGLPPPPPRPPPPPPPHLIPLWGGLPAPRRVGSRRRGRWTPEDDQKLTTDYIEKHGHGSWRALPKLAGLNRCGKSCRLRWTNYLRPDIKRGKFTPEEEQTILQLHSVLGNKWSAIAKHLPGRTDNEIKNFWXNTHLKKKLIQMGFDPMTHRPXRTDFFAALPQLIALANLRQLVEQRPWDEQSASQLQADPSSIHLEYYMPAQSEQHCTIQLSTHIPLTDNRL

SEQ ID NO: 121854 - protein, 135 aa, Triticum aestivum
  Clone ID: PAT_TA_16272.pep
CRPGRNAFGGRRHWLHALPVRLVRAALVVGVLPGPAASVASSAWTCRCPSSCRTTSSEESPTHLETEKRNIEVYQVRSGSTVVYFTITDPDAAQLTSDASDLRRLGGNEKLLLLVPMVGDAEQAASTTCRSRCWT

SEQ ID NO: 121855 - protein, 176 aa, Triticum aestivum
  Clone ID: PAT_TA_16273.pep
ELAEDLRELCLEIVPRGYLATLEIQSTLMERIREAQKTDKEIEEIKERMSKGKAKGFREDEHDTLWFEDRVYVPNEPEIRKLILQEAHDSPYSIHPGNTKMYLDLKESFWWTGMKKDIAEYVAVCDVCQRVKAEHQKPVGLLQPLPIPEWKWDKLGMDFITGLPRTRSGYDSIWVV

SEQ ID NO: 121856 - protein, 72 aa, Triticum aestivum
  Clone ID: PAT_TA_16274.pep
MAAWTSVGLVAVAVLVVGIAMPASAAVQPPAPAPSSDGTSIDQGIAYVLMLVALVLTYLIHPLDASSPYRLF

SEQ ID NO: 121857 - protein, 72 aa, Triticum aestivum; identical to SEQ ID NO: 121856
  Clone ID: PAT_TA_16275.pep

SEQ ID NO: 121858 - protein, 398 aa, Triticum aestivum
  Clone ID: PAT_TA_16276.pep
MATTLATDVRLSIAHQTRFAFRLASAISSNPESTVNNAAFSPVSLHVALSLITAGAGGATRNQLAATLGEGEAEGLHALAEQVVQFVLADASYAGGPRVAFANGVFVDASLQLKPSFQELAVCKYKAEAQSVDFQTKAAEVTAQVNSWVEKVTTGLIKDILPAGSISNTTRLVLGNALYFKGAWTDQFDSRVTKSDYFYLLDGSSIQTPFMYSSEEQYISSSDGLKVLKLPYKQGGDKRQFSMYILLPEAPSGIWSLAEKLSAEPELLERHIPRQKVALRQFKLPKFKISFGIEASDLLKGLGLQLPFGAEADLSEMVDSPMAQNLYISSIFHKAFVEVNETGTEAAATTIAKAVLRQARPPSVLDFIADHPFLFLIREDTSGVVLFIGHVVNPLLSS

SEQ ID NO: 121859 - protein, 398 aa, Triticum aestivum
  Clone ID: PAT_TA_16277.pep
MATTLATDVRLSIAHQTRFALRLASTISSNPKSAASNAAFSPVSLYSALSLLAAGAGSATRDQLVATLGTGKVEGLHALAEQVVQFVLADASSTGGPRVAFANGVFVDASLLLKPSFQEIAVCKYKAETQSVDFQTKAAEVTTQVNSWVEKVTSGRIKDILPPGSIDNTTKLVLANALYFKGAWTEQFDSYGTKNDYFYLLDGSSVQTPFMSSMDDQYLLSSDGLKVLKLPYKQGGDNRQFFMYILLPEAPGGLSSLAEKLSAEPDFLERHIPRQRVALRQFKLPKFKISFETEASDLLKCLGLQLPFSNEADFSEMVDSPMAHGLRVSSVFHQAFVEVNEQGTEAAASTAIKMALLQARPPSVMDFIADHPFLFLLREDISGVVLFMGHVVNPLLSS

SEQ ID NO: 121860 - protein, 443 aa, Triticum aestivum
  unsure (1)..(443): unsure at all Xaa locations
  Clone ID: PAT_TA_16278.pep
LFFFTLCIPLRSNQSPTNPPPRPCQPPSLHRTSRLSIAHHXRFALRPRLHHHSSNPKSAASNAAFSPLSLHXPHLGLLAAAAGXATRDQLVATLGTGGGRGTPALLRRRHVVHGCVLGQHASSRWEGCRGCRPSPTGVLTVGTRADLLPQAPSFQEACMQLASXQWAEKPNPWTYQTKAALKLLLQVNSXWVXKVTSGRIKNILPSGXSVDNTTKLVLANALYFKGAWTDQFDSYGTKNDYFYLLDGSSVQTPFMSSMDDDQYISSSDGLKVLKLPYKQGGDNRQFSMYILLPEAPGGLSSLAEKLSAEPDFLERHIPRQRVAIRQFKLPKFKISFGIEASDLLKCLGLQLPFSDEADFSEMVDSPMPQGLRVSSVFHQAFVEVNEQGTEAAASTAIKMVPQQARPPSVMDFIADHPFLFLLREDISGVVLFMGHVVNPLLSS

SEQ ID NO: 121861 - protein, 130 aa, Triticum aestivum
  Clone ID: PAT_TA_16279.pep
SLNKITEIVRLQQMLKKWRKLSVAPPSAAASGPPPKGHLAVSVGPAMRRFVIPTEYLKHQAFAALLREAEEEFGFQQEGLLRIPCDVPAFEAILRAVDKGRAGGKHKDAAFCYCSAEFAIAVGTPNNSLR

SEQ ID NO: 121862 - protein, 201 aa, Triticum aestivum
  Clone ID: PAT_TA_16280.pep
MADSSAPTRVMMAVNESSLKGYPHPSISCRSAFDWMLSKLVRSNTDGFHLLFLHVQVPDEDGFDDMDSIYASPTDFQSMKQRDRIRGIHLLEYFVNECHRLGIKCEAWTKQGDPKEVICHEVKRVQPDLLVVGSRGLGPFQRVFVGTVSEFCVKQAECPVITIKRKTPIERSTGPHRRVMLSVQPVLNFAYGMGITAWDGL

SEQ ID NO: 121863 - protein, 175 aa, Triticum aestivum
  unsure (1)..(175): unsure at all Xaa locations
  Clone ID: PAT_TA_16281.pep
ASKKNAANDNGTVTEKPKPRLLLINRGESRKFVNLPEVSAAVQAAGFELLVMEPSRDMGLEEFARAVXTPGDVLMGVHGAALTNSSFLRTNAVLLQVVGLGLXSARPCINYGDQAKAVMVQHIQYXSSAPKESTLYEKYGKDHPPVCPPPSAPRRGGQAALRGLGADQALSPPIS

SEQ ID NO: 121864 - protein, 308 aa, Triticum aestivum
  Clone ID: PAT_TA_16282.pep
MAMAAGGPNAGAKVVSLRLQYYCVFAAVGVAVIVLSLTFLSPSAMGAVRQNLGTVVAVATNSSSGDGAARVVGGGEAVAAVAAAKPEPEKEKPKQKKAEPPVVLFNFGHSNSDTGGVAAAGGIHIMPPEGRTYFRRPTGRLSDGRVIIDFICASLKTHELNPYLKAVGSDYSNGVNFAMAGSTVSHGVSPYSLNVQVDQFVYFKRRSLELIELGLKGPVSKEGFENALYMMDIGHNDVAGVMHTPSDQWDKKFRQIVERDRRRDPDPVRQWRRGKFWIHGTGALGWLAGLVVQKGEHRTGCFAGTNGA

SEQ ID NO: 121865 - protein, 136 aa, Triticum aestivum
  Clone ID: PAT_TA_16283.pep
LSQIHTKKRNRLLHNKMRDLVFIKFNSKLKQKRKMKNRDPIVDHTFVDVVEDEDNEWITGIVPHEPDEVVEVAASTSQGAVGASKRKRASQSRSRKKKKLLPVFREDELESASSSSESEDDAMHSPSGSSNESDSE

SEQ ID NO: 121866 - protein, 178 aa, Triticum aestivum
  Clone ID: PAT_TA_16284.pep
MERRRWLQAAVLMCLLLLCSGRELKNKRQAPAYNSTLAKTLAEYTSAVYTNDLSQLFTWTCEKCGDLTEGFEVIELIIDVKNCLEAYVGFASDMNAVVVAFRGTQENSIQNWIEDLFWKQLDFDYPGMTEAKVHSGFYSAYHNTTLRDGVINGIQKTREAYGNIPILVTGHSMGGAMA

SEQ ID NO: 121867 - protein, 476 aa, Triticum aestivum
  unsure (1)..(476): unsure at all Xaa locations
  Clone ID: PAT_TA_16285.pep
ARGRAPPPAVLVPSPGFPVARRTLALQHQIVAVAAMVPDSRSTPGSRLVLAVSVLLGFGVSSACLTSVFNGSSVPGQLSGARASGLWWDARRSTRPSAWASYFRGREHIVSLAPHAGLPLFPARPRPLGLGANRRSPVMKPRRIQKDLRFLSTAPHEAFRWVNGFADQQCYVNLLPHPMASSKKHSSELIPFDAMLDPYVKCRSPPKILVILNPRSGHGRSSKVFHGKVEPIFKRQLAGFKMEVIKTTHAGHAKSLVSTIDFSTCPDGIVCVGGDGIVNEVLNGLLCRDDQIEAGSLPIGIIPAGSDNSLVWTVLGVKDPISAALSPVRGGFTPIDVFSVEWIQSGTTHFGTTVSYFGFVSDVLELSEKYQKRFGPLRYIVAGFLKFLCLPKYSFELEYLPVADVDGAGHKIVEGQEKVDTSDLYDDVVQRSRAECLPRASSLSSIDSIMSTSIMSGGEPXVFSPHANNEPSELVR

SEQ ID NO: 121868 - protein, 87 aa, Triticum aestivum
  unsure (1)..(87): unsure at all Xaa locations
  Clone ID: PAT_TA_16286.pep
ISVASFHSVGAERVVGPAAELLDQGPPAGNHGGIWTPTSPPSWLTSPLXEGQAQDLPPVKEARLRLTSTFDASTSDFIDLCVHAVFP

SEQ ID NO: 121869 - protein, 603 aa, Triticum aestivum
  unsure (1)..(603): unsure at all Xaa locations
  Clone ID: PAT_TA_16287.pep
MQQAQRSKSSAEVDFFTEYGDANRYKIQEVIGKGSYGVVCSALDLQTRQKVAIKKIHNIFEHTSDAARILREIKLLRLLRHPDVVEIKHIMLPPSRKDFKDIYVVFELMESDLHQVIKANDDLTKEHYQFFLYQLLRALKYIHTASVYHRDLKPKNILANSNCKLKICDFGLARVAFNDTPTTVFWTDYVATRWYRAPELCGSFFTKYTPAIDIWSIGCIFAEVLTGKPLFPGKNVVHQLDLMTDLLGTPSMDTISRVRNEKARRYLSSMXRKKDPVPFSQKFPNADPLGVKLLEKLLAFDPKDRPTAEEALTDPYFRGLSKPEREPSCQPIRKMEFDFEHSRVSKDDIRPLTRPEILEYHPQLLKSYIDGTERTTFLYPSAVDHFKKQFSHLEESDGSGPVVPADRKHASLPRSTIVHSTPIPAKDTRPLFGKPCNKTSSETGRYAGNGHSASQASHAAQAVVSRRAAGSALPYDAASRPTISPGCPPQQQIPQMYGQYQHQAPPRAPAGAGIPQAMGGYACGGYTKGTAPNAAAAPAMRAPPYRHLPAGQKNGPLDRLAVETTDIYTRSLNGIVAAAAASAGTASAHRKVGAVPFGMPTTY

SEQ ID NO: 121870 - protein, 39 aa, Triticum aestivum
  Clone ID: PAT_TA_16288.pep
GSPGLQATNGSSSSVIALPCPDAYEILKSRWDSLLEHKT

SEQ ID NO: 121871 - protein, 280 aa, Triticum aestivum
  unsure (1)..(280): unsure at all Xaa locations
  Clone ID: PAT_TA_16289.pep
NGYIRIDCYGGLNQLRRDLCDGIAVARLLNATMVLPKFEVAAYWNESXDVFDVDHFIEQTRGYVEVVKDMPEEISLKEPFKVDCRKQKGHFDYVETVLPALLQHRYISLTPAMSQRKDRYPSHAKACYCQGCYNALKLNKKVEAKAMELLQAIPKPFLSLHLRFEPDMVAYSRCEYSALSSKSLDAIEAARGEDRNVLVGDAAHLWRNRGKCPLTPGETAFILQALGIPTETSIYLAAGDGLMELDGFTSVYKNMYTKSSLLTHEDFXRMHGNTKAALDY

SEQ ID NO: 121872 - protein, 165 aa, Triticum aestivum
  unsure (1)..(165): unsure at all Xaa locations
  Clone ID: PAT_TA_16290.pep
GITGESLGGMHAWFVAWARPRYSVVVPIIGVQGFQWAIDNDKWQARVDSIKPLFEEARIDSGKSEIDAEVVKKVWDKIAPGMASQFDAPYSVPLIAPRPLLLLNGADDPRCPVLGLQEPAPKAAEAYEKAGSADKFKFIAEPGXGHRMTASMVKEASDXWFDRFL

SEQ ID NO: 121873 - protein, 134 aa, Triticum aestivum
  Clone ID: PAT_TA_16291.pep
GFPRSPPGSGSSPNAPPTPPMPRATPPHLVGASVPTAIAGPPAPLPRGIDRAARPPLRTIAGRHRRGPLHHRRSPSPSPMPPRRTASPASPSSPTSSPRPTAISLRPPTSGPTLLPPPSIMSITLEEPTTTCRP

SEQ ID NO: 121874 - protein, 65 aa, Triticum aestivum
  Clone ID: PAT_TA_16292.pep
GPRGPYGWSDTAPVAHSVSQDHRTPMSTFERLRRHEMVRPRLGALVCFTLVLRYRCNLLVIGNNA

SEQ ID NO: 121875 - protein, 148 aa, Triticum aestivum
  Clone ID: PAT_TA_16293.pep
MGIQASRALAALLLAALAAATLRGASAVVQCGQVTQLMAPCMPYLSGAPGMTPYGICCNSLGVLNQLAASTADRVAACNCVKAAASGFPAVDFSRAAALPARCGLAINFAVTPNMDCNQVTDEPCQRTGEPRARTVHRHAPNVLGGPT

SEQ ID NO: 121876 - protein, 194 aa, Triticum aestivum
  unsure (1)..(194): unsure at all Xaa locations
  Clone ID: PAT_TA_16294.pep
QASLSLSSGTTQGXPKFLPFNDELLENTLQIFRTSYAFRNCEYPISEGKALQFVYGSKQALTPGGILATTATTNLYRSQRYKEGMKDIQSQGCSPDEVIFGPDFNQSLYCHLLCGLIYSDEVHSVFSTFAHSLVHAFQTLEEVWEDLCADIRDGVLSEKITVPSIREAVSKILKPNPELADSIHKKCAGLSNWY

SEQ ID NO: 121877 - protein, 153 aa, Triticum aestivum
  Clone ID: PAT_TA_16295.pep
MAAIWALAIIHLLLLLPLLRSSIVFELHGDVYPTGLFYVTMNIGEPAKPYNLDVDTGSPLTWLECDAPLQSTHKGPHEAYRPTPTNVVPCDDERCVAVHRDLGLAHDCTRNPDQCDYVFGYKDGESSLGVLLADQFSLPTNNENRPNLAFGCG

SEQ ID NO: 121878 - protein, 124 aa, Triticum aestivum
  Clone ID: PAT_TA_16296.pep
LLLSPPWKLFTVQLQLRKKAQLASARCRRCGGGRGRRQRPRRSGRAGGCRRSGRCGAAWSGRSPSAVPAAGGPLCGCDQPEHARCRPAHDDDDVRRICTCALVCIKSVAVAENFSWLAARQNVC

SEQ ID NO: 121879 - protein, 172 aa, Triticum aestivum
  Clone ID: PAT_TA_16297.pep
MDAGSSSSPLRIVIVPWLAFGHLLPYLELSERLAARGHRVSYVSTPRNLARLPLPLRPAAAPRVDLVALPLPRVDGLADGAESTNDVPDDDRELHWKAFDGLAAPFAEFLAAACADETTRPHWIIADSFHHWAAAAALEHQVPCAMLLPTAALIARAHCVDTRTLISVTTRV

SEQ ID NO: 121880 - protein, 389 aa, Triticum aestivum
  Clone ID: PAT_TA_16298.pep
GRVGAMKDGGLHDPSVLVFKSSWSSKSKVKESEMFDCPQTSMTQRPSNDEDIAFMSIIELGELFRTKKITSHELTDVFLRRLKRYGAVLESVITYTEELAYKQAKEADDLLEQGKYLGPLHGIPYGLKDIIASAEYNTTWGSKTFKNQVIDMEAFVYKRLKSAGAVLVAKLVTGSLAYDDIWFGGRTRNPWNIEEFSTGSSAGPTASTSAGLVPFAIGSETAGSITYPAARCGVTALRPSFGTVARTGVMSLSQPRDTRAPFCCSAADCAIVLDAVRGADAGDPSSREIALEDPFHVDITKLTVGYLDSAEMEVVKVLSAEGAKLVPFELNYTVESVQSILNITMDVHMLAHCDNWQREGHDDEYEAQDQWAVELRCARLVPAGYYVQA

SEQ ID NO: 121881 - protein, 202 aa, Triticum aestivum
  Clone ID: PAT_TA_16299.pep
RAVHFAACDGAISTRFLHTWAAAGTGAVAPSPPVIDRTLVEDATGLYDVFVKAMPSADEMEHVKVLDDKLLATFTLSKEDIQRVKDVVASEAARRGAAPPRCSSLVATFGFMWSCYQRARDDAGSNGGDRPTYLVFPVDHRARMNPPVPDGYLGHCVGGAVHAAPMDKLAEAGAGGLFVACTALAAAIDEAVRGIRSPETIA

SEQ ID NO: 121882 - protein, 411 aa, Triticum aestivum
  unsure (1)..(411): unsure at all Xaa locations
  Clone ID: PAT_TA_16300.pep
VRGRVGLSISCNLPGLPHPTFTRARXGPVPFFLAPLSNKMGLEAAVEATVEFLNKAVKPVLVAGPKLRVAKAGKAFVDLVDASGYAYAIMPSAKGFVPETHPHFLGTYWGAVSTAFCAEIVESADAYLFAGPIFNDYSSVGYSFLLKKDKAIIVQPXERVIVGNGPASGCVMMKEYLSALAKRVQKNNTGYENYKRIFVPEGHPLKGEANEPLRVNVLFKHIQDMLTGDSAVLAETGDSWFNCQKLKLPEGCGYEFQMQYGSIGWSVGALLGYAQGASDKRVIACIGDGSFQVTAQDVSTMLRCEQNSIIFLINNGGYAIEVEIHDGPYNVIKNWNYTALVEAIHNGEGKCWTAKVKCEEELTAAIETALGEKKDSLCFIEVIAHKDDTSKELLEWGSRVSAANSRPPNPQ

SEQ ID NO: 121883 - protein, 263 aa, Triticum aestivum
  Clone ID: PAT_TA_16301.pep
MFLVLCLVVTCAIACVLSCQCYEDYEIVSACIAKRVHNNTTPDENYKSIFVPEGHPLKGEANEPLRVNVLFKHIQDMLTGDSAVLAETGDSWFNCQKLKLPEGCGYEFQMQYGSIGWSVGALLGYAQGASDKRVIACIGDGSFQVTAQDVSNMLRCEQNSIIFLINNGGYTIEVEIHDGPYNVIKNWNYTALVEAIHNGEGKCWTAKVKCEEELTAAIETALGEKKDSLCFIEVIAHKDDTSKELLEWGSRVSAANSRPPNPQ

SEQ ID NO: 121884 - protein, 210 aa, Triticum aestivum
  unsure (1)..(210): unsure at all Xaa locations
  Clone ID: PAT_TA_16302.pep
TLRDPGHXGVLRMSEDKLIFTPNDPRSLMKLNVDFRSIKGHKFNKVDGSKPTPPLLNLSKDSXQGASDIFEFENVGNRDVGRDFVARVLGKHQGTVPARTNVPPEKSAVSTGPEQLSSAEMERRMKLLREDSELQKLHKKFVLGNILQESEFWATRKNLLDDETNKASKQKPGFKSAMLADVRPSADGQTNKVTFSLTTEIIHQIFAEKP

SEQ ID NO: 121885 - protein, 202 aa, Triticum aestivum
  unsure (1)..(202): unsure at all Xaa locations
  Clone ID: PAT_TA_16303.pep
AGVTGAAGYIASWLVKLLLSRGYTVRGTVRDLGEKKTGHLRSLENASENLKLIKADLLDYDAMAAAIEGXCQGVFHVASPVPKGDVTDPEVEVLGPAATGTRNVLEAASAAKVRRLVVVSSIVAVDINPKDWPTDKIKDESSWSDREFCRSNEDWYSVSKITAEEAALEYGRRTGLDVVTLNPAVVCGPLLQPTVNASSPFL

SEQ ID NO: 121886 - protein, 123 aa, Triticum aestivum
  Clone ID: PAT_TA_16304.pep
SISLMRITRPPSPRVSRPSNGCARLLALLNQREKLRGLRTADIDPEGAMRYLDALAKRVVQGEDKGRGVRTPGEITDYADTDNSPGGTYSRATLIMQLLRDNLGQWIGDEDRVLPEEPLTKLG

SEQ ID NO: 121887 - protein, 261 aa, Triticum aestivum
  unsure (1)..(261): unsure at all Xaa locations
  Clone ID: PAT_TA_16305.pep
IFEKLRNFSIFSYSFYLFFQKEIRIGLVNRKQFYRKIEVKIEVKIAISFLMEHTYQYAWVIPLLPLPVIMSMGFGLILIPTATKNLRRIWAFPSVLLLSIAMVFSVQLSIQQINGSSIYQYLWSWTVNNDFSLEFGYLIDLGRAHAKIQCITVGILVLIYSDGYMSHDEGYLRFFVYISFFNXSMLGLVTSSNLIQTYFLWELVGMCSYLLIGFWXRRPLAASAGQHASAANRAGEWGLQLGISGVLGRPGRCGTRAAATR

SEQ ID NO: 121888 - protein, 154 aa, Triticum aestivum
  unsure (1)..(154): unsure at all Xaa locations
  Clone ID: PAT_TA_16306.pep
XFSDSIXVHHXNXFTHXEQXRLDQQLIRLKRCXRMIXXRXARRGRXRHTQTCSWRDYCSTWHMMVSIEHRQSHEGKQGHKASLSASVGTAVVPGLLLWSDDDPCSLREAQFRREIIVLCEQLSSILVVQIRISGNHQVPKGKDQQEHGGHRLVD

SEQ ID NO: 121889 - protein, 196 aa, Triticum aestivum
  Clone ID: PAT_TA_16307.pep
EALLFLIQSSHHLSPFPMNATNLHPQNPQSCMYMRTNTNSLVGYCIPRSTGSSTRQYCCIAWELDATVVLGQTKGLTSFHLMLWSPMPKKHSSPSSLTWLNWKLSSSSSAGSTPEQWMPPSFSGAVCTDGATKFGASPYIGGGRHGGAGRAAKELPPSLNRSFRMDSSTPSPIRLPSTIEPGIGRDGMAIACWCQL

SEQ ID NO: 121890 - protein, 152 aa, Triticum aestivum
  Clone ID: PAT_TA_16308.pep
YINSSEYIHLFARYFRMDPLPGRNALVPSQPGEKIVTYPVRPVDTSTDFEGTTSLQPTQPPSGNGPPGGQPVPRQIPRQMQQPMGGMQRMPPGANMGAFGAAPQAGMVGMNPGNIPMQRGAGGQSHPHQLRRKADQGMGMQNPGYPQQKRRF

SEQ ID NO: 121891 - protein, 138 aa, Triticum aestivum
  unsure (1)..(138): unsure at all Xaa locations
  Clone ID: PAT_TA_16309.pep
MVAQGRGGAATGLVAGVVLLCVLLPITGAAAMARQAPRTYVVGDDKGWGXDLNSWWPKDKTFYAGDVLVFKYDKELHDVTVLGGKGYQRCEVPRHSSKSWVMRTGNDQVTLRKGATIYFICGLPGHCDKNMKLAIKAW

SEQ ID NO: 121892 - protein, 202 aa, Triticum aestivum
  Clone ID: PAT_TA_16310.pep
RPVPENILKKRKTLEQQRAERAIQAKELRKKSGRQAPNHLQESAESYVREYRKAEKELISARRRAKDNNDFFLEPEPKLAFVIRIRGINGVAPKTRKILQLLRLRQINNGVFIRLNRATTQMLRLVEPYVAYGFPSRKSVRELIYKRGFAKVNSQRIPVTDDAVIENGLHNSEIICIEDVIHEIYTVGPLFRQVNKFLWPFK

SEQ ID NO: 121893 - protein, 174 aa, Triticum aestivum
  Clone ID: PAT_TA_16311.pep
KLLGEDGRGQVPAQVKGTMGYLDPEYYMTQQLTEKSDVYSFGVLLLEMITAKKPLERGRYIVREVLAALDRSKDLYGLHDLLDPVLGASPTSLGGLEQYVDLALRCVEEAGADRPSMGEAVSEIERITRMAGGAPESASESMSYASRTPRHPYGGDSPSEYSGGGLPSSRVEPK

SEQ ID NO: 121894 - protein, 166 aa, Triticum aestivum
  Clone ID: PAT_TA_16312.pep
HESGCSAGANIAHNMAVRAAAPGAVPEGAAVRGLMAVHPYFTGKEPVGAEAAFGPDVRDFMDRTWRFVFPGSLGLDDPNVNPFVTDEARAAVAGIPCERVLVCVAEDDVLLKERGLWYARELKASGYAGEIEMFESKGVGHAFHFDQLGSGEGVKLQERLVKFIKK

SEQ ID NO: 121895 - protein, 118 aa, Triticum aestivum
  unsure (1)..(118): unsure at all Xaa locations
  Clone ID: PAT_TA_16313.pep
WRASESWPENVLFLRYEKLLRDPAGNVRKLARFVGVPFSEAEEEAGVVRXHRRACSLGSLRSVEVNRTGYMDGLKFPRKALFRKGVAGDWANHMTPEMARRMDDIVADKLRATGLTFQ

SEQ ID NO: 121896 - protein, 292 aa, Triticum aestivum
  unsure (1)..(292): unsure at all Xaa locations
  Clone ID: PAT_TA_16314.pep
SWSFNSTLAPPRKDHDKKAAVVGWLIGGAMALLVLWCIISYFKWTRSXVQNFLAPSGGARQLEYRVLAAATDDFSEERVIGQGAFGVVYRGTFFKVPSSGAPSRESDGPSSTESCAASNSSSKESADDIEVAVKKIKNGTKGGDFLAEMNTISEAQHKNLVKLKGWCCRENNRNLLDFMCXCCREKKDAELFLVYELVPNGNLYYQLSESEQVIAWPTRYQIVKDIGSALVYLHHECEPYILHRDIKPGNILLDDKFNAKLADFGLSRIGNQDNMTLMTTAIGTEGYIDPEC

SEQ ID NO: 121897 - protein, 133 aa, Triticum aestivum
  Clone ID: PAT_TA_16315.pep
MQELQRELAAAEAGGDQQQLRQWMQRRALELEKQKLAYEVREYALEKQRHKWEQFKATKEWDMEHERLRIERRRVDGQRMLLVLKQKEFDLDLAEAYNNYSSSVDHHPGAQTPPPAGFQQQPGSSPSTTGHPN

SEQ ID NO: 121898 - protein, 248 aa, Triticum aestivum
  unsure (1)..(248): unsure at all Xaa locations
  Clone ID: PAT_TA_16316.pep
MPLSSRGPRSAAVPCCMMTSRRLGAHGSLAQGASSHRRLVAVEPLSETSHQGKTEFATEIETISRVQHRNLVKLYGCCLEXNKPLLVYEYLENGSLDHALVGQRRAGPPGPPRRALRLGVARPPADRPGQACCRGLLDTTRDMEGQANNPLHCTPISILRSRNFGLAKLYDDQKTHVSTKVAGTLPGGRHAAGGDAAPGDREPVARLHPHHRRGQVRCVCAPRCLVVATARWVVWAKESIFISPCREC

SEQ ID NO: 121899 - protein, 140 aa, Triticum aestivum
  unsure (1)..(140): unsure at all Xaa locations
  Clone ID: PAT_TA_16317.pep
MAEEQFLAAAVGAAKSAGEIIRKSFYLSKKVEHKGQVDLVTETDKACEDLIFNHLRMLYPDHKFIGEETSAALVSTVXLTXNHXXDXXPPXMXNNXVKGSFWXAXIWLQIGNPHXGXVPTRRFKFGKGFSKPINKLGKGK

SEQ ID NO: 121900 - protein, 228 aa, Triticum aestivum
  unsure (1)..(228): unsure at all Xaa locations
  Clone ID: PAT_TA_16318.pep
LHDGVRPHVVHRDIKASNILLDQDLTPKISDFGLAKLLPSDVSHISTRVAGTLGYLAPEYAIRGQVTRKSDVYSFGVLLIEIVSGRCNTDTKLPYEDQILLEKTWAYYDQGQLDEIIDSSLGEXDWTLDEACKVXLRXGLPCTKERXXRRPDMSTVTXRMLKGEEDVELHEITKPDVIRDFRDLKLRSKATSSSLLTSIVARSSPSSSSSTGNTTRTSITFTAISDRP

SEQ ID NO: 121901 - protein, 254 aa, Triticum aestivum
  unsure (1)..(254): unsure at all Xaa locations
  Clone ID: PAT_TA_16319.pep
MINTLDGVRDETGASACPWAVWTRAWTAEENRHGDVLNKYMYLSGRVDMRMVEKTVQYLIGSGMDPRTENNPPRRLVYTSFQERATAVSHGNTARLARXHGDXVLARTCGTIAADEKRHETAYSRIVEQLLRLDSDGAMLAIADIMRKRITMPAHLMHDGSDMSLFEHFASVAQRLGVYTAPGYTDFVEFLVKRWKLEALEGGLSGEARRARGFVCGLAPXRMRRAAERAADRAKKXEPRKVRFSWIFDREVVV

SEQ ID NO: 121902 - protein, 186 aa, Triticum aestivum
  Clone ID: PAT_TA_16320.pep
TDTARCEAARQQAAASEQLNVFTNDDVSFTGYPVVGYQHRIQAFGTCFNSPEDGLLTSCAWDPRIRGFFNYNSGFSIPLSNAPAFIADMQRLRDLNPDSFCSSVDPNIGVLLRYVKASSAYLGKPEDSIGVDIIFYRSHTEGMPRAHADLVDEIEQMALHKYGGIPHWGKTPVPAGHPKQNQFGKH

SEQ ID NO: 121903 - protein, 200 aa, Triticum aestivum
  Clone ID: PAT_TA_16321.pep
PSRPTSSSYGPSSVGRHRWAPCGSHAPARCLAAPARAPSGLDDIANMCLILHLIGAYQVYAQPIFATAERWIVSRWPDTWGFARAGTVSIPLMQRGSVTVAPYKLVLRTVIVIATTVVAMMIPFFNAVLGLLGAFSFWPLTVYFPISMHIAQGKITKGTKWYLLQGLSMVCLMISVAVGIGSVSDIVDSLKVSTPFKTVS

SEQ ID NO: 121904 - protein, 215 aa, Triticum aestivum
  Clone ID: PAT_TA_16322.pep
MAQRQDIIISHFSHPGHELVKRHHTGPFRCDMCWEDLSGTAYICRAGCDFCIHESCAGHSQTFSSPEHHVHPLTLVQTRRDATLSCDVCFGLCAPGSFLYRCPPCGFDMHPTCALLPQVVRSVRDPTHDLTPVVPDGRCAACDAGRGARVVTTAARHATVDYHISCAASTGDNNSAHELKMPLTLRCTIKVQEQTRKPSWDCGSAYMYQRSNVML

SEQ ID NO: 121905 - protein, 180 aa, Triticum aestivum
  unsure (1)..(180): unsure at all Xaa locations
  Clone ID: PAT_TA_16323.pep
LDACFSNLMVSSGGGRGQAETGGAVPMLSGWKDLPMELLMRIISVAXGDDRIVVVASGVCTGWRDXLGWGVTNLSLSWCQQNMNNLTISFAHKFTKLQVLTLRQIKPQLEDSAVEAVANYCYDLRELDLSRSFRLSDRSXLYALANGCPRLTRLNISGXCPSCSDSALIYLSCHWKNLKS

SEQ ID NO: 121906 - protein, 268 aa, Triticum aestivum
  unsure (1)..(268): unsure at all Xaa locations
  Clone ID: PAT_TA_16324.pep
AVQRQGAEAVAGLWDRYLVHIVADPXKLRPERLAELIGVVPAGXRKTHDHLYEAINTYLVEHPSLSGEEKAALCGHLECPRRSHEACIQAVQNERMPLRFIVQALFVQQMHTHRAFXERSDSFRYMLSGELIPGVXGAYTPSPGCPVPTSQPLSTTSPYTDAHTNAALDGKLRARGDDDAASDYETASFRIQALEQEIISLKKTLQRHNTLKGGSVRKDSKEPSFRADVAAPVAIRRRAPVSGSCIGSMRWGSQRRVRRRILRVFTRL

SEQ ID NO: 121907 - protein, 119 aa, Triticum aestivum
  unsure (1)..(119): unsure at all Xaa locations
  Clone ID: PAT_TA_16325.pep
CRNSARGFSSSLCVLVRSLGWRRVDEEQQPVLXCSSTHCPTVAPSPVTDIDTSGIHXLLEELLKALEKRKIQLILANPGPAVIQKLRSAKFTDLIGDDEIFLSVGDAVKKFAPKSALNV

SEQ ID NO: 121908 - protein, 205 aa, Triticum aestivum
  Clone ID: PAT_TA_16326.pep
DASRSTHNQLSNTMMILETAHPGAATWAAHTRRKYGGSQASTAVPRMQAEGVLVALGTTGRTQGSLAACLYGATEFGGMLPWWCIGSGPPGTSLFAPSPPAAWLDGASTTSSPIVNDATGLGRWPSTNPCCSALRPPSPPLPTTTSPLCIILAASIFLATPRVQTKNSSTAILKEAMDKLKTLLDKLCREPATLLLPIAEIFVLS

SEQ ID NO: 121909 - protein, 105 aa, Triticum aestivum
  Clone ID: PAT_TA_16327.pep
AHRREKTREDGSRVPWRRWMFFSLVLTAGVDAKHLGLETKRGLAVKELGVGVVDELVGVSLVDHNVVVLGEKTHAIVSREEHTSSDGNEERVNLQGRANREPLVV

SEQ ID NO: 121910 - protein, 120 aa, Triticum aestivum
  Clone ID: PAT_TA_16328.pep
MQRAVRRLSPAPRSCAWPRCYLAATPAAEAGATTYLVGDAAGWTRNVHFGGWLAGKTFRAGDVLVFKYNSTFHDVPWVSKGGYKKCTVSPKGFAPVYRNGYDAVTLPRGTHYFICGVPGH

SEQ ID NO: 121911 - protein, 124 aa, Triticum aestivum
  Clone ID: PAT_TA_16329.pep
VRERNKKTATEAPSCSRTTAVVEATAVAVTALAGRTLTRRETPPLQWRRSTRRCILPSPYSPPRPATECASAALHSSARRPPPHRLRLRSPRPPLPPTEVVGAGPGFLTHFPLGVPFRSPIENF

SEQ ID NO: 121912 - protein, 142 aa, Triticum aestivum
  unsure (1)..(142): unsure at all Xaa locations
  Clone ID: PAT_TA_16330.pep
MEAESRKLLLLAPILLCCFMARSEAQSQHIGVNYGEVADNLPPPDATARLLKSTAITKLRLYGVDAGVIRALAGTGXSLVLGVAXGDIPAIAADPNAAAGWLAAKVLPFLPGPGISVFVPGGDVLESGDAALAAALLPAMQN

SEQ ID NO: 121913 - protein, 238 aa, Triticum aestivum
  unsure (1)..(238): unsure at all Xaa locations
  Clone ID: PAT_TA_16331.pep
VLLFGPPAPXKITMIAAISNYLEYDIYDLELTAVNNNIELRKLFIETKGKSIIVIEDLXCSVDFTGKRGDKKFGGESDNMKKERKQDADXTKLTLSGMLNFIDGLWSACGGERIIIFTTNHKDKLDPALIRPGRMDKHIEMSYCRFEAFKVLANNYLDITITAHHFFELFTEIGKLLHEVDMSPAEVAGYLMRAEEEYAGARLKGLVEALKTRKGNAPMDKATAKEEIVHTDVGGSRS

SEQ ID NO: 121914 - protein, 286 aa, Triticum aestivum
  Clone ID: PAT_TA_16332.pep
ARGGDARELFAAEVSAVAARLGSTVRRTIEEFGSAIQGESSRRPVQGGEIHPMNRYVINYCGLLADCRSTLDMILVNTADAVDGDEATGGGGGATSTPSGRCMLELLTRLLRKMDEKSCLYDDAGLKHIFLMNNLYYIVQKVMDSPLRELLGDDWIRRHRGQIRQYETGFLPGVVDLPAFPVLGDDGGSAAPTVKDKARSFNAAFEELYRSQTAWKVIDPQLREELRIAVSERLIPAYRSFLSRPRPQTGSSSGSRHSASKHVKYTLEDLEDYMLDFFEGVQKFVK

SEQ ID NO: 121915 - protein, 139 aa, Triticum aestivum
  Clone ID: PAT_TA_16333.pep
PLIPLTLAKSLSSGTVMPSKFGCPSCCSPSCGFIFVPASSSVSAGDDGFLVLPGGLGESLAMAAWMAPKNSMSSSLLCFLTAILEVEDPLGFGSARQGRGARQRTPPWSAMEKQHLFGEQMIRRRPLFAEECERFGDAA

SEQ ID NO: 121916 - protein, 158 aa, Triticum aestivum
  unsure (1)..(158): unsure at all Xaa locations
  Clone ID: PAT_TA_16334.pep
MAWTAVADANAGGFGVGAAGVGQVLDGSNPAIVRLRQLVDGPQSSEGWRRCWEQGVTPWDLGEPTPAVVKLVQSGTLPAGNVLVPGCGGGFHAVXALSGGGRSVVGLDVCAAVSHRPTLPSPVVPFRSAAFCSRSPPPPVPLGCPFAYLYRPYTLSDY

SEQ ID NO: 121917 - protein, 202 aa, Triticum aestivum
  unsure (1)..(202): unsure at all Xaa locations
  Clone ID: PAT_TA_16335.pep
PNVGVLGTFKSSSYVGNLELCGLPIQKGCRGTLGFPAVXLPHSDPLSSSGVSXSPTIIKPPHFLNGVVIGSMSTMAVALVAVLGFLWVCLLSRKKTGVNYEKMDKQTLPDXAKLVTYQWNLPYSSGEIIRRLELLDEEDVVGCGGFGTVYKMVMDDGTAFAVQRIDLNRERRDKTFEKELEILGSIRHINLVNLRGYCRLST

SEQ ID NO: 121918 - protein, 118 aa, Triticum aestivum
  unsure (1)..(118): unsure at all Xaa locations
  Clone ID: PAT_TA_16336.pep
FKRCCEXTLSVMXGXKEAXLTIIEVFIHDPFYKWALSPLKALQRQKETEYNDSCLDVFQEACEVNKDAARAILRVKQKLDGFEDGEMRSVEGQVQQLIQDAVDTDRLCQMFPGWAPWL

SEQ ID NO: 121919 - protein, 213 aa, Triticum aestivum
  Clone ID: PAT_TA_16337.pep
RDRWRLQNGNFIMLMCKDRPLLRLHSHRQFPTPNSLIWIFLFRRTHSLLSLAILKRTLMITPSLTLHIPDASGLYYFGIYGYQGGEYTFTYTVSSPCKCTPNNGECVEGTTVCQCFSGFAGDTCNVSYVKVESAQQNAKINALGWYYYAIEVNVQSRAVLFELMLGGTEQETHKADLYVAANRPPTRYDFDYATPDKSNETLLKIQITMPVTP

SEQ ID NO: 121920 - protein, 98 aa, Triticum aestivum
  Clone ID: PAT_TA_16338.pep
TYAFLNMCELESFHESYSSGILPYKISTLQLHRTREVNERICIGEVGVDLELCVHAHGHDVHLLIEASFKINYSLGYKFMLYLGSGLLQSVVPDHVLL

SEQ ID NO: 121921 - protein, 350 aa, Triticum aestivum
  unsure (1)..(350): unsure at all Xaa locations
  Clone ID: PAT_TA_16339.pep
ITGSVAVTLVSASCCSVTPEIPDPSVPGSMISAAISSPLLCSPLPSESKTMEPDSACVAGLSEPLSAGAFFSSSCCSSGATTSVAAPFSLSPSLTLSTTSTAGGAESSAASAWSILSSVAASXPSSSPAAAVPWSPGPASELWLPSPSTSPTPSASDSTGAGLACPLEDGRPTAPSGAANSPPAVGXSPPASAAGAALARGRSSSSGRESGSAPAPVSEPGSEWPSESPLTITKGPPTPSRSSPVGETALAAANSAFGASPAPPRAVPSAVIAAQPRITPRSTQAADPGSTSPPPSTPRRSERGGGTDGTSEIDPGACAIGRRDGSVSLSRGVGLRSVCFCCALRVGFWR

SEQ ID NO: 121922 - protein, 127 aa, Triticum aestivum
  Clone ID: PAT_TA_16340.pep
MEQTAAYTLLLPDDALREILLRVSTDVGALFRCGITCKRWGRLIADRSFLRRCWPENAAGSSFLLGFFQKELPKDQPRYFSPILPGSVFGSHRRSLTTFVSGVPAGVLNKAIPDRRATWPPPHASHG

SEQ ID NO: 121923 - protein, 48 aa, Triticum aestivum
  Clone ID: PAT_TA_16341.pep
ILFVTYESTVDTCLLGITLATYHTRMVVVLRQQSNSDPSNSQVFYSST

SEQ ID NO: 121924 - protein, 146 aa, Triticum aestivum
  Clone ID: PAT_TA_16342.pep
MAYKKIRLRIEDVQARSALTTFHGLDFTTDKLKSLVRRWQTLIESFVEVNTTDGYRLRLFAIAFTKKRPNSQRKTAYAQSSQIRQIRKKMFEIMTREAASSDLKDLVVKLIPEVIGKQIEKECQGIYPLQNVFIRKVKVIKTPEND

SEQ ID NO: 121925 - protein, 98 aa, Triticum aestivum
  unsure (1)..(98): unsure at all Xaa locations
  Clone ID: PAT_TA_16343.pep
MLLRRTAAAAAQRSSWLPPWRTILPHVGPARPYSATTCTCSPHRQRLRTPQVTDSSLTTTAAPRPFPDYSPPRPDSPADDALASRXAXALLCFASPGS

SEQ ID NO: 121926 - protein, 131 aa, Triticum aestivum
  Clone ID: PAT_TA_16344.pep
RRRRPRRPQHQHAAGAVRRPLPPKAASAATTSEPQPQPQRRPAQRSERQRQPAGGQRGAYICPGDKRDAIPGHGPVMIEQDDDDDASATNQESPGGTDLDLSCAHTDLHLHMHAHLIDRLIPPACLPAGAS

SEQ ID NO: 121927 - protein, 76 aa, Triticum aestivum
  Clone ID: PAT_TA_16345.pep
GIPPDERLAGTVAGVSSSGGDLQAKGYGGALDLIQLNGLVPSGERRKERREKERNEERELQRQMGEHHRPSHLPPP

SEQ ID NO: 121928 - protein, 543 aa, Triticum aestivum
  unsure (1)..(543): unsure at all Xaa locations
  Clone ID: PAT_TA_16346.pep
DLASIDGDDDEACFFDMGVYEEGETGNRLALWEDFELRGFSPLVPAHIILDFSSKHTFGSDGXPRVRLKKARAQRILSAGKALLNFVQIDQLRIYFDPSSRKFVVAKEPPVFGAAISTHRSRNAPETNAVELEHEIGNFFDAVATNLGAMQSGVQLCSEGEDDEEIVFKPTASEKLPKVLTELPVNGYIQPLQMSTAGWPTMGGPVTIQSTASASGPGNCNVNESLPMSSGGWAFNGRQEAISSNVSMSTTYEFVQPVEMATSSWASNGAPLVGPLNTMPTFSAAISDPRVSAAMVPHFGSPDYSKLLLEQEKLLMMGLNNVHLAGNGFPEXEVSGWTEWIQSMVYSPHVSVESVRNNTSLMHNQVKATEETIPSTSDSIVPSVAASGGMTINLTDAPVAVSKKNPVSRPSRPVGPPPGFNHITPKRHDDIMPFEKLQHQQIDDYSWLDGYQPSMERVHNSKAIYPDVATTSSAFTTPFPFPGKQQVSGVHTLGASEKTWHDFHLFDPAKQNMVQNHQQINQHSGQVAEKQPAKPIGSGRYLV

SEQ ID NO: 121929 - protein, 273 aa, Triticum aestivum
  unsure (1)..(273): unsure at all Xaa locations
  Clone ID: PAT_TA_16347.pep
MAVSELEVDGVVFPPLARPPGSEHAHFLAGAGVRGMEIGGNFIKFTAIGVYLQADAAVSALAAKWAGKPAADLASDAAFFRDVVTGXFENFTTVTMILPLTGAHXSGKVTENCVAYSKATGVYADAEPAAVDKFKEAFGPHSFAPGASILFTHSPAGLLTVAFSKDSSVPESGGVAIDDARLCEAVLESIIGEHGVSPAAKLNLGXXVAELLEGGRPPPGXNXAPKPFRFGVKKPGGITALSRCCFFCWCFCTPVPSISSTFVFLPWNINMRG

SEQ ID NO: 121930 - protein, 234 aa, Triticum aestivum
  Clone ID: PAT_TA_16348.pep
MGLLVQAPNLAGARRPTARVLRSDRGGRFKVTAAASGGSVKEEEEEKGTGKKEKIVIRVLDPVRERRLPPPLFSAPETPAESPAAIRRPEEDGEERRRYYVNMGYAIRTLREELPDVFCEEPSLDIYREDIVFKDPLSKFVGIDSYKRIFWALRFTGQIFFKALWIDIATIWQPVDNVIMVRWIVHGIPRFLQDGPSRFDGMSEYKLDKNGKIYQHKVGNVAMFPKEVKLPVQP

SEQ ID NO: 121931 - protein, 330 aa, Triticum aestivum
  unsure (1)..(330): unsure at all Xaa locations
  Clone ID: PAT_TA_16349.pep
RALDTLCGQAVGAGQLDLLGVYVQQSWIVCGAAAVALTPAYAFATPILGSLLRQPAAVATAAGPYARWAIPRLLAHAANFPLQKFFQTQSRVWALTAITGAALAAHVALTYVAVNRLRYGLRGAVVAGNVSYWLIDAAPGAYLVSGRFPDAWKGFSGVAFRNLAAFVKISLVSAAVICLEFWYYAALLILVGLLKNGQLQXLEISCHVCINYEFWTMMVALGFSEAVSVRVSNELGGSRPKDAKFAVAVAAXTSALIGATFMAVFFIWRRSLPRLFSDDEEVVDGAARLGYLLAVTVFFGSIGPVLSGVAVGAGWQLQVAFVNIGCYYLV

SEQ ID NO: 121932 - protein, 73 aa, Triticum aestivum
  Clone ID: PAT_TA_16350.pep
RSTQRPASWVAQGKYYTHANNTCAAGQQCGTYTQVVWRRTAEVGCAQASCASGATLTLCLYNPHGNVKGESPY

SEQ ID NO: 121933 - protein, 183 aa, Triticum aestivum
  Clone ID: PAT_TA_16351.pep
MAPQRRHHAACLLVLLALCAAPAHGGLALPARVSKALAAAANATATADEFLAPHNKARAAVGVAALRWSADLTAAAAWTSSQQQKQKNCAFADMGASPYGANQGWASYRARPAEVVASWVAQGKYYTHANNTCAAGQQCGTYTQVVWRRTAEVGCAQASCASGATLTLCLYNPHGNVKGESPY

SEQ ID NO: 121934 - protein, 401 aa, Triticum aestivum
  unsure (1)..(401): unsure at all Xaa locations
  Clone ID: PAT_TA_16352.pep
PRHLRADRGAGQRVKLDIGVSTDVIGYDXNVVDLIPRGREQLRNHRFMFSLGERSNILKEIDQPGLVPCISEANSLKYPYEVIFRSLQKLLMDTASSEYIFIKAFFRDESMFYRVFEGPVAVVRPRVRLTLANSHDAICLMLMICITKKHQLALIYLWPRFKTVFDMYIQSLYQCDAKMLWVDGTHPHHIVRCYMEFTASLIQLNAECGDGQLDMSLKRLRLAVDDLLVRFAEKFATQKLKHLLRFMECAAALSSRREAGEEAKELRRYFEEKLESNLVSFVDELLMEYFGDLIKFVKNHISEDLISYTECPNIADVEPVVKNFAVKWRTALELMHNEVVTCCSNFVSGMAILKAAMAQLLNDYNRLSECVKMIPGGSSLNRNLVSITSISYEIRKYSRTL

SEQ ID NO: 121935 - protein, 168 aa, Triticum aestivum
  unsure (1)..(168): unsure at all Xaa locations
  Clone ID: PAT_TA_16353.pep
MVDPNMCENVHPLNGEKKTCIGSVESMVEFVSSMLGSTRDLQAFSSFPGCPMKVXEQGRRYKVVASXRPTESSETATCHGMNFPYAVFMCHAMNPTRVYAVTXESEHDGCEAQKMEVLVVCHLDTSGFDPSKMPKGIRPGQAPACHFVGRDTVLWAPAAAAATTTTAA

SEQ ID NO: 121936 - protein, 144 aa, Triticum aestivum
  Clone ID: PAT_TA_16354.pep
RPRTRGRTRGGGGSARFMGPRHAPPRPSHGPPPAKRRLSAPVVLACSCRAPRGTSTSTRLRANLRPKVTPGASCFLALRSALLLLRFGFCMDLVLGFGPLGCMVGNTKSSLHSCEPTAHASSSVIDFPKKNQLLMFSLAWSTTF

SEQ ID NO: 121937 - protein, 164 aa, Triticum aestivum
  unsure (1)..(164): unsure at all Xaa locations
  Clone ID: PAT_TA_16355.pep
MAASELHFLLVPLVAQGHMIPMVDLARLLAARGPRVTVVTTPVNGARNRVTVDSARRAGLAVELAELPFPGPQLGLPEGLENLDXLLDDVSSAMYLAFFQAIWKMAGAXLQGNVRALPRRPDCLVAEXCNPWTAGICTALGIPRLVLHCPSAYFLLASAQPVHA

SEQ ID NO: 121938 - protein, 88 aa, Triticum aestivum
  unsure (1)..(88): unsure at all Xaa locations
  Clone ID: PAT_TA_16356.pep
GGGGARPAFHLEPKAVELRVSMHCYGCARKVQKHISXKMEGVSSFEVDLENKKVVVTGDVTPYEVLQSVSQGDEVCGAVGGPQVPGSE

SEQ ID NO: 121939 - protein, 182 aa, Triticum aestivum
  Clone ID: PAT_TA_16357.pep
LNSSSAAAALNFPTLAAVPLMKKVMAEFLGTFILMFIQVSSIIMDEQHHGVVGLMGIAVSVGLAVMVLVFSIIHISGCHLNPAVSIAMGVFGHLPPAHLVPYIAAQVLGSTAASFAGNAIYHPVNPGITTIPSVGTVEAFAVEFIITFILLFVIIAVATDPHAVKKLIAVAVGATVVMNILM

SEQ ID NO: 121940 - protein, 136 aa, Triticum aestivum
  Clone ID: PAT_TA_16358.pep
SAHASEEIVPFRARQLRNLLCDLGPSFIKAGQVLANRPDIIREDYMSELCILQDDVPPFANQVAFSIIEEELGQPLEQLFSKISSETIAAASLGQVYRATLRETGEDVAIKVQRPGIEPIIFRDLFLFRTLAFFLN

SEQ ID NO: 121941 - protein, 117 aa, Triticum aestivum
  unsure (1)..(117): unsure at all Xaa locations
  Clone ID: PAT_TA_16359.pep
ITPMXQVARAILENPNDKTKVHLVYANVTPEDIXLKEELDSLAEEYPDRFKIFYVLNQPPEVWNGGVGFVSQDMIKTHCPAPAEDIQILRCGPPPMNKAMAAHLEELGYTKEMQFQF

SEQ ID NO: 121942 - protein, 279 aa, Triticum aestivum
  Clone ID: PAT_TA_16360.pep
MDFLQGRSVETMVAVAVAVVAVAVGGALLLRRSKRPKGCLDPENFKKFKLVEKTQISHNVAKFRFALPTPTSVLGLPIGQHISCRGQDATGEEVIKPYTPTTLDSDLGNFQLVIKMYPQGRMSHHFREMKVGDYMSVKGPKGRFKYQVGQVRAFGMLAGGSGITPMFQVARAILENPNDKTKVHLVYANVTPEDILLKEELDSLAEEYPDRFKIFYVLNQPPEVWNGGVGFVSQDMIKTHCPAPAEDIQILRCGPPPMNKAMAAHLEELGYTKEMQFQF

SEQ ID NO: 121943 - protein, 210 aa, Triticum aestivum
  unsure (1)..(210): unsure at all Xaa locations
  Clone ID: PAT_TA_16361.pep
SSATQRFHFEPKPASEKPFHIEIPAARSGKEPEVITFSXFDNSVCTSSAATXLXFTNLSSQLITIVSGTSACAPASRKAAHKADDDGXCHCPKKKKPREKRVVRMPAVSDKVADIPSDSYSWRKYGQKPIKGSPHPRGYYRCSSIKDCPARKHVERCRGDAGMLIXVPTRNDHDHAQPLHLAKLNGNSESLTKTPVTKEPEFYAWDMQST

SEQ ID NO: 121944 - protein, 98 aa, Triticum aestivum
  Clone ID: PAT_TA_16362.pep
MASLSMSAAGRAGWTPKQNKLFEQALAVHDRDTPDRWHNVAHAVGGGKSADDVRRYYELLVRDVANIEAGKVPFPAYRPPCPGPNVGYEADRLKHLKI

SEQ ID NO: 121945 - protein, 37 aa, Triticum aestivum
  Clone ID: PAT_TA_16363.pep
SGTPLEALGDITSLYYDEEREEIITGNHQGLIHVWSN

SEQ ID NO: 121946 - protein, 154 aa, Triticum aestivum
  unsure (1)..(154): unsure at all Xaa locations
  Clone ID: PAT_TA_16364.pep
DTEVSSNEFVTPSAFIFLYEMQLFLTFRNRSVSVWNFXRGELVTSFEDHFLWHPDCNTNSIYITSNQDLIISYCKAEPDDPSSEDNACSINISDILTGKCMAKIKAGNLCKQKSSKFLCTPLEALGDITSLYYDEEREEIITGNHQGLIHVWSN

SEQ ID NO: 121947 - protein, 396 aa, Triticum aestivum
  Clone ID: PAT_TA_16365.pep
STPGEANSDARCTARRCPCSPIPSRQVRCTSRPRGALAVTSPAAAMTSPASTSSWFSGIVRTASGNPPSSAMPPAGGVTSAPVSLPDTPAAVSGKGGVVAPVATTGVGARRKQLQGTLFKYGPKSAQVAFRTGDFTRQVIFIGGLADGLLATDYLEPLSLALEVEKWSLVQPLLSSSYTGYGISTLEQDALELDQLIGYLINKDNSEGVILLGHSTGCQDIIHYMRTNFACSKAVSGVILQAPVSDREYRATLPETGEMIDLAAKMISAGRGMDLMPREANSDAPITAYRFHSLCAYMGDDDMFSSDLSEDQLKQRLGHMSTTQCLVVFSMADEYVPEYVDKKALVDRLSRALGDSEKVEIKWGNHALSNRVQEAVEVIVDFVKREGPKGWDDPWS

SEQ ID NO: 121948 - protein, 220 aa, Triticum aestivum
  Clone ID: PAT_TA_16366.pep
AYVMGDAFRPKKMWHVYYATEESEQPMVTLEMCMTALHAGKAAVFFKKSADGGCSSAKEMTKVSGISAIIPEMEICDFDFDPCGYSMNGVCGPAASTIHVTPEEGFSYASYEAMNFNPGSLVYSDLIKRVLSCFRPSDFSLAVTIFGGQGFAKSWAGGAEGSSYVLEDVVEQELPGGGLLMYQSFSAVAPGAVSLRATVDEGWCRVGSGPGVRQGVVCPR

SEQ ID NO: 121949 - protein, 145 aa, Triticum aestivum
  unsure (1)..(145): unsure at all Xaa locations
  Clone ID: PAT_TA_16367.pep
SDSLSLSSRFPQAPTQPPPPWIPAAATSRASSKPYPPWIRTKPPPTRPAXPGPSXRPPRRPLPKPSPSRPRPETSRRPPSNPPGPRAPAARAPAARPSGPPPRPSRSSPPSPPWTTTAGPAPSPPSRSGPSSPRTSPSPMPVGRP

SEQ ID NO: 121950 - protein, 254 aa, Triticum aestivum
  Clone ID: PAT_TA_16368.pep
LFLVEPCKILTASSTPICSSAWPARVGERPPAPLPILASGGAGRPPPAAAAAPPSVLMYSPPCSAAGSNGGRSFAAGANPLALLDHAMDFDEHVLFPMHNAGMQDGVQFYNPTAGGTSADAWVSMEKGLKGGKRKGSGEGSSTMHSQEETGAMSQREVSMERAGEKEGDAASNREDYVHIRAKRGQATNNHSLAERFRREKINERMKHLQDLVPGCNKITGKAMMLDEIINYVQSLQRQVEFLSMKLSAGSPEL

SEQ ID NO: 121951 - protein, 133 aa, Triticum aestivum
  Clone ID: PAT_TA_16369.pep
VRSPPWRRRPCLLTSRGPPSPSRLFSPSPVAEAAALLFLPSCSAREGKKLTRGHPPPIRRARHQEAASGQIRLHPTPSSSSTSLPHHRSPPSAPCETSRPDPRVVALQDLLPRLRRRHRPALPGQVLAPRQGP

SEQ ID NO: 121952 - protein, 63 aa, Triticum aestivum
  Clone ID: PAT_TA_16370.pep
SETMLFHLNTTQTLFCHFHPLKANFLFSVLSFTLFKNESHSITLYIKVRVYKTPHSSSCAHKS

SEQ ID NO: 121953 - protein, 149 aa, Triticum aestivum
  Clone ID: PAT_TA_16371.pep
MAPGDAGVEQPRKAHRVAKSGAKARKKGKGAPGDDEGGERKNPKAFAFRSATKAKRLQSRSAEIEQRRLHVPIMDRSIGEPPPFVVVVQGPPQVGKSLLIKCLVKHYTKQNLSDVRGPITVVSGKSRRVQFLECPSDINGMIDAAKIAD

SEQ ID NO: 121954 - protein, 136 aa, Triticum aestivum
  Clone ID: PAT_TA_16372.pep
YQLSIATVAVAHLSPCRQEQDGMACASAAIRTINRKIAPHYPVTTVGELFTPEALAVTRILFTALEKDVPDVVVFNTGYPASPPAQSKKLMLARLCARGVKCHIVQETALIVEPNIPGGQAPTDARNAMKLVIFSP

SEQ ID NO: 121955 - protein, 89 aa, Triticum aestivum
  Clone ID: PAT_TA_16373.pep
SLFFFCKNSDGRNIAFSFLILQHQRLSQSDKSDEENGGDEKEHVRDDLPDPHLGLVRVRVVVPLPAKLVEVPLVARVARHWHAVDSGTC

SEQ ID NO: 121956 - protein, 124 aa, Triticum aestivum
  unsure (1)..(124): unsure at all Xaa locations
  Clone ID: PAT_TA_16374.pep
FXSXSXPXLXWIXXCAGPRGXXLAIXFAKVEXPPPKPTRSSQGRPKIFHCSXFRAADFLKVDGVPMPRDTGYEGYFDQFGGQRNYYANPDEPEVGIREIIPYMLFLVSPIFFVAFIALRKSLML

SEQ ID NO: 121957 - protein, 67 aa, Triticum aestivum
  Clone ID: PAT_TA_16375.pep
VRDGLRKEKDARVMEFNAVINRLLSKVPESRRRRKLYIRTLAVVPLTEDCGLNMMDGLGIAGRVSCF

SEQ ID NO: 121958 - protein, 123 aa, Triticum aestivum
  Clone ID: PAT_TA_16376.pep
PEHSFIDDAWIVLHGHVYDITPWIPQHPGGNIILSRAGKDATDMFERIGHSDYAQHRLKEFYIGEVEGEKRHDNIGEGLPWYYQTRLGQDAHRDKSPRPFDFRQPGEVEEVANFLHGPPLGNT

SEQ ID NO: 121959 - protein, 60 aa, Triticum aestivum
  Clone ID: PAT_TA_16377.pep
VSRAAAEEMRRRTTTPLPFHRNSLFGYFRSNPAIHSISRKLSSYSSSNSNRGRSATAAAN

SEQ ID NO: 121960 - protein, 137 aa, Triticum aestivum
  Clone ID: PAT_TA_16378.pep
SADAWGKGGRVSLYQDAHVPDDFRPNIEIEGGRTYEQNKCWEDICHAIVEAHHLIYLIGWSLYHPINLLRESTKPLPNGVPRTIGEILKSKVQEGVRVIVLLWDDKTSHDKFLLKTDGLMHTHDEEARKFSRHSRCP

SEQ ID NO: 121961 - protein, 336 aa, Triticum aestivum
  unsure (1)..(336): unsure at all Xaa locations
  Clone ID: PAT_TA_16379.pep
AVAPAEVLVHTFLSVLPHVSGPVCFAVDDAMFRIDPYIARIFKERNNLPGSETQQSQLMRFKLRVLTLLELYLQRNPGKKLVLEVYAFLMQAFVKSHSADGNEQFRQRIGGILQKRIFKAKECPKGFDVELSXDLKVLLQKALHLASRSRYKPVASAAQNATFRIPTSINSKGCSKQELASVVDKFQYMLNDYFSNKKSRLKIGFVKEAVRRNPWVGRELFGFALQKIGSTKAEYRRVQTLELVDCILKSWVGDDVSSASKVLKKHMALLCELMQEILTKMPENKSRRQEVRRFCTRALQTVTRLNLKEKFQKKLSSEAYTLCEAQLGAAFVPFRQ

SEQ ID NO: 121962 - protein, 139 aa, Triticum aestivum
  unsure (1)..(139): unsure at all Xaa locations
  Clone ID: PAT_TA_16380.pep
SEVVLGEVAAAIKIVLKSSQPNLVVKLDMQRIEAQGYEGINADSVQLSIINYPKLKLKSQHVRVIDEAKLRIYPDGTDRSKLQFELHNLKSMLPKVIVKGIPTVERAVVNPVKGRDKTIERYNLLVEGTXNLLAVLGAP

SEQ ID NO: 121963 - protein, 161 aa, Triticum aestivum
  Clone ID: PAT_TA_16381.pep
SAVLLQCYILSNSKNEVCHTRISSSGVKETKMVITALAALVPGNKKLTIRVYVSRLWQHRGTTDNGPIIHTDMVLVDAEGSHIYAEISKDWVSKFMEKLREGCAYEICQFLVFPNKRYFKAVDAANMICFNRFTTVNPNTDLEVAFPFCTMHLSNLSVDYL

SEQ ID NO: 121964 - protein, 146 aa, Triticum aestivum
  unsure (1)..(146): unsure at all Xaa locations
  Clone ID: PAT_TA_16382.pep
AGPTRAHACENARLIRNPRSPAPKRTHRRPLPSPPLPSAPPPFASAPIAGTYRCPLLPPHRRSRRRTLPPPPPPSXRRTLPPPPPPSVPPPFDAASIAIPVRKKKXPSPATFSRRSGPPLATFPHPHPLPYRAPLTGPCLPPRRKV

SEQ ID NO: 121965 - protein, 90 aa, Triticum aestivum
  unsure (1)..(90): unsure at all Xaa locations
  Clone ID: PAT_TA_16383.pep
ECYCLLKNNNILPSANWLSFLPSFLSLCRPTTACGRSVTGRSAASPSGSTGRCAPPTPTRCAPCAGPPGSHGPLPPRGSGGLLEXTGAAG

SEQ ID NO: 121966 - protein, 152 aa, Triticum aestivum
  Clone ID: PAT_TA_16384.pep
PGCRGHLISSGVDTTKVRKICQAIALLSPAAFMMLSSVDLGLPPWVVVAFLTGGISLSNFALSGLYCTHQDISREYASILLGITNTVGAVPGIVGVALVGYLVDTTHSWSMSLFAPSIFFYLTGTAVWLTFASSKPQDFNKLASESLAESNQ

SEQ ID NO: 121967 - protein, 189 aa, Triticum aestivum
  Clone ID: PAT_TA_16385.pep
MPLAGIALAPLLVSPLAPPSPRGSVAAVSAEPARRRRALRRVRCSAAAASGGGGVPRELSRATLLWRAAKLPIYSVALVPLTVGTAAAYNHAGLFFARRYFGLLAAALLAITGLILSNDLYDSGTRADMYQLDSPVDAVGWWAVTQYAANVPLLFGFGGLFWAFTEAGDVRFITLVLCAILCGYVSQVF

SEQ ID NO: 121968 - protein, 146 aa, Triticum aestivum
  unsure (1)..(146): unsure at all Xaa locations
  Clone ID: PAT_TA_16386.pep
MTSPTRRKELDVMKLMMNEYEVNVGENPAEYFITFYGPKDSPYEGGXWRVRVELPPTYPFKSPSIGFQNRIFHPNVDEASGSVCLDVINQTWSPMFDLVNVFESFLPQLLLYPNPTDPLNGEAAALLLKEPEKYKNKVRDYVQRFA

SEQ ID NO: 121969 - protein, 193 aa, Triticum aestivum
  Clone ID: PAT_TA_16387.pep
GYLPRQPLSRHPRFLPLPRDPRRRLLSRYRRARASPRPHWPPATSNPCSPPRRHSHLELEQSGGSAGGGNSQPRLVRVAWWPRCGRPVLCLHERGLDPDSAGGGEQQLAMLCWPWRRKELMWLGFGYPRHPSPRSLSAWPWSEGGRRDAAKSSDAGCNSLNRGGSRPRERERWPFAPAPLSLPFLWRCFAGDI

SEQ ID NO: 121970 - protein, 205 aa, Triticum aestivum
  unsure (1)..(205): unsure at all Xaa locations
  Clone ID: PAT_TA_16388.pep
AAFLTIGAIFLPETPSFLIQRDGNVDEAKMMLQRLRGTMGVQKERDDLVTASNISRAIKNPYRNILKKKYRPQLVIALLIPFFNQVTGINVINFYAPVMFRTIGLGESAALMSAVVTRLCATVANIVAMVVVDKFGRRKLLLVGGVQXMILSQFTVGAILAVKFKDHGVMDQEYGYLVLIIMCVCVAGFAWSWGPLTYLVPTEIX

SEQ ID NO: 121971 - protein, 168 aa, Triticum aestivum
  Clone ID: PAT_TA_16389.pep
MSVKMFGEDDQENLYNLVQDKATSGKQGLGIKDLPMKVGGQRWKGNKTSLGDSDEENSTQSELSEVEEDEDEEGSASDAKVNEVHVKTVKEVCVDAKPKTKFKKLCKKILRQAPSQSMKLKELKEAVEEQSTILSDFSCRREALSFLKRKLQGSKKFNLEGKRVHLVS

SEQ ID NO: 121972 - protein, 235 aa, Triticum aestivum
  Clone ID: PAT_TA_16390.pep
LRKSRRMARGAPNGRGGVRSHKIEDYDDAVTKKAPSGKRVRKEKNDLAAELKDLGWSDADLHDETRPTTMSVEGELSQILREVAPKTSEGKKAGGIDKSQVNALKRQALVLKREGKLAEAKEELKKAKILERQLEEQEILGEAEESDDDLAAIIHNMDDDNQDDILYDNSRLPAINFEQILAVSDDLNFDGNFDVTDDDINDPAMAAALKSFGWSEDDDNQMDSHAPVSSLNREA

SEQ ID NO: 121973 - protein, 149 aa, Triticum aestivum
  Clone ID: PAT_TA_16391.pep
RAKEGQEEEEGDAGLILSTDAKPRLKWTPELHERFADAVKKLGGPDKATPKAIMRVMGIPGLTLYHLKSHLQKFRLSKNLQAQANAVHAQHVYGFGTATDKACEGHGSPADHLNRETNTSRSMHINDALQMQIEVQRRLHEQIEVQRHL

SEQ ID NO: 121974 - protein, 123 aa, Triticum aestivum
  Clone ID: PAT_TA_16392.pep
TGNSLIAPQVGRAFLQGITNLLSLSEVAIRYNVRYAKSPTVKMAEAAVRKQVAGHCDLFINGIQDQPEEAGDGVAVIEDVQVQAEDAPEAEGGATASTSEIDIVDTAQLYDQSTASAHSHWYP

SEQ ID NO: 121975 - protein, 221 aa, Triticum aestivum
  Clone ID: PAT_TA_16393.pep
MQAAAARARRLLASPAASGIQGILSASHRGCAAAAELVLLPHLENGFPASRSSPDHTRSFSSHLPRTLLSQTATSHCRCNKSVCYHMARAHLSTDSSGIDQPKESAEELYQKMLKSVEAQTMPPNAWLWSMISSCSSEEDIKLLFQILQKLRIFRLSNLRINATFRHPLGMRGAAACPRGGGLGHGLEVLRGRIVYGITPTIGSAHYLLQHAKEHNDTKLM

SEQ ID NO: 121976 - protein, 203 aa, Triticum aestivum
  Clone ID: PAT_TA_16394.pep
KKIAIGSARGLAFLHHSCIPHIIHRDMKSSNVLLDNNLDARVSDFGMARLMNALDTHLSVSTLAGTPGYVPPEYYQSFRCTTKGDVYSYGVVLLELLTGKKPIDPTEFGDHNLVGWVKQMLKDNKGGEIFDPTLTDTKSGEAELDQYLKIASECLDDRPARRPTMIQVMAMFKELQLDSDSDFLDGFSINSSTIDESAEKSSS

SEQ ID NO: 121977 - protein, 468 aa, Triticum aestivum
  unsure (1)..(468): unsure at all Xaa locations
  Clone ID: PAT_TA_16395.pep
SYTSDLKELVVXLPDCLADHFGSLVPGIEKALNDKSSTSNLEIEALAFTRIVMASHSPSVFHPYIQALXSGPILSAIGDRYYKVTAEALRVCGELVRVLRPNFEARSIDFRPYIIPIYKAILGRLANQDQDQEVKECAISCMSLVIATFGDGLQSELPSCLPILVDRMGNEITRLTAXVKAFAVIANSPLRIDLSCVLDHVVSELTAFLRKANRALRQATLGTLNSXGCHIWGVKLGSSSYDRDLELVRTRGRTRGCASTIEMLKGILNDDSSTNSAKQHMALLCLGEIGRRKDLSSHIQIENIVIESFQSPFEEIKSAASYALGNIAVGNLSKYLPFILDQIDNQQKKQYLLLHSLKEVIARQSVDHTGQSELQDSNIVKILALLFNHCESEEEGVRNVVAECLGKIALIEPNKLIPALKERTTSPAANTRATVAIAIKYSIVERTGKIDAILYSEISTFLMLIKDL

SEQ ID NO: 121978 - protein, 651 aa, Triticum aestivum
  unsure (1)..(651): unsure at all Xaa locations
  Clone ID: PAT_TA_16396.pep
FPRNTCEKNSSSGFKHTLPQSHKFNTFVVSIYDTALVCLANHDPSLDVEQCSLSCISHGIVNFRAVSRGNWPSCLPILVDRMGNEITRLTAAXAFAVFANSPLRIDLSCVLDHVFAELTAFLRMAIXALRHVALGTLNXLEKTIRSKSMTRAVKKEIERKEDLLRSALRAIAAVNRISGSDYSMKLKNQMSKIAATPLLDXEQFGAQRMSAEYFSVYMLEYRRVKVGSAGFEAMLLPKFAIVGYPLSILVEMQWCGNYQGGNCSLMNXVQFGRRPDFAQHFPVEMIGIVSVKSAFRCRGAAASYVLGNIFEGTHFHXLGSRRETVXKEENIQYLLLHSLKEVIARRSVVHTGQSELQDSNIVKLFALLFKHCESEEEGVRNVVAECLGKIALIEPNSLIPALKERTTSPAANTRATVAIAIKYSIVERTGKIDAILYSEISTFLMLIKDSDRHVRRAAVLALSTAAHNKPSLIKGLLPELLPLLYDQTVVKQELIRTVDLGPFKHVVDDGLELRKAAFECVDTLLDNCLDQVNPSSFIVPFLLSGLGDHYDVKMPCHLILSKLADKCPSAVLAVLDSLVEPLEKTIGHKPKSDAVKQEIDRNEDMIRSALRAIAAVNRISGSDYSMKLKNLMSKITATPSLAEKYNSVRSE

SEQ ID NO: 121979 - protein, 155 aa, Triticum aestivum
  Clone ID: PAT_TA_16397.pep
LLDLLILWALSSMNEIKAAENLLDSLRSRVSSMDTKRQQVMHKAIQLADAVYKYGKGEHKAVFDTLGPDFDGLSYKMIGASDEQVDVFNEVWYTVLINAGETSTAIELLVKQISKRQGAPFLWRLLEKAYAVEGRGADASVAAEKANALQAAQFH

SEQ ID NO: 121980 - protein, 144 aa, Triticum aestivum
  Clone ID: PAT_TA_16398.pep
FQLYLIMSLACLVCHGMSSPSQSFRSYSVSSSEEENRCGAAVACLSRKILAAGPANRVGTSKASRVLLAFNGAVLFQGILSGTGTSTRSLLGTRVARCQQLSPGWTLDYYLARVDVHFLVYIWISMYYISTRLNQRANCLTVTG

SEQ ID NO: 121981 - protein, 130 aa, Triticum aestivum
  Clone ID: PAT_TA_16399.pep
LQVENLENIYGVLPEIDSIWVYGNSFESFLIAVINPNQQALENWAGQNGVTGSLAELCENAKTKEHFIAELAKAAKEKKLKGFEFVRAVHLDAVPFDMERDLITPTYKKKRPQMLKYYQGAIDALYKSSK

SEQ ID NO: 121982 - protein, 144 aa, Triticum aestivum
  unsure (1)..(144): unsure at all Xaa locations
  Clone ID: PAT_TA_16400.pep
TLRKKLWFKGFKTAASVXCSLSPPSSLPCLXCTXSSTDHMCPWTSTGDPSSSDHMWLASTSCSHRIVSSWHCVTIXIHXALFQPTLVEISIWPGYVCRCKSHFRLSISSQLIILAAHVSQSYIVHMYWHLTWSTAVRMFHCMVK

SEQ ID NO: 121983 - protein, 118 aa, Triticum aestivum
  unsure (1)..(118): unsure at all Xaa locations
  Clone ID: PAT_TA_16401.pep
PGCRPPPATDLNSQQCRGRGKGGKGLGKGGXQRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 121984 - protein, 100 aa, Triticum aestivum
  Clone ID: PAT_TA_16402.pep
ELIGFFDLLVRFLFSKEPPTPPSEQRRQQEERRSEMAPPSKEPCKKEACDIQACLSQEPLRFQEVFESYSVTTICVGAARVQINTLWFFVGLAQKHFKVM

SEQ ID NO: 121985 - protein, 111 aa, Triticum aestivum
  Clone ID: PAT_TA_16403.pep
TSGFMRSTDTYLPKLSCYDLPHVHGLQQPLLSVHPSSSLQHRSRREQPFPDETQINHQAAHVRPQPQILQSAPHSGSSWCCSSDSHRVFGAPGRQQPGACVSVVGSDFRAA

SEQ ID NO: 121986 - protein, 252 aa, Triticum aestivum
  Clone ID: PAT_TA_16404.pep
EVYSEVDKCIEGLTESSHKSLHTLFVILNTVFPKLEVSLTNASEGRAVPFTHDENSSQLICERLPQVDVESPQWSEALTTDAISLIYENLHKLDSFVSSQLSSHKKPRNMTIYWLPRPCGAIGLSACSLWLLRHSSLMGSSDMDNWIQDAKESVAGFWDEHVERPVISIRDELFETFKRTDKRVMEREEVQLTEESLHRMLITFCEQTSKEKLAQDASLQELLEIVMKRCEKESMHSIQNLVSGELARAMLI

SEQ ID NO: 121987 - protein, 197 aa, Triticum aestivum
  Clone ID: PAT_TA_16405.pep
MAVQAQHLSHAFPHDLHAYNSVGALEDEMTGGSLFFPENLKRGPELEGAGNTVFGDVPRVDPTWHDNTTRSHGFAQRKRARVVPEAPSYLENQRGQGLVPVGDVLTRAVGSGTASTSGRMINAAGPPQDLLSQLYRQGMEIDAVLRLETDRMRAGLEEARQQHVRALVSAAERAAARQLRAAEAALELARCRNAKLS

SEQ ID NO: 121988 - protein, 134 aa, Triticum aestivum
  unsure (1)..(134): unsure at all Xaa locations
  Clone ID: PAT_TA_16406.pep
AQPCQYQSVIXEYTANSSSGSPSKATSANPTEARRIMTXGLPSTTHHGGHDPLQPGQTAYMYFMIGDGGSVGDPWNFAQNKGTLLGKIIRIDVDNMPSGNNTPSWGNYGIPKDNPFSMDPEFAPEVFAMGFKNP

SEQ ID NO: 121989 - protein, 128 aa, Triticum aestivum
  Clone ID: PAT_TA_16407.pep
FPSRTIAFSSQLKQQFMWLAQSVRELNGARLEASVRAYGGAGQRKVSNRCRRAERGEAGGVSEGVRRRRPEEGVQQMESVLYGEAKQRHAAPLEGRLLGPFVLCLIPSLCIVAALMLRWTHFSWEFGL

SEQ ID NO: 121990 - protein, 168 aa, Triticum aestivum
  unsure (1)..(168): unsure at all Xaa locations
  Clone ID: PAT_TA_16408.pep
AEKLCKKIWCKACKAVKEIEIVKQWPPPPPCPDKPKKPPCACTCPPPPPPPDPPPCPPCPCPPPPPPPPPPPCACTCPPPPEPPKPCPCHPKPCPPAPEHKPCKPEPKPCPPEHKPCKPEAKPCPTEHKPCKPXAKKAPEPVQDPPPPPPPYEFLPFPVPVPFPMQCQ

SEQ ID NO: 121991 - protein, 118 aa, Triticum aestivum
  Clone ID: PAT_TA_16409.pep
FCFSDHSPHFRSTSSRPWVQPWVSPLEQQRICHFINYHVLAPSLPDISGLDHVYHLNRHSEYHSCGVPNHSRIYSNIHSMHYSPIMNKYLAINIIQSCLCSTQTPNINYTGLTPNLDS

SEQ ID NO: 121992 - protein, 443 aa, Triticum aestivum
  unsure (1)..(443): unsure at all Xaa locations
  Clone ID: PAT_TA_16410.pep
MHAVMRHPNTFCATGVSIRGRCPCTRLLKNLVLWEMRLPWPYLRLYRQIKKRMILVLLQLIEEPGHAGDEAPLALTALIKDSVELAENXAFSTNAVAKLSNHLLANTLETRRAVTILLALAELCSKQEESRSQLMSGQVSTLILDALKHDCVDIRVAACSCLKNISRSSKVLSAGRLSCDTVIAPLVQLLYDSSTSVQIAALGAICNIAVNLTPRKLALESQGXDLILKELTXSLDPTLRLRSGSARSGTVLLAGPEASGRIREVXTVSTLSSLICDSEHSVQEQTLALVQNLLDGYVGSVNYVIGEDGMVINAISRQLNSASATGVCIQGMLVLANMAAGNELNKEAVMDVTVPHRADRIKPSFVVNFLQSKDKQLRVATLWCILNLIYPNSDSSSTRVARLQNAGVISQVKNMINDPCLDCKLRVRMVLEHCLDNAAAGFM

SEQ ID NO: 121993 - protein, 176 aa, Triticum aestivum
  unsure (1)..(176): unsure at all Xaa locations
  Clone ID: PAT_TA_16411.pep
TRGIRKKSDALNXRFDEIFGRIIEKRVEADQAGADTAXDFLEYMLKMEKEGGDGKAAFTMTNVKALLMDMVVGGTETTSNTVEWAMAEMLQNRRILRKVQEELDAVVGIDGVVEESDLPQLHYLQLVVKETLRLHPALPLMVPHCPSEDTTVGGHRVPAGSRVFVNAWAIMRDPAA

SEQ ID NO: 121994 - protein, 222 aa, Triticum aestivum
  unsure (1)..(222): unsure at all Xaa locations
  Clone ID: PAT_TA_16412.pep
MGKKGKWLGAVKKVFSPESKEKKEEKLRKKLAARDPSPPDLTPSTSLEVNVLMPPPPPAVPSPHQTEEVQVRDVELEQEQEQSKHVTVEAAPDAPAQTVGGIAPWMYRAEELAAIKIQTAFRXYLARRALRALRGLVRLKSLVEGNSVKRQAASTLRCMQTLARVQSQIRSRRLKMSEENQALQRQLLLKQELDSLRMGEHWDDTTQSKEKIEASLISRPEA

SEQ ID NO: 121995 - protein, 291 aa, Triticum aestivum
  unsure (1)..(291): unsure at all Xaa locations
  Clone ID: PAT_TA_16413.pep
MATLSLPVAHPQVSLWRQGRRRLHGLPSCQFRHAGRVQSSYRGLEALYDDGYGTVKDLDYFYQALGQLVEHDSGPPCWLCPVDAGSTVEDAPLMLYLPGVDGMGMGLCMHHKALGRIFELRCMHIPLRDRTPFEELVTMVEDVVRAEHSASPTKPIYILGNSFGGCIALAVAARNPGTDLVLVLVNPATSFERSRIKTLLSVFSPLSDRACIAAAALLNYNIHNEVNMALSMMKSGRHPFEALSRLTSNMSSSLKHSKMLDKLPKDTLKWKXKLIKQAASYANSHIQSVTX

SEQ ID NO: 121996 - protein, 84 aa, Triticum aestivum
  Clone ID: PAT_TA_16414.pep
GFIVEKKHDGAEQRAAGEDPWRNLAGRAATTAGRSRRHALATIIHVRRIVKEISLPLYLNSIPELCPPLVLANASWTLRSIGAQ

SEQ ID NO: 121997 - protein, 146 aa, Triticum aestivum
  unsure (1)..(146): unsure at all Xaa locations
  Clone ID: PAT_TA_16415.pep
MYTARKKIQKDQGXVEPSEFEDTVAQAFFDLENGNQELKSDLKDLYINTAIQIDVVGNRXXPVVIHVPYRLRKPFRKIHVRLVGQLEKKFSGQDVVFVATRRIVRPPKKGSAVQRPRTRTLTAVHDGLLEDVVYPAQIVGKRVRYR

SEQ ID NO: 121998 - protein, 109 aa, Triticum aestivum
  Clone ID: PAT_TA_16416.pep
CCLALQEEKNIVQLLMGADPELANYPADGVSPLYLAILLGKSTIALILYDKSGGNLSYSGANGLNALHVGVLPHRDSVMMEFLVHWNKSLTTQVDRDGRTPLHFASSLI

SEQ ID NO: 121999 - protein, 54 aa, Triticum aestivum
  unsure (1)..(54): unsure at all Xaa locations
  Clone ID: PAT_TA_16417.pep
CINXVVXPTACLHVXTKSFIIQTDPPRDNRASIKKRTLYIYVRLMIYNTKTCRY

SEQ ID NO: 122000 - protein, 39 aa, Triticum aestivum
  Clone ID: PAT_TA_16418.pep
FFFFAVITISIEGNKKGRFYEFIYTHASVLLPPFHIKCH

SEQ ID NO: 122001 - protein, 261 aa, Triticum aestivum
  Clone ID: PAT_TA_16419.pep
MAPPSSPPSAAAPARSSSRKRSASAKAAAPEEATVTKRPRKGTTSGKKKPPAPKAKKQQKATKAPREKKEATPAPADAGGGEEPDEEELALGEEDEPSASGEQQQAGQAAAAKRRVAQPSKKARNVAAGDKEPEFLGEPVPADEARAKWPQRYQRGSPKRPEDEEDMKARVHYRSAMVDGVVYALGDDVYVMAGENEADYIGRITEFFEGVDKTSYFTCRWFFRPEDTVISRAKFVNDHTHDPKRVFLSEEKNDNLVDCII

SEQ ID NO: 122002 - protein, 264 aa, Triticum aestivum
  unsure (1)..(264): unsure at all Xaa locations
  Clone ID: PAT_TA_16420.pep
MTRTSGANGGGQQGSGKLPRKRFYRARAHSNPLSDSHFPIPISPDDVDLSQHYPRYFPADKGEHGDGDGDPEAPRIRFADVGCGFGGLLVGLSPLFPDKLMIGMELRDKVTXEYLKERVLAFEGIKSXGQYDNISVVRPNSMKYIPNYFGKAQLSKMFFLFPDPHFKEKNHRRRVISMHLLDEYAYVMEAGGIIYTITDVEELGIWMRTCLEKHPLFGAVPEEEIKVDPVVKLLSSATEEGQKVARNGGQTFQAIFRRISLQEE

SEQ ID NO: 122003 - protein, 93 aa, Triticum aestivum
  Clone ID: PAT_TA_16421.pep
VTIISAGPPVDGRVGAEERITIRWTFKKFNEGNMREILDPLLEDRVDEEVLEKLLSLAFQCAAPTREDRPTMKEVGEQLWEIRKEYGKSVRRV

SEQ ID NO: 122004 - protein, 453 aa, Triticum aestivum
  unsure (1)..(453): unsure at all Xaa locations
  Clone ID: PAT_TA_16422.pep
MLHPVAPLLLPLFQPVPAPRRLVRPLHLPAQFLLALPPPPPLRALLALLRSSSALDSGSEPTLLWTCGNDQVSILETSDGLQNLSINGVLVKDRAEGCDRLRSYFGSGCLRCDERSQSWRGAWMRYCSDDGSQSSYVTLTPNIPRRLLKQSSENGAKAEDDPCGNTGLHENKHDANDSSEKEDPLLAVPGVLLLCCGLMLPCFHAERKEGRRHNTTSIQRNAVDSLSSFDVSTSSEKIPPTPHRIPPSPSRFAPSPHIARVGSVDLSVQQILRATQNFSHSFKLGEGGFGTVYRAVLSDGQVVAVKRAKKDQFAGPSEEFSNEVELLAKIDHRNLVRLLGYTDKGNERIIIXESVKACALLPTTRAYTNTFHEHLDGNVLCFLAHALTYLHLYAEKTIIHRDVKSSNILLTDSYRATCSLCALARNAPRDTAHTNMSPPVTDTPSSRVPPYRR

SEQ ID NO: 122005 - protein, 166 aa, Triticum aestivum
  Clone ID: PAT_TA_16423.pep
PCVGTDALKPTAGTATRMGFPRGGVSICGRRPSPRVRESASLWMSDDHNFRAIYCYKDHQRLEGRRCAGNTGRGTGAPFRALSTLSPTDGVSAADRIERRRPAHRRARGIPRDGEEGRGWSARQSGCGSREGGGKPPGRDPEEYRSDETTREREVPAVGEVWRGGG

SEQ ID NO: 122006 - protein, 180 aa, Triticum aestivum
  unsure (1)..(180): unsure at all Xaa locations
  Clone ID: PAT_TA_16424.pep
LFTWAIRHPPSGYVQGXINDLVTPFLXVVFLSEHLEGDLDTWSMENLSLQDVSNIEADCYWCLSKFLDGMQDHYTFAQPGIQRLVFRLKELVHRIDEPLSKHIEEQGLEFLQFAFRWFNCLLIREVPFHLVTRLWDTYLAKGDYLPDFLVYISASFLLTIWIPSDVPSVSFFPSGQRSCR

SEQ ID NO: 122007 - protein, 67 aa, Triticum aestivum
  Clone ID: PAT_TA_16425.pep
SYGSCQKFLWKVKLPLKCRFFIGLAGQHRCWTANRQQTRAPLSENLGTCPLRAQHQEMAKHYSVRCP

SEQ ID NO: 122008 - protein, 126 aa, Triticum aestivum
  Clone ID: PAT_TA_16426.pep
SLFSSLLFYSTTVSVRPRTMEGKNRVAAIAALCMLLLLTLPKPSHQQPSGVNCKCYRRCYPACKERIQPLPCKVKCAGRCPDAIDRLASCLIACGMDSICDQPAPSVDVEVCRNVCHDMWVASGAN

SEQ ID NO: 122009 - protein, 103 aa, Triticum aestivum
  Clone ID: PAT_TA_16427.pep
NYSNSFNQLQGEILATFTGVAVLPLPRHLQASSAAFFLLGRPGGCPFLTRHWFLSHCILPINTSKLPSKTFKILSHRGRCDATDNSSYPMTARTLHVTPGVPS

SEQ ID NO: 122010 - protein, 1262 aa, Triticum aestivum
  Clone ID: PAT_TA_16428.pep
MDATAEASSGEGARHAHGAKDDRPEKKVPLLGMFRYADRLDMLLMVVGSLGAVGNGVSEPLISVLFGDVINSFGESTTSTVLRAVTKVVLNFIYLGIGTAVASFLQVACWTMAGERQSARIRSLYLKSVLRQDIAFFDTEMTTGEAVSRMSSDTVIIQDALGEKAGKLVQLTSAFFGGFIIAFTKGWLLTLVMLTSLPLVAIAGAVSAQMLTRVSSKRLTSYSDAANTVEQTIGSIRTVVSFNGEKKAIEMYNKFIKSAYRTVVEEGLVNGFGMGSVFCILFSSYGLAFWYGGKLIIDKGYTGGKIVTVLFAVLYGATSLGNATPSISAIAEGQSAAYRLFETIERKPEIDSDDTSGMIMENIKGYVELKDVCFRYPARLGQLILDGLSLQVASGTTMAIVGESGSGKSTVVSLVERFYDPQAGEVLIDGVNIKNLNLDWIRGKIGLVSQEPLLFMTSIKDNIIYGKEDATLEEIKRAAELANAANFIDKLPNGYDTLVGQRGTLLSGGQKQRIAIARAILKDPKILLLDEATSALDVESERIVQEALNRIMVERTTLVVAHRLSTVRNVDCITVVHQGKIVEQGTHHALVKDPNGAYSQLIRLQETRGDERRKIQDSGVPNSLSKSTSLSIRRSMTKDSFGNSNRYSFKNPLGLSVELHEDEITGEQNKDDLSNGKTLQKAPIGRLFYLNKPEVPFLLLGAIAASVHGVIFPLFGILMSGVIKAFYEPPDKLRKDSSFWALISVVLGFASFIAIPAEYLLFGIAGGKLIERVRTLSFQNIVHQEVAWFDNPSNSSGALGTRLSVDALNVRRLVGDNLGLIVQSTAALITGFVIAFTADWRLALIITCVIPLVGAQGYAQVKFLKGFSEEAKEMYEDASQVATDAVGSIRTIASFCAEKRVVTTYNKKCEALRKQGIRSGIVGGLGFGFSFLVLYLTYALCFYVGAQFVRQGKTTFADVFKVFFALVLAAVGVSQASALASNATKARDSAISVFSILDRKSKIDTSNDEGLVLENVTGDIHFSNVSFKYPSRPDVQIFSDFTLHIPSRKTIALVGESGSGKSTIIALLERFYDPDSGIISVDGVEIKSLRISWLRDQMGLVGQEPVLFNDTIRANITYGKHGEVTEEEVTAVAKAANAHEFISSLPQGYDTLVGEKGVQLSGGQKQRVAIARAIIKDPKILLLDEATSALDAESERIVQDALDRVMVSRTTIVVAHRLSTIKGADMIAVLKEGKIAEKGKHEALMGIKDGVYASLVELRSNS

SEQ ID NO: 122011 - protein, 129 aa, Triticum aestivum
  Clone ID: PAT_TA_16429.pep
YLLTNKTDTTALTSVHHMACLLGSARSRSELYTPYSKSTGAQHMRKERRVKMELMENRHAFMASFLTATISDHGQLTNHGPGGTSKEQSRRSGQVRGVEEDTSALSSRRSCQARSARNAPRTTCIATAT

SEQ ID NO: 122012 - protein, 126 aa, Triticum aestivum
  Clone ID: PAT_TA_16430.pep
RGRGRGTPECSTQPCKLPLVAADENSAPALASDKEGDTEAPFVKHKRRRRTCRSEPAKSTCGSPSTSIADKKAGGNVASAPPKGRGWLRKPSLMAAAADEITPNEARSCTGQAAPQTSQTVSAELL

SEQ ID NO: 122013 - protein, 115 aa, Triticum aestivum
  Clone ID: PAT_TA_16431.pep
WEYLHVITGRSAIVVGVVALFTGMKHLGQRYDSENVEELTWALMLWVLSAIVIALSLEYKEVKRRGGDRSFRGHWVLGNTEEDDSVDLLHPDSSARSSESRPSGVMEVQLEPLTR

SEQ ID NO: 122014 - protein, 137 aa, Triticum aestivum
  Clone ID: PAT_TA_16432.pep
GGARQLGRDEDEGIGLPCLGRSRTGTPREGWIDVLAAPTEAPDAVPLVIEEMTDLDNGAITNEEPSGAESGVLPITLDVQYNGDRNIAYDDSVRHRQSFECLACHELSCTELLLCNTESNANDLALAQGTKKKKKKK

SEQ ID NO: 122015 - protein, 74 aa, Triticum aestivum
  Clone ID: PAT_TA_16433.pep
RWRRRRGRARRRSPSFRGEPKQDTRERWRRRRRHRRQRWPWQAAQEVGADRIWGLGFVAAQGVDAARIWGSRFA

SEQ ID NO: 122016 - protein, 236 aa, Triticum aestivum
  unsure (1)..(236): unsure at all Xaa locations
  Clone ID: PAT_TA_16434.pep
HASAHHRAEQSRGATLAAAQRIPPTHPPTPIARTKMAAAPTTFSGEVWAELRLADARDVPHIHSLIHQMAEFELLTDLFAATHELLASTLFPTPRPAPFASFTALILDLSPAPXPSPRGGGRVTAGFVICFPNYSTFLARPGLYVEDIFVRAPWRRRGLGRMMLSAVAGRAAEIGMGRVEWCVLDWNQNAIDFYEGMGAEVFKQWRICRLTGPALDQYKGAGAGGQEEQDAAGKAE

SEQ ID NO: 122017 - protein, 110 aa, Triticum aestivum
  Clone ID: PAT_TA_16435.pep
KLLQCLCRAGKLQSLCMKIMAMARRFRSPMIKMFFKMLDSVREEIRGDGPMHAKSDVGHAEVLYVLVCPLPESASSMLLNSEDARRRCRQWRRGCEIRCRRRERGARRAA

SEQ ID NO: 122018 - protein, 444 aa, Triticum aestivum
  Clone ID: PAT_TA_16436.pep
TRPVSSSFVRARLHRPPTRPAAAAGATPATARKALASTTSALLSSSPALRRRSLSCSAASAATAPRIAQQPPDLLRWVQREGGFVHPALRVADHPEYGLGVSATAADGVIPPGAVLIDLPGRIPLRLRHPADAADAVLMQLADRVPEELWSIWLGAPLLHQRTKSGPFRRPFVADLKQKLGTVPSGDHPFCGQDVHSSSLGWAMSAASSRAFRLHGEIPMLLPLVDMCNHSFSPNARIVQKGDVESPDMSVKVVAETQIDQNAAVTLNYGCYPNDFYLLDYGFVVTSNPYDQVELSYDGNLLDAASMAAGVSNPNFSTPAKWQQDILSQLNLHGEGAVLKVSLGGPDVVDGRLLAALRVLLAADPDTVGKHDLETLMSLGTKAPLGPTVEASALRTVLALCAIALQHFHTKIMDDQAVLKGEPPLTTELAVQFRLQKKLMLRPT

SEQ ID NO: 122019 - protein, 117 aa, Triticum aestivum
  Clone ID: PAT_TA_16437.pep
GQFLLGRRAVENKIGTDETYYNYKLVRVAHRRRLALANILLHPGPKQCAVAGGSAVFVAEAEYLVGVEVAPLAHPATVALHLAVLHASAGLAVGRVIGLAQLLASRPLRSREQEERL

SEQ ID NO: 122020 - protein, 204 aa, Triticum aestivum
  unsure (1)..(204): unsure at all Xaa locations
  Clone ID: PAT_TA_16438.pep
IEVLAARCTWRLPDPSPYGSTSSTLSATAMSTMVASNARCLLAFGRPHTAASCRRPTSRSTLFAVGSLHHVATSLLPDETSYASLSSWLPVKACSFSSGIDFTFILLCHGWIFSPLAYVLSILYSRRLASCVCVVGGLTCALYWHCKRAVAGRGRAGASLQRRCRLAWHHRVCAFDLSWSSVRQRRSAGCAVAQVRLSXNIAID

SEQ ID NO: 122021 - protein, 211 aa, Triticum aestivum
  unsure (1)..(211): unsure at all Xaa locations
  Clone ID: PAT_TA_16439.pep
AKVSSEVPETEGPDCIEKIKPVRFRCGAPEKSLERNMSVAGSLVSDKLTMDANDLRSTGTSSKIKICSKPKTEDYPPDTPKPSIVIRPPAEVEKDVPRKKVIIKQPKGHVDQLRAIEVRSGQEPRKIRKIAELSSFEKNSRDDDGWYAGEPSQMNSSHDRLGRDGNRKSKEVMGADESWRAFKEQRERQEQRLIEARIYSREEEXQKAKKK

SEQ ID NO: 122022 - protein, 222 aa, Triticum aestivum
  unsure (1)..(222): unsure at all Xaa locations
  Clone ID: PAT_TA_16440.pep
AAARAGTDDVEFFEYVEAVKLTGDLSVPAGQVTFRAKVAKGSRLENRGAYPEEFGVTASYKGQGRIAQPGFKNPRWVDGELLVLNGKXQSHTLVAQSSVSCTACPSRASWFSLTALRFPSERDLAETSWFSHGREFHGETNWPDFRRPKVGSARLSPSSSSSPERASCDRWLAPHRRSTRFGIFEGTEKHGILRPGNMAWYIELSCDVIQHNKLRVANMRPG

SEQ ID NO: 122023 - protein, 664 aa, Triticum aestivum
  unsure (1)..(664): unsure at all Xaa locations
  Clone ID: PAT_TA_16441.pep
IRTRNLALMVYITVGSAANPILEFLEEWGTENFEEISPAVIPQAAKIFVNGCWVGIHRNPDLLVKTLRRLRRQIDVNTEVGVVRDIRLKELRLYTDYGRCSRPLFIVENQRLLIKKKHIRALQQRETPDEGWHDLVAKGFIEYIDTEEEETTMISMPGRVLETSRHNPGEAYSETYTHCEIHPSLILGVCASIIPFPDHNQSPRNTYQSAMGKQAMGIYVTNYQLRMDTLAYVLYYPQKPLVTTRAMEHLHFRQLPAGINAIVAIACYSGYNQEDSVIMNQSSIDRGFFRSLFFRSYRDEEKKMGTLVKEEFGRPNRENTMGMRHGSYDKLDDDGLAPPGTRVSGEDVIIGKTSPIPQDDAQGQATRYSKRDHSTSLRHSESGMVDQVLLTTNADGSRSVQVXTRSVRVPQIGDKFSSRHGQKGTVGMTYTQEDMPWTIEGITPVVFGSPHAIPSRFSLGQLIECIMGNVPAHMGMEADATPFTDVTVDIVCYARHKXGYQLRGFETLFNGHTGRKLTAMIFLGPTYYQRLKHMVDDKIHSRGRGPVQILTRQPAEGRSRDGGLRFGEMERDCMIAHGAAFFLKERLFDQSDAYRVHVCEKCGLIAIANLKKNSFECRGCKNKTDIVQVHIPYACKLLFQELMAMAIAPRMLTHEVKGARDKHR

SEQ ID NO: 122024 - protein, 684 aa, Triticum aestivum
  unsure (1)..(684): unsure at all Xaa locations
  Clone ID: PAT_TA_16442.pep
MQPLSLTRTMAPIQCVLAAKLLLPFGALPCCGGAPTPMCVSPSLEHETNDSKRKLLKLALGGVGLPALLTANKALAHDQGVTSCRLSYSTFLEYLGKARVKKGDLFENGAIAIVAAIAPEHGDRGQRVRVHLPGLSQGLPRKFRXEKNTDYAAHNLQDRAGLLLFIPCCTLSVTLLLGCALLVMWGRGRDEESVGPWVTRDPLAFSKVLAELLEGSRXAVTCSDVSGADGAELSCRELGAHWWPPAAVPGVGSPVANGVLRVGCCWRMLILLGMEIAGQALVGMVSXCGSEFVDKSVGIGAARVCALVQKAYQMGPXIVFFDALDAVGRERGTVIGGGNDEREQTLNQLLTEMDGFEGNTGIIVVAATNRADILDSALLRPGRFDRQVSVDVPDVRGRTEILKVHGSNKKFDADVSLEVIAMRTPGFSGADLANLLNEAAILAGRRGRTGISSKEIDDSIDRIVAGMEGTVMTDGKSKSLVAYHEVGHAVCGTLTPGHDPVQKVTLVPRGQARGLTWFIPMDDPTLISRQQLFARIVGGLGGRAAEEIIFGDSEVTTGAAGDLQQITGLAKQMVVTFGMSDIGPWSLMDAAQSGDVIMRMMARNSMSEKLALDIDSAVKQLSDQAYQIALQQVRDNRVAMDKIVEVLLEKETLSGDEFRAILSEFTEIPVENRVPPTPQAAVPV

SEQ ID NO: 122025 - protein, 176 aa, Triticum aestivum
  Clone ID: PAT_TA_16443.pep
TSPKSMMIAQVIGTAMGCIISPLTFMLFYKAFDIGNPDGTWKAPYALIYRNMAILGVEGFSVLPKYCIAISGGFFAFAAIFSIARDVMPHKYAKYVPLPMAMAVPFLVGRSVPPPGRLGSLIVFAWTKINEKEAGFMVPAVASALICGDGIWTFPASILALAKIKPPICMKFLPAA

SEQ ID NO: 122026 - protein, 184 aa, Triticum aestivum
  unsure (1)..(184): unsure at all Xaa locations
  Clone ID: PAT_TA_16444.pep
TPRRIKRIRNPRAARGTYNEYNYSLLRPARRADYVRVVFVDADILVLRALDALFXFPQLAAVGXNGSLFNSGVMVLEPSACXFDALVRGRRTVRSYNGGDQGFLNEVFVWWHRLPRRVNYLKNFWANTTGERALKERLFRADPPDVWSVHYLGLKPWTCYRDYDCNWNCRAQRVAATSHXRWWK

SEQ ID NO: 122027 - protein, 70 aa, Triticum aestivum
  Clone ID: PAT_TA_16445.pep
RHSSSPGAPPPASATRRARCHRRSPLTSPPSAPRPPSRAFSARPRRRRPSASSPCAPPPPCPPRPRRPLS

SEQ ID NO: 122028 - protein, 146 aa, Triticum aestivum
  Clone ID: PAT_TA_16446.pep
LATLLGLQCMVVSWCNLIIILCRNHTGNLVPVMHHPTYMMKEVIMINDDPPECRSEPQVSMHPPTGTYPTSISVPNNFGPRPFYCHPPPMQILPRENFAGSMPVFPMFGAQRQQVRYSQSLHLTPSRVQPPQGYINPHVYYPQDLR

SEQ ID NO: 122029 - protein, 304 aa, Triticum aestivum
  Clone ID: PAT_TA_16447.pep
PWPATNPSYYQSGVCQDIKQKEHLFHLYMNQIFDGQGVTNANQVTVAKPSGQLSGFGHTIANDWTIRDGPAADANLVARARGMHMGAGKVDQNWLFCHNILFTDTRFKGSSLKVLGDFVSGKDSEWAIVGGSGEFAYAQGVVVAKEIQTVPPTPGRTWELRISAFCLCIPKVTPVTKMGPWGGDGGTSFDITELPRSLQTVTIRCGDVINSVMFSYTDQTGQKKTVGPWGGAAARPASLLVLLPSCHRSLGSGSVDWTMYISTWQQRSTYGPLETNGPLAAPMYTLGITAGVVSLALAAIHMMS

SEQ ID NO: 122030 - protein, 100 aa, Triticum aestivum
  unsure (1)..(100): unsure at all Xaa locations
  Clone ID: PAT_TA_16448.pep
AVAPCHRRLWEMITLSSMGRSGDIYRGCLKKSGLRCCRSKKVDVEGAVRRTXVGIKLSXSKKSQCPRICSHCLGPFWVXGCXKGNCXXVTKVQXSNRGRF

SEQ ID NO: 122031 - protein, 125 aa, Triticum aestivum
  Clone ID: PAT_TA_16449.pep
MGQAEDIIVVRGRTIAHGRSVSGAVVVLEETGNYLDEVLVSIKGTSSQVQTAHHLIQEVLLGDRKFLPPRSRGYCNPDAGPVRPWFDPCGAPASPEYAPPLYSDYLSSSSSVRHYHSAAYHGYRL

SEQ ID NO: 122032 - protein, 146 aa, Triticum aestivum
  unsure (1)..(146): unsure at all Xaa locations
  Clone ID: PAT_TA_16450.pep
AGRRPGLSRPNQTPHQSRTRTAHRRPRRRREEKXEMEAAAAAAGVQLGTSKPQIATQAEMAEARLPIPYRDQCAHLLIPLNKCRVAEFYLPWKCEPERHSYEKCQYELVMERMLQMQKIREAQAGAKVKGSVTIGVPLAPSTAKLA

SEQ ID NO: 122033 - protein, 124 aa, Triticum aestivum
  unsure (1)..(124): unsure at all Xaa locations
  Clone ID: PAT_TA_16451.pep
MEAAAAAAGVQLGTSKPQIATQAEMAEARLPIPYRDQCAHLLIPLNKCRVAEFYLPWKXCEPERHSYEKCQYELVMERMLQMQKXIREAQAGAKVKGSVTIGVPLGPLPPPSSPDPSDSGVVGG

SEQ ID NO: 122034 - protein, 160 aa, Triticum aestivum
  Clone ID: PAT_TA_16452.pep
PDSSSTSSRIPCSDDRCTAALQTGEALCQPSDAPSSPCGYTFTYGDGSGTSGYYVSDTMYFDTVMGNEQTANSSASVVFGCSNSQSGDLMKADRAVDGIFGFGQHELSVISQLYSLGVSPKTFSHCLKGSDNGGGILVLGEIVKPGLVCTPLVPSQPHYN

SEQ ID NO: 122035 - protein, 192 aa, Triticum aestivum
  unsure (1)..(192): unsure at all Xaa locations
  Clone ID: PAT_TA_16453.pep
PSLPLLPLLQRWPGPPAPTPARAFLRSAAARSPLIPLGAGHAVPAAVGAAISAAGLAACRPLACAPVFRLEKPVGVGGGGFCLETVWVSLDNLWFAAQATVGVFLHLIDTPPGSWAASTSFILPSFIGHSRSQTQLRRTPTTSTRSMSLLLPARWPSYTPAPRPKGYASGKVRDCGRQLSWPSLACRLDXKP

SEQ ID NO: 122036 - protein, 104 aa, Triticum aestivum
  unsure (1)..(104): unsure at all Xaa locations
  Clone ID: PAT_TA_16454.pep
ILLDKSMTPKIADLGLSRVYASSETHQTEIVKRNTWVILPPEYLQHRLISQKFDVFSXGAIIIKMVAGNTGSSRRSQMPPMEFIKLASEYWTKRLQAMPASYSS

SEQ ID NO: 122037 - protein, 168 aa, Triticum aestivum
  unsure (1)..(168): unsure at all Xaa locations
  Clone ID: PAT_TA_16455.pep
ALGQGEPSMATRPVSYALLLVLTTLPLALATSFPHRALLQTCQPSGTIAGESGSCSTENDSECCEDGRRYRTFACSPRVTGRTRASLTLNSFADGGDGGGKSECDEKFHPRXKMVVALSTGWFPRRGAVREALVIPGRXTGRTAXTATVVDECDPNTGRHGAAFVPPP

SEQ ID NO: 122038 - protein, 214 aa, Triticum aestivum
  unsure (1)..(214): unsure at all Xaa locations
  Clone ID: PAT_TA_16456.pep
LCNLFDECPVVXYIPFPAPGVCITPYYRLTRHSAQCFHDVACYDGLIKFVEIVRDGPDCMIKGKGWRATTWIRNISWGGWRKHTRVDVANISVDPRYSALLPELWNHETHKLELKKLVFLLPTLSVRNDDLLHIMAKVGGEHDKAWVIAVDMKSTVVEGLAPVSTGRYCPSTMFSPCAFPSYLNNMTQETSLKNHSLDVMEESWKKRKFKPSTG

SEQ ID NO: 122039 - protein, 97 aa, Triticum aestivum
  Clone ID: PAT_TA_16457.pep
SGKTSVSSSSRENPQITLRISISLAPNHQHPHTMSWHGVLPDEEDRIDLPLYISPATPPYISPATLLPKVRAYEMAAPDSICVHHLVARPAGGEHAK

SEQ ID NO: 122040 - protein, 180 aa, Triticum aestivum
  unsure (1)..(180): unsure at all Xaa locations
  Clone ID: PAT_TA_16458.pep
QPGGHAPISSTDKQIPPDAESGMVYSXPRRLQADEIPLIVDDFRRAARNVIEAGFDGVEIHGAHGFFLEQFMKDSSNDHTDKYGGSLENRCRFAVEVIDAIIHEIGVDRVGIRLSPFVDYTDCFDSNPHVLSTYMVQQLNKHKGFLYCHMIEPHMTIVDGRMQIPHGLLPFMKAFNGTFI

SEQ ID NO: 122041 - protein, 176 aa, Triticum aestivum
  Clone ID: PAT_TA_16459.pep
MATRMSKEELAAYQPRPGVRCEKAAAEFLARRKKEMESEPEESRTDINAYEAGLYRVFWEQMFGKNGSRYEDITMIPPMAFTDHGCKFAGVQSTIQIFSVKVEETTGGLVWPLHVYGMVAVRDVVDHNRNVIFHRERDNCQIITTMDPYLALTGPTRGVVVSVHPVYFEVHLKVKG

SEQ ID NO: 122042 - protein, 142 aa, Triticum aestivum
  Clone ID: PAT_TA_16460.pep
RPRTRGDLQRLRHMLLTTGAGGGHHQLASAATIPASGPCYGAALPSQRDHHMCADLFSLPPATMTTTSATEQYSEFLAMAAANLAKKGVRPDGGQEMSTNKRKRDGRSSMLAAADVLAAHVQQQTIDVERILLKHAQNLWTT

SEQ ID NO: 122043 - protein, 84 aa, Triticum aestivum
  Clone ID: PAT_TA_16461.pep
DKRRSSIHDITTVNIPDDDHASNTNPSPSPPSALTATSSPPEQFGALVDSKPPPLGGHHHFMPHLFRRREIWRPAITATTATLF

SEQ ID NO: 122044 - protein, 153 aa, Triticum aestivum
  Clone ID: PAT_TA_16462.pep
PTRPEIPSCPSFPEPNVRRGAWFDVVAVKLPCTRVAGWSRDVSRLHLQLSAAKLAVTSSRGNRKVHVLFVTDCFPIPNLFPCKNLVKHEGNAWLYRPDLKAVREKLRLPVGSCELAIPLKAKGGLLPPDPRRPRSATGLALASEYVCGAITAA

SEQ ID NO: 122045 - protein, 167 aa, Triticum aestivum
  unsure (1)..(167): unsure at all Xaa locations
  Clone ID: PAT_TA_16463.pep
KQQDLLSTHLHLCEVYEGHSSNTSTRQGVCNQEKARKILKGRNTFAAPPLHSNGTRVRPTRPSRSRRCASRCRSAIXXRIRCDSLAASILLSSARTNPSPIALTACTTSLSPAYPSSSGSGRFLFLGGEGEGGSGEAGGGGDGEWDLERKEHLCRAPRAEFGTRPRA

SEQ ID NO: 122046 - protein, 119 aa, Triticum aestivum
  Clone ID: PAT_TA_16464.pep
LSRSRERPPLKSTLSHPSSQLQLHMTQQNLKASASCHDTEPKSFEKKIITRTSSTLLATQHDPQLLNPKLQFHLLVRPLLLIWLECTTTAKVEILPDGYLTMHACHVQAAAKEQGQQAH

SEQ ID NO: 122047 - protein, 154 aa, Triticum aestivum
  unsure (1)..(154): unsure at all Xaa locations
  Clone ID: PAT_TA_16465.pep
PRVRPPVRINPPSSPPPRRRRCPPPMAAFASAPQQSKPLVLGCGAVSVDYLATVASFPNPDDKIRSLALKVEGGGNAGNALTGAARLGLSPRIISKASNDALGKNILKELQDDGVDTSYMTIADGGNSPFTYIIVDNQTKXTRTCINNSWFIPQ

SEQ ID NO: 122048 - protein, 139 aa, Triticum aestivum
  Clone ID: PAT_TA_16466.pep
VRPRVRQGGAERSSRRPPPQICVRTHIAIFTAAAPARRCRWRSRHGRGGQHQGRRRCCRRHCSQGPHSADALGLGVAGGGEGGGGRFGGEGCGAGGRDRGDLRLQERLPEAVLQSVAADPPARAHDGGGQGRTTPVAGG

SEQ ID NO: 122049 - protein, 168 aa, Triticum aestivum
  unsure (1)..(168): unsure at all Xaa locations
  Clone ID: PAT_TA_16467.pep
VSRGRGRGTALQWQQPTVPSPSVRSVVSKGTQCCTPGRCVVSASPPPSLRPGAGRARPRPPAYALLRRHTWEIALWXPSARCDAXRTPSLRGLVLKDKISVYDLGNMRMGCADYGCSLTDNVTSSSGKNQYLNTGQLDMNGAPRHHSGLVPTVVAVALVHMLIFGRPI

SEQ ID NO: 122050 - protein, 131 aa, Triticum aestivum
  unsure (1)..(131): unsure at all Xaa locations
  Clone ID: PAT_TA_16468.pep
SRVALSRARVESIHLVPIVSPVCPWRKKFILNLKLIDIRRIKHWSPILCRLHPELTNFGLYQSRCRSQTGIIDVXKVWPGWVVPRAAPASIRVGRPSSVHHFPSFSPHPLPSTFSRDGHGERWLISGAVGS

SEQ ID NO: 122051 - protein, 205 aa, Triticum aestivum
  unsure (1)..(205): unsure at all Xaa locations
  Clone ID: PAT_TA_16469.pep
SCRIRHEVPLKVPSGLRPVYFASDDDRRESQSPARPLLSSRGASSNVEHRLINHTVNFQKMWSSEQEVRSRCKLLGXKRLQDDGRIFSIWRPLCPSGYVSIGDVAHVGIHPPHFAAIYKNVNDNFVLPLXGYDLGWRNCPEDYRSHVSLWQPRPPEGYVALGCVAVSASEEPPPDCAFCVNESSAEHAVVEDQSLPWDAHNNPEL

SEQ ID NO: 122052 - protein, 202 aa, Triticum aestivum
  Clone ID: PAT_TA_16470.pep
MSAGTATPGLVVTATDPIRSFLSSAAGSPDLSDDLRGLASALSSERAVPYRSIRAIWCADCSRGRPPLRQLLQGAQFVLSSPKPREKSDELKARLEKLREMQERKEYAELVKDVAPKEDNTEPFSSYKDQLGFGLHVVVIMFTGYLVGFATFKALFSNSPVMNAAGGILGVVGGMLMETVLFIIRSSSKELSSSVPRSKKLQ

SEQ ID NO: 122053 - protein, 62 aa, Triticum aestivum
  Clone ID: PAT_TA_16471.pep
CPTLPQMRSDDPSPPDMHIHLYTQRMRRDNILAKVRGKLVGLDSSALARGIARSSLEHLLLV

SEQ ID NO: 122054 - protein, 91 aa, Triticum aestivum
  unsure (1)..(91): unsure at all Xaa locations
  Clone ID: PAT_TA_16472.pep
VVVMPPVPGPSIFLVMTGEGEVQADSMSDGEKAKEGDVFFVPAHTEVRLSASGHATXQLYRAGVNSRALYACNAAAAGKRSQLQNICEMAS

SEQ ID NO: 122055 - protein, 144 aa, Triticum aestivum
  Clone ID: PAT_TA_16473.pep
SAHASAHASATIRPPGALNNPKLTSNISLNASIVASVLVASRLPSWLHVFAIMLFSLQVFLFAPLVTFCIKKYSCRLHLIFSSALMVMTLGVTYQLHRMLFILLLALVVFISLVCPYWLIRIQEYKFEINGPWDEAKLCFDITE

SEQ ID NO: 122056 - protein, 113 aa, Triticum aestivum
  Clone ID: PAT_TA_16474.pep
RPRVPSRLPLQVLGLLARCRSRTPCWRGGLMPSASLLLFSLGLVLLCLTSGSTVRLAEAQKTWCMAKPSSDEKVLQANINYACSNVSCAVIQPGGPCYLPNNRAAHSYNPITT

SEQ ID NO: 122057 - protein, 144 aa, Triticum aestivum
  unsure (1)..(144): unsure at all Xaa locations
  Clone ID: PAT_TA_16475.pep
SSSKLCRSRLFGGHFLPNPWSQLVAHDDNAGCPNETAAPPAGTFKPILSPEEMEDQLEQFTSVMQEKFLSGQDSEHMDYXKIDDDEMLDDHWSREAXNYDAGXKYFNEGFRTVHNVSRLLFKFAILGQVGVRRPMFQDPVVLVW

SEQ ID NO: 122058 - protein, 248 aa, Triticum aestivum
  Clone ID: PAT_TA_16476.pep
MHKIFNKYQKMVHTYDPRSEALETILSITETHSTQQYGCPSSRFSFIQETLAPVHTTDEEIALSSDLAKATREILLRLPAESAIRSKFVCKQWFRLVESKNFIQSYFQHKNIDGKPKVMLVVQSTGRLGFSFAPLNKCLPEAPSRSTLLDTKVVCSKPCHGLNLVSTETKDYLCDPCTGFHRGFSNLGPNLHLRSRMPKIEEHAFTVGNKNVGLTFNSLTREHVIVEIFYHRKDFESRQYDMACTLHV

SEQ ID NO: 122059 - protein, 84 aa, Triticum aestivum
  unsure (1)..(84): unsure at all Xaa locations
  Clone ID: PAT_TA_16477.pep
LNRLCYALGDVQCMSDLMAYVLHSLVTKDTGALVISFQFYYCCRHAAIHAYEASYVNAAAAVVCIGRPGLTQHTRQALXKXLIX

SEQ ID NO: 122060 - protein, 209 aa, Triticum aestivum
  unsure (1)..(209): unsure at all Xaa locations
  Clone ID: PAT_TA_16478.pep
QAQTTDARTSLQEISSKRAGIQQEMATCKQKLSFIDKRGPELEAEKKVAAAARNFKEAGRIAAEAKALNSEKEELRAKLEKAGTDLEVIEKDIAATTDKIQECEGLIVLKEQESAMASYKRLRLDSSAARAELXTAATETDDGEEVEILRKEAEAXAESKALELKTLVNLPXDSDEYIFQPVVPIAFITNSTWQHLXEMAFSFGLSPET

SEQ ID NO: 122061 - protein, 194 aa, Triticum aestivum
  Clone ID: PAT_TA_16479.pep
DVKDRGSACCHRGAQRSRAKGRWGVIGRDRCCKILAYACGDVSQRLEAHAARSPLPTAPGTLVWFQSLQPWRRRRRLVAAAASGLGMGGVIARQAGASRWVRLLEDKLRDGHLPSKREGKSRLAQIWEGRRHLRSHPAAGGFRRDGPPEREVEEVRRCKPNCLRGQDCHDHGKRTRRGRERHPRGRGRGASEER

SEQ ID NO: 122062 - protein, 272 aa, Triticum aestivum
  unsure (1)..(272): unsure at all Xaa locations
  Clone ID: PAT_TA_16480.pep
RVINNRLSALSFHIREYYWVDMKKINEIYRYKTEEYSHDAINKFNIYPEQIPSWLADWIPDKGGYLIGNLQPAHMDFRFFSLGNLWAIVSSLATQKQAEGILNLIETKWDDIVANMPLKICYPALEYEEWRIITGCDPKNTPWSYHNGGSWPTLLWQFTLACIKMGRPDLARRAVEAVEKRLSDDKWPEYYDTRTGRFIGKQSRLYQTWTIAGFLSSKMLLDCPEVASILICDEDLELLEGCACXLSNSARIKCSRRAAQVSSPCVVTYTFA

SEQ ID NO: 122063 - protein, 70 aa, Triticum aestivum
  Clone ID: PAT_TA_16481.pep
LVGHLSDKALMTPTPGLHAYPGCFLTERVFGHTPNSRVPRLKRKGRQRQTIYNPARRHFTCHFKIHCQID

SEQ ID NO: 122064 - protein, 67 aa, Triticum aestivum
  Clone ID: PAT_TA_16482.pep
GTHPADPAVTIAEVLPLPPSRTIGNVGVSTGARQPSLAKILSQIDAYLWLYNDDYGRQPLYIKYKWR

SEQ ID NO: 122065 - protein, 108 aa, Triticum aestivum
  Clone ID: PAT_TA_16483.pep
AILPHNPRGSESYDSCSQFGHAHLMHGYPAKGTRNGTILSGRCFLHMHRYDLTFWLSWVASLLYFTYALPASSSSVVMGAPLADCYCQCQPDVYLRLGEARKIVYFRE

SEQ ID NO: 122066 - protein, 96 aa, Triticum aestivum
  Clone ID: PAT_TA_16484.pep
ALGACDWLDRWHQQAPAGLVHCCGLLSSGAVHPGALPLPGTEQSQGAAMMRVHVTVVQALELFQKSLLKLYGHPDEDVAKANWKYIFAETLQSSRC

SEQ ID NO: 122067 - protein, 123 aa, Triticum aestivum
  Clone ID: PAT_TA_16485.pep
EPVRFPVAAPADIPAPAPAGSSADGQIYRPEAAGGDKPQGSEHSVEQLDPKTPGWTQRGRLAAAAPGRPPCADRVTTLEKTVREFAEHPRDIVMMPKIGTSFDTLGEAYDFYNLYSWKKGFGI

SEQ ID NO: 122068 - protein, 109 aa, Triticum aestivum
  unsure (1)..(109): unsure at all Xaa locations
  Clone ID: PAT_TA_16486.pep
PFRLVSAAGTGFAAPRNREREATIRCAPPRPRIPPPLVSGFIFAGARRRSRGRGRAKRASIFIRLVSAAGTGFFYVKRKNPRRITEKLEFRKYDPRVNXHVLFTEAKMK

SEQ ID NO: 122069 - protein, 184 aa, Triticum aestivum
  Clone ID: PAT_TA_16487.pep
GGSIESARAMAALRHAARRALQQGGAQVRPSVVAEGPRRLLLNGASPARRPMSTSSISRKPTSSAKPHGELELLEMRFKKTKEELFDLLVAVRRAELYPQLSWEDIQTHRLITHLAAQVEPRPHDPNWRMFRRTRRLNDFNTITVPLGYFGLFAYCVATNMREDGATSKNSEANFVSEPENDMN

SEQ ID NO: 122070 - protein, 95 aa, Triticum aestivum
  Clone ID: PAT_TA_16488.pep
SSLHCTSEECWLTISLSGRMDVIICASRVTRPRGPCQFEGRWSWIVSSSLRCDSCSPASCSFTRRFLLLCTRVAVDLMASARVSLLGSHSCLHSC

SEQ ID NO: 122071 - protein, 51 aa, Triticum aestivum
  Clone ID: PAT_TA_16489.pep
LGVGLILFEFFVCGGIMSGCGYQVTNYCFIRSPAQVWKINLLRYIVREKKK

SEQ ID NO: 122072 - protein, 77 aa, Triticum aestivum
  Clone ID: PAT_TA_16490.pep
HKDSAILADVSISIKDQEIGKHMKLSGRLQFNNRVSRWGWEKFISLEDFKDSSKGYLVKKKCCIEAQVAVIGSSKTE

SEQ ID NO: 122073 - protein, 721 aa, Triticum aestivum
  unsure (1)..(721): unsure at all Xaa locations
  Clone ID: PAT_TA_16491.pep
PPRAVRGLAASVGPSPCPAPPPPRAAAALPPGFPPSLRRLVSSRLTVRPPPPCGVAASRPRRPGPAPAVALCRAAPIRCRAWRGPCRPSLPGRGGRGAARRGPVTGVSHHGPPVPRAAVAVFFSGFGAARRPGLLQIVGRRRYGVRRPAWVAHSGEKVAIKKIHDIWEHISDAARILREILYIYNGXFPAIKKNNHVSAPPARGLLLVSPAVFLRRQSDLHQVIKANDDLTKEHYQFFLYQLLRALKYIHTANVYHRDLKPKNILANSNCKLKICDFGLARVAFNDTPTTIFWTDYVATRWYRAPELCGSFFSKYTPAIDVWSIGCIFAEVLTGKPLFPGKNVVHQLDLMTDLLGTPSMDTISRVRNEKARRYLSSMRKKELISFSHKFPNADPLALDLLQRLLAFDPKDRPTAEEALSHPYFKGLAKVEREPSCQPITKMEFEFERRRVTKEDIRELIFRGDIXEYHPQLLKDYTNGTERTTFLYPSAVDQFRKQFAHLEENSENGPVVPMDRKHTSLPRSTIVHSAPIHGKEQPRIGPSRDKPSPDESYKNHRDSEKYSGNVQRTSQAPQRVPTARPGRVVGPVLPYENGGMKDTYDPRRVAAMNSGYPPQQQIPQIYGYYQTPAKSACSEPSQAEMYTLHQQAYACANSSTVPDVALDMRAPPFHQSAGPKRGSSDRLSAESNLYSRSLNGIAPTTTGVAASAHRKVGVVPYGMSQMY

SEQ ID NO: 122074 - protein, 180 aa, Triticum aestivum
  Clone ID: PAT_TA_16492.pep
MSPFVCVAILFLALVSPSPAAASIPGTSNNGAAVAAPSVPTVTQFLQAHNDARREVGVAPLTCNSTLEQDAQRYAGRLGIRCKLEPLKWDAPHIYGQNSYWGSGYNDGAAVTGSWVYERQSYDHRANTCAPGKVCGSYTQVVWNTTRELGCARRTCRSSRDTVAVCRYFPPGDYRGVPPY

SEQ ID NO: 122075 - protein, 371 aa, Triticum aestivum
  unsure (1)..(371): unsure at all Xaa locations
  Clone ID: PAT_TA_16493.pep
MAEAAYWSSLPPDLVRRIGDCLLTTNDIDYYMGMRAVCHNWRSATADPGQLDLLRFRPRLWLMLEEEPKDARDDTRLFVNVVTGRFLRRRLPLLRRHILIATSDGLLVLGRTELPLAIRVLNPFTGSMLRFATRIPCDETMAAVTGSDPALIFSFDFRQGLKVCCADQASALFCEQAFPRSQALIASIVAYAGHAYMVDAKGVVDQERWYGEPPXRKVVAEMLDVVACPPEASAMYSFFLVESAGELLLVLRDSSSWRGAKVFKVDVERGALVPVKSIGSRALFLGCRCVSVDADGFPSVDGNSVYYADDLYGMSKMYRVDLRSGTQENISSLSEEPRSDSLRVRPYSFVQALLNYCMTLPDVLAQLRPVL

SEQ ID NO: 122076 - protein, 68 aa, Triticum aestivum
  Clone ID: PAT_TA_16494.pep
STRRPSQLGRRPRPHRHCTRCHHPCPRRPHHRRRRRCPLPPLPLSVCRHIAAERQRRLISAASLPPRP

SEQ ID NO: 122077 - protein, 223 aa, Triticum aestivum
  unsure (1)..(223): unsure at all Xaa locations
  Clone ID: PAT_TA_16495.pep
LLVDTKSKKVLFAEGWQGVRRLPSSGLLTLPIGAVVKLISAGTMHGSIGRLYQSVDNIGSSYLQPNKDRTPGSCCSCRPPVARGPXPSSPPAAARVLPCAGYCATATMRGQGXCPQCKQAMATEVTFVLPSAAPKTSSTAAAAGDETGGYVQGLVTYIVTDGLEVTPMSAISSITLINEFSVHKDVQLAEKFVSVRMDEGLGLLKVALRSDTVLSDVFLAEKK

SEQ ID NO: 122078 - protein, 74 aa, Triticum aestivum
  Clone ID: PAT_TA_16496.pep
FRSHERRPVFYFARVLYKCPTLGGTMLAHHAPRRRRGAAGDGRAGAAGGGGHGGRSPRGRPSRRTRAWAARSGA

SEQ ID NO: 122079 - protein, 121 aa, Triticum aestivum
  unsure (1)..(121): unsure at all Xaa locations
  Clone ID: PAT_TA_16497.pep
ASFRAAREGDGSLQGQGRDQPAEEGAGRCPEKGGCRGAARIGLRGAGAQAGRRREGRWGRQAAAWRPVITYVLTNGEPSALGCGVKVFSKRSXVQSWLVLAGESALQQITSFILWTSANYY

SEQ ID NO: 122080 - protein, 138 aa, Triticum aestivum
  Clone ID: PAT_TA_16498.pep
MADLFFGGSPFRRLLYARPFASATAAMDWVETPTSHVLRINVPGLGKDHVEVQVEDGNVLSVRGAAKEKGNEGNEEAAVWHVAERGKPEFAREVALPEHVRVEQIRASVDHGVLTVVVPKEPAPARPRTRPIAVSSKL

SEQ ID NO: 122081 - protein, 108 aa, Triticum aestivum
  unsure (1)..(108): unsure at all Xaa locations
  Clone ID: PAT_TA_16499.pep
MVLMQADPFLSELTNMYERSTEXGSVWVTXERSSDEXCQSRLKTDARGKGAPVEHRCMVRASDGKRNISTSLSAMEYRKCQGSYALGLKAHMHALKEEGEERTGSMKI

SEQ ID NO: 122082 - protein, 115 aa, Triticum aestivum
  Clone ID: PAT_TA_16500.pep
MEISVKTLTGQTITIKADPSDTIYVVKAKIQDQQRLVFGGEELEDGRTLAHYDVRDNSTLHLDLRQAEEGVPAVAGQSSSFAVGKPEPRGRSHPGGLWHQESGHHSPPTATTLPR

SEQ ID NO: 122083 - protein, 126 aa, Triticum aestivum
  Clone ID: PAT_TA_16501.pep
TRRRSPRTAPASLSTSRQGVFSAAASWCFRTTSSSALPTGSSSSATGSPSMLSASSTPSLARCSLSRQWLEAAGMSAQRHSSSGSTAATITTTPSGAQIRPATTSASPTEMARSVSEAWSPTQATS

SEQ ID NO: 122084 - protein, 174 aa, Triticum aestivum
  Clone ID: PAT_TA_16502.pep
PVCSVGCFKSYFKGQGKNARRSQDPKQPAPGTDSRGRQQRARPSQGKEPPSNEYRQRPCPRQYHTDRGHRSAGRVAREQGRRPRRRRLLAEGGTGRAGRVARGQGRRQPRRRGPGAAGTGAAGRDEWGPAAGPPRCRGRCAATAPAGRRGERQAGAAPHRSRRRRQGGVCEGDR

SEQ ID NO: 122085 - protein, 493 aa, Triticum aestivum
  unsure (1)..(493): unsure at all Xaa locations
  Clone ID: PAT_TA_16503.pep
CRFGTRPELDSQTAPCPMGEDKVGELDVASSCNVQVEPENASYCSPESDSQIAPGSLNSSALAERSTAASTSVMHSTEENYRVSPVPPHTEPFQSVCSEDPPKLPPLPPLQWRLGRPRLGLLSTKDRAPDPASRTTSILPVSSQNMDNGLVSLDGMAEPIALVSSQDIKERHQNSVVDTSDQRVESGMPRENDRPFSEACWNIKHQGHIISSPSEAEEHLNDSGATAHVINQQDCQQHLLCSDISDIAKALSSTDPAASEDDKTVDDHNAARNVHFHKVSSSTPGHVSENGSCQQSQHGESLSGTSDNEEHSSNASDEEKNLKDQSITRGLPLDTTKHTASGSVLEEGTQESQLPEQDADNLKGGLSEGQSHTAESMVSEDYPHGDHNLDTESILQPNPSWPSNISKYLGDFDEGGYAHAEQPPVMGWTVGPQMLHPNYGISTEGSRFEPEVTDYRLTRKPVSVRNXPRNPLLMAGAAHDRSTAPFKTLLPPE

SEQ ID NO: 122086 - protein, 145 aa, Triticum aestivum
  Clone ID: PAT_TA_16504.pep
MRCPSSVTMPREGQRIKYSRELLLAVASSDACKVLPAGVDLSKHPDYVKLWVRAETWAARSVGGAAPGRGKSELPQRAREPESFQAGVGRKSKPCIRFFSTAGCRFGDNCRFIHYIPGGYVALEKLGILSGAAPALPPAQGVENP

SEQ ID NO: 122087 - protein, 108 aa, Triticum aestivum
  Clone ID: PAT_TA_16505.pep
TAALALDQRPREKMEGSGLNFLLDAVDRFPLREEFANNIEQPDPVPMAFLPNNEAGLAVHEDSNAGSGCAKQLGGDGTGREGLVSTGVRDASPDEVRAVDRPSHSGRT

SEQ ID NO: 122088 - protein, 330 aa, Triticum aestivum
  unsure (1)..(330): unsure at all Xaa locations
  Clone ID: PAT_TA_16506.pep
MCITGGTGSYGSWLVXLLLSRGYAVHATVRDPRDPKNAFLTHLVGAPANLXLFKADMLDYETVAAXFAGCEGVFHVATPVPDQKMVDPQKEMMEPAVKGTMNVLKACSAMQVHKLIVVSSIATNCFNPDWPRDQIKDETCWSDQEFCRQTENWYSLAKTEAEEMALEYGEKNGLHVVTFCPGLVFGPLLQHVAVNTSSKVLVYMIKGGPDTMNNKFFPIVDVRDIADALLLLYNKAGPSERYICSLDQMDLKDLLAIMKNMYPSYTYVDKMVDVDFNVGVTSEKLKNLGWKPRKLEETLADSIESYKKAGLLGVSDEWKPAWIVISDAWV

SEQ ID NO: 122089 - protein, 180 aa, Triticum aestivum
  unsure (1)..(180): unsure at all Xaa locations
  Clone ID: PAT_TA_16507.pep
XNLPYEXKLVDLANKPDWLFTINPEGKVPIVKLEDKWVADSDVITQVLEEKXPQPSLATPPEKASIGSKIFSTFIGFVKSKDTNDGTEQTLLSELTSFDSYLKDNGPFINGGTISAADLSLAPKLYHMEIALGHYKNWSVPDALAHVKTYMKTIFSMDSFVNTRGLPEDVIAGWRSKVMG

SEQ ID NO: 122090 - protein, 250 aa, Triticum aestivum
  unsure (1)..(250): unsure at all Xaa locations
  Clone ID: PAT_TA_16508.pep
SGRVRRLLPARASPPRRAFTARASAEPLEVCAKASITVPDRLGDCPFTQRVLLTIEEKNLPYELKLVDLANKPDWLFTINPEGKVPIVKLEDKWVADSDVITQVLEEKYPQPSLATPPEKASIGSKIFSTFXGFLKSKDTNDGTDQTLLSELTPFGSYLKDTGPFINGXNIFAADPPLAPKFYHMEIALRHYKNWSVPDALAHVKPYMETIFLNGFICQYSGPARGCHCLDGAQKSLVKSRIVKRDESIE

SEQ ID NO: 122091 - protein, 83 aa, Triticum aestivum
  Clone ID: PAT_TA_16509.pep
YVAAAVRVLHAEEPVEPAAVAATAAVRPAGATAIRAAPLTRVAEARGGARISQSRGLKVSGCHAVSSRLWRTKLKQEGWRGPL

SEQ ID NO: 122092 - protein, 211 aa, Triticum aestivum
  Clone ID: PAT_TA_16510.pep
HRSIHRRLSRQDVDGEEGEDRKPVIKPGVHVTLKVRNTDGHTVYRTMRRTEQLQSLMDFYYASVPAVQPGTGRFLYDGGRLRGWQTPAELQIEDGDEVDFFTELLGGGGTSALPKAERNMASPLAADLRFVTLKVVDQEQRLVRRTIRMNAELQIVMDAYYDEAGDVVRGTGSFWFENVRLRGARTPAYFKLQDGDAIDFFETQLGGGIPV

SEQ ID NO: 122093 - protein, 153 aa, Triticum aestivum
  Clone ID: PAT_TA_16511.pep
YQSAMDKASDSKPQFPLHLPPLLLLVVVGDPAHDVALGAEVLADVVLHLVDLGDAGLAQLHGGEDRRREVSLGRRDDDWLVIDGEHAAHLLHGQPLPHHPLAVHHPALRLRLPIGLRRRLLRRHLGDGRIRLSPLGLLPIFLVLVFQSPAAGS

SEQ ID NO: 122094 - protein, 370 aa, Triticum aestivum
  Clone ID: PAT_TA_16512.pep
AHACAYSCALKSHPRRVFSPFLLPGWAHPEWRATATTTTTAADQQHHPRKAVGLAAHDEPGDRSPIRIPRRSTGDYDVAIKVLYCGICHSDLHTIKNDWRNAIYPVVPGHEIAGVVTEVGKNVAGFAAGDRVGVGCMVNTCRACESCEEGAENYCARVVLTYNSRDRDGAVTRGGYSDLVVADARFVVRFPDALPLDVAAPLLCAGATVYAPMRRHGLGAPGSHVGVIGLGGLGHVAVKFARAFGAAKVTVISTSPGKREEALERLGADAFVLSTDAAEMKAAAGTMHGIVNTASAAASLHPYLALLKPHGKMILLGIPDKPLQVSAFALIGGGKTLAGSCMASISETQEMLDFAAEHGVAADVEVIGAG

SEQ ID NO: 122095 - protein, 115 aa, Triticum aestivum
  Clone ID: PAT_TA_16513.pep
GTRSRFYKTVIGSDKEAPSRCTPEVVNFILQQHFDAPSMWAIFPLQDLLALKDKYTARPAAEETINDPTNPRHYWRFRLHVSLESILEDKDIQASIKNLVTSSGRSFPGKKTDKA

SEQ ID NO: 122096 - protein, 653 aa, Triticum aestivum
  unsure (1)..(653): unsure at all Xaa locations
  Clone ID: PAT_TA_16514.pep
DLGVGEFPDLKLLVDWAVNSGFHLVQLLPINDTSVNKMWWDSYPYSSLSVFALHPLYLRVQALSDAIPADVKEEISKAKKELDKKDVDYEAALATKLRIAQKIFNLEKDKVLNSAPFXQFLSENIXWLKPYAAFCFLRDFFETSDHSQWGRFSQFSKEKLDKLVAADALHHDIIRFHYYVRCQLFTQLSEAAACARKNKVILKGDLPIGVDRNSVDTWVYPTLFRMNTATGAPPDYFAKSGQNWGFPTYNWEEMSKDNYGWWRARLTQLSKFFTAYRIDHILGFFRIWELPDHAATGLCGKFRPSIPLSQEELLGDGIWDFDRMSRPYIRQDMLEEKFGSLWTVVAANFLHEYQKHCYEFKEECNTEKKIVTKLNTSPEKSLWLEKEDSIRRGLFDLLQNIVLIRDPEDSTKYYPRFNLEDTSSFRDLDEHSKNVLRRLYHDYYFVRQENLWRQNALKTLPVLLNCSDMLACGEDLGLIPACVHPVMLELGLIGLRIQRMPSEPGLEFDIPSKYSYMTVCAPSCHDCSTLRAWWEGDEGTRSRFYKTVIGSDKEAPSRCTPEVVNFILQQHFDAPSMWAIFPLQDLLALKDKYTARPAAEETINDPTNPRHYWRFRLHVPLESILEDKDIQASIKNLVTSSGRSFPGKKTDKA

SEQ ID NO: 122097 - protein, 149 aa, Triticum aestivum
  Clone ID: PAT_TA_16515.pep
STCATKQRGRPILESNNLFTAGRRARPPSAHENKPQRNPAWAARRRPRRRPSQDTTDGSTLSSECASPCSLSSSGLLLLLCSPRRSIVERAESASVAMSSYTDGVQGRGRGSRWLGLVLLTLDGVGGALMATEPRGGSPVLEETRRPKP

SEQ ID NO: 122098 - protein, 104 aa, Triticum aestivum
  Clone ID: PAT_TA_16516.pep
MSSSARGEEEEDSKPAVAPLFVTLKVVDQKQNLVRHTIRTTDKLQAVLDMYYSKVPGVEYGTGTFHFDAVRVVRWRTPAELEMEDGDVIDFFERQEGGGLALAA

SEQ ID NO: 122099 - protein, 112 aa, Triticum aestivum
  Clone ID: PAT_TA_16517.pep
MSRRVPGKEEASNATVDLVGFNCPSCSQPLKPPIYQDTAGRLVCSCCFDKVTKTPQLGPPPRYSRCFTAERMLESVRLPCSNASSGCAAVTPYHRWADHESSCPHSPRFEYV

SEQ ID NO: 122100 - protein, 149 aa, Triticum aestivum
  Clone ID: PAT_TA_16518.pep
RNAPAPWRDHKPVGGRARHPDPRRGHPRRRPGAAAAPTERPGDPPVPGDGSPGGRRRGRRLQLQPARHRARRLRGRTGRHVRDRAPKVQRLPHQQPGPQTIKSHGGARSSSEGRSCAQDQALIPHVINRDVSSIQGRKQRISFPFSLSQ

SEQ ID NO: 122101 - protein, 140 aa, Triticum aestivum
  unsure (1)..(140): unsure at all Xaa locations
  Clone ID: PAT_TA_16519.pep
IIHLGHGARGVVHARYRHCRPQLRRHLGYARRKASVPSGVSGGCDITTARHSSGDLEAWSQEQHTRPAPMRSSTAPSLAKTHASASRGISDQSLADGPACTFCRTPXLRECDEWNYRPGIRGGGHHRVKGRIGETYVKKK

SEQ ID NO: 122102 - protein, 139 aa, Triticum aestivum
  Clone ID: PAT_TA_16520.pep
LNFIGAGLNVQLHGIHLLNHILQLFATNLVSNPCTVVTHLKWPVFTSTFYFLTQCSLNFLHVEHELAAVGDDGLAAGTLRVSQRGASDRPRQLQHPHYPLLDVVEALERAALDKGRHRRGRGRRRRAGRGVWRRRPTVG

SEQ ID NO: 122103 - protein, 113 aa, Triticum aestivum
  Clone ID: PAT_TA_16521.pep
THCTTPLQDQTSRPDGEERHFRDDNHRGRRSGGSELPKHVFAPLEPPVFQCAAGHVVCSTCHGDLPDKDRCGSCFVNSGFSRCFIPTSYGRCLALERVLQSVRVACPHGCAAT

SEQ ID NO: 122104 - protein, 196 aa, Triticum aestivum
  unsure (1)..(196): unsure at all Xaa locations
  Clone ID: PAT_TA_16522.pep
KTVHAAAAPSDPAGVLGRRRSGGDDDLGRPLARVGAWIASGGIARGRLAEERXSWRKNHPHGFVAKPETLPDGSVDLMLWRCVIPGKPGTDWEGGYFPLTLQFDDNYPTTAPSCRFPAGFFHINVYDSGVVCLSILGDAWKPSITVKQVLVGIQELLDDPNPNSAAQHRCYELYKKNMPEYRNKVREQTKRYPSRM

SEQ ID NO: 122105 - protein, 206 aa, Triticum aestivum
  Clone ID: PAT_TA_16523.pep
GLRASPGPGPLAAAAPGPLPDCCVAPPPAFARLLGSPLQGRDARAAAPAQSLAVRATAFDRRYGDLHLLCGCAPAPVWAQHAAGISSVPRRVLALSVRLSSIPRPMQAAVSLVAAGVTGDRSARVPSPLQIRTSRDASSISSPWWRGMCSALRTFPSPSWPGFSWALRLYLFHSCSLGSWGIRLNMYNTRLQGVNNIFISCCANLE

SEQ ID NO: 122106 - protein, 199 aa, Triticum aestivum
  Clone ID: PAT_TA_16524.pep
APSSGLVHCASLRERNLLADVSTLVERHRAAGARKRDLLRLLAASLRAMGHDAALCLSRWDKSSSHPAGEHAYVDVLLPAGSERGDRERVLVDVDFRSQFEVARPTKAYRAVLQRLPSAFVGKEDRLRLLVAAAADSSRASLKKRGLHLAPWRKPEYMRAKWLSPYEREAPPPAPDGPASASASELADTGEGGEDGAKA

SEQ ID NO: 122107 - protein, 96 aa, Triticum aestivum
  Clone ID: PAT_TA_16525.pep
MRRLAHAVSMGLFEKLNGTWLLTIVLAVFRKVVGRWGKESRVLTGRVDAVGPTSAAGQPPSIRHHGSLQLGEKRAGCSRGWMFRVDPSSACRVTSP

SEQ ID NO: 122108 - protein, 154 aa, Triticum aestivum
  unsure (1)..(154): unsure at all Xaa locations
  Clone ID: PAT_TA_16526.pep
SISSFPWKESSMGPSLRRRNSLCALLTSSPPASSDGGRAASLRAFLALASTDTPDAAISVAALIPMGRSAPCLLMLGGLSLSAKPSEPVCTCCSSPCPPHADVLRCTTVIPAVPPWVPADEFGNEKPAGLPLPLLDVTMKPASPTKEEVSLPSX

SEQ ID NO: 122109 - protein, 528 aa, Triticum aestivum
  unsure (1)..(528): unsure at all Xaa locations
  Clone ID: PAT_TA_16527.pep
MVHEPDDQSPPGMKSHEGRWGRMTAPRRSKPDREPGDGLQIEKQEEAGTRATLQVSEEKENGKQARTKILGNEGEGWEGPGTGSKVEMHXTDAILVWSKVDTSMDRGEPVMLKLGQEQVIRGWDQGLKTMKNGENAVLTIPPDLANGEAISPPAIPPNASLQFDVEVMSRASGKEVCKTVGTYKGFVVEGQKGEKPEDAEALNATYHTDLQLVSGKTVTLIGDDKRILKKVLKEGEGYERPNDGAVVRVGLIGKLDDGTVFRKKGHEGDEPFEFKTDEEQVIEGLDTTMLTMKKGEEASARIPPEHAFGSTETKMKQLILAVVPPNSTVFYEVELVSFDKEKESWDLKSNAEEXQAASEKKDEGNRRLRSWASSXAALDEIWTMEKKHNKYDISFSXDEXKQSKAVKISIKLNNAACKLKLKDYKEAEKLCTKVLELESTNVKALYRRAQAYTELVDLELAELDIKKALEIDPDNREVKVAYKALKDKLREYNKRDAKFYGNMFAKWRKTENAAGKQEAQPMAIDSTA

SEQ ID NO: 122110 - protein, 164 aa, Triticum aestivum
  Clone ID: PAT_TA_16528.pep
MEAQMSKFFESVGSFFSGGDNIPWCDRDIIAGCEREVAEAATEEQKNDSIMRLSWALVHSKQTDDVNRGIGMIEASLDKTTSPLQTREKLYLLAVGHYRNGNYVRSRQLADRCLEIQPDWRQASSLKKAIEDKIAKDGVIGIGIATTAVGLIVGGIAAALARKK

SEQ ID NO: 122111 - protein, 182 aa, Triticum aestivum
  unsure (1)..(182): unsure at all Xaa locations
  Clone ID: PAT_TA_16529.pep
TRPAAQAPVIEEHNRALLEVVGATGPLSSLCIPHRQEEEEPSGQDLPRTPIVVPLGEHRLIRPSEEDAAAEFGPKTVVTTLLKGVGATPAPSVLGLRPVASMPARRKKNLPPNFTPRRSARLCQQDDGMKKGPEQRAQTVLLQRMGLIENKEQMTQEALEAYLRLFDKPLAPQHIRXGGRPA

SEQ ID NO: 122112 - protein, 174 aa, Triticum aestivum
  Clone ID: PAT_TA_16530.pep
YFDCDTKNRKVDYHVLINDNNPNLNANTKKPKRSYVHRARASTPGAPEWRQALRRGRREGTGGGQRAAEGKGCPACGQLRRGAEQSGRGDGGDHGRAGRQERAWQGAHGGSERRRAQPTRHRRSAARLAGAAAASAQAGLRAPRGQGGSGGAGTSSTRVGECTRELQGIALPRA

SEQ ID NO: 122113 - protein, 275 aa, Triticum aestivum
  Clone ID: PAT_TA_16531.pep
MKHPSISYMQKIYPDEWTNFLERLGTNVKSEDIRYWASFRGQTLSRTVRGMMYYRKALRLQAFLDRTNDQELYKGPVGTEREQNKRNIHQSLSTELDALADMKFSYVISCQKFGEQKSNGDAHAQDIIDLMARYPALRVAYIEEKEIIVDNMPHKVYSSVLIKAENNLDQEIYRIKLPGPPIIGEGKPENQNHAIIFTRGEALQTIDMNQDNYLEEAYKMRNVLQEFVRHPRDQTPTILGLREHIFTGSVSSLAGFMSYQETSFVTIGQRFLADP

SEQ ID NO: 122114 - protein, 157 aa, Triticum aestivum
  Clone ID: PAT_TA_16532.pep
HASAKPRRAWLPTGGLKLLDTLHQALPSMSLIASDFSYLPDVSIPGDRAPLVSSKKDGKTLDHPNYLDARGDADIFFPTDFLLLEQIDHHCSGFSKDQMNRGAFKPVKSRRTIILDSAAFMEEFGLPLKTRTKDGYNPLLDDFRNTKFYLSVPTHNK

SEQ ID NO: 122115 - protein, 172 aa, Triticum aestivum
  unsure (1)..(172): unsure at all Xaa locations
  Clone ID: PAT_TA_16533.pep
MDGKLPPPNPNLPYREDCWSEGETAALVDAWGSRYIDLNRGSLRQPQWREVADAVNTRPGASARRRPPRTDIQCKNRVDTLKKKYKAQRARGGPSPWXFXRQARSPRRPNLSGAAXKKPPRPAGXPMXRXXKXAFRSPXPAXPGPPIXLPLAKXRXGSNSPGXDYSPKGVRN

SEQ ID NO: 122116 - protein, 101 aa, Triticum aestivum
  unsure (1)..(101): unsure at all Xaa locations
  Clone ID: PAT_TA_16534.pep
SRRLLLPRRRRTLQRPQXMGVFTFVCRDSGAEWSAKQHKGELEASAATPYDLQRQLVSAACAEDKSGGVQSSFTMVSPKAEEKKEEEKEESEDDLGFSLFD

SEQ ID NO: 122117 - protein, 152 aa, Triticum aestivum
  unsure (1)..(152): unsure at all Xaa locations
  Clone ID: PAT_TA_16535.pep
PTRPPTPPIPPPSSRRLLLLPRRRRTLQRPQXMGVFTFVCRDSGAEWSAKQHKGELEASAATPYDLQRQLVSAACAEDKSGGVQSSFTMVSPKSAIFQVVIGGASAGPIGGGAAAGGAAASGGAAAEAPKAEEKKEEEKEESEDDLGFSLFD

SEQ ID NO: 122118 - protein, 252 aa, Triticum aestivum
  unsure (1)..(252): unsure at all Xaa locations
  Clone ID: PAT_TA_16536.pep
MAETEYRCFVGGLAWATDDNNLQQAFSQYGEILDAKIINDRETGRSRGFGFVTFGSEESMRQAIEEMNGKELDGRNITVNEAQSRRSGGGXXGGGGGYPCARPGLLASHPTTKLQTPPPPPPPPPHAPETAGMGVFTFVCRDSGAEWSAKQHKGELEASAATPYDLQRQLVSAACAEDKSGGVQSSFTMVSPKSAIFQVVIGGASAGPIGGGGAAGGAAASGGAAAEAPKAEEKKEEEKEESEDDLGFSLLD

SEQ ID NO: 122119 - protein, 244 aa, Triticum aestivum
  Clone ID: PAT_TA_16537.pep
MATTISSLAAPPALHRRCCRSPASASTPARVSFRAAPPAGAAARARRRAAVKVLASSAVMEAPEELATRKLYVGNIPRTVTNDELSAMFAAHGTVVRAEVMYDKYSGRSRRFGFVTMSTAEEVAAAIESLNDTEVGGRKIKVNVTESFLPNIDTSAPESEPSFVDSQYKVYVGNLAKKVTTEVLKNFFSEKGEVLSATVSRIPGTPKSKGYGFVTFSSEEEVEAAVSTFNNAELEGQTIRVNRA

SEQ ID NO: 122120 - protein, 160 aa, Triticum aestivum
  Clone ID: PAT_TA_16538.pep
RPAPATPPPWPPTPIARRRYLLAHRGLPSGEMAPRHVPRGLRNLDTDGERRSRYNSYLREALEMDPDMSYVEVPDHLVAPKGRTKREIMKRAAILKCGSTGYGCPVGFSGYVTYPASEIEKQLLNSAGAGAAAAPPTGGRSCSSNRRCCGLNWSVRDTTR

SEQ ID NO: 122121 - protein, 290 aa, Triticum aestivum
  unsure (1)..(290): unsure at all Xaa locations
  Clone ID: PAT_TA_16539.pep
MSAATHSSRPLSVRVSREKECADNSMVEPMSPTGRVMEELGVCIVVVIGLGVPVNLPVFRAGIETELLTLFPRFRSIQVMDESTNNGKPRWVQTPVNMDDHIVVPRLDPEAVASDPEKAVRGXYVASLSLLPMDRRRPLWELHFLDFPSSEAASTVVLRLHHSIGDGTSITTLLMASSRSTADPARVPAMPPPPKRTGAIYQRQPRPPLSSGDYLALLAWFWSYVVLAWHTLVDVTMIVATILFLSDPRTLFTRAHVQESRSRKRFVHRTLSFDDVKLIKTAMNCTINDG

SEQ ID NO: 122122 - protein, 341 aa, Triticum aestivum
  Clone ID: PAT_TA_16540.pep
MRFSTLMFAWAAAVLLAVAAISAVADASPPPSKFLKVGFYKHTCPQAEDIVRDAVRRAVARNPGFAPGLIRMHFHDCFVRGCDGSLLINSTPGNIAEKDSVANNPSMRGFEVIDDAKAALEASCPRTVSCADVLAFAARDGAYLAGGINYRVPSGRRDGRMSIADEVLNNNVPPPTDEVAELVASFKRKGLSADDMVTLSGAHTIGRSHCSSFTQRIHNFSGEVGRTDPSIDKSYAAELRRQCPPSTDNPSDLTTVPLDPITPREFDNQYFKNVLARKVPLTSDQTLLTSPQTAGIVAFHAAVEKAWRAKFAAAMVKMGNVEVLTGHEGEIREKCFAVNHH

SEQ ID NO: 122123 - protein, 415 aa, Triticum aestivum
  Clone ID: PAT_TA_16541.pep
AHFFALNKQLNEEAASLDWTKSSGHVLSGRKIFDSYEDEFDLEPEAHVVGHKLGGGSSSLASARVLPGVAAYQRLLSASSTDMGSSPSSVTKSVEIYNVQGTQAEPDPDDAGQYFVQENVKTEPDPDDNDAMPVDVTIVTSGPAGFVASTEQNTIGYSEPVLDDVAKKSSVGYLEPDPDDSADVDMLNKDINGEHDNEPDPDDGTSEFVLESGNKMEVEMEPRTDSTVLKSEPDPDDSSSSIQTQKVSIDGKHVAEPDPDASSCGAVMTSGNKIQAEIGQSRNHSVLESEPDPDDNAANLKSDELQRIEEPVAALCSRLHKAIEMLRSQATPSEAASALQTLFKIIKNVIENPNDIRYRRLRKTNPHFQRSVANYKAAMEVLELIGFCEDVVSDEIGRAETYLVLKRNDPGLLWL

SEQ ID NO: 122124 - protein, 607 aa, Triticum aestivum
  unsure (1)..(607): unsure at all Xaa locations
  Clone ID: PAT_TA_16542.pep
MDEQRIARISVTWRXRQLEVDADPSCTVKEFGQLLQVLTNVKPETLKLIGYRNLQIKVPTLIRSSFQDPHSXSLTLKEAAVSEGKPIRMMGVFEDEIEEVSDNGKRSDLPIIGFEEEEQRLRQRSSGRPRVSLKLPQGQYIFCDFRTLHLPGVELNPPPSEALKRMHILACDPGIIAIMNKHRWRVGIMTEMAPVGYVGVSPKCILGFNKNMGEEISLRLRTDDLKGFRKYESIKKTLLHELAHMVHSEHDAHFFALNKQLNEEAAALDWTKSSGHVLSGLQGIEADPDPDDAGPYFVPVGDKPGPGPGALAAAPVVPAVAASRPPGCAASTELGTSRCYSEPVPDDVPKKISVGSSIQTQKVSIDGKHMAEPDPDASSCGAVLTSGNKIQAEIGQSRNHSVLESEPDPDDNAANLKSDELQRIEEPVAALCSRLHKAIEMLRSQATPSEAASALQTXQNYQESDREVLESEPDPDDNAADLKSDELQRIEEPVAALCSRLQKAIEMLRSQATPSEAASALQTLFKIIKNVIENPNDIRYRRLRKTNPHFQRSVANYKAAMEVLELIGFCEDVVSDEIGRAETYLVLKRNDPGLLWLAKSSLEVSMA

SEQ ID NO: 122125 - protein, 312 aa, Triticum aestivum
  unsure (1)..(312): unsure at all Xaa locations
  Clone ID: PAT_TA_16543.pep
AEWGRIRSLRDTGGRGTASAPPATPVEIEGAXGALPQWPGVEVXVVDLRRKGQGMLSQGRKKKQEKDRLRKIDENMTEEAEIGEETPERVEMPIIVKADVQGSVQAVTDALRSLNSPQVFVNVVHVGVGPVSEHDIDLAQACRACIVGFNVRDPPSAITLGATQANIKILLHKGFHPPRVEGGWLMVEEAPRSAESPISAEAAARHIFRPYGRSKSKGPDIKIAGCRITDGRFSRTGTMRLLRSGDVVFEGPCSSLKREKQDADTLDKGTDCGLVIEDCDEYQVGDTIQCLEQVIRKPKFVSTQSGAVRIEC

SEQ ID NO: 122126 - protein, 236 aa, Triticum aestivum
  unsure (1)..(236): unsure at all Xaa locations
  Clone ID: PAT_TA_16544.pep
MGSVPAATPSVREIWRAQRADGPAAVLAIGTANPAHCVPQDEFPDFYFRATNSDHLTALKGKFKRVFQKLGVEKRYLHHTEELLRAHPEFLDDEAASLDARLDIVATAVPELAAEASKKAISEWGRPAADITHLVVTTNSGAHIPGVDFRLIPLLGLRPSVRRTMLYLNGCFAGSAALRLAKDLAENNRGARXVPVVCAELTLMLFNGPKGGXLRXXXIQXGLFGKARALXXGXXP

SEQ ID NO: 122127 - protein, 302 aa, Triticum aestivum
  Clone ID: PAT_TA_16545.pep
MAHRVHPAPLLPLSTPPAPPPDNSDAAAENTPLRSTTAAAAPGASYIVHVPKDQVLRVPPPDRARRYRKLAARPARRRMLRRACCGACCALLLLLLLAAAFVGAVYLAFRPRAPSFSVTSLSVAGLLDASPARLDAAVRADNGANRKVGVDYRAGGEVRVSYSGVLLATGRWPAFYQPPRNVTLISMPLTGRDGLALTDDQRARLAEQAAAGAVPLTVEARVPVRVRLGKVLRTWTVDVWARCQVTVDRIDGETTAANQGARSSQPSGVVGDRRGQGGVNQARRLFDKITESNSIITAGEVD

SEQ ID NO: 122128 - protein, 248 aa, Triticum aestivum
  unsure (1)..(248): unsure at all Xaa locations
  Clone ID: PAT_TA_16546.pep
MATGTGGRPATMRAVQYSGYGGGSAALKYVEIPVPSLKKGEVLIKVEAASINPADCRIQKGLLRPFVPQFPFIPVTDVAGEIVEVGSAVQQFKVGDKVVSKLIFWKAGGLAEYVAASESITVPLPAGVSSADAAGLPVAGLTALQAVKAIGTKFDGTGVGSNILITAASGGIGSYAVQLAKLGNHNVTATCGARNLELVADIGADEALDYRTPEGAALKNSSGKKYDYIVNTTNGXKWSAFKPSLSSH

SEQ ID NO: 122129 - protein, 399 aa, Triticum aestivum
  Clone ID: PAT_TA_16547.pep
MAQVLHSLHEHASPQVLVLIVCPLVLLLLIVRFATSTATTRRADKLLDRLPSPPYKLPLIGHLHLVGSLPHISLRNLAKKHGPDVMLLRLGAVPSLVVSSARAAMAVLRTHDHVFASRVQSAMTDILYYGSTDMGFSPYGDYWRQIRKITATHLLSSKKVGSYRLARENEVQDAMARIRTAAARSTAVDLSKLLSSFTTDIVCHAVSGKSFRGGGRNELFRELVETSSKLIGGFNLEDYFPKLARLDVVRRMVCARAERINKKWDDLLDEIIDDHAKNTMLDHEINQDRETDFIDVLLSIQQEYNLTRENVKAVLVDMFIGGTDTSFIVLDCAMAELIQNPEVMTKLQAEVRSMAEGKEMVTEEDLSGMIYLKGVIKETLRLHSPVPLFLPHLSTADCD

SEQ ID NO: 122130 - protein, 189 aa, Triticum aestivum
  unsure (1)..(189): unsure at all Xaa locations
  Clone ID: PAT_TA_16548.pep
RHEAKNECTAAAGFKWMLNQGLVANQAAVVDYFNQRGVSVIFLFRRNLLRQMVSQLANNHDRYLKQLKGKHKAHVHTKDEANILAKYKPRLNTTTLMWSLKQADDYTRKALENLKSVRHITLYYEDLXQNRTMLVEVLDFLKVPVRKLVSRHVKIHTKPLSDQIENWDEVYNALNGTKFESSLNADYRT

SEQ ID NO: 122131 - protein, 116 aa, Triticum aestivum
  Clone ID: PAT_TA_16549.pep
GLSCEHMGFNTESLRGLCSDGLWKYAVFWSIKSEKHGILTWEDGYVDKMTKNTRDHYGDPADSDNQIITLTWSNDGQYQSYPFCPIEAALLRMSSHSYSLGEEIIGKVAIMGRHCW

SEQ ID NO: 122132 - protein, 183 aa, Triticum aestivum
  Clone ID: PAT_TA_16550.pep
DDQPKATEWVLDSGCTNHMTGDKNLLMDAPLSPSPREHIILADKGKSQVLGLGKVAISKDRHMDKVMLVESLEYNLMSVLMLCDLDMVVVFGKYRCVVILEADNSKVSEGFRRGDLYIVDFSTGPQPSVCLLAKASEGWLWHQRLGHAGMRNLYTLAKKKHVMGIERVQFKKDHLCGSSEARK

SEQ ID NO: 122133 - protein, 345 aa, Triticum aestivum
  unsure (1)..(345): unsure at all Xaa locations
  Clone ID: PAT_TA_16551.pep
GDGAAFSASGVARPHRGREAATQFARGFSYITDAVVPLQLVKCHFYICLGNVGTTVKLLRLREQQEKINEVRKQLGMNXSSVAIQGFLSXASIREDSFELEIWNVQKSSKMLKSAVKWRAAYKPEMISWEEIALEAETGKIYRADYKDKLGRTVLVLRPGLENTTSGKEQIKYLVYSLEKAIMNLTDDQEKMVXWIDFQGWTMGSTPLKVTRETVSVLQDCYPERLGLAILYNPPRLFESFYNILMPSLRRDPSDMVCCGYSYPQASETRMAEVFDMXLDSAFGGRNLATFXYSSYAEQMKEDDXKMQSNDASSDASSEASFYSGTDSPKHEDGGHGATKKACAT

SEQ ID NO: 122134 - protein, 176 aa, Triticum aestivum
  Clone ID: PAT_TA_16552.pep
QEIFQISVPLPHPLRQNRQIVIHYQLKGGGYFQNLSLKKLLGASSNLNTDTACGSVVSSTGPLAGCFSGCELPGYTLQQDSSYSACKEQVPPLNFPSSSYTSENVPDGASKAIPVSLANLSMDDSCRLHTANSKVGQVTNPEGVKVIKKRARPGESTRPRPKDRQQIQDRVKELRE

SEQ ID NO: 122135 - protein, 184 aa, Triticum aestivum
  unsure (1)..(184): unsure at all Xaa locations
  Clone ID: PAT_TA_16553.pep
GTRPPAPPSCSAPPPRCRAASPPPPAGAAAAPRTPATASWRLPPPAPRPAXPPRAARRPPRAGAPAAPPAPAAATPSRPPAAPSTAPLRVVLASGAAPLASPPAPSPPPPRTLFPPCGGESGRSTPPRPPCPVGSFGCWRVLWSFLSLFAVPGAPPTGFSGCSFVREGKVLREGQPPTSLCQAL

SEQ ID NO: 122136 - protein, 169 aa, Triticum aestivum
  unsure (1)..(169): unsure at all Xaa locations
  Clone ID: PAT_TA_16554.pep
MSTAPPQANHQQQQQQRHRRLRVRRVFDLFDHDGDGVITAAELSGALGRLGLALGAQADAPVAAPGAPGMPGLRFADFEALHAELAGGGEEDEEAEMREGVRRVXDENGDGYISAAELQAVLXRMGVPEAACMARVQGMIAAHDRDSDGRVDFHEFKAMMAAGNVNVRA

SEQ ID NO: 122137 - protein, 160 aa, Triticum aestivum
  unsure (1)..(160): unsure at all Xaa locations
  Clone ID: PAT_TA_16555.pep
WAVASVTSLLELSTPTHIEPDPGLRKQIGDYPTPEIRDAVRREYLKKGPCQPYGHDFPRNTTDKRVFREEWFDESDVFCSCGSLANLALKLVETKEHLHFPLVYRLITLALTXPVATASVERVFSAMNIIKTDLRNKISDDWVNDLMICYVERDIFAGIV

SEQ ID NO: 122138 - protein, 205 aa, Triticum aestivum
  Clone ID: PAT_TA_16556.pep
LIEMAGNNNVKEKLRKLPLLSLRRSPKDCTLLESRILPNGQESVESATQKLEAFKLQLRKTDNATLAENGTEGTLNTSMPEKRNRWSIAKSWTPCPLGMIPCSYSSTAVLPVLDVIDDELKHDTAEHGDFEPDGEIEIFDCYAHPEQHLDGEGILEMPRSPPEHGISDSPVLSARRRAAGRVGGVWKKVTEEELLSIKSSMKILL

SEQ ID NO: 122139 - protein, 191 aa, Triticum aestivum
  Clone ID: PAT_TA_16557.pep
GTRPPCWTHEETLALIEAYRDKWEALKKGNLRAADWDEVAGAVTARCGRFPTATYGRGRGCRHKIEKLRKRYRAERTRSMGRSKGPKWPFFPLLHDLAGGGVPDASPNPIIKIKPRGNATPASPSPVSSPSSEDAGRSRSLHGLISNGGGGSGLRFTIPKASRTKPGVPREARPDRDRGEDDPEAEAMAEV

SEQ ID NO: 122140 - protein, 242 aa, Triticum aestivum
  Clone ID: PAT_TA_16558.pep
RGGCIMGYYKSLLPFHSLLKLPPESGEGMLFNSRDIHHWQSLNETTKHVIRNKPVKRDIPTVTPISFSRTSPSLTSTRCKNKHQLKILLLLKKTYETSEEEAGRVLPDKLIKFRISPAPSYTRCKNKQQLKILLSPKEDETKKIIGSICKSFSSSVDIHSSDKSQFSSSKSFTRCKNKQQLKILLLKKVEKKEIEVERLSDPSVTNPSHIISRISFSERYTRCKNKQQLKILLSLKEKRRKR

SEQ ID NO: 122141 - protein, 118 aa, Triticum aestivum
  Clone ID: PAT_TA_16559.pep
SARGNDLILVHNHMLEAKLEELRRGLPRAPFTAVCAPGPPLGLITAPTQNGFDKETVLEACYPVFISGSAAVPCLDPSRHVNFDGLHMTEAAYKLMARGMLDGPFAAPPIMSTCNHSC

SEQ ID NO: 122142 - protein, 126 aa, Triticum aestivum
  Clone ID: PAT_TA_16560.pep
MTSSTSLRIFNYQAWVILLPTIVKVGLRKEANPLSPTYFYGGGKGDFLRPAVAKNTQGVRTINITISARNPCFGNRWQQLLINSIVGYDTILTNSLVNSPGQGYLYNFQTKELYDLSYGHEPPTGP

SEQ ID NO: 122143 - protein, 80 aa, Triticum aestivum
  Clone ID: PAT_TA_16561.pep
GKREGGCVVVSESRRGAVAGAGACRCTWRARCWGLAGWVDSFVLTTTLYSQCGCSSFFSLLGSRIDRPNTYVALFLPSLQ

SEQ ID NO: 122144 - protein, 128 aa, Triticum aestivum
  Clone ID: PAT_TA_16562.pep
EYKVVRTKESTQPARPRRRALHVQRHAPARRRLLSTRRHLPPSRFLCCIYTAPRSRSLAAKKSSIPLLSISGSLTVSVFALLRTGPACRRRRAGSRGHGGRRRGRSRAGRPRAASCRGRCTCSGCRRS

SEQ ID NO: 122145 - protein, 240 aa, Triticum aestivum
  unsure (1)..(240): unsure at all Xaa locations
  Clone ID: PAT_TA_16563.pep
MAMVAQAGFGLTRVVMLVGAGVAGSVVLRNGRLSEILTEIQEFLEKGEMGKXGGGGADHGINDALNEVRQLAMQVRNLGSPRSITVLSGGSGQTGVSGLIVPAATVGALGYGYMWWKGISFGDLMYVTKQNMANVVSSMTKHLEQVQSSLAAAKKHLTQRIEKLDDKLDQQKALSGQIKDDVTGARLKLENIGSEIKNIKELVWGLDEKMDSMEAKQNFSCAGXVMYLCQFIEXSXWEAP

SEQ ID NO: 122146 - protein, 327 aa, Triticum aestivum
  Clone ID: PAT_TA_16564.pep
MGMPAVRRRERDAEAELNLPPGFRFHPTDDELVEHYLCRKAAGQRLPVPIIAEVDLYRFDPWALPDRALFGTREWYFFTPRDRKYPNGSRPNRAAGNGYWKATGADKPVAPRGGRTMGIKKALVFYAGKAPKGVKTDWIMHEYRLADAGRAAASKKGSLRLDDWVLCRLYNKKNEWEKMQLQQQGGEEMMVEPKAENTASDMVVTSHSHSQSQSHSHSWGEARTPESEIVDNDPSLFQQAAAFQAQSPAAAAAHQEMMATLMVPKKEAADEAGRNDLFVDLSYDDIQSMYNGLDMMPPGDDLLYSSLFASPRVRGSQPGAGGMPAPF

SEQ ID NO: 122147 - protein, 124 aa, Triticum aestivum
  unsure (1)..(124): unsure at all Xaa locations
  Clone ID: PAT_TA_16565.pep
ARRRFVGHIKDDVTGGTXLKLENIGSEIEEHQRIGSGDWMGKMDSMEAKQNFSCAGVMYLCQFIEQSGGNLPERLEGIEPSAKRFETIGIQGLQLAIETGNFSDFSNPDSTDKISRSNSLKSAN

SEQ ID NO: 122148 - protein, 279 aa, Triticum aestivum
  unsure (1)..(279): unsure at all Xaa locations
  Clone ID: PAT_TA_16566.pep
FGTRNDPKSDQTATGEHHATASQTVVVDTSSDIPWVQCLPCPIPQCHLQKDPFYDPAKSSTFAPIPCGSPACKELGSSYGNGCSGSTDQCKYTVNYGDGRATSGTYVTDTLTMSPTILVKDFRFGCSHXXVRGSFSDQTAGVLXLGGGGGSLLEQTAGAYGNAFSYCIPHPSSSGFLSLGGAGGGXSKFARTPLFKNKHAPTFYIVHLEAITMAGKRLGVPPATCAGGAXMDSGAVVTQLPPAAYAALRAAFRSAMAAYGPLAAPVRNLDTCYDFTRFP

SEQ ID NO: 122149 - protein, 209 aa, Triticum aestivum
  Clone ID: PAT_TA_16567.pep
MASALRALHHRLPRSLHHSNPLSTSASPHDLRELLRIQRILGDPAATTQPTQTQQRPRAAATADLHRLLHRAAGLTTAEATSLLRRVPNTHRLGHLLQELRGLRLPAGEIRNALGSDPDGLLSMEPGEPSRLVELLDELRCRAPIKDQVLSHGVLSAAIAARRRVELLHERGLSRRDALRVISVEPRAILYSLDDVERKVEFLVGRMGF

SEQ ID NO: 122150 - protein, 119 aa, Triticum aestivum
  unsure (1)..(119): unsure at all Xaa locations
  Clone ID: PAT_TA_16568.pep
RPKLSTTKEKLSLAVTKGKSLXRDLDSLKETLAEKSGELERCMVELEQRSDALQESEGRLEELKMLLDEKSGEHEKCLDELRETYNAWEAAKASIEQLNDVNTTLTISDGFLQRIGEVM

SEQ ID NO: 122151 - protein, 156 aa, Triticum aestivum
  Clone ID: PAT_TA_16569.pep
MAFWGVEVKPGKPYTHSYNPSHGRLRICQATLGSCDAATRTVVQCIVGNKKPIILCSLNPKLAEMCHLEIELEEVDEVLFSVLGQSSVHLSGYYLRPGSRGNAGDEDSESYGEDVGESDTDQDYEGSEDSYESDFIDDGDNEVPEDSDVSDSMDGW

SEQ ID NO: 122152 - protein, 72 aa, Triticum aestivum
  Clone ID: PAT_TA_16570.pep
GGYVDAYLFERLFVRVMRVLVQRILLIAIWGVLRSALSLVCSPLALPPFRSFGFFGHSIEDYIRSKMSESTL

SEQ ID NO: 122153 - protein, 212 aa, Triticum aestivum
  unsure (1)..(212): unsure at all Xaa locations
  Clone ID: PAT_TA_16571.pep
SPPDASPRLSPRATASVRGVADRMLRAGYGPELAQVYVTARRDALAEAVAHQLGAAEPVAIEEVLRMEWAVLDQKMRRWNHAIRAVVRTLLAGERRLCDEVFASDEELGHECFADVSRGCVLQLLGFADAVAMSARATEKLYRTLGMYEALADVAPELEALFTGDARELFAAEVSAVAGGEGSTLRRTIEEFGSAIQGESSRRXVQGGEDHP

SEQ ID NO: 122154 - protein, 173 aa, Triticum aestivum
  Clone ID: PAT_TA_16572.pep
PEFPALAKRPQPGYLTPPSPPAQRQLKSLSYHQNLLEPSAYQDGDLPAHRGGRRFRSNGRTYWATAYAPGLNTQVVGYHQAFHVTAYSRSVPNPESLHLPWLVRRFTGAAHQLLGGHNSLREGALADTTGPITVARGKIHDIDLQQNPATQSIPELIIRASNAHPITIFVRGS

SEQ ID NO: 122155 - protein, 136 aa, Triticum aestivum
  Clone ID: PAT_TA_16573.pep
PRAAREDCTVMGYDIPKGTNVYINVVAICQDPEYWSSPAEFKPERFENNTVNYNGTYLEFIPFGAGRRQCPGTQFGTSLVEMVLTNILYHFDWKLLDGASLASFDMSEKFGLTLHRRNDLKLRATPRVLSKATPLE

SEQ ID NO: 122156 - protein, 339 aa, Triticum aestivum
  unsure (1)..(339): unsure at all Xaa locations
  Clone ID: PAT_TA_16574.pep
TRAADMLVDSFGRFYNYLRIFLTVRCNLRCKYCMPAEGVELTTKSELLXHDEIIRIANLFVTSGVDKIRLTGXGEPTVRKVLEGYLLVIXLASTGLKTSAMTTNGILLSRIAHXTSLLMFDLLCLCLLMXCLECQVAGPLCRDTRYCKSIVSIDTAIQLXYDPVQINCVNMRGXNDDEICDFVELTRHKPINVRFIEFMPFDGNVWNVKKLVPYAEILDKVRQRFKGVERLQDHPSDTAKNFKIDGHXGTISFITSMXTEHFCAGCXNRSPLQPEGNFKLCLFCALRGELERAYSSWLWMMLGLKEIISAXRLKRKKAKHAGMFDIAKTANRPMIHIGG

SEQ ID NO: 122157 - protein, 229 aa, Triticum aestivum
  unsure (1)..(229): unsure at all Xaa locations
  Clone ID: PAT_TA_16575.pep
MAKGFLSSSSSRARRRVAWVLLCLCMLLCTVHGGSSSRKVYIVYLGDVKHGHPDHVVASHHDMLTTLLGSKEESLASVVYNYKHGFSGFAAMLTPEQAEQLAEFPEVISVEPSRRHKASTTXRSWDFLGLNYQMSGSALPHGTNYGEDVIIGVIDTGIWPESRSFSDEGYPPIPSRXXKGMCQLGPDWDKNNCSRKIIGARFYDTGVSEEALKTDSLSPRDYSGHGTHC

SEQ ID NO: 122158 - protein, 439 aa, Triticum aestivum
  unsure (1)..(439): unsure at all Xaa locations
  Clone ID: PAT_TA_16576.pep
GDIHIAAPSHLRHQPVGAALQQLLCVSSQLLCENTSPALQQPSPASSWCLPCSTASSRRSPSYLARSSKLLLLSSEIQLAAASLVGCCSCLWLSAAHLLSLPAAAIKLGVSSCWPLTTMARNDFGFGSLIIDIKLDGSNYREWAFSARTVLRTAGFVSHTDDPPSPNDDAARKSWQKIDDRVMGVLILGVEPSLXMSLEHHTSAKEIWKYFEXRYLQPSSALHFSLLQNLHNTRQPEDMSIEEYYGAFTRITGQLGSMVPKGNSGCQSCAAKEKYDHQTLMFQFVMGLKPNFENIRTQLLGRTTPPTLTEALASLIAEETRLRSLGTTSAQTLHTSVLAFPQRPGASKATPSAVICSFCKKTGHHRDGCFKLHPELLAEFQARRALNQQRRAXAPYQQQARVLLILSPAVAATNLGGGASSSDIVLPATREPKMPGMGT

SEQ ID NO: 122159 - protein, 276 aa, Triticum aestivum
  unsure (1)..(276): unsure at all Xaa locations
  Clone ID: PAT_TA_16577.pep
RHEGEVKVIHEAVMDLIRSRKKERFLVNAGDERNDLLSRMIDCGYADEDIRDMVISFIMAGRDTTSSALTWFFWLLMRHRDVERDVLEEITSMRRDSSNGTYAGEGFDLDDFRRMRVLHAALSETMRLYPPVAWDSKHAAAADVLPDGTRVWPGDRVTYFQYGMGXRMEAIWGSDAGEFSLERWLALPADGNAASGGVSPFKYPVFQGGPRTCXXREMAFVQMKFVAGAILRRFDLRPVXRAAXPAFLPLLTSHMXGGLKVTVXKRKVETENRSFF

SEQ ID NO: 122160 - protein, 141 aa, Triticum aestivum
  Clone ID: PAT_TA_16578.pep
PGEPPSPPPPRSAGPRGSLLPWPGSPRGGGGGLLVPPRRLFHSTPPARYSASSSSQISPDQFTEMAWEGVAGAVEAARLSKQQIVESEHLMKALLEQKDGLARRIFSKAGIDNTSVLRATDDFIAKQPKVSGDTSGPVVGQ

SEQ ID NO: 122161 - protein, 151 aa, Triticum aestivum
  Clone ID: PAT_TA_16579.pep
MEGAAPAPAAAAAEVKNPRCFMDITIGGEMEGRIVIELYASVVPRTAENFRALCTGEKGVGASGKPLHYKGSYFHRIIKGFMVQGGDFTAGDGTGGESIYGSKFEDENFILKHERKGILSMANSGPNTNGSQFFITTTRTPHLDGKHVVFA

SEQ ID NO: 122162 - protein, 302 aa, Triticum aestivum
  unsure (1)..(302): unsure at all Xaa locations
  Clone ID: PAT_TA_16580.pep
MALCRTAPANSSCFHPRAVASSPSSLSVGTKVFVGLKAQTRLGSLGFWSSCPNVNARFYTAVNRRVSLGLSNKRATRARISMMPVGTPRVPYRTPGEGTWQWLDIWNALYXRERIIFIGDTIDEEFSNQVLXASMLYLDSVDDTKKILLYINGPGGDLTPCMALYDTMLSLKSPIGTHCLGFAFNLAGFILAAGQKGSRTGMPLCRVSLQSPAGAARGQADDIENESNELNRIKNYLYGKLAEHTGHSVEKVHEDLSRSKRFDAEGALEYGIIDRIVRPSRIKKEGGSTTGQKKELRNLGLG

SEQ ID NO: 122163 - protein, 249 aa, Triticum aestivum
  Clone ID: PAT_TA_16581.pep
MSTPRFYTAVNRRVSLGLSNKRATRARISMMPVGTPRVPYRTPGEGTWQWLDIWNALYRERIIFIGDTIDEEFSNQVLASMLYLDSVDDTKKILLYINGPGGDLTPCMALYDTMLSLKSPIGTHCLGFAFNLAGFILAAGQKGSRTGMPLCRVSLQSPAGAARGQADDIENESNELNRIKNYLYGKLAEHTGHSVEKVHEDLSRSKRFDAEGALEYGIIDRIVRPSRIKKEGGSDHRSEEGAAEIWGLG

SEQ ID NO: 122164 - protein, 298 aa, Triticum aestivum
  Clone ID: PAT_TA_16582.pep
MALCRTAPANSSCFHPRAVASSPSSLSVGTKVFVGLKAQTRLGSSESSCPNVNARFYTAVNRRVSLGLSNKRATRARISMMPVGTPRVPYRTPGEGTWQWLDIWNALYRERIIFIGDTIDEEFSNQVLASMLYLDSVDDTKKILLYINGPGGDLTPCMALYDTMLSLKSPIGTHCLGFAFNLAGFILAAGQKGSRTGMPLCRVSLQSPAGAARGQADDIENESNELNRIKNYLYGKLAEHTGHSVEKVHEDLSRSKRFDAEGALEYGIIDRIVRPSRIKKEGGSTTGQKKELRNLGLG

SEQ ID NO: 122165 - protein, 164 aa, Triticum aestivum
  Clone ID: PAT_TA_16583.pep
GCLAALRLPVSLAPTSRRRRRRRRPRSRKMPFKRFVEIGRVALVNYGKDYGRLVVIVDVVDQNRALVDAPDMVRCQMNFKRLSLTDIKIDIKRIPKKATLIKAMEEADVKTKWENSSWGKKLVVQKRRASLNDFDRFKVMLAKIKRGGAIRQELAKLKKEVAAA

SEQ ID NO: 122166 - protein, 135 aa, Triticum aestivum
  Clone ID: PAT_TA_16584.pep
MPFKRFVEIGRVALVNYGKDYGRLVVIVDVVDQNRALVDAPDMVRCQMNFKRLSLTDIKIDIKRIPKKATLIKAMEEADVKTKWENSSWGKKLIVQKKRAALNDFDRFKVMLAKIKRGGAIRQELAKLKKEVAAA

SEQ ID NO: 122167 - protein, 171 aa, Triticum aestivum
  Clone ID: PAT_TA_16585.pep
AGRVGLPCLAALRLPVSLAPASRRRRRRRRRPRSRKMPFKRFVEIGRVALVNYGKDYGRLVVIVDVVDQNRALVDAPDMVRCQMNFKRLSLTDIKIDIKRIPKKATLIKAMEEADVKTKWENSSWGKKLVVQKRRASLNDFDRFKVMLAKIKRGGAIRQELAKLKKEVAAA

SEQ ID NO: 122168 - protein, 157 aa, Triticum aestivum
  unsure (1)..(157): unsure at all Xaa locations
  Clone ID: PAT_TA_16586.pep
VTSGPRAAGSPRLAVSPHAAAAKMPFKRFVEIGRVALVNYGQGXYGRLVVIVDVVDQNRALVDAPDMVRCQMNFKRLSLTDIKIDIKRIPKKATLIKAMEEADVKTKWENSSWGKKLVVQKRRASLNDFDRFKVMLAKIKRGGAIRQELAKLKEVAA

SEQ ID NO: 122169 - protein, 171 aa, Triticum aestivum
  Clone ID: PAT_TA_16587.pep
GTGPPLGVDGIDKLDIEFPGAHPSPRLAVSPHAADAKMPFKRFVEIGRVALVNYGKDYGRLVVIVDVVDQNRALVDAPDMVRCQMNFKRLSLTDIKIDIKRIPKKATLIKAMEEADVKTKWENSSWGKKLVVQKRRASLNDFDRFKVMLAKIKRGGAIRQELAKLKKEVAA

SEQ ID NO: 122170 - protein, 123 aa, Triticum aestivum
  Clone ID: PAT_TA_16588.pep
MSEKKRAPGPRKDEVVTREYTVNLHKRLHGCTFKKKAPNAIKEIRKFAQKAMGTNDVRIDVKLNKHIWSSGIRSVPRRVRVRIARKRNDEEDAKEELYSLVTVAEVPQEGLKGLGTKVVEDED

SEQ ID NO: 122171 - protein, 111 aa, Triticum aestivum
  Clone ID: PAT_TA_16589.pep
SIRQTGGLVLNLHKRLHGCTFKKKAPNAIKEIRKFAQKAMGTNDVRIDVKLNKHIWSSGIRSVPRRVRVRIARKRNDEEDAKEELYSLVTVAVVPQEGLKGLGTKVVEDED

SEQ ID NO: 122172 - protein, 123 aa, Triticum aestivum; identical to SEQ ID NO: 122170
  Clone ID: PAT_TA_16590.pep

SEQ ID NO: 122173 - protein, 160 aa, Triticum aestivum
  Clone ID: PAT_TA_16591.pep
PLAFLPAHPSPRLAVSPHATAAAAAKMPFKRFVEIGRVALVNYGKDYGRLVVIVDVVDQNRALVDAPDMVRCQMNFKRLSLTDIKIDIKRIPKKATLIKAMEEADVKTKWENSSWGKKLVVQKRRASLNDFDRFKVMLAKIKRGGAIRQELAKLKKEVAA

SEQ ID NO: 122174 - protein, 407 aa, Triticum aestivum
  unsure (1)..(407): unsure at all Xaa locations
  Clone ID: PAT_TA_16592.pep
TRIALLLVHLHLLLCGHGAAAVAATATPPPLPVLPVPSYAQLQWQLSEMALFIHFGPNTFTDSEWGSGHADPAVFAPSELDAGQWARVAAEGGFGRVVLTAKHHDGFCLWPSALTDYSVAASPWRGGAGDVVGELSAAARAEGIGLGLYLSPWDRHEPVYGDTVAYNEHYMGQMTELLTRYGDVEEVWLDGAKGDDTYMDYMFDAWFALIHQLQQRVVIFSDAGPDTRWVGDEAGIAGRTCWSPFNKTVVTIGHIIPEYSQSGDQFGEEWVPAECDVSIRPGWFWHASEKPKSAVTLLDIYYKSVGRNCLLILNVPPNSSGLISDEDMQVLQEFTEIRRTIFSHNFAANGTVTASSVRXGGLNNLQFAPSSVLRDSIYSYWAPQEGQTSWEMLFDLGRSTSFNLLQL

SEQ ID NO: 122175 - protein, 148 aa, Triticum aestivum
  Clone ID: PAT_TA_16593.pep
FGTRGAGHRARREAGMALYHVSVAGMNRSKIARTPGVVRTLLATAEARDRGNEAYADAAALRKLAVMILANLAGCPEGRAALMDGGAVAAIVGLMRSGSAAPGSAEEEYCISALYGMSRGSLRVRGLARAAGVEAALMPVGRERRRGR

SEQ ID NO: 122176 - protein, 201 aa, Triticum aestivum
  unsure (1)..(201): unsure at all Xaa locations
  Clone ID: PAT_TA_16594.pep
SARGKIVVAISRRKQTAELCRSLGLTERIPGVINELIKKHRQIDAVQFIQAFGLSEAFPPAPLLKAYVDEIKGSLNNKGDAGATPSVDDLKNRELVALRAIIKCIEEYKLQKECPLGPLQKRINELKPKGAKRPSGSANRNYAKKQRVSGSGTSAPRRPTGAAAPRRPASSXVGTWQQRAPPPPVPAYPDRYGVRPPDRYH

SEQ ID NO: 122177 - protein, 148 aa, Triticum aestivum
  Clone ID: PAT_TA_16595.pep
RPRTRGVSPILQSYGIAAIAPFSHRLAFDDLPVDIQRLRCKVNFEALIFVPYIISLGRTLEKRLRSPVQGHSTEFAQQVIEENTDQDGKYAVLHLRFDKDMAAHSACDFGGGRAEKLALAKYRQVIWQGRVLNSQLSDEELRNTGRCR

SEQ ID NO: 122178 - protein, 324 aa, Triticum aestivum
  unsure (1)..(324): unsure at all Xaa locations
  Clone ID: PAT_TA_16596.pep
MSATSALGSPATSAAAAPLPDLSIPYDLATRGQWQALLANLAHPSHAHHPHHGLLLSALSALSLAKLRRYPDGAALLASLHPDPGCPPPPFLLRLLHALLPLFFPDRPLALDRXLYTLLSSVRARPDSQHPEWRRRDXLVASVLASDHLAHREFDVALALVAELVAREPDNPVLLSRLAYAHLQIGNLAAASAVFQHVESVAAGDSSHDSLLSRNRALECIVAKDYAAAVREYELCIEADPADAIAVNNKALCLMYSRDLGDAIKVLEGALETMPTAALNETVVVNLCSMYELAFVNHGEVKRTLADWITRVAPDDFDKSCTRM

SEQ ID NO: 122179 - protein, 144 aa, Triticum aestivum
  Clone ID: PAT_TA_16597.pep
PRCKAVTSAGTADARAGGGVRGPAFHRAGQQPPPPPAAGTAEDPLVGPAPAGTPAAHDDSSEGLAIPDTPLAFPKDAEHDEAEVAEDEAKASVQHKVDVDPPPCSCAPPAAGPPPAASSSPSALSRSQLCRRSWAPPPPARGSL

SEQ ID NO: 122180 - protein, 262 aa, Triticum aestivum
  Clone ID: PAT_TA_16598.pep
RGASPGGPGRAGDDRSIEAAVAVAVEDENTRKVFVVVPAERRAGRSTLSWALGHLCGGATATTVVVTHVHVPPQMIPVMGAKFHASKLSSEQVSSFRRMEPDKAAKMLDHYVHLARNTGGWCAELVIGFLPLPPPLVARIASGGSAPPVVPAAAHRQDPTYLACPVCGPAASFLQRAGPACDISSLCLVHLICSRDSSVPGASPPVTAPLLPNPGHEVLRLSTHQEEHDDDSEVELGFHDELREACRAAEDLMNRALSESHR

SEQ ID NO: 122181 - protein, 129 aa, Triticum aestivum
  Clone ID: PAT_TA_16599.pep
MAAALSPHLAATLPSLRSPARRPSPAASLLPPRGARIALRRSSRHPYPLSRNSGWFENATKKKALFASDSDSPNTEVSKQSSTGDASASPDGPPVLTILAGIVVFFLLLWVIGSIFTWIVGLVFGAAKS

SEQ ID NO: 122182 - protein, 110 aa, Triticum aestivum
  Clone ID: PAT_TA_16600.pep
MLSFITDESLCFFKKKILVNHSSGEQKSQATSTAPDEVGHDGELLDGIVAAGLKQEVDMLLALGLVELDHSVPPARLDPLRVRARPVHEPAELRRGDQHVAAPELAPLPG

SEQ ID NO: 122183 - protein, 237 aa, Triticum aestivum
  Clone ID: PAT_TA_16601.pep
ACEAVGLPRFGGCGAQRKPDTCHPSQYSQLFKSACPKSYSYAYDDATSTFTCNHTDYTITFCPQSYPSRSNPYSGKPNKHALRRPSHEQLEDDVWLASLNRASGAAACSAAAGSPAARAHAALAVPAAALRAPPRGGRPRFGGVSPSLGVICRVFCRIKRGSEHERKRRGWPLRGAVVLVHVLHAAPPGGQCSWRVFWFVIVLYPLFGILVPRGLFVFVRSWFVGLPDQCSTVKYRH

SEQ ID NO: 122184 - protein, 230 aa, Triticum aestivum
  Clone ID: PAT_TA_16602.pep
RSHGLALGVSFLLLLSVAGIAQSDREKNKTTVVSHLPGFDGPLPFSLETGYVEVDDRNGVRLFYYFVQSEANPAEDPVLLWLTGGPGCSAFSGLVYEIGPLSFQPDSYTGGVPELVYRPDSWTKVANVIFLDSPVGAGFSYSATDQGYKSCDTKAVDQIAIFLTKWYEEHPQFLSNPLFIAGDSYSGLIAPPLTFQIAKGIEMGDKPLLNLKGYIIGNPLTDRKFDLPAR

SEQ ID NO: 122185 - protein, 383 aa, Triticum aestivum
  unsure (1)..(383): unsure at all Xaa locations
  Clone ID: PAT_TA_16603.pep
MAAAAEGVEAFLATCAASGDAAYGAAKAVLERLDAPATRAEARRLLGAVRRRFAAGGPAAGLECFRTYHFRIHDVVLDPRLQGFQQRKKLTMMEIPSIFIPEDWSFTFYEGLNRHPDSIFRDKTVAELGCGNGWISIALAEKWCPSKVYGLDINPRAIKIAWINLYLNALDDDGLPIYDAEGKTLLDRVEFYESDLLSYCRDNKIELDRIVGCIPQILNPNPEAMSKIVTENSSEEFLYSLSNYCALQGFVEDQFGLGLIARAVEEGISVIKPSGLMVFNMGGRPGQGVCERLFLRRGFRINKLWQTKIMQAADTDISALVEIEKNSRHRFEFFMDLVGDQPVCARTAWAYMKSGGRISHALSCCIAFNFAQPNQLKKIFEXL

SEQ ID NO: 122186 - protein, 175 aa, Triticum aestivum
  unsure (1)..(175): unsure at all Xaa locations
  Clone ID: PAT_TA_16604.pep
MGQGQSSGRWRPRRSFTKFFLDAVDRPLLRICSLWSMISSRIPSMVSGMLWRFLLMPVGKQQGETRAAFRGKEFISETDVRVSGSCINYLGLVIKETFRPYPPTPILVPRESTEAREINGYVMPAKTRVSIKSWAVGCYPXYWENAEEFRPEKFKAARMSHGLSWHLLRVQASSE

SEQ ID NO: 122187 - protein, 150 aa, Triticum aestivum
  Clone ID: PAT_TA_16605.pep
RARLGATNIRKEAKSPTIEDGKEELLCDLGPADAHPPCSPGFRWRHPRTGWTVHLQQPRGSAKLPVDPWWRLISTTYGPFLRMNEARDLVGRPSRSPAPISMLNPIIIVCSSWRAVGCGVVPPHVVCGVAWVGLGLYYKVAPSSPARAGL

SEQ ID NO: 122188 - protein, 175 aa, Triticum aestivum
  Clone ID: PAT_TA_16606.pep
MAIASLIASRFARSGHGHALPAAAAAISQAPRAQHAASPLLSGFGPLTRAFSSRPLWKGAFVDAFLQRIKNKRENLNGKKIWSRRSSILPEFVGSTVLIYNGKTHVRCKITEGKVGHKLGEFAFTRRRRPHRAILAKGGQGKGKKKYEMGMCVRQRWFHGRWDEGLVEAHLLESP

SEQ ID NO: 122189 - protein, 348 aa, Triticum aestivum
  unsure (1)..(348): unsure at all Xaa locations
  Clone ID: PAT_TA_16607.pep
MGGLSMDQAFVQAPEHRTKANLADADGIPVIDLSPLAAGDKAGVDALAAEVGRASQDWGFFVVVRHGVLAETVARALEAQRAFFALPADRKAAVRRDEAAPLGYYESEHTKNVRDWKEVFDLVPREPPPPAAVADGELVFENKWPEDLPRFREALEEYAEAMEELAFKLLELIARSLGLRPDRLRCFFKDQTTFIRLNHYPPSPSPDLALGVGRHKDAGALTILYQDDVGGLDVRRRSDGEWVRVRPVPDSYVINVGDIIQVWSNDRYESAEHRVSVNSQKERFSMPYFFXPGSDAMVEPLEEMVSDESRPXYDAYNWGNFFSTRKNSNFRKLDVENVQIAHFRKDRS

SEQ ID NO: 122190 - protein, 187 aa, Triticum aestivum
  Clone ID: PAT_TA_16608.pep
MPTNGELANDEERHKTLEGQALFPATTTGEGEEGDGSSAAGHSDSDTARQGGSLAGVPCRWGCSAPPPGARGGQHFRRYALRPRPASASTTSLGNNILDFSNNGSPRECTSTASGAAFKKARTQEPSPAQSTVKVRKEKLGDRITALHQLVSPFGKTDTASVLLEAIGYIRFLHGQIEVQQKEKSSI

SEQ ID NO: 122191 - protein, 179 aa, Triticum aestivum
  Clone ID: PAT_TA_16609.pep
PSLALELGRDEDEVGAIGVGHGLEVAEVDDDGPAAGEEDHRGDLPPIVVPPRAAAAAREVDDLRAARGGEVVPGWRHLRLRRRRPEEGGGLVAEGSSAEGLNEPWALRGGVVVPKGRFPQHRRGRGRGLRPAGGADVAEETGEGGARVLEGGHVVLIFASFVWDFREFWCRIPAARGIH

SEQ ID NO: 122192 - protein, 355 aa, Triticum aestivum
  Clone ID: PAT_TA_16610.pep
ISNEKVWGQRGRAAQIVNRELVGEETRSRDKKDLSGINSASECLLNESSFGLSTNARNVSAIGKCEGSDNDFERATAVVASVVDELHARKDELVHKSYTEIIEGSGNNLGRSASSPQKGYHSSPNAVHNKGQGDGNSDSGSSYHGNARSYEHYVTTPSLGSPLSDTPKSKVSEWSSSCFHNHTDNQIDMQPPSSDDVGGVLEALQRAKMSLREKLGRASPPRQDMLALPAPEDHYTDDDLQVDDTELPLCMSQRLSQEILTLPASEDYLSRISLPGDDAKVPVGPAGLFRLPTDPFPQNEVCSTDGYGSRFSLTSSRQAVFSRNPASHIVLTSSRPQVWFWVSHRIRYYDLHNSM

SEQ ID NO: 122193 - protein, 265 aa, Triticum aestivum
  unsure (1)..(265): unsure at all Xaa locations
  Clone ID: PAT_TA_16611.pep
IRHERVIKPSEKFRFSFDWENTEDTSRDMNMLYQAPHEARLLYGRGFLAGIDRREQKKAAAVFEKETRAEQRRKFGVEDRPEDDVADKKKAAAAEMYDAFDMRVDRHWSEKGIEEMTERDWRIFREDFNISYKGSRIPRPMRNWPESKLGTELLRAIEKGGYKKPSPIQMAAIPLGLQQRDVIGIAETGSGKTAAFVLPMLSYITRLPPISEDNEAEGPYAVVMAPTRELAQQIEEETVKFATYLGIKVVSXLVGGQSIEEQGFK

SEQ ID NO: 122194 - protein, 227 aa, Triticum aestivum
  Clone ID: PAT_TA_16612.pep
TGSLFIFFNHENGRNGIIDLFFQDRYLNAIQTNAPHLLRYLAAAVVVNKRRRNMLKELIKVIQQEQNSYKDPIIEFLECLYVKYDFDGAQQKLVECEQVILNDPFLGKRVEERNGIAVPLRDEFLENARLFIFETYCRIHRCIDIGVLAEKLNMTYDEAELWIMNMVKSSKLDAKIDSVTGTLIMTTNCVDVHEQIIESMKNLNARTYMLAKSVVDPGHAAAQQAAR

SEQ ID NO: 122195 - protein, 395 aa, Triticum aestivum
  unsure (1)..(395): unsure at all Xaa locations
  Clone ID: PAT_TA_16613.pep
MAEHDLTASVAAWMDPHLVLPVLEFLQERGVYADEEILRGKIRLLGGTNMVDYAMDIHKSLHGTDDVPADMVARRSEVVERLRALQEAVAPIVAFLSSPQLVQELHADKQYNLHMLQERHQIGPDQIEALYQYAKFQYECGMYSDAADFLSQYRALCTNSERSLSALWGKLAAEILMQNWDVAQEELNRLKEMIDSSSFTSSPVNQLHSRIWLMHWSLFIFFNHENGRNGIIDLFFQDRYLNAIQTNAPHLLRTLLLQLLFNKRRRNMLKELIKVIQQEQNSYKDPIXEFLECLYVKYDFEWRSAEAGRCEQVILNDPFLGKRVREKEXIAVPLXEEFXENARLFLFEPLLPTSIDASDFGLGGGGRENITYLGRRLVDDKEYGRRPRYLMRWMN

SEQ ID NO: 122196 - protein, 271 aa, Triticum aestivum
  Clone ID: PAT_TA_16614.pep
SGVELNSDDVRAYIQAQQVAAHFRRSIFGAGSGHINETMSAEASPGFSVRDAVGVELNSDDVRAYIQAQQVAAHFRFSIFGAGSGHINETMSAEASPEFSVRDDVGVELNDDDVRAYIQAQQAAAHSRRSTFGAGSGHITETMSAEASSPGGGDGRLGVEWNDETLTALPPRAPAMREHDGSQDFLVDEAGGRFLAIHIHPPQQGDQGLVGAARGTQDGPGDLARHALPSVIGGLVPLCFNLLLDDSILKADSSPGYIKAAAAAGAGACDC

SEQ ID NO: 122197 - protein, 213 aa, Triticum aestivum
  unsure (1)..(213): unsure at all Xaa locations
  Clone ID: PAT_TA_16615.pep
TLTSTQXELAHALRFLASVXVTNFIAFGDILDXHKKFLELSGGVNRYLNSRASXSISNNAVMPSNVISVPSEETISFRNVDIVTPSQKLLASQLSCDVSQGNSPRGAGPNGSGKSSIFRVLQSLWPVASGRLTVPSEGIFHVPQRPYTCLGTLRDQIIYPLSREEAELKMAKTGDRSTSLDDHLRTILENVRLVYLLEREGWDATPNWEDILS

SEQ ID NO: 122198 - protein, 311 aa, Triticum aestivum
  unsure (1)..(311): unsure at all Xaa locations
  Clone ID: PAT_TA_16616.pep
LPCHQDLTCXRKCQRLRACXRHACKRRCCVGDCPPCAETCDRRLRCGNHKCLSPCHRGACSPCPLMKTISCFCGKTYXRFPCGTEKNQKPPKCSKRCNIDRLCRHKLECRPHKCHYGACPPCKLICGEQLSCGHKCKERCHGSIPPPSPEFTVKPMKKKMEKHIECTPGTPCPPCQEVVLVPCFGEHLGQERAIPCSKSRQFPCQNLCGNLLHCGNHYCTKDCHVLEIPSDQRKADTILSLSRKNTLAEPCERCNLPCQRARDPPCSHPCPLRCHLSDSLPCVVPVIPARHCGAMTHAFECVYYNNXXXXX

SEQ ID NO: 122199 - protein, 218 aa, Triticum aestivum
  Clone ID: PAT_TA_16617.pep
MAPVKLYGMTMSWNVTRCVAALEEAGVEYDVVPIDFGAGEHKTPDHLARNPFGQMPVLQDGDFYVWESRAICKYTCRKNKPELLKQGNLKESAMVDVWLEVEAHQYTAALEPVILECLIRPMFGRATDQKIVEDNLVKLKKVLEVYEARLSKCKYLAGDFLSLADLNHVSATACLATTPYASLFDAYLHVKAWWSGLMARPSVQKITALKKPYFQNSV

SEQ ID NO: 122200 - protein, 198 aa, Triticum aestivum
  unsure (1)..(198): unsure at all Xaa locations
  Clone ID: PAT_TA_16618.pep
RRRKXTKVARLLAAKTCNVMALLDGGMLTRQXSGVKAEPPAIIVATVASLCQMVEKRAFSLGSIKILVIDEVDFIFGSSKQVNSLRKILNSYTAASSRQTIFASASIPQHNRFVHDCVQHKWTKSDVVHVHVNPVQPMPLHLHHTYVICSKKERLHVLLSLLERDAPKSVIIFVAQQSEKSKRAGNPPSSTLVVEFLR

SEQ ID NO: 122201 - protein, 643 aa, Triticum aestivum
  Clone ID: PAT_TA_16619.pep
MTDGHLFNNISLGGRVGNNPGQFRLYSGGLAWKKLGGGKTIEVDKADIISVTWMKIPRSYQLSVGTKEGIRYVFKGFREQDVSNLTNFIQKNTGTTPEEKQLSVSGHNWGAVDINGNMLSFNVGSKEAFEVSLSDVSQTQLQGKTDVVLEFHVDDTTGANEKDSLMDLSFHVPTSNTQFLGDEERPSAHIFWQKILAIADVGSSEEAVVSLEGIAILTPRGRYTVELHMSFLRLQGQANDFKIQYSSILRLFVLPKSNNPHTFVVITLDPPIRKGQTLYPHIVIQFVTENVVEKELSLSEEVLAEKYKDRLQSSYNGLEHEVFSKILRGLSGAKVTRPSTFRSCQDGYAVKSSLKAEDGLLYPLEKGFFFLPKPPTLILHEEIEYVEFERHGAGGASMSSHYFDLLVKLKNDQEHLFRNIQRNEYHNLFNFVSGKNLKILNLGEDGQDRTGAVAAALQSTDDDPVDPHLERIKNQAGDEESDEEDEDFVADKDDSGSPSDDSEEGSDASISDGEKEKSSKKEASSSKPPAKRKPKNVDVEGSEKRKPKKKQKKDPNAPKRAIAPFMYFSKAERANLKNINPELSTTDIAKKLGEKWQKMSAEEKQPYVEQSQVDKKRYAEESAAYRGAGAAPVDVDSADGSSD

SEQ ID NO: 122202 - protein, 274 aa, Triticum aestivum
  Clone ID: PAT_TA_16620.pep
DFQQGVNFAYGRSTALGPEFFESKGFTLFMPVSLENQTEWFRNVLQLAGSVEEQRKLMATSLVMMGEMGIHDYLIFITGKLTEAEIRTFVPHIVGAIRSVITEVIDAGAKTVVVRGMIPLGCQPLMLALFEGTGADYNRATGCLTRLNDLARMHNHALMRMVLDLRRAYRGTGAAILYADQFDPVTALVSAPGKYGFGDKPLAACCGGSGTYNFDPTFATLCGMPGANKCADPSKYVSWDGIHLTDAANRHVAGNVLRSIVLRQTPYMAHLSSS

SEQ ID NO: 122203 - protein, 357 aa, Triticum aestivum
  unsure (1)..(357): unsure at all Xaa locations
  Clone ID: PAT_TA_16621.pep
AVSRITDARQGAAPAALPLTWTPSDPVPSGHPPLDTSLLRQGPTLTLQPTSFVNVYVHYTRVKGQASFPAEAPSPGKAQASCSAEGSSPPAEPPRVFGCVIGVQPGGTAYIFISFELVLDPFTGTLEGLLMVWKLDLFXEVFPEFYVLGWYSTGKRLCRILTFLIHKALMDINDSPVCLLFNSAINHSQLDLPVAAHESELHVIDGGPQLIFVKSNYTIETVEAERISVDHVAHLKPSDGGSAATQLAAHLTGIHSAIKMLNSRVRVIQQYLGAMQKGDIPLDNSXLRQVSSLVRRLPAMESEKFQDDFLTEYNDTLLMTYLAMFTNCSSTMNELVEKFNTTYERSPARRGGRGAFM

SEQ ID NO: 122204 - protein, 180 aa, Triticum aestivum
  unsure (1)..(180): unsure at all Xaa locations
  Clone ID: PAT_TA_16622.pep
GSGAPPVAPTSLLSRTRAPALPRTPSAGWSPGGDAVFGALGELGAALACGARLSALLLSPLGHSLAICTFNQATFLVNALSHLFALPDGGPPLPVNKEYVLEVLEXRGFLLNFVGNRLFFGGVPLLLWIFGPXVLACLCSMVMIPVLYNIDIVYIERGKGGEVSDKVELTDADSDDGMQV

SEQ ID NO: 122205 - protein, 178 aa, Triticum aestivum
  unsure (1)..(178): unsure at all Xaa locations
  Clone ID: PAT_TA_16623.pep
VVFLDDDIVVQKDLSDLFTINLNGNVMGAVETCMETFHRFHKYLNHSHPLIRAHFDPDACGWAFGMNVLDLVEWRNKNVTGIYHYWQERNADHTLWKLGSLPPGLLAFXAGLNHGTQKGNVLGLGATTGGPRTIWGGAVLPYNGDLKPWLKIGMEKYKGFWDNYVDYSHPLLQRCFMR

SEQ ID NO: 122206 - protein, 548 aa, Triticum aestivum
  unsure (1)..(548): unsure at all Xaa locations
  Clone ID: PAT_TA_16624.pep
VEVDSTVSLEAFSRIAPAIPTIADVVTSSNLFDVLSSTSGGRLPFPVYDKYLAGLDRAFKKMKTQSESSLLSGFRSQRGERVLEVDGTLTTQPVLEHVGISTWPGRLTLTDHALYFEAVKVVTFDKPKSYELAEDAKQIVKPELTGPWGSRLFDKAVMYKSTALTEPVIIEFPELAGHSRRDYWLAIISEVLYVHRFVRKFNISGVDKEEIILKASLXLLRLQAIEELAFPASNRYESLLLFNLCDKLPGGDVILETLASTISSRSSAHANQPGMSIGMRSMSAFAVLSNLGMVSPGNNSERLFVGEIVVGEMSSLQKAVTESMNNYKKVELAQATVDGVKVDGLDTNLVVMKELLSPVSDLWRFLVSLALWDEPFKSFIFCLLSSSIIIRGWVVYFLVMVILLSATVMLLTRLTSQGKPMTEVKVTSPPSMNTMEQLLAVQNAISKVEELVQDANIVLLKIRALLLAFPSQATDKAILALLLMALVLALLPTRLLILAMFLEVFTNHSPLRRASTERCTRRLREWWFSIPAAPVVVEKDNKEDKKTK

SEQ ID NO: 122207 - protein, 217 aa, Triticum aestivum
  Clone ID: PAT_TA_16625.pep
LKGKRIGVPNGFFQGYDQTQLNTYKQHLATMRKLGAVVIEKLDVAANLTALFVEIYSKEGIAMQAEFKLSINAYLADLVYSPVHSLADIIRAAARAGVEERLKDFGQPDLIAAQSTNGIGPVERAAIRRLKELNTNGLEKLMMEHQLDAIVAPNSDISSLLAISGHPGIVVPAGYLGRDHAIGICFGGLQGYEPRLIEMAYSFEQATKVRRPPMFKP

SEQ ID NO: 122208 - protein, 114 aa, Triticum aestivum
  Clone ID: PAT_TA_16626.pep
PPAGSARSILSSAILQAAWASSSASTPAPSRTRYIIAKTSAPHTPPSNPSKLILSPLRSRWLLHSRCLIKHKVLLFIPYWIASVWRGAVPEFLVCSGLASRALLSPSNLMNLTK

SEQ ID NO: 122209 - protein, 173 aa, Triticum aestivum
  Clone ID: PAT_TA_16627.pep
QIDRGMEVLIRLLLRQLRAKSLPPSETRLCSSSSVDFICGTGQHAEQRDRGSCPRPWPWAGEQQRHQAVRLRHWGHFRRCRCFGGRRYSSAPILQVLQAGESTASAEDPPLQVPTGGGNQLSVHHLHCRFPPPRARGSAPHVRARLPPPLPPGGGGGAEPTLPALLGSSAVKV

SEQ ID NO: 122210 - protein, 334 aa, Triticum aestivum
  Clone ID: PAT_TA_16628.pep
QIQDLEFCSAPSKAMASEQMVHMSQGQGETSYARNSSFQKAEQNRMKSLIEAVIADWRGGSSTFLPGKMVIADLGCSSGPNALALVSVAVEAIHGYCLQFQQPPPELCVFLNDLPDNDFNTVVKSLVTLRRSNDPVVLTGVAPGSFYESLFTSSSVHLVCSSSSLHWLSKPPEVLTKNQIPAYYIDEHARRDNLPMVLAAYAQQFRNDFRHFLELRAKELVPGGQMVVSIIGRHSDGFAPFHIWGILAQVLSLMASEGVIDKAKFDSFYVPVYGPSKEDLREVIQDEGSFSIKEFLVHDFLSGLDSALVTPSWIANQIRAVYEQIVVQHFGDVM

SEQ ID NO: 122211 - protein, 102 aa, Triticum aestivum
  Clone ID: PAT_TA_16629.pep
FGRGRASPRATPSSAAPRTLLPPRPRRSRSRRRSVRRPPDAAPTDRRRALPAPPPPTPSPPRWQSAPGSAPTPSTSTRCFLLSRRRPSAPGRGGGPSPLAGW

SEQ ID NO: 122212 - protein, 331 aa, Triticum aestivum
  unsure (1)..(331): unsure at all Xaa locations
  Clone ID: PAT_TA_16630.pep
RHEAGTHCPKAPNGLEMVAAIVAVVVAVVCLRLPAVARGQLQVGFYNTSCPNAESLVQQAVASAFANDSGIAAGLIRLHFHDCFVRGCDASVLLVSANGTAERDAAPNKPSLRGFEVIDAAKAAVEKSCARTVSCADIVAFAARDSINLTGQAAYQVPSGRRDGNFSLDQDALNNLPPPTFTAQQLVDRFANKTLTAXEEMVILSGAHTVGRSFCSSFLARIWNNTTATVDTGLSPAYAALLQALCPSSPNAATTTAVDSTTPAVLDNNYYKLLSLNLGXFFSDNXLRTNATLNTSVKXSXXNETSGTEFVXXMVKWGNXVLTDQGRXRXN

SEQ ID NO: 122213 - protein, 233 aa, Triticum aestivum
  Clone ID: PAT_TA_16631.pep
MAEGFGRWESDPLFPAAECVQDSADRMDGVYRLLLHEKKVIQDDTSDAKLHAPIQYERDVATALGTTKWQLEQFEREVNAAAFSDKSTSRENAILKFRQFIRAIAEQISEVEESLKTLRTDFSRTPKSPYSSSEQDGDGLASFLSGGNSHSHAYYSTDTNEITELKLDSAPMMNGYHSAQEHTTRELRYSGNDVEGASRLQCSRGESASEVDHNGSTLCSLDADDSLGTCPGS

SEQ ID NO: 122214 - protein, 260 aa, Triticum aestivum
  unsure (1)..(260): unsure at all Xaa locations
  Clone ID: PAT_TA_16632.pep
LSSSQDATDRQASYLGAELNRGGGDGGXAATLATELDRLLAMARELEARVDGAPGAARELCAALAESVDRAMRLAGSCPRGGGGGGNAGNVRASVSGQVKGGRKAGANKVRTQVRVASVTDAGPLNDGLSWRKYGQKDILGAAYPRAYFRCRHRHTQGCQATKQVQRAHADPLLFDVVYLGAHTCAQAAAVLAGPEQQPPAAFALEHQQQEPAAGRDSVAGRARDAAPLPFLAGRLIHAGKPLVRACRQLRLRCRRGARG

SEQ ID NO: 122215 - protein, 291 aa, Triticum aestivum
  unsure (1)..(291): unsure at all Xaa locations
  Clone ID: PAT_TA_16633.pep
MEERCALATELAQVLDTVRQLEAHMGVKGGADRGETCRALVSSMRSSVDRSIHIAMSSCCVVLGAPESPPXAGGSPRSGGSDQAADSPCRGAHAAGQSKKRKTQPKWSTQVRVNSVEDVGPLDDGFSWRKYGQKDILGAKYPRAYFRCTHRHTQGCYASKQVQRAHGDPLLFDVVYHGNHTCAQGKHSNSQRPQPAASGEHRQPQPAGGQERISVGQETEGGVAPAFSFPSKQAGADTGSDFQAGCATTASPFMSPATSECKASTTESPMGDMDFMLQLADADFLDNSRYL

SEQ ID NO: 122216 - protein, 185 aa, Triticum aestivum
  unsure (1)..(185): unsure at all Xaa locations
  Clone ID: PAT_TA_16634.pep
MLCRLLSLLLLAALLAAAAGHGDSSASSCPFHGGHDEKPHEHHDHGHSCGGALDDSNHEHHHHHSHHHRDEIQRLLPEELAEEADLELEGFDHDHHHHHDHHHDHIHGDFHPESTSMGVWLRAMGCSLLVSMASLVCLILLPVILFQGKPFEGRCGTHXAVFGAGAMLADSFLHQLPHAFVVYCS

SEQ ID NO: 122217 - protein, 79 aa, Triticum aestivum
  Clone ID: PAT_TA_16635.pep
AKLLLAGGEADPFWPPPPPLRRPPRPPGPRGLPPRPPFALSRRPTWLARPPPRPPPGGRSPPPLLFAEFPGQGKRVREP

SEQ ID NO: 122218 - protein, 115 aa, Triticum aestivum
  Clone ID: PAT_TA_16636.pep
TDTFSKVGDGAGLVQSGRRRWSQGARGASGVVRLKLRRGAAEAPALTQVEHRGELRAGAAGAKERRRDGSDAVGVCPGAAETGSTCPAGNGPATVAAGEPWRAIPSLFFRTRGRT

SEQ ID NO: 122219 - protein, 291 aa, Triticum aestivum
  unsure (1)..(291): unsure at all Xaa locations
  Clone ID: PAT_TA_16637.pep
EYPDVDEMXKILLFSYYDLPSHLKPGLLYLXISFHEDHKIMTDELRWRWIAEGFICSEKQETSLYXLRDCYFNELINRNMVQPVDIDEDGRAEACXLHDMVLDIICSLSSEENFVTILDGTXRKLPNPHRKVRRLSIHKSNTDVLATTSIAQPRSVTVFGNDIVQQMPPISSSKGLRVLALEGCTISDIGLLVYLRPLPYLGLRAAWVDGFLVRIGKLHFLQTLDLRGTKNIRELPSSIVWLRNLMCLYIDEAMNMPCGIANLTSLEVLKELRLVDDNLVIVKEMFHLIKL

SEQ ID NO: 122220 - protein, 110 aa, Triticum aestivum
  unsure (1)..(110): unsure at all Xaa locations
  Clone ID: PAT_TA_16638.pep
ILXGIFFFFFFLCTFLSKSLSSPHILAWLQNSTIYYTAIFLCVACMQSASTCTESWRQPHQSARSLPHKIILELVIISQRRHSSGCPARYYLLHSYFSLCSMHAIGVNLH

SEQ ID NO: 122221 - protein, 295 aa, Triticum aestivum
  unsure (1)..(295): unsure at all Xaa locations
  Clone ID: PAT_TA_16639.pep
MAIALAAFLLIPLFSLGAVFVLRAWRLDKKAPAQRTPRTRPYPLLGHLPQFLANRHRVLDWLTEVLALQPTCTLVFRRPGGVRGVITANPTNLEHIMRASFDNYPKGPRFASLLHDFLGRGIFNADGEPWRAQRKAASYEFNTRSLRLFVARSVHSELHGRLLPLLRRAAGSGGHLDLQDTLERYAFDNICRVAFDHDPRQLPDGDACPEVESTGTASSRFADAFRDAANLSAGRFRYAIPGFWKIKKALNLXSEWRLRESIAIVHGFADGIIRSRREEMNMGCEKHDLLSGFMG

SEQ ID NO: 122222 - protein, 240 aa, Triticum aestivum
  unsure (1)..(240): unsure at all Xaa locations
  Clone ID: PAT_TA_16640.pep
MSCGRSENTTRKCRTRSTPGETMYLHTADAKKITHYQANLPTTMDRDIGAYPVKHHFPSPIVSWIEDLSSFGDVPFSHDTEYVDDQSTPSFGQSFASSNLHDMQISVRLTDEFMELAKENTSNNLEACGILGASFRDGTYYVTTLIIPKQEGTAHSCQASNEEEIHAVLSEQSLYPAGWIHTHPSQTCFLSSIDLHTQFSYQVMLPEAVAIVAAPTDPTRSYGIFRLTDPGGMDVLRXCS

SEQ ID NO: 122223 - protein, 185 aa, Triticum aestivum
  unsure (1)..(185): unsure at all Xaa locations
  Clone ID: PAT_TA_16641.pep
MSCGRSENTTRKCRTRSTPGETMYLHTADAKKITHYQANLPTTMDRDIGAYPVKHHFPCPIVSWIEDLSSFGAVPFSHETEYVDDQATPSFGQSFTSINLHVMQIPVRLTDEFMELAKENTSKNLEXCGILGSFRDGLLCATLISKQEERHHVKLITRGQAYTYYTSRSLVMPPPDIFTSHSQPG

SEQ ID NO: 122224 - protein, 93 aa, Triticum aestivum
  Clone ID: PAT_TA_16642.pep
WILSLVIIGINTYFFCTSFVSWLVYSDLPRFAKAIISTLVFPFMAAYIVAVICGAFRKVSTNAVLPSSSVSCEIEVAEVPRQDNKDEVWALHC

SEQ ID NO: 122225 - protein, 122 aa, Triticum aestivum
  Clone ID: PAT_TA_16643.pep
SWCSQQQVLGHRAVGCFVSHCGWNSTMEAARNGVPVLCWPYFCEQFLDRSYVTDVWRTGLAVCPGDDGIVAKEEVRGKVESVIGDAGIRKRASWLKDAASECIGEGGSSEKNFKKFIDLLSQ

SEQ ID NO: 122226 - protein, 167 aa, Triticum aestivum
  Clone ID: PAT_TA_16644.pep
MARWTAQRCGLLLVAALLAVAAVADDSGEKCTGGCGNPCGIPCTYSSPPPPEPALPPPVYYPPPAPVYSPPPPEAVYPPPTPTADCPPPPTEGYTPAPYTPTPSTPSGGYTPTTPSGGYNPTPSGGGYNPTPSGWFTPPNLPSYLTPPGPLYPQDPGFRPNPSTSWR

SEQ ID NO: 122227 - protein, 202 aa, Triticum aestivum
  unsure (1)..(202): unsure at all Xaa locations
  Clone ID: PAT_TA_16645.pep
ARRRRRRNRPFQQPQASGVTSEPAAKFALPAGNQGKSEVTPTATVGGGSLPGVTQHMVIDTASDVPWVQCAPCPKPQCHPQTDATYDPSKSTTYAPFPCSSPVCRQLGPYANGCTGAGNTGQCQYRVQYPDGSSTSGTYISDVLTITPTPAGMVSGFRFGCSHALQRPDLFSNTTXGIMSLGRGAQSLSSQTKGTYGHVFSY

SEQ ID NO: 122228 - protein, 287 aa, Triticum aestivum
  unsure (1)..(287): unsure at all Xaa locations
  Clone ID: PAT_TA_16646.pep
ISLPLIMSFISLVGTITLFLGATLALAQRDIKRSLAYSTMSQLGYMMLAXLGIGSYQXAALFHLITHAYSKALLFLGSGSVIHSMEPLVGYSPDKSQNMVLMGGLRKYIPITRTTFLWGTLSLCGIPPLACFWSKDEILSNSWLYSPFFGIIASFTAGLTAFYMFRIYLLTFDGYLRVHFQNYSSTKESSLYSIPRPRPRXPQGENRDFVLSTTKSGVSFFSQNXYXKIQGNTRERIGSFXTSFGAKNTFAYPHETGNTMLFPLLILLLFTLFIGFIGISFDNGGIG

SEQ ID NO: 122229 - protein, 302 aa, Triticum aestivum
  Clone ID: PAT_TA_16647.pep
TRVGNPIEPAIPAVESTDVMDTTLSPQVSVEPDNNTYNSNTEGSVVNSSTKRDLLSSWIESIASEAKKDHQPCKSTLPSISLPVLAPKEDSRRAGLDSAGNPVGKSPQMNGTSSMPPKVAPKQANLPSSSREPPRVSSNPRHKTWHRGDLTSSTSLPSSQPSGLPPKQPPRRNDKTQNSYIRKGNALIRNPATGKLSHSSSLDTQNKLNKPVMRRSMNFVRKVDSNDSAARLSFTVERPKTPPLPLHAKSINSTTNLPEQLSKTLPKQHVPETEKEDSARQLDSGVDTPSIKSAQTPEPSDA

SEQ ID NO: 122230 - protein, 239 aa, Triticum aestivum
  unsure (1)..(239): unsure at all Xaa locations
  Clone ID: PAT_TA_16648.pep
SVTAASAAFPPAVSRPRALCVQVPGVVPPVFPAGPPLLFGDPGQLGARPLCRPRPAASLYPVSFVFPRPLSLLHAHYFKTPGVSTTDFPAHPPVQFDYTAHNVTQTLWQPVPATNLYQLRFGSVVQLVLRDATIVPRQTHPFRLHCXPGLVLAEGLGNFDAEKDSAKFNLDHPPQRNTVAVPVNGWAVIRFRADXPGVWLMHCHLDVHITWGLAMAFLVEDGYGELQSLEAPPVDLPMC

SEQ ID NO: 122231 - protein, 149 aa, Triticum aestivum
  Clone ID: PAT_TA_16649.pep
RAAARAGTVMLARPAEHFSATRDMAGFKRYVVYLFDAMCARIPRGQEKFLCVVDLKGWGYPGRDLRAYIAAIEILQSYYPERLGKALMIHVPYLFMKAWKVVQPFIDANTRDKFVFVDDKSLEETLRREMEDGQLPEMYGGKMPIVPLE

SEQ ID NO: 122232 - protein, 93 aa, Triticum aestivum
  unsure (1)..(93): unsure at all Xaa locations
  Clone ID: PAT_TA_16650.pep
XXXLTGVGRSSSMSXTRSQNSDWALKPWNRRNNVISSRKGLYFPYRAGPIMRGVRHCNILSRLAHSLGLTQLCFFFRDWIIWYSVLKVCSCQS

SEQ ID NO: 122233 - protein, 62 aa, Triticum aestivum
  Clone ID: PAT_TA_16651.pep
PPWRPPAAAAAGSGSGSGCWRGLMQAAPPSTGLRPTTCWPSAPNLTDLCSFLDLLFFFLVAS

SEQ ID NO: 122234 - protein, 482 aa, Triticum aestivum
  Clone ID: PAT_TA_16652.pep
MLLSSEPLRLCPPSQLLLHLDREKLGSPAERRGEEPTLALGCAAAMGSLRGGSGGEGRNEDGGKVGLPALEVALAFPQATPASLFPPAVSDYYQLDDLLTSEEKALRKKVRAISEKEIAPIMTEYWEKAEFPFHAIPKLATLGLAGSTTKGYGCPGLSLTASAVSIAEVARVDASCSTFILVHSSLAMSTIALCGSEAQKQKYLPSLAQFKTVGCWALTEPDYGSDASSLKTSAIKVPGGWQLDGQKRWIGNSTFADVLVILARNADTKQLNGFIVKKGAPGLRATKIQNKIGLRMVQNGDILLNKVFVPEEDRLTGINSFQDISKVLAMSRIMVAWQPIGISMGVYDMCHRYLKERKQFGAPLAAFQLNQEKLVRMLGNIQAMLLVGWRLCKLYESGKMTPGHASLGKAWTSSKSREVVSLGRELLGGNGILADFLVAKAFCDLEPIYSYEGTYDINSLVTGREITGIASFKPAAVAKSRL

SEQ ID NO: 122235 - protein, 248 aa, Triticum aestivum
  unsure (1)..(248): unsure at all Xaa locations
  Clone ID: PAT_TA_16653.pep
IRTRRTTSSCLIFLLALLLPLAAVAVPRRHRFPSLQLAPVNASEPPTTFFEVDRPIQPPRGSVGPCSALLLSDSFGYTYGRPPATAAYVPPGCLAAARARGGSLALAVLEWSADCRGRQFDRIFGVWLSGAELLRSCTAEPRPDGIXWSVSRDVTRYAALLSEPGEVAVYLGNIVDSTYTGVYHANLTLHLYFHPTTPSPPPPPPHADLILPISRSLPLNDGQWFAIQNSADVQSRKLAIPSNTYRAV

SEQ ID NO: 122236 - protein, 124 aa, Triticum aestivum
  Clone ID: PAT_TA_16654.pep
TSARRARTSDRSNNRAELGSITHRPWRPPPPPRTKASPAAPSGAWTPRRRGCPVPAPAPPAGTRRGSWAAPSGASGRSRPPSRSRPRSPRPPSTPPAPARPRGRPRRRRPQWWPSRGGRWRRRP

SEQ ID NO: 122237 - protein, 259 aa, Triticum aestivum
  unsure (1)..(259): unsure at all Xaa locations
  Clone ID: PAT_TA_16655.pep
PGARVGAARERENTLLSFGRAAEHAAVAFVEFDVQVTKDGCPVIFHDAARRTQKTEVLYERRVTDLLLDEFLSYGVQKEPHKVSKPLLRRMEDGRVLAWSTEEDDYLCTLQEVFEHVSPHLGFNIELKFDDNIIYPGVNLNRAPQAVLQVVFQYAGNRPPFFSTFQPDAARLTRALRSLYPLLFGADRRTAEHDDRRRNSLDNAIQVCQEXSLHGVVSEVRGVLKNPSAILKAQESNLAILTYGQLNNVREAVYIQYLM

SEQ ID NO: 122238 - protein, 176 aa, Triticum aestivum
  unsure (1)..(176): unsure at all Xaa locations
  Clone ID: PAT_TA_16656.pep
RARSPLPSPNSPPPKPNPRQWRHYSSKPTVRRKPSPRARAATAAPLPPRPTPSASSAPSSLPGRRRPRPSSSASSPTRAAASKPSPTRPASRTSSPAXTPSLPPPRTPTPCRTPPSSPAPGASCGRPSRSSSSSCATPPSARRGAATCSTSSGAHMDDFTTSASLKAMTPTPSTIR

SEQ ID NO: 122239 - protein, 157 aa, Triticum aestivum
  Clone ID: PAT_TA_16657.pep
SPLPSIHPRFNSAVARSLHRPHPSRSSQKVQADRQGAMAGAASEANKGEMHSVPVGLEANKEGMQPVAGGASVDEDNAWMQFISDGAWYTSAVAREDNSWMQFTSDVAWVHQSRRGQGWFLPAVHLRRQLGTAAPATDRERQRKVKNRIKGLPFLRV

SEQ ID NO: 122240 - protein, 125 aa, Triticum aestivum
  Clone ID: PAT_TA_16658.pep
SVLRRKKEKMRAWTENSVHITISDHQGIVSHVRFGERALVCFHHRPPNQTKPNHAKHHPRHPPALTARSKGTQAAEARGEGYRPGVQAADRQATGAETQANAEEEEEEGELARSYGTGREGYWIG

SEQ ID NO: 122241 - protein, 242 aa, Triticum aestivum
  unsure (1)..(242): unsure at all Xaa locations
  Clone ID: PAT_TA_16659.pep
MEGGGEGKGRAAPAAGGGFGGYESAGDRKWWPWLVPTVIVACVAVFVVEMWVNDCPRHGSALGGGCVAGFLRRFSFQPLRENPLLGPSSTTLGKMGALDWNKVVHQHQGWRLISRPRTRGRPSGLVVNMLSLLFIGIRLEQQFGFVRIGAIYLLSGFGGSVMSALFLRNNYISVGASGALFGLLGSMLSELLMNWTIYSNKVAAIITLLFIIAINVAIGILPHADNLVXMGGFWPGFLWGLV

SEQ ID NO: 122242 - protein, 284 aa, Triticum aestivum
  unsure (1)..(284): unsure at all Xaa locations
  Clone ID: PAT_TA_16660.pep
RPAPPLLRPSSFLPHPSILGLHIASRHRSQLRARGTAWRGAARGRAGRRRRRGEGSAGTSRPGTASGGPGSCPPSSSPAGFVRLCGCGLTSGFGGSVMSALFLXSAYISVGASGALFGLLGXSMLSELLMNWXTIYSNKVAAIITLLFIIAINVAIGILPHADNFAHIGGFLTGFLLGFVLLARPQFGWLERSELPHTNQPPKYKPYQYVLWVVALVLLLVGFTLSLVMLFKGKNGNDGCHWCHYLNCVPYVGGGSAIPRRFLLSVFGRKTRSVVRTFFMPVCL

SEQ ID NO: 122243 - protein, 365 aa, Triticum aestivum
  unsure (1)..(365): unsure at all Xaa locations
  Clone ID: PAT_TA_16661.pep
MYAETEPGAAAERTAFRRAEKQYKLYKPPSRKGRSKSRGKPAVGGGGGDLSAVVDFHALLAAGGEGELPAGIRXATAPGFHLPVFCFLDRPGFYFIPGALSTEEQCYWIRESLKTFPQPPNRTNLTATYGPISDLLIAAKNQKILVEVESSSGKPRDEQNNVGENAHPGKFKFVDDSEIQKEERPKSTMAAALVRKLRWSTLGLQFDWSKRNYDVSLPHNKIPDDLATLAKKMAVPAMPSGEEFTAEAAIVNYYGPSDMLGGHVDDMEADWTKPIVSISLGCKCIFLLGGKTRDEAPTPMFLRSGDIVLMAGEARERFHGVPRIFTEGDQQDISGLVSELSDDDDRCTWDYIHNSRININIRQVY

SEQ ID NO: 122244 - protein, 225 aa, Triticum aestivum
  Clone ID: PAT_TA_16662.pep
LRRCRPFSSSSSPSSSSCTPPSRKAAAAAAEDICIVGSGISGASTAFFLTNYTAPDPAPQLRVFERRDRVGGRLATVTVAGEVFEAGGSIIHPRNLHVRRFADLLGLAAKTGGDNDEDWLGIWDGARFVFKTLRPPPPGSSWLRRKLHGLANSLLLLRRYGLSLLRMDSFVQEMLQKFMLYYNGFESRPVFDNVEEMLKWSGLYGLTRRTLEDELIDAGLNTQTI

SEQ ID NO: 122245 - protein, 209 aa, Triticum aestivum
  Clone ID: PAT_TA_16663.pep
MRWWLHRLAAAVAFVAAALATGAAVLRPPAPLRFGPGGRFKVALFADLHYGENAWTDWGPAQDAASDRVMATVLDAEKPDFVVYLGDLVTANNVPIPNATLYRDRAISASRRRGLPWSTVFGNHDDMPFEWPPEWFSPAGIPPVHCPPAASGCSFRGTPRIELMTAELNRDGADGLSRSSVGPQELWPGVSNYVLQVLSHEKQQDPALL

SEQ ID NO: 122246 - protein, 172 aa, Triticum aestivum
  Clone ID: PAT_TA_16664.pep
MATTSTTPFHRLLAPARSNPAARLSLYTRGPPMLSFSRSISVRRSLAAASKDTASDKGQEQESSTAAGGAAEPAEEETPPGEKTSDEVATELKEVMRARKEAEVARGGGGWWAGVAQEMTEIEWPAPGKVLGTTGVVLGIIAGSTVALLSVNAILAELSDRVFAGRGLQDFF

SEQ ID NO: 122247 - protein, 193 aa, Triticum aestivum
  unsure (1)..(193): unsure at all Xaa locations
  Clone ID: PAT_TA_16665.pep
HKGIFKLPALVGVAMDVSKCMSNLHQTKIIHRDLKTLKVLMAENVRVKVAEFGVARIXVQSTVMNAEMRTYAXMWAEVIEHKPYDHKADVFSFGILLWELLTGKIPYEYLTPLQAAVGVVQKGLRPTIPKNAHAKLAELLQKCWQQDPAERPDFSEILEALKKIAEEVGDEHDGKHKDKSLGGFFSSLRGRGH

SEQ ID NO: 122248 - protein, 219 aa, Triticum aestivum
  unsure (1)..(219): unsure at all Xaa locations
  Clone ID: PAT_TA_16666.pep
MDPCPFVRVLVGNLALKMPVAPRPAGAGAGVHPTTSPCYCTIRLNKLPLQTAAAPLLPSDDMTQGPAATGALAAAFHLSKADLDRVTAKPSLFVARSARLKVAVYAGRRGTTCGVNSGRLLGKVVIPLDLKTAVGKPIVFHSGWLSINKRGRKASAVSGSAQLNLTVRAEPDPRFVFQFDGEPECSPQVLXXQGGMMQPMFTCKFSCRSNSDLRSRSMH

SEQ ID NO: 122249 - protein, 234 aa, Triticum aestivum
  unsure (1)..(234): unsure at all Xaa locations
  Clone ID: PAT_TA_16667.pep
GTRPQCYPQRDPLFDPSTSSTAAAVRCSSPACRSLGPYGNGCSNTSANAECRYLIEYSDDRATAGTYMTDTLTISGSTTVRNFRFGCSHAVRGKFSDLTAGTMSLGGGAQSLLAQTARSLGNAFSYCVPPASASGFLSIGGPVTTNSTTVFATTPLVRSAINPSLYLVRLQXVVVAGRRLRIQPVVFSAGAVMDSSAVITQLPPXAYRALRRAFRSAMRAYXRSGATGTLDTCY

SEQ ID NO: 122250 - protein, 268 aa, Triticum aestivum
  Clone ID: PAT_TA_16668.pep
MIGEMDADMVVGYFGGKSILITGSTGFLGKVLVEKILRVQPDVKKLFLLVRAPDVESAKLRIQTEVTGREIFLVLKEKHGMGFYDFIDEKICPLAGDIMHENFGLDTANLRELSKDIDIMVNIAATTNFSERYDVAFDANVLGAKHVCAFARKCTKLKMLLHVSTAYVAGEQEGLILEKPFLMGETLKEGTHLDIESELNLIRETRRELKANCSLEKAERRTMNELGLKRARQFGWPNTYVFTKAMGEMLLGHLRGELPVVILRPSII

SEQ ID NO: 122251 - protein, 125 aa, Triticum aestivum
  Clone ID: PAT_TA_16669.pep
TRKVIEGGIEIKKIKRRPSRSSISSGQVRTNHVAAAAPSAVPLPAQIYDHGSYYQCWAQGGGGASRRCSLASPLLQPAPLNAHRTPVPSPYLASPAPSASGYNLYSLCTLPTVNKIFDSMCNGFR

SEQ ID NO: 122252 - protein, 105 aa, Triticum aestivum
  Clone ID: PAT_TA_16670.pep
MVVHVVLLAAPAVGGFLLHAFKFSGLLWPFNLTLPLLRDLPRVCATLRGAASLYAAELRASLAGRRRRAPAPQLDRQYFSLRGVRRRPAERLVDHAMLALVDISY

SEQ ID NO: 122253 - protein, 170 aa, Triticum aestivum
  Clone ID: PAT_TA_16671.pep
MGAIMCCLRGRGPGDDAPGCCCLPWPFLNNDRNNDNNNTNHNSGPPAPQRANTRVAPVQGRVPPAGSRQDDSMNTFRCPPRPLPYDDPQFRHQTERHPLVAGRDKASTQSQKSNLLEESNDADTRSTCADEKADGSSLKAESGGKKLGGAKVCVPSDCEDDCPICLEEYD

SEQ ID NO: 122254 - protein, 135 aa, Triticum aestivum
  Clone ID: PAT_TA_16672.pep
CSKEPIPSGHEAPGPGARAPDPATLLPSRPPWTTSRASWPATSASALRGKLRPCRPPAPRRPLDPPGTAPDPPPLPRHPPPPTTISSGPRPPRRRPSPRSRPPSTPCSTPSRSPLPQPRRPSPSTRCPVFDKPVD

SEQ ID NO: 122255 - protein, 174 aa, Triticum aestivum
  Clone ID: PAT_TA_16673.pep
RVRRGRARSYSPKSGPLRSPLQPVRREIQKGRAAVEFEKKAHADNLLQSKAMEKNMIAVASEIERLRGELVNAEKRATAVTTAAAVTNPGYAQPYSSSEATYATMYGNPEAAYAAYGSAEATYAGTYANSDAYSTTNQAQTRTDGNPHYMTQPVHYAQYEGQQQQQQQHTNAQR

SEQ ID NO: 122256 - protein, 122 aa, Triticum aestivum
  Clone ID: PAT_TA_16674.pep
MASAGVVAAAAVVAALAAFCATDPMRLGSMADFPGFEAHPVELPDAAEMPPHADAAERLRGAEIRFRGEVQGPESVAFYPLGRGPYTGVADGRVLVWDGARWAYFAHASPGWTAERCGGPKA

SEQ ID NO: 122257 - protein, 251 aa, Triticum aestivum
  unsure (1)..(251): unsure at all Xaa locations
  Clone ID: PAT_TA_16675.pep
FGRGNTLFLLAAAASADERIRPYTRKWESSVMSTIDELRLRAVPVPDPEGAARCDVRHDVPAVVFSTGGYTGNVYHEFNDGIIPLYITARRYNRKVVFVMLEYHDWWMTKYGHIVEQLSDFPPVDFSNDTRTHCFPEAVVGLRIHDELAIDASRMPGSQGIQDFRHMLDDAHRGRINAIIEEENAAPQAAPAAAALAQKRQPRSSSSDTEDKPXRLVIVSRNGSRAIENEPELARAAARAGFRVTVLRPRP

SEQ ID NO: 122258 - protein, 260 aa, Triticum aestivum
  unsure (1)..(260): unsure at all Xaa locations
  Clone ID: PAT_TA_16676.pep
MNKRPRDEPSSSLASAQKRQFGAGGGGGGYGGQQGYSEERNSARRVADHYSARSNQTLEERENSPIIHLKKLNNWIKSVLVQLYARPGDCVLDLACGKGGDLIKWDKARVGYYVGVDIAEGSIKDCMTRYNGDTDQQRRKKFSFPARLICADCYETRLDEYLCEDAPFDICSCQVAMHYSWSTEARARQALANISALLRPGGTFIGTMPDANVIIKRLRESEGMEFXNSVYCITFGEEYTEKKFPASXPFGIKYKVHLED

SEQ ID NO: 122259 - protein, 227 aa, Triticum aestivum
  Clone ID: PAT_TA_16677.pep
EMSLLASSNRAPCYPESSCHLFSFEFLFLGWWLRCPDECVHAFDAVSTGADPHLPRRHWQHGYGERQAESAGCAARPRLAAVAEVLKVGGAEETVGDLTEDGAPLRGFAERNRATDLLSCYPPHLSCCRTRTKFPLACAVWARRPSVVPVAPVLPRGSPCASAPAPVFLGGVTSRAACPALCLPRGPVGRRVPRCGSASAPRFLAVSSRAPGLPPLPPSSFLVLADF

SEQ ID NO: 122260 - protein, 136 aa, Triticum aestivum
  Clone ID: PAT_TA_16678.pep
MSWRSMTSRHGAGVAEGGLGRRTRRGPGGTARSRRGSATPRWTACCACSVACPSPTPPPATPRPPPPPPPQPPRPSAGPPSSPAPPGAPATGARTRSSPEGTGAEPEGPGRGASSARAWTASPGRLPSSPPATLRP

SEQ ID NO: 122261 - protein, 254 aa, Triticum aestivum
  Clone ID: PAT_TA_16679.pep
RKQDRWTSLLYDPEISAQASARMVEYETELSTSNPAKLHKLVNSKAKDFSFQKRKIESVKNLYYAMRKRVCNEPCNTNDLGFLIAPCSCMAIGGECVCGGVPKPSHDQHVVQNIEPGMNTVSCYGQAGGSYSGAQQTHPEINGHSFHAQHPGSMIKARGATNNAPYVYSDVQMYDTYTQKVPEPSEVNNVSLRGITDFQDSMQFQQLASSNQCGNEVVESKEMLITDQVGVEHVHFPANNSGKTIWNGVDETNT

SEQ ID NO: 122262 - protein, 309 aa, Triticum aestivum
  Clone ID: PAT_TA_16680.pep
MDGAGGIFAAVVCALLVFAIFPLLLWRRRSDAAAAVDNHRLPPQPLQGERVLRGGAAARRMRRRPAAASSSAASTSRDVADDESGSEEEDPNVPKGSKKERKRQEREEREAQRQANEAARNSRRTNQDRYEEMRRKKDEEREAQERLLEEEAMARKAKEEEAAALEFEKWKGAFSVDAEGTTESETQDGGQGLLHNFVEYIKKQKCCVPLEDLAGEFGMRTQDCINRIITLEGMDRLSGVMDDRGKFIYISIEEMQAVADYIRKHGRVSISHLANNSNEFIDLEPKPLYDEKEESHQDESAPAGVVAEA

SEQ ID NO: 122263 - protein, 214 aa, Triticum aestivum
  unsure (1)..(214): unsure at all Xaa locations
  Clone ID: PAT_TA_16681.pep
MDREQVTEFLGQVPLLQCLPGSSIRRIAEAVQVKHYEPGDYVAREGEPVDGLCIILDGQAEVSAPANTEEANRPDYVLNKYDYFGYGTNSSVHQVNVIAVTKLSCFVLPSQYGHLLQTKTIWNAEETPESHSLMEQILHLEKLEVDIFRGFTLPEAPTFNQVFGGQLIGQALAAASKTVDCLKLVHSLHAIFLIAGDNNMPIIYQVHXERDGTS

SEQ ID NO: 122264 - protein, 268 aa, Triticum aestivum
  Clone ID: PAT_TA_16682.pep
DFCIGLWLSAFTWPIAEASYPRNRLKLVHSLRICVRIAGDNKMPIIFQVRRERDGTSFATRKVEAKQKGLVMFTLIVSFQKEELGFEHQAAIMPDVPPPEQLLNMEEIRERRLTDPRFPMQYRNSAAKKKFVPWPIEMRFCQDSKSQHEPSLHYWFRARGKLSDDPALHRCVVAYASDLLYSGVSLNPHRKRGLKTYSLSLDHSMWFHKPVKADDWLLYVIDSPSAHGGRGFVTGRMFNRQGELIVSLTQEALIRRAKTPGQTPRPKL

SEQ ID NO: 122265 - protein, 100 aa, Triticum aestivum
  Clone ID: PAT_TA_16683.pep
MSFRSIARDVRDGFGSLSRRSFDVTIASLYGLTGHHKGKAQSSLDDFLDPAPVIQESRWASLPPELLQDIIRRLEADESTWPSRKHVVCFAAVCKTWREM

SEQ ID NO: 122266 - protein, 119 aa, Triticum aestivum
  unsure (1)..(119): unsure at all Xaa locations
  Clone ID: PAT_TA_16684.pep
TRIQTRGQVYSLRSRDQGWGAASPATSAAARRRSAGARRGRRRGRARARAGRTRRSTTSSRATGCAASTPPSSYLFQASKLKDMDALSKSGFLMLGGFTQKNGMGXATNSIGPALXSDN

SEQ ID NO: 122267 - protein, 66 aa, Triticum aestivum
  Clone ID: PAT_TA_16685.pep
VWHCLERQQLRHRRIGQGCSSPVASTDGRCSTPPCASGSSPLTFLHPRLFVSLHLAHNHLHTIHIS

SEQ ID NO: 122268 - protein, 196 aa, Triticum aestivum
  Clone ID: PAT_TA_16686.pep
MGSSSTLSSVREIRRLQRADGPAAILAVGTANPPNCVSQEEYPDYYFRVTKSQHLTGLKQQLKSFCQMTSTEMRYFHHTEELLDAHPEFLRRDTPSLDARLDIAAAAAPELAASAAAKAIAEWGRPATDITHLVVSTNSGAHAPGVDLRLASLLALRASVCRTMLNLNGCSAGAASLRLAKDMAENNRGARVLVAC

SEQ ID NO: 122269 - protein, 251 aa, Triticum aestivum
  unsure (1)..(251): unsure at all Xaa locations
  Clone ID: PAT_TA_16687.pep
VRDKQKELQDLGASHKEFTGLISXRLAEIRRRQEERIEILNKLATFLNILTDLKSISSSKAFQVLKDQLQKSQAELDQCRTLLEKLHVNKDKLIWQEREVNVKVDLSGIPHRVSLNCESTIAVLNQNLRKVVDEKNMLALKLEKSSREPGRNQIISEFKALVSSLPGEMGAMQTELSKYKDDASELHSLRAEVRSISDILARNEHTINESLCRSTHAGSEVRDLRSRVHELRQTNRELKLFVEMYKRESTD

SEQ ID NO: 122270 - protein, 103 aa, Triticum aestivum
  Clone ID: PAT_TA_16688.pep
CRPSAHAFADAWAPFPIPPTLPLFRSLAPGLPPSLFTPTSPPLLPLRVSKKGTTRRERRERSWGWSRIDPVRLQRRRHGRRSSGSALKKYAPEQQLTLLISST

SEQ ID NO: 122271 - protein, 239 aa, Triticum aestivum
  unsure (1)..(239): unsure at all Xaa locations
  Clone ID: PAT_TA_16689.pep
GTRVRYEKDIFFETTVLIQLGTSFNSVCAGSSNTHTLWIVAIAVPITVLLCGFLACFMWMRRRRRRVTNLSGRVNIPTMSMEMEQVLKLWKIEESDSEFSLYDFDQIADATKKLSNDYKLGQGGFGAVYKGELPGGLEGPIKEVSTCSLQGLMEFKTEXQLIANLQHXNLVRLLGCSPSPEEMLLRYEYMHNKSLDCFIFDSAKGAILNWERRFRIIDGIAQGLLYMHKHSRLRVIHRD

SEQ ID NO: 122272 - protein, 316 aa, Triticum aestivum
  Clone ID: PAT_TA_16690.pep
PHARHSPSDGDADPPPSVAAAAPRPRRPPPRPPPPPPPPARPPGRDEDDCYDLLGVKQDANASEIKKAYYKLSLKHHPDKNPDPESRALFVKVANAYEILKDEETREKYDYAVAHPEEFFYNTAQYYRAYYGYKTDTRSVLIGLLLIVSAFQYINQLTSYSQAIESVKQTPAYRNRLKALEFERTGGISSKKKGNKPMDKKVEDELRNEVDLQIQGVQKPSVWNLCGVQLILLPYLIGKLLIWQICWFWRYRVKKSPYAWEDACYLTRTSLRMPANTWQNIDEFTKEDLVMKRLWEKANMERHIAEARRGSKQRRR

SEQ ID NO: 122273 - protein, 165 aa, Triticum aestivum
  unsure (1)..(165): unsure at all Xaa locations
  Clone ID: PAT_TA_16691.pep
PAHHIPPPPTHPPIFYRSIDPSSVLPXASATAALTGTPAGKPARRPPFLASRPRTVTAGRVCLPTAPTATPPYRHAADPRDKAIDGVKGVDGELRRGVEEPAEGRSGNTEGAAEEAAEGAREGGAQGRDLGEXADKETEEASDDAKXAARAITKKAATGAKKQAN

SEQ ID NO: 122274 - protein, 157 aa, Triticum aestivum
  unsure (1)..(157): unsure at all Xaa locations
  Clone ID: PAT_TA_16692.pep
MAPEWEAALGMELGMGSHYHHAPPSAAASPMNQHHHHHSAYSHSQPPHQYHFXRXAPLGGDGADPMRVDEMLDLSSHLGAHDFFSGANNGAADNAPAQPAAAAASSSDHQHHHPSSFNLSFADEFYLPVPTEEAAELXEWLSNFVDDSYPDIPNYPP

SEQ ID NO: 122275 - protein, 114 aa, Triticum aestivum
  Clone ID: PAT_TA_16693.pep
LTLDITSCKELISRIVCKLRTCCSSTPGCFPLGLRVPAISTTCLHIHLLTENKQQFASRFMRPVSLIALLAGSVLGHGRVLDVIPVIWKLRIKRGTTSSDVLGALVILGRLHPW

SEQ ID NO: 122276 - protein, 113 aa, Triticum aestivum
  Clone ID: PAT_TA_16694.pep
WLKGRDSGIFLVEISLMFFRNEFHSLFNTTMRKVVKCWPSAKCTGPSRGLTPKTEERSRELLPHTCRLQGAPPPCMEKRSAELRRRVRQTKAATFEYYTQSVARLLTVLLLET

SEQ ID NO: 122277 - protein, 119 aa, Triticum aestivum
  Clone ID: PAT_TA_16695.pep
MGASRKLQGEIDRVLKKVQEGVDVFDSIWNKVYDTENANQKEKFEADLKKEIKKLQRYRDQIKTWIQSSEIKDKKAPPLPRAPLVRVLGRCCLDGWNCFLPSFLHENYLLPRSSVQSTV

SEQ ID NO: 122278 - protein, 136 aa, Triticum aestivum
  Clone ID: PAT_TA_16696.pep
MVAALVLFLLFAAAAVILMLALLVAARAFRQQGRRRHRAPPDSSAPPPPPAVGLPSAKIRLLPSFVPCPCDARGGGDPAPSSPRICPVCLDAARAGERWRALPACGHAFHAACVDRWLLLSPGCPVCRATVAVPVS

SEQ ID NO: 122279 - protein, 152 aa, Triticum aestivum
  unsure (1)..(152): unsure at all Xaa locations
  Clone ID: PAT_TA_16697.pep
KAQEVHKLASMXIDPDTADESLLHCSPEPPGKEIQVDAFVGRMNVDESLVHCSSTPSDEEIPVDAFCSQMNELPPISDYVCTTDKLSLDDISRLADMFPVNDFVDTTGEPPGDDYIGLADISHLPMPMFELDTELNWEGFDFASMERELERL

SEQ ID NO: 122280 - protein, 187 aa, Triticum aestivum
  Clone ID: PAT_TA_16698.pep
MDSANGDNMAAGIMRLLMLMARGPSAADAMPVAGGGRVEVRHFIFSGDGGDLFSGEVGGSVPPASKAAIASLKEVQAAGEGEGEGSLGDCAICLDAFGAGKEMPCGHRFHGECLERWLGVHGSCPVCRHELPKAEPAAEEQPNGDGERRGPRGAVLVSIVTLRGAERPQQEEEQREEPVNIRIEDVD

SEQ ID NO: 122281 - protein, 158 aa, Triticum aestivum
  Clone ID: PAT_TA_16699.pep
DMNNMVYLRAVIKESLRLYPVAPLLAPHLAMADCTIHGYMVPAGTRVVVNAWAVGRDSSSWEDAEEFIPERFTDEGNATNVNFKGNDFQFLPFGAGRRICPGINLGIANVELMLANLMNHFDWELPVGVERKDIDMTEVFGLTVRRKEKLLLIPKSCM

SEQ ID NO: 122282 - protein, 278 aa, Triticum aestivum
  unsure (1)..(278): unsure at all Xaa locations
  Clone ID: PAT_TA_16700.pep
MANLVQELMLETPPRAWFLFLLPLLLLSLHHWFTRKTGSTGQRLPPSPPALPIIGHLHLVGALPHVSLRDLARKHGPDVMLLRLGAVPTLVVSSPRAAEAVLRTHDHVLASRPRSVVSDIIMYGSSDIAFAPYGEYWRQARKLVTTHMLSVKKVQSFRSPGAEEVSMSMAKINEAATASGTVDMSELLNSFSNDMACRIVSGKFFLKDGRSKLFRELINDTSRLLGGFNLEEYFPALGRVGVLKRAVCAKXRRVRNRWADLLDXVIDDRVXQRKSASD

SEQ ID NO: 122283 - protein, 522 aa, Triticum aestivum
  unsure (1)..(522): unsure at all Xaa locations
  Clone ID: PAT_TA_16701.pep
MEDLVKKPMPETPPRALFLFLFFLFLLFVSWFTGKTRKMQHQQRENNHLPLPPSPPALPIIGHLHLVGSLPHVSLRSLARKYGPDMMLLRLGAARTLVVSSLRGAEAVLRTHDHILASRPSSVVSDILTYGSSDMAFAPYGEYWRQVRKLLTTHMLSVRKVQSFRSAAAEEVSIXRMAKINQAAAADAAVDMSELLHTFANDMACRIVSGKFFLKDGQSKLFGELINDTSRLLGGFNLEEYFPALGRVGVLKRAVCAKAERVRNRWADLLDKVIDDRVSKRKSTSDHKDGDFVDILLSVQQEYDLTREHMKALLTDVFFGATDTSANALEFTLAELMRKPHLMLKLQDEVRGIVPRGQEIVSEADMNNMTYLRAVIKESLRLHPLAPLLAPHLAMADCTIDGYMVPAGTRVVVNAWAIGRDPSSWEYAEEFIPERFTDEGSSMHVNFKGNDFQFLPFGAGRRMCPGMNLGIANVELMLANLVCHFDWELPVGVERKDIDMTEVFGLTVRRKEKLLLIPKSRM

SEQ ID NO: 122284 - protein, 354 aa, Triticum aestivum
  unsure (1)..(354): unsure at all Xaa locations
  Clone ID: PAT_TA_16702.pep
MANLVQELMLETPPRAWFLFLLPLLLLSLHHWFTRKTGSTGQRLPPSPPALPIIGHLHLVGALPHVSLRDLARKHGPDVMLLRLGAVPTLVVSSPRAAEAVLRTHDHVLASRPRSVVSDVIMYGSSDIAFAPYGEYWRQARKLVTTHMLSVMQSFRSAAAKSLPSFSMRRPHRRSKHEDEARSNCRSKTWKYNIQQXMSKTTYLMTGIKESFRLYPLAPLLAPHLAMADCIIDGYIVPAGTRVVINAWAIGRDPSSWEYAEEFVPERFTDEGSSMHVNFKGNDFQFLPFGAGRRMCPGMNLGIANVELMLANLVCHFDWQLPLGVERKDIDMTEVFGLTVHRKEKLLLIPKSRM

SEQ ID NO: 122285 - protein, 205 aa, Triticum aestivum
  Clone ID: PAT_TA_16703.pep
SARGQRAGVGMTIAMLANVAAAAVETRRKSVAAASGMLDAPKGATLPISVFWLVPQYAIHGIADAFMDAGRLVPAPVLAPRRGWSTAAALYWLTISAGSYLGTLLVTIVHEKTRASGQWLQDNLNRGKLDNYYWLVVGLQGLNLVYYFVCVKYYTFKPLETEVEHQPGHGNGTESAQEGCKLQVTRMRGRMYLAICHDILILPRV

SEQ ID NO: 122286 - protein, 206 aa, Triticum aestivum
  unsure (1)..(206): unsure at all Xaa locations
  Clone ID: PAT_TA_16704.pep
MATSFQGTPTKXTPCDKTVYLVDKLTADNRVYHKACFRCHHCKGTLKLANYNSFEGVLYCRPHFDQLFKRTGSLDKSFEGTPKVVKPERNVGNENATKVSSAFAGTREKCFGCTKTVYPIERVTVNNTMYHKSCFKCCHGGCTISPSNYIAHEGKLFCKHHHTQLIKEKGXSASSRTTTTRRHRVPGQWMMKTRSISQSLRISIDE

SEQ ID NO: 122287 - protein, 91 aa, Triticum aestivum
  unsure (1)..(91): unsure at all Xaa locations
  Clone ID: PAT_TA_16705.pep
MAVVADRSMLRSYASLLRAAPARASSSAARPSLRRALGAPPRLLRXPVEASFCVESLLPLHSATAAARMTSMLAVPGRGLGWLTEGKDETR

SEQ ID NO: 122288 - protein, 144 aa, Triticum aestivum
  Clone ID: PAT_TA_16706.pep
CAAARGGRAEKHQNTYCSHIDDTSTSAAAAYSYLPASQSKERKNGGQAQSGSTGGRSPPGGVPVSRDGGGREWRQAASGAGGRGHCACGDGGIAGGRCYPDGGEGRRAQANVRRRHAPRDQGLRAQPRCRALSAGHAMPCHGCH

SEQ ID NO: 122289 - protein, 81 aa, Triticum aestivum
  unsure (1)..(81): unsure at all Xaa locations
  Clone ID: PAT_TA_16707.pep
RSKYQRVYVSDLCREFTEEEVKEALFSMAYNRAPGPDNIPVEFYXVCWDIVKEDIMRLFASFHNGTLDVQRLNYGVITLLP

SEQ ID NO: 122290 - protein, 280 aa, Triticum aestivum
  Clone ID: PAT_TA_16708.pep
AGRVAILPKFLEASTRSQLSSYRQPWLPRPPHASPSSRKRWSSPRETPSSSPPSSSSWPSSPSLSPPSTWSSSSRSPPRCSATSPRCRPPTPQAPSLPGSWRRYGRKPGSSSSSPSACFSSPWRWSSPSRSSPSPPPPRPTPATATRSPSSSEGPPHASPSSRKRWSSPRETPSSSPPSSSSWPSSPSSSPRSTWSSSSRSPPRCSATSPRCRPPTPRAPSSPGSCRRYSRTPGSSSSSPSGSFSSPWLSSSAKQILAFSAASTTYSGDVLLARRAPPEG

SEQ ID NO: 122291 - protein, 152 aa, Triticum aestivum
  Clone ID: PAT_TA_16709.pep
MGALDHLSRLCNLTHTREAIRIKKRRPLTTVNIKVKMDCEGCERRVKSAVKSIRGVTTVVVNRKINKVTVTGYVEPRKVLARVKRTGKTTADMWPYVPYTVATYPYVGGSYDKKAPAGLVRNVPQAMADPAAPEVKYMNMFNDEDVTACTVM

SEQ ID NO: 122292 - protein, 161 aa, Triticum aestivum
  unsure (1)..(161): unsure at all Xaa locations
  Clone ID: PAT_TA_16710.pep
MGALDHLSDLXSMTETKEALKLRKKRPLQTVNIKVKMDCEGXRGRRVKNAVKSILGCDEVWPSNPKMSKITVTGHVXEPRKVLERVKSTGKAAEMWPYVPXTSLATYPRTSAAPTTRKGTGRAFVRAAPPPRPWPDPAAPEIHYMNMFNDEXVNACTSHVI

SEQ ID NO: 122293 - protein, 214 aa, Triticum aestivum
  unsure (1)..(214): unsure at all Xaa locations
  Clone ID: PAT_TA_16711.pep
MADGVLLTTAPAALTLVFLLFFGAAHGQLQMGFYSDSCPGAEDIVTAAVQEAAXPDATILPALVRLQFHDCFXRGCDASVLITSAGNAAVVNNNKHQGLRRLDVVDRAKAGPEGQPPGAPARAALAAPASPVPRPLPVGPPSRVPTPRRAAPSSSVPHADLPPAVRASIQVLRSKFAASGLNDRDLVLLTAAHTXGTTACFFVKDRLYSYPLPG

SEQ ID NO: 122294 - protein, 121 aa, Triticum aestivum
  Clone ID: PAT_TA_16712.pep
TSPHHRSLRAPPLLHRRTCPLQCICLIDDLIRRTGAGPPSSSYTEPLPRHRLPWSQICFPEADAKRRSTTVVDNELTPVADHDSQRPPRPSFSSSIGNVCIESLSSTCAVPILFIPTHQIA

SEQ ID NO: 122295 - protein, 405 aa, Triticum aestivum
  Clone ID: PAT_TA_16713.pep
MAFAPLAARLAASALVAGVVAAVVAMPVPAAGGVCFDRIFSFGDSLTDTGNFLLSVPDDFPDPARSLPYGQTFFGRPSGRYSDGRNLLDFFAEAFGMPFVPPYLGGGDFLNGANFAVGGATALNNSFFRELGVEPTWTPHSLDEQMQWFKRLLPSIASTESEHSVIMSKSLFLVGEVGGNDYNHLMVRGKSLAELRELVPQVVGAISLAITELIILGAKKFVVPGNFPIGCVPLYLAILPSEEKDYYNEETGCIKWLNEFTEYHNRLLQEELEKLRNLHPDVSVIYADYYGATLNIYRAPLQFGFTVPLNSCCGSDAPHNCSLSVLCGNPGSFVCPDPSKYVSWDGLHFTEATYKVIIQGVLGSYAVPPLSEICRDGEYKVSQLHQCTDSNPTNTVTYDAMSSFI

SEQ ID NO: 122296 - protein, 345 aa, Triticum aestivum
  unsure (1)..(345): unsure at all Xaa locations
  Clone ID: PAT_TA_16714.pep
VLAPLTXERSFGNVPQPHAILYYQQRTTKGGLLIAEATGVSDTAQGYKDTPGIWTKEQVEAWKPIVNGVHAKGGIFFCQIWHVGRVSNHTFQPNGQAPISSTDKPLKPVVRANGIDVPTISTPRRLQTNEIPLVINDFRAAARNAIEAGFDGVEIHGAHGYLIDQFLKDQVNDRTDKYGGSLENRCRFALEVVQAVVDEVGADKVXIRLSPFANYSEAXDSXPEALGLYMAHALNKFGILYCHMVEPRMVNIGEKLETPHSLRPMRDAFKGTFIVAGGYGRDDGDKAIADGYADLVAYGRLFLSNPDLPRRFEMDGPLNKYNRDTFYLSDPVIGYTDYPFLPSDV

SEQ ID NO: 122297 - protein, 375 aa, Triticum aestivum
  unsure (1)..(375): unsure at all Xaa locations
  Clone ID: PAT_TA_16715.pep
MSNAASTTPLLAHYKMGKFDLSHRVVLAPLTRERSFGNVPQPHAILYYQQRATKGGLLIAEATGSFRTLLKGYKDTPXASSKKQVEAWKPIVDGVHAKGGIFFCLGQIWHVGRVSNHTFQPNGXDAPISTDKPIKPETATRADGIGLAKVSTPRXRLKTDEIPLVIDDRVAARNAIEAGFDGVEIHGAHGYLIDQFFKDQVKDRTDKXGGSLENRCRFALEVVQAVVDEVGADKVGIRLSPFASYSEASDSNPEALGLYMAQALNKFGILYCHMVEPRMVNIGEKFETPHSLRPIRDAFKGTFIVAGGYDRDDGNKAIADDYADLVAYGRLFLSNPDLPRRFEIGAPLNKYIRDTFYLSDPVIGYTDYPFLPSDV

SEQ ID NO: 122298 - protein, 101 aa, Triticum aestivum
  unsure (1)..(101): unsure at all Xaa locations
  Clone ID: PAT_TA_16716.pep
MAKLMCLCFIILTIGVAVSADECEGDRQAMIKECAMYQKWPANPKIDPSDACCAVWQKANIPCLCVGVTKEKEKIXCMEKVGYVANFCKTPFPHGYKCGSK

SEQ ID NO: 122299 - protein, 197 aa, Triticum aestivum
  Clone ID: PAT_TA_16717.pep
GVDRKDFNSYGSRRGNDEVMARGTFANIRIVNKFLGGEVGPKTIHVPTGEKLSVFDAATKYKSEGHDTIILAGAEYGSGSSRDWAAKGPMLLGVKAVIAKSFERIHRSNLVGMGIIPMCFKAGEDADSLGLTGHERYTINLPTDVSEIRPGQDVTITTDDDKSFTCILRFDTEVELAYYNHGGILPYVIRNMAGAQN

SEQ ID NO: 122300 - protein, 107 aa, Triticum aestivum
  Clone ID: PAT_TA_16718.pep
MAKLMCLCFIILTIAVAVSADECEGDRQAMIKECAKYQQWPANPKLDPSDACCAVWQKANIPCLCAGVTKEKEKIWCMEKVAYVANFCKKPFPHGYKCGSYTFPPLA

SEQ ID NO: 122301 - protein, 181 aa, Triticum aestivum
  unsure (1)..(181): unsure at all Xaa locations
  Clone ID: PAT_TA_16719.pep
MVSWTVTKQGFLASRICFLPDLKFRDVCAQRGKCYELFMRTQNARLRVTTLSFSNPARYGCGCARDWTCXGTPMHLGMKAVISKTLERFHRRHLVEMGIITLCFKAGDADDXLAFTRHERYTINLPTDVREIRPGQDVTITTDNDKSFTCILRFDTEVELAYYNHGGILPYVIRNMAAAQN

SEQ ID NO: 122302 - protein, 231 aa, Triticum aestivum
  Clone ID: PAT_TA_16720.pep
MVSFKSLLVAVSALTGALARPFDFLDERDDGNATSVLEARQVTGNSEGYHNGYFYSWWSDGGGYAQYRMGEGSHYQVDWRNTGNFVGGKGWNPGTGRTINYGGSFNPQGNGYLCVYGWTRGPLVEYYVIESYGSYNPGSQAQHRGTVYTDGDTYDLYMSTRYQQPSIDGVQTFNQYWSIRRNKRTSGSVNMQNHFNAWRSAGMNLGNHYYQILATEGYQSSGSSSIYVQTS

SEQ ID NO: 122303 - protein, 243 aa, Triticum aestivum
  unsure (1)..(243): unsure at all Xaa locations
  Clone ID: PAT_TA_16721.pep
QWXVLXNIEMFGRGGLAPGVGFGWGTCGGGFWSLKXLLAQLDSQLVLELIKIIYAAPEALLPSVKVQTRIIPVLGVSLIAGPGQISTLERAFDILFQPSVLKCLKSSMHCLASQRKLPKTFEWDITEDEYQHFSRVLNSHFRSRWWAIKKKNPDKHARNNSAINKPKVPETLETIQEEMELTEVVNPPCSTFVLEWPHQRLPLPAHGILSSCGCSVGADVSCAGLGLELTFFSLFGKTSLFPP

SEQ ID NO: 122304 - protein, 276 aa, Triticum aestivum
  unsure (1)..(276): unsure at all Xaa locations
  Clone ID: PAT_TA_16722.pep
RWPVVPRLDRRSVWGTATRHTXRATLEGSSGSGFEWLRWHPRGNLIIAGSEDCNVWMWNADHNAFLNTFAGHSSTVTCGDFTPDGKLICSGSDDATLRIWDPKSAQCRHVVRGHGYHTQGLTCLAITPDSQSIVSGSEDNSVHIVSINSGQVVGSLVGHTNSIECIGISSRYNWVATGSIDRTLIIWDLARQAIRSTCEHDEGVTCLAWLGSSRYVASGCIDGMVRIWDSLSGDLARMFSGHRDVVQSLAVSADGNSIVSVSTDKSARVFDISMFK

SEQ ID NO: 122305 - protein, 274 aa, Triticum aestivum
  Clone ID: PAT_TA_16723.pep
FGTRLASIPFKGQVLNETSLWWFNRTSHITPNAVVSSPDRNVTIAKRCSVFPVEFVVRGFVTGSTDTSLWTVYNKGVRNYCGNAIPDGMVKNQKLPANILTPTTKAADHDVPITPDEIVKSGLMSKDDFDEARSKALSLFEYGQKVALENGVILVDTKYEFGKTADGTVVLIDEVHTPDSSRYWIANSYEERFKSGLEPENVDKEFLRLWFKNNCNPYEDKVLPEAPEELVSELAWRYIFLFETITNTKFEIPETQEPIHERISRNVAQALRNL

SEQ ID NO: 122306 - protein, 141 aa, Triticum aestivum
  Clone ID: PAT_TA_16724.pep
LPTSPIAAASAITHESTRARDPRLLPPSAGPGRCRREPADHHHASSFPLLSLSSFSPVSRPRAPTGHGHGRRLSTSSSRPPHLAAPSAVPAVGGGGGGRAVGAGGASSQLRQLSFLSRSTHICRLVQTSRRLVHPRLDSYL

SEQ ID NO: 122307 - protein, 244 aa, Triticum aestivum
  Clone ID: PAT_TA_16725.pep
MAACSALSAATLPSAAAPVSRRRATASPRLPGKRVSGAVRCRAAPGGLGISGKVAELWQAARSAPPGTVLAAVAAAAAVYKVASGLLAPPPPPPRRWQEVADEALPPAPEPVQVGEITADELRQYDGSDPEKPLLMAIKGQIYDVSQSRMFYGPGGPYALFAGKDASRALAKMSFEPQDLTGDVSGLGPFELSALQDWEYKFTSKYVKVGTVKGTGPVEQGNVSTTSEIQEEAAAVKLNGEKAP

SEQ ID NO: 122308 - protein, 106 aa, Triticum aestivum
  Clone ID: PAT_TA_16726.pep
MSRSGGGGRGRQQPEAESAAVPVPGPCASTHRALAECHRRAARGPLQPEVPCRHLNRALAECVVNMCCPGETDAVRTLCGSSGTALKRSQCERARIDLSLCLEAHT

SEQ ID NO: 122309 - protein, 71 aa, Triticum aestivum
  Clone ID: PAT_TA_16727.pep
RRAVPRHRPARDPGGHPLRGADGDADRLVASIHVVMSMLRALLAGCSWALMNRAHSFDAADGGELGQLFFF

SEQ ID NO: 122310 - protein, 326 aa, Triticum aestivum
  unsure (1)..(326): unsure at all Xaa locations
  Clone ID: PAT_TA_16728.pep
GGGRAHCTAVCAPVAHNDRSPVLLPICGGMGAGNTTVLTAVLPEAFWAEAGTNALVVEAAALXEKESMYRAISSMGHHNDMLQSAELVHKSSIDAASSLLVTALNEGRDVILDGTLSWEPFVELSIAMARAVHSQRHRMGVGYKVDEDGTITENYWEPVPNDQDFVAANRDRKPYRIEVVGVVCDAYLAVARGIRRAIMTGRAVRVNSQLTSHKRFAAAFQKYCQLVDGAKLYSSNSLGSPQLIAWKGDINGSLLVEPREIDCLDKVSNLNEGATSLHDLYPGGATTCGSRSIWDDMIVAPSRATVQREIREAIRSVEPTATPTAL

SEQ ID NO: 122311 - protein, 68 aa, Triticum aestivum
  Clone ID: PAT_TA_16729.pep
LLLHCSKGAHGAQLIWQTYRVPIGKSRQLTRRHKDHNYTQPHLAQASILGSTQKLLAFPVCPRIAVRT

SEQ ID NO: 122312 - protein, 239 aa, Triticum aestivum
  Clone ID: PAT_TA_16730.pep
PTRPPTRPPTRPGNTIVVKTSTGDEFHGGKCIITVGAWASKLVKSVTGADLPVQPVHTLVCYWRVKPGHEEELTTEAGFPTFATYGEPGFYGTPSMEYPGLIKVCRNGGPPCDPDGRDWATGTGAGGIAEVVARWIDEFMPGVVDTAGGPVLRQPCMCCMTPDEDFVIDFLGGEEFGKDVVVGAGFSGHGFKMGPAVGTILAELALDGESGTAAEAGLELEHYLIGRFEGNPMGNATSH

SEQ ID NO: 122313 - protein, 148 aa, Triticum aestivum
  unsure (1)..(148): unsure at all Xaa locations
  Clone ID: PAT_TA_16731.pep
RGNTRPRSRCAGTVRRRATGRAGARRQARGWAGSRSIVARWIEEFMTGVVDTTDGPVLRQPCMCCMTPDEDFVIDFLGGEEFGKDVVIGAGFSGHGFRRAXASGRSPAELGVGRSSRAQRRRAAWELEHYLIGRFEGNPNGEPHESMW

SEQ ID NO: 122314 - protein, 73 aa, Triticum aestivum
  Clone ID: PAT_TA_16732.pep
RLRQGQQKRIGGSTDASDNIISDTDKICMQLFLDIQEYARNLRTLGIDAREIESYRSLWQCVAPKDKQDSIQF

SEQ ID NO: 122315 - protein, 189 aa, Triticum aestivum
  Clone ID: PAT_TA_16733.pep
MSEVAAMAGQAYMRQLSKHPLRTKAITSGVLAGCSDAVAQKISGVKKLQLRRLLLIMLYGFAYAGPFGHFFHKLMDKIFKGQKKGKETTAKKVIVEQLTVSPWNNMMFMMYYGLVVEGRPFGQVKSKVKKDFANIQLTAWKFWPIVSWINYEYMPLQLRVLFASSIASCWAVFLNLKAARSIAGASKNA

SEQ ID NO: 122316 - protein, 148 aa, Triticum aestivum
  Clone ID: PAT_TA_16734.pep
SSCCRRASCGARRRRRRRAPRGAASGPRARVGPTASARARGRAGGPPPPPPSGSCSTRSAASSRSSSASASPGCSSSCSSPAARSTPPPPTTSRPCSAPSRQPRRRPRRPQPRPTPSPSPSPPRATRPRPTRTTSPPPRSRRPRGARR

SEQ ID NO: 122317 - protein, 279 aa, Triticum aestivum
  unsure (1)..(279): unsure at all Xaa locations
  Clone ID: PAT_TA_16735.pep
FGTRPPHRRPPPPQPPRSIAVRHGATQSRLPRPQAAPPDPRPRSRARAQTPKPSAPASPPPLLPAAAXPRSPRPPAPSRRRPRRRSRRPPPPPTSSPPSPAXRTPSRPPTSGSPSPASSSASTSTPRPPPTPPASSSSRSAPSGSSRPGAPGPPGRRRTPTPSRSPWPSTSPAPPPSTSPASTTRSPSSPAPSASSPRFSRLKTPPGDEGGDPDAEGFDVRPVAHAVRLQLANVKTALGRREEALADLRASVELKESILPPGSRGARRWRIGTSRRPPL

SEQ ID NO: 122318 - protein, 250 aa, Triticum aestivum
  Clone ID: PAT_TA_16736.pep
MRMPDETEQGVFALRETFSGARQPDWARFSMNEVPPQRSTRPFPMELPHAIYSSSRQGSSNRASRSRGSSRPEDSSPQMFRDVYRRMNMDGIAEVLLALERIEQHDELSYEQLLVLETNLFLSGLGLNDQHRDMRMDIDDMSYEELLQLEDRIGSVSTALSEEQLTNCLSRVVYKRANPALEVNEPVVDDVKCSICQEEYIEDEEVGRMKCEHQYHVCCIQEWLRQKNWCPICKASAVPSPSDAADKGDT

SEQ ID NO: 122319 - protein, 96 aa, Triticum aestivum
  Clone ID: PAT_TA_16737.pep
LIYHDVTTSHASTIPWPKQGTCRSGASGISRNALSWDLTLGITSGWLNPALERLMWHTMNIMVDGIMTIRWSGTRRCWIDHYQMLTNTKHHNNIQR

SEQ ID NO: 122320 - protein, 133 aa, Triticum aestivum
  unsure (1)..(133): unsure at all Xaa locations
  Clone ID: PAT_TA_16738.pep
GANPTDISYIFSXYAPLSIRLVQHGVQLCWRSIEELLKLLPGPHMDLKRGVSTISSSELLPGSGSQQSTDRVGHRSLVLVVFIGGVTSAEIAALRFLSAQEGMGYDFLVATTKVITGNTLLRPIIASSKEGMI

SEQ ID NO: 122321 - protein, 95 aa, Triticum aestivum
  Clone ID: PAT_TA_16739.pep
MSKYVEMLDMGVRIAARFHSHCPQTARMYYKPPQSTSTSSSGAAEAASTDRRAAGFDGEDVAAGFRPFAASGGFGDGVQPRFGFDTAQVVIYEVV

SEQ ID NO: 122322 - protein, 94 aa, Triticum aestivum
  Clone ID: PAT_TA_16740.pep
MAKYAEMLDMGVRIAARFHSHCPQTARMYYKPPQSASTSGAAEAGTTDRRAAGFDGGEDVAAAFRPFAASGALGAGVQPRFGFDTAQVVIYEVV

SEQ ID NO: 122323 - protein, 95 aa, Triticum aestivum
  Clone ID: PAT_TA_16741.pep
MAKYVEMLDMGVRIAARFHSHCPQTARMYYKPPQSASTSGAAEAATTDRTKAAGFDGGEDVAAGFRPFAASGALGAGVQPRFGFDTAQVVIYEVV

SEQ ID NO: 122324 - protein, 123 aa, Triticum aestivum
  unsure (1)..(123): unsure at all Xaa locations
  Clone ID: PAT_TA_16742.pep
MADSGGVNANNAAAGNDEEEGNTAPFPRVGTNXGYPEYRVPRKLGKYGFGKVLVGVRLTGGKARRAPAAAVATXGPPHDWRAFSARTGTHGVPKVHYKGRQGDYYVMIMDMLGPSLWDSWNSA

SEQ ID NO: 122325 - protein, 446 aa, Triticum aestivum
  unsure (1)..(446): unsure at all Xaa locations
  Clone ID: PAT_TA_16743.pep
MSTTKVKRRVGKYELGRTIGEGTFAKVRFARNTETGDPVAIKILDKEKLLKHKMVEQIKREIATMKLIKHPNVVRIHEVMGSKTKIYIVLEYVTXGELXDTIVNHGRMREDEARRYFQQLINAVDYCHSRGGVXTRDLKPENPCTKTMKILLDSCGNXVSDFGLSALSQQLKDDGLLHTTCGTPNYVAPEVLEDQGYDGAMADLWSCGVILFVLLAGYLPFEDSNLMALYKKISDAEFTFPPWTSFPAKRLLTRILDPNPMTRITVQEMLEDEWFKKGYKRAEFDEKYDTTLDDVDAVFNDSEEHHVTEKKEEEPVALNAFELISMSAGLNLGNLFDSEQEFKRETRFTSKSSPKEILRKIEEAAKPLGFDIHKKNYKLRLEKVKAGRKGKLNVATEILRVGPSLHMVEVRKAKGDTLEFHKFYKNLSNTLKDVVWKSDDLQIQPS

SEQ ID NO: 122326 - protein, 219 aa, Triticum aestivum
  unsure (1)..(219): unsure at all Xaa locations
  Clone ID: PAT_TA_16744.pep
AGSPSPRNTETGDPVAIKILDKEKLLKHKMVEQIMREIATMKLIKHPNVVRIHEVMWKQTQIYIVLEYVTGGELFDTIVKHGRMREDEARRYFQQLINAVDYCHSRGECTTGNSXNQKNLLLDSCGNLMVSXVGLSCLIXAERVISXVKDDGYSHTTCGTPNYVAPEFLEDQGYDGAMADLWSCGVILFVLLAGYLPFEDSNLMALYTFLSAAVCTFCN

SEQ ID NO: 122327 - protein, 84 aa, Triticum aestivum
  Clone ID: PAT_TA_16745.pep
GHQNSIEMMPLFPATLLLGGLQHPVVAAALGLLYTVARFFYFKGYATGVPENRYKLGGLNFPAIMGLIICTASFGINLVIREAI

SEQ ID NO: 122328 - protein, 148 aa, Triticum aestivum
  Clone ID: PAT_TA_16746.pep
MAVLVELTKEYGYVVLVVVAYAFLNFWMSFQVGAARKKYKVFYPTMYATEAENKDAKRFNCVQRGHQNSLEMMPLFFVTVLLGGLQHPVVAAALGLLYTVARFFYFKGYATGVPENRYKLGGLNFPAIIGLILCTASFGINLVIREAI

SEQ ID NO: 122329 - protein, 148 aa, Triticum aestivum
  Clone ID: PAT_TA_16747.pep
MAVLVELTKEYGYVVLTVVAYAFLNFWMSFQVGAARKKYKVFYPTLYAIESENKDAKRFNCVQRGHQNSLEMMPLFFVTVLLGGLQHPVVAAALGVLYTVARFFYFKGYATGVPDNRLKLGGLNFLAIIGLILCTASFGINLVIREAI

SEQ ID NO: 122330 - protein, 148 aa, Triticum aestivum
  Clone ID: PAT_TA_16748.pep
MAVSVELPKEYGYVVLVVVAYAFLNFWMSFQVGAARKKYKVFYPTMYATESENKDAKRFNCVQRGHQNSIEMMPLFFATLLLGGLQHPVAAAALGLLYTVARFFYFKGYATGVPENRYKLGGLNFPAIMGLIICTASFGINLVIREAI

SEQ ID NO: 122331 - protein, 134 aa, Triticum aestivum
  Clone ID: PAT_TA_16749.pep
MTGGGKSGGKASGSKNAQSRSSKAGLAFPVGRVHRLLRKGNYAQRVGAGAPVYLAAVLEYLAAEILELAGNAARDNKKTRIIPRHLQLAIRNDEELNKLLGHVTIAQGGVLPNIHQNLLPKKTGKTGKTSSMEL

SEQ ID NO: 122332 - protein, 238 aa, Triticum aestivum
  Clone ID: PAT_TA_16750.pep
VHGLYHETEKTITIGGEHGTVAWVDLWRGIFFCDVLKKRPLLRDVPLPVPARSNWDRLLINDDPGYFRDVTISRNKDSIKYVELEFRSIEVLNPATTPVSYTDWVAVKNSSRKSLHVIRDGWKSTTWSMAIPVGLQERWNRDCVFDVKDISLEPCLSDRMAMLSSKTMKELQVGHPILSMDDDVVYLLSETTPKHMDKLALMFAIDVKKSTLRGLAELDVKKFDYLSSFCTSEICRGT

SEQ ID NO: 122333 - protein, 194 aa, Triticum aestivum
  Clone ID: PAT_TA_16751.pep
MASEYSFARGVSLPAHRPPLAFTSYRLRHGAAVARANRRVVAARAARAVSVGAARRMPGSVRYGGAGVAALRVEERGVAVPPSVPVRVAYELQLAGHRYLDVRTEGEFAGGHPAGAVNVPYMYSTGSGMAKNSHFVEQVSAIFRKDDEIIVGCQSGKRSLMAAAELCSAGFTAVTDIAGGYSTWRENGLPVHGR

SEQ ID NO: 122334 - protein, 197 aa, Triticum aestivum
  Clone ID: PAT_TA_16752.pep
MASEFSFARGVSLPAAAHWPPLAFTSYRLRHSAACTRANPRVVAAARAVSVAAARRMPGSVRYGGARVAALRAEEAEVAVPPSVSVRVAYELQLAGHRYLDVRTEGEFGGGHPAGAVNVPYMYSTGSGMAKNPHFLEQVSAIFGRDDEIIIGCQSGKRSLMAAAELCSSGFTAVTDIAGGFSTWRENGLPVNGRGLL

SEQ ID NO: 122335 - protein, 717 aa, Triticum aestivum
  Clone ID: PAT_TA_16753.pep
MATAASSGGPSDHQYVSVKLESPRLAALDLAPHLFGSHPAAGSWDPSKALPMERAAAAIWELSCVLPSRHETLDFKLLLKPKADSSECIVEEGPNRPLGCGSNQVEMTDAVFKLAEKDSLECKVWVETEMLSPFDLAASWKAHQENLQPSRVRGTYDVVMNTETEARDENDFASGLELDLEKYVVPTTPNMGSGVVYAANLTENPRSLLDTGISPNNLIKGDAPLNHYANTKKVVDGRHTPSQEEQKAVFVDRGVGSPRFARPTNETVSTSNIKQDSETKLGMPAAEGAVAAAAVADQMYGPKEDRKLVIVLVGLPARGKTFTAAKLTRYLRWLGHETKHFNVGKYRRLKHGTNQTADFFRGDNKEGVEARNEVAALAMEDMLSWMEEGGRVGICDATNSTRSRRNMLMKMAEGKCKIIFVETICNDQDVLERNIRLKVQQSPDYAEQTDFEAGVRDFKERLAYYEKVYEPVDEGSYIKMIDMVSGNGGQLQINNISGYLPGRIVFFLVNCHLTPRPILLTRHGESLDNVRGRIGGDSSLSEVGEVYSRKLASFVEKRLKSERTASIWTSTLQRTILTAQPIIGFPKIQWRALDEINAGVCDGMTYDEVKKNNAEEYESRRKDKLRYRYPRGESYLDVIQRLEPVIIELERQRAPVVVIAHQAVLRSLYAYFADKPLEEVPKIEIPLHTIIEIKMGVTGVEEKRYKLMDAVNPTAEV

SEQ ID NO: 122336 - protein, 244 aa, Triticum aestivum
  Clone ID: PAT_TA_16754.pep
MAATKIRWGELDEEDDGGDLDFLLPPPVVVGPDANGLKKTIHYRFDDDGNKVKVTTTTRVVKLARTRLSKAAVERRSWAKFGDAATGDDASTRLTVVSTEEIFLERPRAPGSKADEPSASNDELATANKGTALMVCRSCGKKGDHWTAKCPYKDLVDTLDRPPTSDGPAALNDPAKSSYVPPRLRKDAVYQDGGHDMRRRNDENSVRVTSLSEDTREPDLLELFRAFAPVSRVYVALDQRTGSS

SEQ ID NO: 122337 - protein, 139 aa, Triticum aestivum
  Clone ID: PAT_TA_16755.pep
PLETPRVYAPVSAIQRKAGSDLEVGGIKVPEGTVLTIPIATIHRDKEVWGEDANEFKPMRFENGVTRAGKHPNALLSFSSGPRSCIGQNFAMIEAKAVIAVILQRFSFSLSPKYVHAPMDVITLRPKFGLPMILTSLEM

SEQ ID NO: 122338 - protein, 217 aa, Triticum aestivum
  Clone ID: PAT_TA_16756.pep
MGLLWMVAAAVAAVLASWAINALVYLVWRPRAITRQLRAQGVGGPGYRFFAGNLAEIKQLRADSAGAALDIGNHDFVPRVQPHFRKWIPIHGRTFLYWFGARPSLCVADVNVVKQVLSDRSGLYPKSIGNPHIARLLGKGLVLTDGDDWKRHRKVVHPAFNMDKLKMMTVTMSDCAGSMMSEWKAKMDKGGSVEIDLSHHFEELTADVISHTAFGSS

SEQ ID NO: 122339 - protein, 355 aa, Triticum aestivum
  unsure (1)..(355): unsure at all Xaa locations
  Clone ID: PAT_TA_16757.pep
MGLVWMVAAAVAAVLASWAFNALVYLVWRPRAITRKLRAQGVGGPEYKFFAGNLGEIKRLLAATAGAVLDVGSHDFVPRVQPHFRKWIPIHGRMFLYWFGARPTLCVADVNMVKQVLSDRSGMYPKNIGNPHIARLLGKGLVLTDGEDWKRHRKVVHPAFNMDKLKMMTVTMSDCAGSMMSEWKAKMEKGGDMEIELSSQFEELTADVISHTAFGSSYEQGKXVFLAQRELQFLAYSTVFNVQIPALRYLPTEKNLKIWKLDKDVRSMLMNIIKTRLENKDTMGYGNDLLGLMLEACAPEHGQNPILSMDEIIDECKTFFFAGHDTSSHLLTWTMFLLSTHPEWQEKLREEVLRE

SEQ ID NO: 122340 - protein, 309 aa, Triticum aestivum
  unsure (1)..(309): unsure at all Xaa locations
  Clone ID: PAT_TA_16758.pep
AAWAAFGSSYEQGKXVFLAQRELQFLAFSTVFNVQIPAFRYLPTEKNLKIWKLDKEVRTMLMNIIETRLATKDTMGHHXYGNDLLGLMLEACAVEHGHNPILSMDEIVDECKTFFFAGHDTSSHLLTWTMFLLSTHPEWQENLREEVLRECGNGAPTGDMLNKLQLVNMFLLETLRLYGPVAVIQRKVGSDLEVGGIKVPEGTVLTIPIATIHRDKEVWGEDANEFKPMRFENGVTRAGKHPNALLSFSSGPRSCIGQNFAMIEAKAVIAMILQRFSFSLSPKYVHAPMDVITVRPKFGLPMVLKSLEM

SEQ ID NO: 122341 - protein, 516 aa, Triticum aestivum
  unsure (1)..(516): unsure at all Xaa locations
  Clone ID: PAT_TA_16759.pep
MGLLWLVAAAVAGVLASWAFNALVYLVWRPRAITRQLRAQGVGGPGYRFLAGNLAEIKQLRADTAGAALDLGNHDFVPMVXPHFRKWIPIHGRTFLYWXFGARPSLCVADVNTVKQVLSDRSGLYPKSIGNPGTRTSPACSARGSVLTDGDDWKRHRKVVHPAFNMDKLKMMTVTMAGSTVSEWSAKMDKRGNVDIDVSEQIDQLTELVVSHTAFTTSXACGKNGKHGAQAAPALRVLHFSSLLNRLIHAFPYLPTEKNLKIWKLVKEVRTRLMNIIESRLATKDTMGYGNDXFGLRGRLARAWAPEDRQNPLLSMDEIIDESKTFFFARHHTCSHLLTWTMFLLRTHPKWQXEELVGEAGXEGPTGDMLNMLNLLLLVTLELYAPLALMPRIAGXEREVGGIGAPEGPVVTIPTVMIPRDKEVWGXKDANEFKPIRFENGVTRAGKHPNALFSFSSGPRSCIGQNSAMREDRALIAAIPETSAISLPPITVPAPSARPCPHAAAHVPASLEPPHA

SEQ ID NO: 122342 - protein, 284 aa, Triticum aestivum
  Clone ID: PAT_TA_16760.pep
MSSSVGGGGGGGAALAGGDVAGLLDKAKELDQLRKEQDDVATEINKIHKKIISSPEMVDKSVDAMMARLRGFYVQARELSESEVSASSALVGLLDGLLQSGVSAAPRKKIEISEQKKKRMKSDTDTTRFSSASMRSQLDQAANLKGEQVAARVKSDDEKDEWFVVKVIHFDKETKEFEVLDEEPGDDEESAQKFERKYKLPMSYIIPFPKKGDPSSAQDFGQGRQVLAVYPGTTALYRATVASQRKRKSDDYNLLFDDDEEDGQLPERAVPFYRVVALPEGHRQ

SEQ ID NO: 122343 - protein, 104 aa, Triticum aestivum
  Clone ID: PAT_TA_16761.pep
MSAAAGGLRQLLTAAVTAGAAEARAAVFGHAVNPLGKRAATKLLRKKLIGEHVAQWYPDDIKRDDPVVMAREEKERLAKLEMLKRRGKGPPKKGQGRRAIKRNK

SEQ ID NO: 122344 - protein, 125 aa, Triticum aestivum
  unsure (1)..(125): unsure at all Xaa locations
  Clone ID: PAT_TA_16762.pep
RFACCFHRCGLALARAPAGGLRQLLTAAVTAGAAEARAAIFGHAVNPWGKRAATKLLRKKLIGEHVAQWYPADIKRDDPEVMARDXRKSVSRSWEMLKRRGKGPPKKGHGKACDQRETNNCLASV

SEQ ID NO: 122345 - protein, 152 aa, Triticum aestivum
  Clone ID: PAT_TA_16763.pep
MADEYDAEQAAELKRKRAFRKFSYRGIDLDQLLDLSSDQLRDVVHARARRRINRGLKRRPMGLIKKLRKAKQEAQPNEKPDLVKTHLRDMIVVPEMIGSVIGIYSGKEFNQVEIKPEMVGHYLAEFSISYKPVKHGRPGIGATHSSRFIPLK

SEQ ID NO: 122346 - protein, 131 aa, Triticum aestivum
  Clone ID: PAT_TA_16764.pep
MVSAKKHVPIVKKRTKRFERHQHDRFMRVSPSWRKPKGIDSRVRRRFRGTIAMPSIGYGSNKKTRYMAPSGFKAFIVSNKSDLELLLMHNKTHAAEIAHNVSSRKRVDIIARAKQLGVKVTNPKAKVTTEV

SEQ ID NO: 122347 - protein, 131 aa, Triticum aestivum; identical to SEQ ID NO: 122346
  Clone ID: PAT_TA_16765.pep

SEQ ID NO: 122348 - protein, 372 aa, Triticum aestivum
  Clone ID: PAT_TA_16766.pep
PTSEPPAVATVPTMSAAYDRAAELRALDDTFAGVRGLVASGVTRVPRIFRVPDDAHEAPQEPTGGRQEPAAIPVIDLGCSNRAAVVAAVGRAAAEWGFFQVTGHGVPLEVGTAAVEAARAFHESPGGEGTDKARLYTREPARAVKYNCNFDLHQSKVANWRDTLYLRVEPHPPDAGDMPESCRRDVFFDYAEHVRNLRDTLFALLSEALGLHPNHLADMGCNQGQMILCHYYPPCPEPELAIGTTRHSDSGFLTVLLQDGVGGLQVLHENQWVDITPTPGAFIVNVGDLLQMISNDRFRSVEHRVIANNDAPRVSIACFPSNPSSERIYGPIKELLSGKNPPLYRETLARDYVAHYYSVGLGPKMAINDFRL

SEQ ID NO: 122349 - protein, 163 aa, Triticum aestivum
  unsure (1)..(163): unsure at all Xaa locations
  Clone ID: PAT_TA_16767.pep
MVVLASTPAVDHIPLLRSPDPGDYFSGMPVVDLSSPGAPRAIADACERFGFFKLVNHGVPADTMDRLESEAVRFFSLPQADKDRSGPAYPFGYGSKRIGLNGDMGWLEYLLLAVDSASLSGACAVPSCALFRAALNEYIAPGPFGAVRPRAAMAGALGIXXGG

SEQ ID NO: 122350 - protein, 103 aa, Triticum aestivum
  Clone ID: PAT_TA_16768.pep
PRSWRRKTVSLRSSGLVKCPSLTFSGPVKRIPMPTIEPRLIQHRYRRRSYFVKLHMVNPLQCVYFWFHCRGFLNVLLMSLKTCINAMHRLFYLCKLSRGNSIW

SEQ ID NO: 122351 - protein, 280 aa, Triticum aestivum
  Clone ID: PAT_TA_16769.pep
MRGVDGAAAAAGVWGGLNSGVVLSIIAVLWTVVWQNLQHLQLQHFVNRNLGRHARRLAALVDPYLSVTIAEYDGGRMRRAEAFEEVKAYLAAATSRSARHLRAEGAPDADRLVLSMVDGEEVPDQLLPEEGSGAVFWWASSRPAPPQDRRWGGGGGGGDEENRRFYRLSFLDRHREQVLNAYLPRVRRQGRAVMVQNRRRKLFTNISSHQFSDGGYARSAWTHVPFQHPKTFATLAMDPASKKEVIDDLDAFKAGKEWYERVGKAWKRGYLLHGPPGTGK

SEQ ID NO: 122352 - protein, 152 aa, Triticum aestivum
  unsure (1)..(152): unsure at all Xaa locations
  Clone ID: PAT_TA_16770.pep
MSTATAPGVSFAKSGAGSRAVAPAIRSASFVGYTKQTPNLSGLRMSNKFRVSATAVHKVKLIGPDGEEHEFEAPEDTYILEAAETAGVELPFSCRAGSCSTCAGKMTTXGEVDQSEGSFLDESQMGEGYLLTCISYPKADCVIQTHQEEELY

SEQ ID NO: 122353 - protein, 94 aa, Triticum aestivum
  Clone ID: PAT_TA_16771.pep
MAKISFLFVALLVLAVAFPVKVMGGGGGGKLKPWECPSKCSSRCSGTQYKKACLTYCNKCCATCLCVPPGTYGNKGACPCYNNWKTKEGGPKCP

SEQ ID NO: 122354 - protein, 99 aa, Triticum aestivum
  Clone ID: PAT_TA_16772.pep
MAKISFLLVALLVLAVAFPVEVMGGGNGGAGGGGKLKPWECSSKCSSRCSGTQYKKACLTYCNKCCATCLCVPPGTYGNKGACPCYNNWKTKEGGPKCP

SEQ ID NO: 122355 - protein, 116 aa, Triticum aestivum
  Clone ID: PAT_TA_16773.pep
VFFFFFFSHGITSLYCIKTNTILIMNIIWCKQVSVEVDQHAQLLIFFDQRLRPWHISKLRQALIKSMLCQIHTLGHIRGLHPTLFSLVFPNDGFTDVKGAQHGLIVHHTKTGEHAS

SEQ ID NO: 122356 - protein, 188 aa, Triticum aestivum
  Clone ID: PAT_TA_16774.pep
RVAPPALLGGRRRRGAAAAGAAPPPPPPPSAAAAPPPPPPAPPPPPPPPPPRPTPAPPPRPPPSTTGTSPTARCSAPCPPTRRPWPPPSTSGTPSRSPRLIPMVAAWISPRHISPMMALMIPQRLLRKHFRIISIQKHLSMKRSMTVYPLPLDPLHVLLKPSPCYTRVLKLRMLLLRLLLVKNVWGSC

SEQ ID NO: 122357 - protein, 489 aa, Triticum aestivum
  Clone ID: PAT_TA_16775.pep
MPHLASRLPFIEKLMAAAPTFFSFCSVKPLLHSASPVARNTCRTSRNRGFFRPPPGIYPGWEPASHELLHDFDLQESLVNVQALLHQHPKSRRAMLTTVDHLKRLCIDHYFQDEIDNVMDACVDLVHSDDLLDATLSLRLMREAGYYVSADDVLRKFTNDNGDFNHGLSKDIRGMLSLQDMSHLNMGESSLYKANEFSSKHLRFAIKYLEPNLARYVSQSLDHPYHVSLMQYKARHHLSYLQNLPTRNMAIENLALAEFQIKKLQHQREIKEVKRWWMDLGLAKEIPAARDQVLKWYMWPMTVLEGLSFHRYHLEITKIRNISIVNLEIVDLQITQNELPLFNEAIKMWDPAAAVDSLPSYMISCYKALYTVTNDIAAMVRKEHGLNPITHLKQAWAALFDGFMIERKWLYTNQAPTPDDYLRNGIVTSGAPLVFLHLFFLLGHDLTEGNNDHMLRIISCAAKIMRLWDDLGSAKDESQEGLDGSYKEL

SEQ ID NO: 122358 - protein, 273 aa, Triticum aestivum
  Clone ID: PAT_TA_16776.pep
MAMAMRAAAAFFSPSASPSPKQQQTHSVFSPRRGSTRRIDPRRLRAFPATELTLEELNPSVALLRKTAEAVGDFRKTPIYIVGTDCNAKRNIAKLLANSIIYRYLCSEDLLEDVLGGKDALAAFRESDEKGYLEVETEGLKQLTSMGSLVLCCGDGAVMNSTNLGLLRHGVSIWIDVPLELAVNDMLKSKGAQAISDPDSFSQAMAKLRQRYDDLKERYAVSDVTVSVQNVASQLGYSSIDSLSLEDMVIEIVSRIEKLIQAKAMMEAAGKPE

SEQ ID NO: 122359 - protein, 229 aa, Triticum aestivum
  Clone ID: PAT_TA_16777.pep
RTRGRRAVVLDATVFHPQGGGQPADTGVIVSASGGARFLVEDVRVKDGVVFHYGRFEDAAAGDGCGAEFTKGQSVTLEVDAERRKLNSRLHSAGHLLDSCMTNLGLHLEPGKGYHFPDGPSVEYKGVVPADQLQDKKIQLEKEANELILKGSKVLVSVFPYEEAAKLCGGALPSYISQDSTPRIVKFGDYPGCPCGGTHVADIADIGNLKVTNIRVKKGVTKVSYSINP

SEQ ID NO: 122360 - protein, 140 aa, Triticum aestivum
  Clone ID: PAT_TA_16778.pep
VAKYLEYTVHTQEHMPTAGLSCPPFAAPCPDAIPLTLIVLLLWRAVTLTVLACANELTSLTRFIALKPALTQPLGQLVQRRRRRLHEPQQGRAIRDVEGRAAAMHGRELCSGAQDHQQGDGGHLHRRWSTGHRNSSYFVW

SEQ ID NO: 122361 - protein, 140 aa, Triticum aestivum
  Clone ID: PAT_TA_16779.pep
ILDIASLYYYYSSESSPHKVAAVAMACAPSTVKVAAISLLVILCAGTQLTAVHGRGPALDVADGGEEDVGTALLRLVKPTSAALDELAQKLRQGWLQCSESCQTCIFVCACQNCECDGPPSEENNKCERDCIQRRGCESL

SEQ ID NO: 122362 - protein, 113 aa, Triticum aestivum
  Clone ID: PAT_TA_16780.pep
YRKAVESFTRYRLQICQEEEDWKRIEDRLGCGQVEELIEEAEDELKLIGKMIEWDPWGVPDDYECEVIEDDTPIPKHVPQHRPVALPEEFFKTLDAIKSDPALQGDSPPQVKS

SEQ ID NO: 122363 - protein, 174 aa, Triticum aestivum
  unsure (1)..(174): unsure at all Xaa locations
  Clone ID: PAT_TA_16781.pep
MFLRRILSGGGGLAALRSARAVKETTGIXVGLDVVPEARNVLIGLYTRTLKEIEAVPKDEGYRKAVESFTRHRLQICQEEEDWKRIEDRLGCGQVEELIEEAEDELKLIGKMIEWDPWGVPDDYECEVIEDDAPIPKHVPQHRPVALPEEFFKTLDAIKSDPALQGDSPPQVKS

SEQ ID NO: 122364 - protein, 225 aa, Triticum aestivum
  unsure (1)..(225): unsure at all Xaa locations
  Clone ID: PAT_TA_16782.pep
MFLRRILSERVRRRRRRRDVSAADPKRRGRAGGDGVCAGGKGRRGSAVETESPGRGGGPALCAGGESRRRGSVGLDGGPRGAGSVLIGLPTRAPLKEDRGPVPXDEGYRKAVVVLHPGHRPSRILRGRRKDWKRIEDRLGCGQVEELIEEAEDELKLIGXMMTEWDXPWGVPDDYECEVIEDDAPIPKHVPQHRPVALPEEFFKTLDAIKSDPALQGDSPPQVKS

SEQ ID NO: 122365 - protein, 273 aa, Triticum aestivum
  Clone ID: PAT_TA_16783.pep
MESTQSNTSVMNHFILVHGLCHGAWCWYKVVAALQAAGHRVTAVDLAASGAHPARIDEVHSFEEYSQPLLDVVAAAPEGDGERLILVGHSHGGLSLALAMERFPGKVAAAVFAAAGMPCVGKHMGVTTEEFMRRTSSEGLMDCKMLPINNNHGAGVAMIMGPNFLARKNYQQSSPEDLALAKMLVRPGNLFMEDPVMKDASLLTDTNYGSVKKVYVVAKADGSSTEEMQRWMVLLSPGTEAEEIAGADHAIMSSRPRELCDALVKIADSLNTC

SEQ ID NO: 122366 - protein, 249 aa, Triticum aestivum
  Clone ID: PAT_TA_16784.pep
MGRLDGKVAIVTGAASGFGQGIAEHFAEEGAKVLICDINEEAGEKVAAHSEAFAFQAMNVTKAADWQAAVAKAVQIWGHIDILVNNAGTSYENKSTNLVTEDEFDKVMSVNVKSVFLGSNAFTTQVKKQGTKGSMINIASVGAHRPRPGLVWYNASKGAITNATMGLAAEYGPDGIRVNSICPLATMTGLLPKFIGKEITPEVQKALGNVPLGRMGEIRDVTKAAVFLASEESSFITGVNLDVDGSRAI

SEQ ID NO: 122367 - protein, 115 aa, Triticum aestivum
  Clone ID: PAT_TA_16785.pep
MAAADYDRAYRPYAPSSAADYDRPYRNEIVPYGDRRIDLVVKPPPPTRSPPPPLPVTKSGGGGGIGSAWCFSDPEVKRRRRVASYKAYSVEGKVKASFRRGFRWIKDKCTGFIHG

SEQ ID NO: 122368 - protein, 160 aa, Triticum aestivum
  Clone ID: PAT_TA_16786.pep
MRIDGAHGAEPSDVKSENHPKCETGAVEDEHDFNPRDMGDGTKPREESNGGDESSTVSQTESAVQQNGPDGAKLTTRGGIRNPFESSFSGANITLDAVAPSAHIGNTSLRSDSSTTSTRSFAFPVLQTEWNSSPVRMAKADRRRFRRDRGWGYRVLCCKF

SEQ ID NO: 122369 - protein, 174 aa, Triticum aestivum
  Clone ID: PAT_TA_16787.pep
VSPLGWRLFVVIGAGGAGKALAYGAKEKGARVVIANRTFARAQELGNLIGGPALTLTELENYHPEEGMILANTTAIGMHPNVNETPLSKQALKSYAVVFDAVYTPKETRLLREAAECGATVVSGLEMFIRQAMGQFEHFTGMPAVDDKFRALSNSLDNPSAVKGDRSTSLKPRL

SEQ ID NO: 122370 - protein, 473 aa, Triticum aestivum
  unsure (1)..(473): unsure at all Xaa locations
  Clone ID: PAT_TA_16788.pep
APLRGLPALLGKPRSVAALVTYRQEWEGGEXESDDETRFEAVHXTMEMGGEXVDIELQVASKCFKFMSGKQPGNXVILSSHCYXNMPSAEELVSLLFQIXAAGDDIIKIATTATQIQDVSRMLXFLVHCQXEQVRKIPRADKLLWISLAALTAPKFGGYIIFGXLEKVKEASPTNXAAAVLNKVYNIRQIGPXTKVFGIIGNPVGHSKSPVLHNEAFRSGCFNAVYVPFLVDDLAKFLSKYSSPDFAGFSCTIPHKEAAVRCCDEVDPIARDIGAVNTIIRKPDGKLVGYNTDYVGAISAIXVDGIRATQQTHSTVSPLAGRLFVVIGAGGAGKALAYGAKEKGXARVVIANRTFARAQELGNLIGGPALTLTELENYHPEEGMILANTTAIGMHPNVNETPLSKQALKSYAVVFDAVYTPKETRLLREAAECGATVVSGLEMFIRQAMGQFEHFTGMPAPDSLMRDIVLRKT

SEQ ID NO: 122371 - protein, 227 aa, Triticum aestivum
  unsure (1)..(227): unsure at all Xaa locations
  Clone ID: PAT_TA_16789.pep
MSQQPAQGPAPVRLITAFGSPFAHRVEVALTLKGVPYELLVEDLTNKSELLLAHNPVHQSVPVLLHGDRAICESLVIVEYVDEAFHDDGDGSAPRLLPADPYERATARFWADFIANKCLKPLWQAMWTDGAEQARLARETKESLWVLDAQLEGKRFFGGDALGFVDLAACTLAHWLGVLEEVAGXRLMKDGEYPALGRWAREYTSDEVVRRSXLPDRDELIAYFTKN

SEQ ID NO: 122372 - protein, 239 aa, Triticum aestivum
  Clone ID: PAT_TA_16790.pep
MSLQPAQAPAQAPVRVITAFGSPFAHRVEVALTLKGVPYELLVEDLTNKSELLLAHNPIHQSVPVLLHGDRAVCESLLIVEYIDEAFHHEAAPRLLPTDPYDRATARFWADFIANKCLKPLWQAMWTDGEEQARLARETKESLGILDAQLEGKRFFGGDALGFVDLAACTLAHWLGVLEEVVEVRLMADGEYPALRRWAKEYTSDEVVRRSLPDRDELVAYFTKNKERYLSSMVKAAAK

SEQ ID NO: 122373 - protein, 149 aa, Triticum aestivum
  Clone ID: PAT_TA_16791.pep
FFLQPEIILQAKLPAAETDRAERSDGEADAEQRKEGDGGQGGEAQGAVDRPGRQPRRPRRRAAAAAAAAGAAAPGAQHLGDEADDAGGVRRRDVRGGGGPEGAREAARHAPRRAPTGRSSPWPGPGTPRRRPPATATSTSPACPTSSRR

SEQ ID NO: 122374 - protein, 336 aa, Triticum aestivum
  unsure (1)..(336): unsure at all Xaa locations
  Clone ID: PAT_TA_16792.pep
GGGGADYGHADVELGRAGVAGKHGDDVVVEIKPLFAVKRSLSQDDLSTMTTAGFDGPAQRSAKRKRKNEFRGIRQRPWGKWAAEIRDPSKGVRVWLGTFNSAEEAARAYDVEARRIRGKKAKVNFPQXEPTVPQKRRACPAAPKVPKSSVAQEPTVIPAVNNLANPNAFVYPSADFASKQPLVQPDNMPFVPAINSAASVEAPVMNMYSDQGSNSFGCSDLGWEYDTKTPDISSIAPISTIAEGTETAVLQSKTYNPAVIAEGAESAPVQSNTYNSVVPPVMENNAVDFEPWMRFLLDDGVDEPIDSLLNFDVPQDVVGNMDLWSFDDMPICGKIF

SEQ ID NO: 122375 - protein, 420 aa, Triticum aestivum
  unsure (1)..(420): unsure at all Xaa locations
  Clone ID: PAT_TA_16793.pep
MAEFRLANPVQVESSGAVQHNFAVPPSDFLHQGAAHANDAVDSEMAEFRLSEPVQVESSRAIREMDFLRQHSATVDMPPEPQTSNLVVNTEDIAVSGQTLPFKATMGSVPFVQNTSEPRANGSTETYVTGNPTHFNEGSVNMQGYNFLTSNVSVEPYPSGSTEPWVTGQQQQSFLSQASWGRPSGPTEPHVTGHPTHFNEGSGNVQGYNLHAPSAWLGHNLQEMPPGMTHSNISTAAFQQNTGTIPQYMSYNDRPNDMFTSNFPERERMLSAPYIGFHQTNDLGQLTAEKGITESDGSNKIGSLSSRKRHLEDSMPAPESRTTENLSSRPHGQRTTDAIPNDDDILASILVGRTPGLVLDSTPLPPNASTSKRQRLTPKTALTPKTXTPKXRVKMDDAMVIHADIIRQXXXSTXXXXXIR

SEQ ID NO: 122376 - protein, 110 aa, Triticum aestivum
  Clone ID: PAT_TA_16794.pep
MASSKLQAFWNHPAGPKTIHFWAPTFKWGISIANIADFAKPPEKISYPQQVAVACTGIIWSRYSMVITPKNWNLFSVNVAMAGTGLYQLSRKIRKDYFADEKEVAASLEG

SEQ ID NO: 122377 - protein, 111 aa, Triticum aestivum
  Clone ID: PAT_TA_16795.pep
MASKIQAFLNHPAGPKTIHFWAPTFKWGISIANIADFAKPPEKISYPQQIAVACTGVVWSRYSMVITPKNWNLFSVNVAMAGTGLYQLSRKIRQDYFSDDGKEVAAASLEG

SEQ ID NO: 122378 - protein, 80 aa, Triticum aestivum
  Clone ID: PAT_TA_16796.pep
ALLYSRGGPVPNSPYSESYYNSLAVVLQRRDWENPGVTQLNRLAAHPPFASWRNSEEARTDRPSQQLRSLNGEWQIVSVN

SEQ ID NO: 122379 - protein, 229 aa, Triticum aestivum
  unsure (1)..(229): unsure at all Xaa locations
  Clone ID: PAT_TA_16797.pep
TARPSAPQYPFLPSGRHATARRASRSGSSAAAPPARPSPRSRAGDEARVVDTRDGTIAVASAFPGHQEAVQDRDHKFLSKAVEEAYKGVDCGHGGPFGAVVVRNDEIIVGCHNMVLNNTDPTAHAEVTAIREACKKLGKIELSDCEMYASXEPCPMCFGAVHLSRIKRLVYGAKAEAAIAIGFDDFMADALRGTGFYQKANMEIKRADGNGALXAEQVFENTKEKFRMY

SEQ ID NO: 122380 - protein, 309 aa, Triticum aestivum
  Clone ID: PAT_TA_16798.pep
PACADVRQRASPGLRFLPSFRRRCRRFSLLPASGNPGVAEPAGRRDFGAQQHACGRNWRRCRLRSQCCSRVFGCRACHNDAENSLQVDLHDRQECPRRELSKVVCSLCSQEQNEEQNCSGCGACKGKYICEQCNFFDDDIPKKQYHCDGCGICRTGGIDNFFHCEKCGCCYSNVLKDSHHCVERAMHHNCPVCFEYLFDSTMDISVLHCGHTIHLECLNEMRVHHHFSCPVCSRSACDMTDAWQKLDQEVAATPMPEFYQKKMVWILCNDCGATSSVRFHVLAQKCPGCSSYNTRETRGGPATAACSRV

SEQ ID NO: 122381 - protein, 316 aa, Triticum aestivum
  Clone ID: PAT_TA_16799.pep
HHHLRSVADAADAAHNATAVAVAAPAPAPVQAASPYGDLEEVLARAATADRTVIMTQINAAWTKPGSLLDLFFESFRTGEGGVARLLDHLVIVTMDPAAYAGCELVHPHCYFLRTTGVDYRGEKFFMSKDYLEMMWGRNKFQQTILQLGYNFLFTDVDVMWFRDPFKHISMGADIAISSDVFMGDPYSLGNFPNGGFLFVRACNKTIEFYRHWQAGRYRFFGKHEQDVFNLIKHEMTDRLGVAIQFLDTTYISGFCQLSRDLNKICTLHANCCVGLGAKLHDLRNVLDVWRNYTAAPVPDKRAGKFQWKVPGICIH

SEQ ID NO: 122382 - protein, 153 aa, Triticum aestivum
  Clone ID: PAT_TA_16800.pep
MAALSSAAVSVPSFAATPMRSSSSRMVVRASLGKKAASAAVAMAASAMLLGGSAMAQDVLLGANGGVLVFEPNDFSVKAGETITFKNNAGYPHNVVFDEDAVPSGVDVSKISQEEYLNAPGETFSVTLTVPGTYGFYCEPHAGAGMVGKVTVN

SEQ ID NO: 122383 - protein, 281 aa, Triticum aestivum
  Clone ID: PAT_TA_16801.pep
MILPRHRPPPTAPHHSSSSVANPHKAELQPVSLQNQTKLIACRMASMQAPAPAPAGYPPHGGQAARPQSTAVAVTAASNGAGNPYVQVTPASASPSTCQSIMKALGRYGKLLEDGTRKAADTTGNIWNHLRTAPNMADAAVARLAQGTKVYAEGGHERVFHQVFGGVPGEQLRKAYACYLSTSSGPVIGTLYLSTARLDFCSDSPVSYHAPSPTQPPEPMYYKVVLPLNQVRTVSPSASMWRPSERYIQVATTDSHEFWFMGFVSYDKALKHLSDALQRRP

SEQ ID NO: 122384 - protein, 154 aa, Triticum aestivum
  Clone ID: PAT_TA_16802.pep
MAALSSAAVSVPSFAAKAATPMRSSRMVVRASLGKKAASAAVAVAASAMLLGGSAMAQDVLLGANGGVLVFEPNEFSVKSGETITFKNNAGFPHNVVFDEDAVPSGVDVSKISQEEYLNAPGETFSVTLTVPGTYGFYCEPHAGAGMVGKVTVN

SEQ ID NO: 122385 - protein, 155 aa, Triticum aestivum
  Clone ID: PAT_TA_16803.pep
MAALSSAAVSVPSFAAKVAATPMRSSRMVVRASLGKKAASAAVAMAASAMLLGGSAMAQDVLLGANGGVLVFEPNEFSVKSGETITFKNNAGFPHNVVFDEDAVPSGVDVSKISQEEYLNAPGETFSVTLTVPGTYGFYCEPHAGAGMVGKVTVN

SEQ ID NO: 122386 - protein, 155 aa, Triticum aestivum
  Clone ID: PAT_TA_16804.pep
MAALSSAAVSVPSFAAGAKVAAPRSSRMVVRASLGKKAASAAVAMAASAMLLGGSAMAQDVLLGANGGVLVFEPNDFSVKAGETITFKNNAGYPHNVVFDEDAVPSGVDVSKISQEEYLNAPGETFSVTLTVPGTYGFYCEPHAGAGMVGKVTVN

SEQ ID NO: 122387 - protein, 159 aa, Triticum aestivum
  unsure (1)..(159): unsure at all Xaa locations
  Clone ID: PAT_TA_16805.pep
MAALSSAAVSVPSLAAQGXATPMRSSSSRMVVRASLGKKAASAAVAVAASAMLLGGSAMAQDVLLGANGGVLVFEPNDFSVKAGETITFKNNAGFPHNVVFDEDAVPSGVDVSKXISQEEYLNAPGEXTFSVTLTVPGTYGFYCEPHAGAGMVGKVTVN

SEQ ID NO: 122388 - protein, 216 aa, Triticum aestivum
  Clone ID: PAT_TA_16806.pep
MAPVKVFGQAMSPNVARVLVFLEEAGTDYELVDVDFQAKEHKRPDHLARNPFGQIPAFQDGDLLLFESRAIAKYVARKYKTDEADLLREGDLSEAAMVDVWTEVEAHTYSAALSPIVYECLIFPLMHGKPTDEKIVDESLEKLRKVLEVYEERLSKHRYLAGDFLSFADLNHFPYTFYFMATPHGALFESYPRVKAWWDSIMSRPAIQKLSATMTP

SEQ ID NO: 122389 - protein, 216 aa, Triticum aestivum
  Clone ID: PAT_TA_16807.pep
MAPVKVFGQAMSPNVARVLVFLEEAGADYELVDVDFQAKEHKSPDHLARNPFGQIPAFQDGDLVLFESRAVAKYVARKYKTDEADLLREGDHSEAAMVDVWTEVEAHTYSAALSPIVYECLIFPLMHGKPTDEKVVDESLGKLRKVLEVYEERLSKHRYLAGDFLSFADLNHFPYTFYFMATPHGALFESYPRVKAWWESIMFRPAIQKLSATMTP

SEQ ID NO: 122390 - protein, 153 aa, Triticum aestivum
  Clone ID: PAT_TA_16808.pep
MTSTLAATATSRPLRLPASLPSPPPVARPGGGRRRRAVLRCASVSEIAPAVSAAYGALLVGGGAFAYARSGSKGSVLGGASGSALMGLTYYLMQFSETKALGDAVGFGSAFLFASVFGIRLYNTRKLVPSGLLLALSLGALGVFYAAYLQDKV

SEQ ID NO: 122391 - protein, 129 aa, Triticum aestivum
  Clone ID: PAT_TA_16809.pep
MLFVCIADESVWGTGAPPLPPIPPARLASRRVCAGSVGEQSDLDAEGPAILRSPSAPWDELDEEDEYEEDPEPMSDEGIQEPKRKRESAVGGSQRRREVDSDEDSPPRKQAATVHRRKGVVFESDDEDE

SEQ ID NO: 122392 - protein, 327 aa, Triticum aestivum
  unsure (1)..(327): unsure at all Xaa locations
  Clone ID: PAT_TA_16810.pep
PAPIRRRGGPAARPRLRPAPSLPPRTLPFLGRLMRVLGTSGVFGADKDPECGGELYRLTPLSRILVDGVDADEHHSQKYFVLAVTSPRLAEAALGLADWFKKDLEPPVPSPFEDMHGAPIFDERTPLMDEEFDAVTNQGLAAHDNLGIATILRECGDIFKGLESLTDCCGGDGMTARALVKAYPHIKCTCTVLDLPKVIDKAPTDGVVYYVAGDLFHTVPSSQAVMLKLVLHFWSDEDCVKILTQCKKAIPPRDEGGKVIIIDTVIGPSLAPIMFEAQLLMDMLMMVNTRGAPRGETGCRLLLRXPGCKDCKIVKKLGARCVIEVYP

SEQ ID NO: 122393 - protein, 182 aa, Triticum aestivum
  Clone ID: PAT_TA_16811.pep
PSPTRPVDVLSMSFGVDENSFGVLHAVQKGITVVYAGGNEGPRPQTVRNGAPWAITVAASKIDRSFPTMITLGNKQQIVGQSLYCRGKNSSKSSSGFKGLVVPVSCAMDILNGTDVKGQILFCTMQPGDQDVFQQAAQYVQDGRGSGVIFAQYTTDLSFTALDVCQGIACVLVDLDIGKEIA

SEQ ID NO: 122394 - protein, 406 aa, Triticum aestivum
  unsure (1)..(406): unsure at all Xaa locations
  Clone ID: PAT_TA_16812.pep
MGILHSSSSSSRVAWVLLLLLLCFCELSFRARGGGSRKLYIAYLGHVKHDDPNDVVASHHDLLTNLLESKEESLASVVYNYKHGFSGFAAMLTTEQAKELAEFPEVISVQPSKRHTPTTTRSWDFLGLNYQMMGSDMLHGSNSEGEDVIIGVIDTGIWPEARSFNDAGYGPVPSRWKGKCQVGHDWGSKNCSRKIIGARFYSAGVPDQFLETDSLSPPDHNGHGTXXASTAAGFGPGRAASFHGLPQGVARGGAPRARIPVYKSFWGLAFGPTPPLPAALPVAILDRGHVLASSFRVRLPSFGVPPAVQKGITVVYAGGNEGPRPQTVRNGAPWAITVAASKIDRSFPTMIMLGNKQEIVGQSLYYRGKNSSMSSSGFKGLVVPVSCDMDILNGTDVKGKILFCTM

SEQ ID NO: 122395 - protein, 242 aa, Triticum aestivum
  unsure (1)..(242): unsure at all Xaa locations
  Clone ID: PAT_TA_16813.pep
MGIQRVCVVLALLCICLREGGAVTFTFLNRCTGTVWPGILSNAGTARIEPTGFALPPGAARALPFPTGWSGRMWARTGCAQDAAGRFACATGDCGTGTLECSGRDGATPATLAEFTLDGGGHNDFYDVSLVDGYNLPILVEPAGSSATGTTCAAAGCSADLNLRCPAELPFGGXAARARSACDAFGKPEYCCSGAFANPNTSRPTAYSQAFKLACPRSYSYAFDDPTSTFTCAGGRDYTITF

SEQ ID NO: 122396 - protein, 316 aa, Triticum aestivum
  unsure (1)..(316): unsure at all Xaa locations
  Clone ID: PAT_TA_16814.pep
SAEGVLELGATEVIFQTNDSLGRIRSLFNLNGGGGGSGSWPPVAPPPQEAETDPSVLWLADAPAGDMKESPPSVEISVSKPPPPQPPQIHHFENGSTSTLTENPSLSVHAQQPPPQQAAAAAQRQNQHQQQLQHQHQLQLQHQHNQGPFRRELNFSDFASNASVTVTPPFFKPESGEILNFGADSTSRRNPSPAPPAATASLTTAPGSLFSQHTATVTAPSNDAKNNPKRSMEATSRASNTNHHXTATANEGMLSFSXSAPTTRPSTGTGAPTNPDPDTQTGASXAKWETTXFVPPPEXKRPRKXGANPANXAXEP

SEQ ID NO: 122397 - protein, 135 aa, Triticum aestivum
  Clone ID: PAT_TA_16815.pep
WLAALAGWRRRGRSARGRRPRRRLRTRWRCLARARSGTRRCSCSRGWPRPRPGRGRRSRSGRSCARSSAGRTGTPGAPRPPTKTTTTPPAWPRTAPASPGDAAGAPGVRARTRRRSTAGPPGRRCRRRRRAGRST

SEQ ID NO: 122398 - protein, 117 aa, Triticum aestivum
  unsure (1)..(117): unsure at all Xaa locations
  Clone ID: PAT_TA_16816.pep
ARGRRAKPTRPERPSPPPPPPPPPAARRPAPPPPRRPPPPPPRPPPPLSPPPXPPPPPAPPPPPRRKRPGPPPAPPSPINGEGHPAPPPSSPPTAPSSSSSRCRSRYRLTTTAMRTR

SEQ ID NO: 122399 - protein, 223 aa, Triticum aestivum
  unsure (1)..(223): unsure at all Xaa locations
  Clone ID: PAT_TA_16817.pep
RLGTCSSLVATMGDQFPELAMTSADCQSMTWLQSIAFISFWNRDTPVEALLSRTTSLSTYTKSKSDYVQSAISKGVWKDIFSWFTMNGAGLVILEPHGGFMGSVPTDATPYPHRSGVLYNVQYIVFWQGDGGAAANTWLXNFYDFRGPYRSKNPRQAYVNYRDLDIGQNVVVDDVTTFDGGKVWGEQYFASNFQRLASVKAAVDPTDYFRNEQSIPPLAQGRK

SEQ ID NO: 122400 - protein, 224 aa, Triticum aestivum
  unsure (1)..(224): unsure at all Xaa locations
  Clone ID: PAT_TA_16818.pep
MSAPSQLSKDPRNNYFDFGAARQVPETHMWEGLYEHPVVDGGVQAGEDAVPVVDMQDPRAAEAVARASEQWGVFLLEGHGIPSELLARVEAGIAGMFALPASEKMRAERQDGEPYGYGLPHIASYSSKATWSEGYTLSPASLRAELPRVWPDPGEDYRHFCXVMEEFHRQMRAVADKLTVLFLAALGLAAVEAERKIVETMTETVTMHLNWYPKCPDPKRALGM

SEQ ID NO: 122401 - protein, 299 aa, Triticum aestivum
  Clone ID: PAT_TA_16819.pep
MAEEPPVKRTKTEEDLGAGSEPDAAAAAAAERERPGGEVTVKIQSKALRCRICSEPLKPPIFKCAAGHVLCSQCPEKLREVGHVLRLGTFCALCCKSTSYSRCVELEQFIDAMKVPCSNQTYGCNEFVGYQQKEKHESSCPHAPCYCPEDDCAFKAPACCLLDHFVTAHGWSPTNLGYNKPLKILLARDRRFTLLVGEDMSLFLLINTLTSIGSALAVVCVRPHESEPSYSCNISAAAHGVAGGKTDGRLVFQKDPHVSSSSLAGGVQMGNFFLLVPLEFAETSSGELTVHIRIDRVAP

SEQ ID NO: 122402 - protein, 335 aa, Triticum aestivum
  unsure (1)..(335): unsure at all Xaa locations
  Clone ID: PAT_TA_16820.pep
PPSRAPHSPPAPLPLAPPEVIAPCGSRPARGPPRPARPGPRPXPLPPPAPPRPAAAAGAPRRAPPGPRPPPPPPARRPVPPPPLPQPALAAGGAPPLHPPRARPPPPPRPTGSQPLNRQRPPSPPPSASPPQDXSPSPPTSNDGPSSGPAATATPAPAAAPGANDDEDRRPLKRTASDXPPALLQPRPHVYRPPPRPRGGALLPPAAPQPPLPSPPSPPPPPPPPATSLSLSLSLPGLDAPEPAPVAQPMSMPPPPAPVQPAAAPQMPPPPPMPFQLQPPPQPQPRTAAPFNGEFLSMMQEMIRIEVRNYMSGFDPRSPADGVHAAKRMMKHGQD

SEQ ID NO: 122403 - protein, 166 aa, Triticum aestivum
  Clone ID: PAT_TA_16821.pep
MPRTRRLRGGFRLGRKLLTAWRWALCGRSRRRGGYLRLDTPCPVEGREAKKLAPVLRWGQSLARLLSLGRTDRGQRTLGGGGGDEAVKTPKGQVAVYVGGGGPGEPLRYVVPVVYFNHPMFGELLREAEEAFGFQHPGGTSCPPPAPRSHRAPPVAAEGKKGFARW

SEQ ID NO: 122404 - protein, 166 aa, Triticum aestivum
  Clone ID: PAT_TA_16822.pep
FGGDDRFFHRLVRDLGQEKEHMRWVIALWLWFEADGNDKFMRRAAALPGPVVLRFVDEALACLARLAGRVLPGASTLLPCTNALLNKPIDDVTYFDEHRDNIMPRVKLLYKTVCRVVLVHACPAPAAVFPPWCPAASAPPAVAPPVRAPAVSPPPPPPTTPRFADL

SEQ ID NO: 122405 - protein, 59 aa, Triticum aestivum
  Clone ID: PAT_TA_16823.pep
PFGRPLFFFFFSFFFSFLFFFFFFFSFFFFSFFFFFFFFFFFFFLPTAFHSSLVSTKCK

SEQ ID NO: 122406 - protein, 94 aa, Triticum aestivum
  Clone ID: PAT_TA_16824.pep
MEAAVGGSWTRVRTLGRGASGAVVSLAADDLSGALFAVKSAPAAAADQLRREGDILSGLSSPHVLPCLGFRAAAVECPLFLEFAPGGSVADVAA

SEQ ID NO: 122407 - protein, 264 aa, Triticum aestivum
  Clone ID: PAT_TA_16825.pep
MEAAVGGSWTRVRTLGRGASGAVVSLAADDLLGALFAVKSAPAAAADQLRREGDILSGLSSPHVLPCLGFRAAAGECQLFLEFAPGGSVADVAERCGGRLEEGAVRAYAADVARGLAYLHGRSLVHGDVKARNVVVGADGRAKIADFVCARAVGSSDRPIGGTPAFMAPEVARGEEQGPAADVWALGCTVVEMATGRAPWSDMDDVLTAMHRIGYTDAVPEVPAWLSAEAKHFLALCFARDARDRCTAAQLLADPSLASAGCGV

SEQ ID NO: 122408 - protein, 247 aa, Triticum aestivum
  Clone ID: PAT_TA_16826.pep
MTVAVCHVMPALDVPPPHTRLPAPMPPPQQLDGSSAIQAPADNDCATKPEPPAVKAKAACPMATVRRSMSHESPSLCTESLGCETGTRGDFLDLASRLYAPPPPHTTDDAVAADFFSPPALEDQEEEKDEAAGELTLKAVQYHRARPQRAFPPPLPSMSRRRGDDAGPCLRVRPHRRDGRLVLEAVAAKPQGYLHAQRQDGRLKLCFVDCSSASASVLDHQKQSMVEQPQHEHQKQSMVQQSQHDVE

SEQ ID NO: 122409 - protein, 183 aa, Triticum aestivum
  Clone ID: PAT_TA_16827.pep
YIKIKVFSPLPATYLSSGCHCIATRRLPLQHRSLFTMFTSTSQPAPIPPLTPSSHTATPQRPRLLPERLLPLPARTPAQRPAQLKLQRAQGERGEGGPPARRPTIRAHARHRSNGAASHALAWEIGGRQCHHGRRAVDHGGGDGLNPAYSRWCAPFGCRDWDCVRLGQWECCGRVREYVRGGP

SEQ ID NO: 122410 - protein, 214 aa, Triticum aestivum
  Clone ID: PAT_TA_16828.pep
VGKEEPVEKKRMTTTETATAREPREASRREGRDSHGRRPHSSSRSRRDDPSPRRRRDDMRHESDRSQHRRRAEEGADDAGDRDEGRNRHLQDVKARSDGPDPGRGEGKPPPGDAKEDPPARHERSPRGTKRFSETREAWRPRSSFFQHDERERAGQGGRHYGRQDYGRQRDQNEHLNDRDRHKSEGHGLQEKVGQAHQQSDVDSTWEHDGFFKL

SEQ ID NO: 122411 - protein, 130 aa, Triticum aestivum
  Clone ID: PAT_TA_16829.pep
MVRTSVLHDALNAMNNAEKAGKRQVLIRPSSKVIIKFLTVMQRHGYIGEFEEIDDHRSGKIVVQLNGRLNKVGVISPRYNVRLAELEKWVVKLLPARQFGYVILTTSAGIMDHEEARRKHVSGKIIGFFY

SEQ ID NO: 122412 - protein, 85 aa, Triticum aestivum
  Clone ID: PAT_TA_16830.pep
ARAPRARAGQPVAARGTTQRATPVGEGGPARGAPTRKRGRRQVLSTECFYPCDSAPPGRSPLAPLPPPLSLRKQRVDAPVTDDAC

SEQ ID NO: 122413 - protein, 175 aa, Triticum aestivum
  unsure (1)..(175): unsure at all Xaa locations
  Clone ID: PAT_TA_16831.pep
MESLLAALAASSGGTVAAAAVGGLAAAAALAVQAGNGGTGPKDRTNAPPVVPGLPLIGNLHQLKEKKPHKTFSKWSETYGPIYTIKTGASSVAVLNTREVAKEAMVAKYSSISTRKLPKSLDVLGRDKAMVAMSDYGDFYKXXVKRLVMAGMLGSSTQKQFRETRDLMMDNMLSS

SEQ ID NO: 122414 - protein, 355 aa, Triticum aestivum
  unsure (1)..(355): unsure at all Xaa locations
  Clone ID: PAT_TA_16832.pep
MPPAAAPWSWACCGRRRKSAGGGAGDGDGAGASGRDGDQWTLFIDLPVLEAATAGFSDGNLLGRGGFGPVYKGVMEGGQEIAVKRLSLESRQGXVREFLNEXVRLLLKVQHRNLVSLLGCCAAAGQKMLVYPYFPNGSLDHILFAQAAPMRRSPACPCTPSHALRQGXKWVQPGWPKRYQIILGLARGLLYLHEESPVKIIHRDIKASNVLLDEKLNPKISDFGMARLFLEDATHVNTFRISGTYGYMAPEYAMNGYLSTKTDVFSFGMLVLEIVSGRKNIDRHLGDEKVDLLNYTWKLSEEGRSLEIVDPGLSGWDAGEVAMCVQLGLLCCQAVVSDRPDMYSVHLMLSSDSFT

SEQ ID NO: 122415 - protein, 432 aa, Triticum aestivum
  Clone ID: PAT_TA_16833.pep
THGIKTSLAPGSGVVKKYLDKSGLQKYLNQLGFNIVGYGCTTCIGNSGDLDESVAAAITDNDVVAAAVLSGNRNFEGRVHALTRANYLASPPLVVAYALAGTVNIDFEKEPVGISKDGKEVYFRDIWPTTDEIAEVVKASVLPDMFKGTYEAITKGNPMWNELPVSASTLYPWDPKSTYIHEPPYFKDMTMTPPGARPVKDAYCLLNFGDSITTDHISPAGSIHPDSPAAKYLKERNVERKDFNSYGSRRGNDEIMARGTFANIRIVNKFLKGEVGPQTIHVPSGEKLAVFDAAMKYKNEGHDTIILAGAEYGSGSSRDWAAKGPMLQGVKAVIAKSFERIHRSNLAGMGIVPLCFKAGEDADTLGLTGHERYTIQLPTDVNEIKPGQDVTVTTDNGKSFTCTLRFDTEVELAYYTHGGILPYVIRKIAAEQ

SEQ ID NO: 122416 - protein, 96 aa, Triticum aestivum
  Clone ID: PAT_TA_16834.pep
HRPIGMAHFQEVDYCSEEVRAVGNPARRGGGVQEHIVKETFVQEFDTSGRRHGHHGHHGRGSGHFEVRESRLEEDFNTRTGEFHERKENFVVRADD

SEQ ID NO: 122417 - protein, 259 aa, Triticum aestivum
  unsure (1)..(259): unsure at all Xaa locations
  Clone ID: PAT_TA_16835.pep
MSPRRRSTSPPPPASLPDDMLGEILLRLPPRPSSLPRASLVSKRWYSLVADPQFQRRFRDHHGKPPLLGFFLQESPSSAFVPILDRPDRIPRGRFSMPLSEGTHIVDCRHGLVLSLSRSPPHRLLVWDPVAREQRRLVFPPELDNDQMLRSQRRGASPCPXQGSHFQVALIAHYKVGNPCTRVFACLYSSETGIWSKINSLQLQSSISLLGPGPSTLIGNSLCWLLWEPSDNYVILEFDLDTQSLTETELPPQVEAPLL

SEQ ID NO: 122418 - protein, 311 aa, Triticum aestivum
  unsure (1)..(311): unsure at all Xaa locations
  Clone ID: PAT_TA_16836.pep
FAMTKMWLVXFEKNNLPSAIFTAFCGGAEIGQAIALDTRIPLVSFTGSTKVGQMVQQQVSARFGKCLLELSGNNAIIVMDDADIPLAVRSVLFAAVGTAGQRCTTCRRLLLHESIYQTFLDQLVEVYKQVRIGDPMEKGTLLGPLHTTASKESFLKGIQNIRSQGGKILLGGSAIESEGNFVQPTIVEISPAAPVVREELFGPVLYAMKFQTLKEAIEINNSVPQGLSSSIFTRKPDAIFKWIGPHGSDCGIVNVNIPTNGAEIGGAFGGEKATGGGREAGSDSWKQYMRRATCTINYGSELPLAQGINFG

SEQ ID NO: 122419 - protein, 148 aa, Triticum aestivum
  unsure (1)..(148): unsure at all Xaa locations
  Clone ID: PAT_TA_16837.pep
PRVRILLGGSAIESEGNFVQPXIVEISPDAPVVREELFGPVLYAMKFLTLKEAIEINNSVPQGLSSSIFTRKPDAIFKWIGPHGSDCGIVNVNIPTNGAEIGGAFGGEKATGGGREAGSDSWKQYMRRATCTINYGSELPLAQGINFG

SEQ ID NO: 122420 - protein, 454 aa, Triticum aestivum
  unsure (1)..(454): unsure at all Xaa locations
  Clone ID: PAT_TA_16838.pep
MASFARQEHQFLAELGLAPRNPGSFACGAWGGSGPVVTTTNPSNNEVIAEVVEASMDDYEKGMSACFDAAKTWMAVPAPKRGEIVRQIGDALRAKLHHLGRLLSLEMGKILPEGIGEVQEIIDMCDYAVGLSRQLNGSIIPSERPNHMMMELVGVITAFNFPCAVLGWNACIALVCGNCVVWKGAPTTPLITIAMTKIVASVFEKNNLPSAIFTAFCGGAEIGQAIALDTRIPLVSFTGSTKVGQMVQQQVSARFGKCLLELSGNNAIIVMDDADIPLAVRSVLFAAVGTAGQRCTTCGMLPLHDSVXKHFLNDVVWFFNKAFMKPLLINLSRFVPMSTTAFIWKVLHGWEPLPITEAIENHYSVHQGLNSSRFTRNPDAIFKCIRLHGRFXGKGNVIRSPTGYEIGSVCAGEREAGCESTKTGSDSXQQYMRRFTGSINYGRDLPVAEGFIYD

SEQ ID NO: 122421 - protein, 167 aa, Triticum aestivum
  Clone ID: PAT_TA_16839.pep
IPRRRLYLLTSSYPWRGEGAGVMFCWATVGRALRADGGGGGPKALDDGASRARVAARPATASYVAAGVDWLGGAATAVPQSCNRGRRKLEPRSSGAARFLHAGEGVLQPWMRKAGSVVRRSYNQIRWSCEFFCRTTDASRRAGGNDVDQGDAATMANRELELTGGGD

SEQ ID NO: 122422 - protein, 168 aa, Triticum aestivum
  Clone ID: PAT_TA_16840.pep
MGEVASTAAAASLSSSSSLLMAATAVKGDEERYVMVASRFFRVKPGAAARHHFLDSCFLCKRSISRHRDIFMYKGDAAFCGEECRQDQMAMDEALHAAARRHRTAGRGRAGCRHRAPRGGGRDDGVDGAPRPWTSRSRRGGAGTRGRPRPSRPPAPRAARRRARRRRR

SEQ ID NO: 122423 - protein, 62 aa, Triticum aestivum
  Clone ID: PAT_TA_16841.pep
MQFSTIVPLFVAAMGVVATPVNSPAQELDARGNLFPRLEYWGKCTKAENRCKYKNDKVYQGW

SEQ ID NO: 122424 - protein, 92 aa, Triticum aestivum
  unsure (1)..(92): unsure at all Xaa locations
  Clone ID: PAT_TA_16842.pep
MQFSTIVPLFVAAMGVVATPVNSPAQELDARGNLFPRLEYWGKCTKAENRCKYKNDKGKDVLQNCPKFDNKXCTKDGNSCKWDSASKALTCY

SEQ ID NO: 122425 - protein, 194 aa, Triticum aestivum
  unsure (1)..(194): unsure at all Xaa locations
  Clone ID: PAT_TA_16843.pep
PAPRPRPPAPAPLRSPPVAPLPLPPAPAPAPSRAHAPWPWPARAGDLAPAAAASRPHRGXPAPRAPPPPPRPPPPPPPPPPPVXAARGGGAPSSPRPRRARSPRPPASGIGCAAASSAMRGPRPGLPGPAARPPAPLPSPSRPPPRRXSGPPPVVPAGPXGRGPPCAGPPQRGRGPPRPHGHGRRGTGHVEGRQ

SEQ ID NO: 122426 - protein, 152 aa, Triticum aestivum
  Clone ID: PAT_TA_16844.pep
MMACALSIAQPTALAPCGGGGGGSSKIVPRNLPKLRSPMVSGRMRSRGVVARAAQDSSEASSGSVVRYVKSSFNTTEDIFALAGIGFAAIAAFWASMMLIGVIDKLPVLPLFFELIGIAVAWWFIYGNLLFKPDREKFLENIKSSASRILGQ

SEQ ID NO: 122427 - protein, 205 aa, Triticum aestivum
  Clone ID: PAT_TA_16845.pep
RRRRRPICRRKAPAPLLPASDPQRGEARPSSEQPRLQQLRTLPSSAPAAAAPSSSPPPAPPVATHTRTIGIIHPPPTLRVIIIHPPTFVAVIGPKIERRIVAHNQGNAKFNFLQPSDPYHAYYQHRVSEIADAPPAPDAAAAADPDALPSDDSAADGAPADHSAPFRVGPPAKVLVPPKAELYTVRLPEGITTEEVDIVKLTAQF

SEQ ID NO: 122428 - protein, 95 aa, Triticum aestivum
  Clone ID: PAT_TA_16846.pep
MSAAVGGAEFHGFGGAAQLPRSRMLGRPVRVAPPGATLAGSWPSAASIRAVSTPLKKDAKEVKRSKVEIIKEKSNFLRYPLNEELVSEAPIVGET

SEQ ID NO: 122429 - protein, 235 aa, Triticum aestivum
  unsure (1)..(235): unsure at all Xaa locations
  Clone ID: PAT_TA_16847.pep
MSAAVGGAEFHGFGGAAQLPRSRMLGRPVRVAPPGATPAGGGGPSAASIRAVSTPLKKDAKEVKRSKVEIIKEKSNFLRYPLNEELVSDAPNVNETAVQLIKFHGIYQQCDREVRGQKNYSFMLRTKNPSGKVPNQTYLAMDTLADEFGIGTLRLTARQTFQLHGVLKKNLKHVISTVIKNMGSTLGACGDLNRNVLAPAAPYARKDILFAQXTAENIAALLAPQSGAYYDLWVD

SEQ ID NO: 122430 - protein, 137 aa, Triticum aestivum
  unsure (1)..(137): unsure at all Xaa locations
  Clone ID: PAT_TA_16848.pep
ARGLISLIEQSRYLQFRDCPVEWGWCRDLQSFIFVFKSHNSXVPIEWQIRRMVTAMKLSSCGRTALIENRPLLIGEDLSEGEAKVLQEYARIPGTGPRPLLADRGRVVQGGWRPRYSTDWRMKIGKLLNEWLFLRGN

SEQ ID NO: 122431 - protein, 184 aa, Triticum aestivum
  unsure (1)..(184): unsure at all Xaa locations
  Clone ID: PAT_TA_16849.pep
EAYQDTLYTHSNRQFYAEDGISGTVDFIFGNPAVVIQNCDIHPRKPRQGQKDTITAQGRTDPNQSTGISIHKCRIAAVSDLGGTKVYLGRPWKAYSRTVVMESSLDRSITPAGWLEWSGQFALSTLYYGEYGNTGAGAGTSGRVELXGVHTSLSTVEATRFTVRDFILGDSWLGDTGVSYTSGL

SEQ ID NO: 122432 - protein, 125 aa, Triticum aestivum
  Clone ID: PAT_TA_16850.pep
ITGGSSSSTATCRWATLARPWVVEATLQAWPIAAVALPVVGSFPRSELVAALYPASSPARAYQYIITSSRNRPADAGVSQSLPHTRGRADCKLRRYHLYWVSGLAAMLMLACWYLPEQQCRSPKL

SEQ ID NO: 122433 - protein, 145 aa, Triticum aestivum
  Clone ID: PAT_TA_16851.pep
MAGGKPRGLNAARKLRTNRKDQKWADLAYKKRALGTAYKSSPFGGSSHAKGIVLEKVGVEAKQPNSAIRKCVRVQLIKNGKKVTAFVPNDGCLNFVDENDEVLLAGFGRKGKAKGDIPGVRFKVVKVSGVGLLALWKEKKEKPRS

SEQ ID NO: 122434 - protein, 229 aa, Triticum aestivum; identical to SEQ ID NO: 116381
  Clone ID: PAT_TA_16852.pep

SEQ ID NO: 122435 - protein, 72 aa, Triticum aestivum
  Clone ID: PAT_TA_16853.pep
TDTGDHHNQKTEWPGLVGKSVEEAKKVILQDKSEAQIVVLPVGTIVTMEYRIDRVRLFVDRLDTIAQVPRVG

SEQ ID NO: 122436 - protein, 157 aa, Triticum aestivum
  unsure (1)..(157): unsure at all Xaa locations
  Clone ID: PAT_TA_16854.pep
MQIFGEDDWTGQRPITLEVESSDTIXDNVKAKXIQDKEGIPPDXQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 122437 - protein, 135 aa, Triticum aestivum
  Clone ID: PAT_TA_16855.pep
HASAHASVLVGGVDRMQQVLSIAKRPHIVVGTPGRLLDHLKDTKGFSLTKVKYLVLDEADKLLNLEFKESLDDILKVIPKERRTYLFSATMTKKVSKLQRACLRNPVKVEVSSKYSTVDTLKQEWYFVPADYKDC

SEQ ID NO: 122438 - protein, 157 aa, Triticum aestivum
  Clone ID: PAT_TA_16856.pep
DSDLAAGCCSSTTPAAKLPTYLHGRRSDGLRFTINYEREYPYDTRELSQFPDVRLWFVRLDASYPWFPVVLDWRAGELARYAAMLVPHQMSMRHGVVFNPEALELFGMKKVFLVYSWLKQQNHAKPRLKTGDMAKMLGFGIGDELFDLIEKYPVDEL

SEQ ID NO: 122439 - protein, 160 aa, Triticum aestivum
  Clone ID: PAT_TA_16857.pep
GRGGRGPPCRWRSGWAPASSPLRGRGSTTPATRRFPRQSAPPPHRGRRRRGRDRQASPSGPSSPGPPRRCPSKRAGEAAGPESPSRPAPAACSCASPASWLPLPPTRPSRTRTGGTGPASAAEARPRDRRRHQRRLSLRRPHHWLSPPAYMQPPPPASSE

SEQ ID NO: 122440 - protein, 116 aa, Triticum aestivum
  unsure (1)..(116): unsure at all Xaa locations
  Clone ID: PAT_TA_16858.pep
PRIHXTXLAKAAPTAPDDGRRGADGGDRDRQGDDRGASTGARLRTHLSDAVAHTDATVSRTTHRRRQTPRQAALHACEDVNNDIRSLLLFLFCIVLKIGDSNRRGIDYGTLNLLHR

SEQ ID NO: 122441 - protein, 139 aa, Triticum aestivum
  Clone ID: PAT_TA_16859.pep
YTETAHGLRAHPAQEATPHSAASKLSSGWRSSGIGWRRRRWSSWARGRAGPAGRRSTAPSSSGCPSCPGSSSPASAATTAAGAGRAAATPRSSSAPSACATAPGPTAAAGTASAAPASTSPAPPNRSSGSFVIESRKCW

SEQ ID NO: 122442 - protein, 202 aa, Triticum aestivum
  unsure (1)..(202): unsure at all Xaa locations
  Clone ID: PAT_TA_16860.pep
MAAAPPQPAAPAPGPASGGDAFRLGFVGAGNLAESIARGVAASGVLPASAVRTAPHRRPERGAAFASLGATILASNAQVVDGSDVIVISVKPQIVKQVLVELKPLLSEEKLLVSIAAGIKMKDLQDWSGQRRIIRVMPNTPSAVGQAASVMCLGEXQATEKDENRVKSLFSAIGKAWTAEDEQLASGAGFSGNGPALLFPWE

SEQ ID NO: 122443 - protein, 124 aa, Triticum aestivum
  Clone ID: PAT_TA_16861.pep
SWPKEAFELVSGEVSKTLERLEPGATASHAFVLESKTQGRFQASPAVIKYRVATKAALQEAYSTPILPLDILAERPPVKKFEWAKKLIAKYGALVSVVSFVLGFIYLVASPSKSAGSKSGKKRR

SEQ ID NO: 122444 - protein, 233 aa, Triticum aestivum
  unsure (1)..(233): unsure at all Xaa locations
  Clone ID: PAT_TA_16862.pep
MAATRPLLLCAAVLLAALSCTFAADAPFLVXHKKVALSRPKPGVERLAVSLDLYNQGSATAYDVXSLMIDSWPKEAFGTWSLAEVSKXWERLEPGAXASHAFVLESKTQGXRFQASPAVIKYLLLPTKXALQXEAYSTPILPLDILAERPPVKKFEWAKKLVAKYGALXVSVVSFVPXFIYLVASPSKSAGSKVWQEEALIYHPWINRLLVATVCLAETLDSRSLRIQHPHGL

SEQ ID NO: 122445 - protein, 191 aa, Triticum aestivum
  Clone ID: PAT_TA_16863.pep
MDAMERGERATLLPESHGPKVQEDDSLQVPLLKHKKRGGSKAPAVILLFECLESTAFNGISTNLVVYLETVLHGTNLASASNVATWFGTSYLTPVFGAIIADSFWGNYNTILVSLVVYLLGMMLVTFSAFVPTTTPALCVAGASCTGTAGTWGLSSQIVAFVGLYLVAIGCGGVRSSLLPFGAGQFDDDSA

SEQ ID NO: 122446 - protein, 334 aa, Triticum aestivum
  unsure (1)..(334): unsure at all Xaa locations
  Clone ID: PAT_TA_16864.pep
GGDGDCGAVQLAAEIEELSLGSTGGLRDRLSALPDDILHSILLRLPSTPAAARTCVLSRRWRGIWAQLPEIRFPFPSDPAAVGPALAASAAGPALRLLHVACRDDTGANAWLRTAASRLIAGGELYFYKRTPGXGRRGRAEALVXQCRTFELPCFETAAKVWLRLGFVDLELPLTGVFFRLTELRLEHGILECGFQLGDMVSSPRCPALRELCIXGPRGVVSLCIISQTLERLELDILHGLEELTVVAPMLRALNVHACFAWRKPVAAIYASRLEVLWWSDAFDPSFVLFGEVENLQQLTTFDIHVYGRFDYALLQDYVMLLQHFPTVSCLTSN

SEQ ID NO: 122447 - protein, 124 aa, Triticum aestivum
  Clone ID: PAT_TA_16865.pep
MEAVELSAVVSCECCGLGEECTGEYIVRVRAYFGGRWLCGLCSESVKYEAGRSKRAAAMGVEEAVRAHMAFCRMLRRGGPAERVAEGMCQMLRRRTACGKCQVAMPSSSSRTTPAPVAPLSIGF

SEQ ID NO: 122448 - protein, 302 aa, Triticum aestivum
  unsure (1)..(302): unsure at all Xaa locations
  Clone ID: PAT_TA_16866.pep
VTSGRRRPPRGARPYQVSLSSVSAAAAEVSTFPLDALKTRLQLRRSTGGGGGSGGGVLRVAGELVRDGGFYRGLSPAVLRHLFYTPLRIVGYEHLRSSLASGGREVGLLEKAIAGGASGVAAQVVASPADLIKVRMQADSRLLTQGIRPRYTGILDAFTKITRAEGLLGLWKGVGPNAQRAFLVNMGELTCYDQAKHFIIRKQICDDNLYAHTLASVASGLCATTLSCPADARDSRTRVLARLAGALYRNSYDCLVRTVKLEGLTALWKGFLPTWARLGXPWQFVFWVSYEKLRQASGISSF

SEQ ID NO: 122449 - protein, 303 aa, Triticum aestivum
  Clone ID: PAT_TA_16867.pep
PASELVEDREAFGMFAETKFRQLDADGDGRLSVRELQPAVADIGASLGLPAQGSSPNADHIYSEAMSEFTHGHGNQEGVSRAEFQEVLSDILLGMAAGLKKDPIVILRIDGEDLRDFVSSPRYEPAVAAIFSQVGSEDAPLRQCLLAAVQQLGVDHGMPPAADPWVVENVVEPALQQLSADELEQPASRDVFFEQLKKLLGSVAEQLQERHVIVAHTENTFDGSGVRRLLGNKFELDKLLDSVWRDVPAELKNAPDNHLRVPLKDGPQAKLNNPWALFLKWDPVRGTKALKGGRRPTVVQGVN

SEQ ID NO: 122450 - protein, 169 aa, Triticum aestivum
  unsure (1)..(169): unsure at all Xaa locations
  Clone ID: PAT_TA_16868.pep
FLPTRLFIFGQMSYSDAIXLLIGSNKKSEFPVKWGLAPQSEHERYITEVAFGGSPAIIRDYPKEIKAFYMRQNDXDGKTVAAMDLLVPRVGELIGGSQREERLDYLEARLDESNLNKDSYWWYLDLRRYGSVPHAGFGLGFERLVQFATGIDNIRDAIPFPRVPGSAEF

SEQ ID NO: 122451 - protein, 195 aa, Triticum aestivum
  Clone ID: PAT_TA_16869.pep
SPLAPHFFLIPPRGSHLATRRCTQSMAEIVKSLSVSSQRLLHRPPSNSAAKAAYTTATAVRDLHPIDWISVGGNQRPAANAAFTMPVLCHIYHPINPIMVDGSRRARRCQVVRLPSHRKSSRSRPMSPTFVQFFPARPCDLLMDGACASWFFRSGPCSCPWLSDLPCLDLGGPLHAPRPRCAAMASLTLRKPGTT

SEQ ID NO: 122452 - protein, 105 aa, Triticum aestivum
  Clone ID: PAT_TA_16870.pep
MAWRGAVSRAVLVAVRRPAHSPALGGLRAPPPFSAPRRRIPSPFAPSPTPSPLWAPRPLGPTLWSPRCAGVVFERITAHPSASARGCCALSQRKGEVAWFWRLPF

SEQ ID NO: 122453 - protein, 252 aa, Triticum aestivum
  Clone ID: PAT_TA_16871.pep
MVKFTSLVALAAPLVAAAPNPQNSPQIVGGTSASAGEFPFIVSITNNGGPWCGGTLLNANTVMTASHCVQGRSASAFAIRVGSNSRTSGGVTSRVSSIRMHPSFSGSTLNNDVALLKLSTSIPAGGSIAYGRLATSGSDPAAGSSLTVAGWGDTSEGGGVSPVNLLKVTVPVVSRATCRSQYGTSAITDNMFCAGVTGGGKDACQGDSGGPIVDSSKTVVGIVSWGDGCARPNAAGVYARVGTLRSWIDSNA

SEQ ID NO: 122454 - protein, 299 aa, Triticum aestivum
  Clone ID: PAT_TA_16872.pep
DTGMRPQNFIRELDLTSVAEDYPKLRELIQRKDEIVTNAASPPMYFKCDLRQHVLSPEFFGTKFDVILVDPPWEEYVHRAPGITDHIEYWNAEEIMNLKIEAIADTPSFLFLWVGDGVGLEQGRQCLKKWGFRRCEDVCWVKTNKKNASSGLRHDSRTLLQHSKEHCLMGIKGTVRRSTDGHVIHANIDTDIIIAEEPTDGSTKKPDDMYRIIEHFALGKRRLELFGEDHNIRPGWLTLGKDLSYSNFNKEAYNKNFADSDGKVWQGGGGRNPPPGAPHLIVTTPEIEGLRPKSPPPKN

SEQ ID NO: 122455 - protein, 336 aa, Triticum aestivum
  Clone ID: PAT_TA_16873.pep
TRSSYPKSKLQTLAGFVADENPGFLQLMSHMKELKKVKIWCCGSTDANNESMPHISEAVQKFAQDGMDTADVRSLSLDFGNSLGDFFGSIQEYCFLSSLKLRGRLTRLPQFVTSLCGLTELCLSSTNLMGNDLSNLCMMPCLLYPQLVEADLTGFIIKDRGFPSLLSLCLIMQMPVLPTIGAGALPRLVSLQLLCKDLVGLSGIKIEQHHCLQEVALDSMVSAKTVDMWETAAKKHPRRPKVLFLKRIGPSETKSTVKYVAADEPIRDKASSVEFNQVQLTQNMLQDECMISLDQSSSMSKLNSAMKKIIVSDPPPAAPELSSSGNSVMPPSASIC

SEQ ID NO: 122456 - protein, 75 aa, Triticum aestivum
  unsure (1)..(75): unsure at all Xaa locations
  Clone ID: PAT_TA_16874.pep
NCCTCKNRAFAFLFADGANDELSLLXAVEAHTFPHLFAEMKKKVDLAPAAIISAKASDSSVLKSIDANRPVRRKN

SEQ ID NO: 122457 - protein, 327 aa, Triticum aestivum
  unsure (1)..(327): unsure at all Xaa locations
  Clone ID: PAT_TA_16875.pep
MAAAAAEEAAPGADAIMDGFAELERQQELLASCTRLYQQLTEHFGSLERGIKSRSDSLRARRRVVELRASRRLDALRRRELSIDASVKLALSRLDALAKSPAPKRDREDGDGPPSPPPPPPSDDVAEGLAALCAAMDPAGFLAFVVERRKEVDALRAELPAALQRCVDPARFAMDAVSEVFPVDRRAVRSPTDLAWACVLILEAVVPALADPDPEIGAARPMVPQAARDRARGMAAEWKEVAERKGGVEGAKPPDAHAFLQHVATFXVAENEDKELYKRIVLSFSWRKQMPRLALTLGLEDDMEEIIEELITKGQQLDAVNFAYEAG

SEQ ID NO: 122458 - protein, 110 aa, Triticum aestivum
  Clone ID: PAT_TA_16876.pep
ASSSDVLRTYATYRCSQSLQNRAPLTKPRRHRLLSFGHFRLILPVVSLVKGWGHGIAIGSRAAVVTGVDGVGHGRGLVWHSKANIRHRHSRWVCIWLPHWALATVEGVPS

SEQ ID NO: 122459 - protein, 462 aa, Triticum aestivum
  unsure (1)..(462): unsure at all Xaa locations
  Clone ID: PAT_TA_16877.pep
GLLPPARATAARVRSIDASVKLALSRLDALAKSPAPKRDREDGDGPPSPPPPPSDDVAEGLAALCAAMDPAGFLAFVVERRKEVDALRAELPAALQRCVDPARFAMDAVSEVFPVDRRAVRSPTDLAWACVLILDXVPALPTGPGEQLDAVNFAYEASVVAAEVPDLPTLMIGQLGTPSTVXQSPLPMRGPQAHPPAVPGPNVRLGLPSQAPPMTYPIYPGXQQRPGSPGHCHDPTGLLGKFSRVTLLKSYLDDSRKRYCTSDNVSTSSGQSGVNANKKDQSALRAVIKCVEDHKLEAEFPLEDLRKRLEELEMAKTEKKKAASSCSSGGPASKRIKGSAGGAMSPSKSGRLSDNTGAPSSPSTATSSSTATAFIGSPASHVSYGTGSPYSYDRSAGHALYCGQSPMREPYAYPPAVPVPNVGLGMPYQAPPMTYPIYAGYNSGPGAYGNAMAPAFHQAYYR

SEQ ID NO: 122460 - protein, 466 aa, Triticum aestivum
  unsure (1)..(466): unsure at all Xaa locations
  Clone ID: PAT_TA_16878.pep
GLNYLKGTGSLGTNATSFSALPDDKAAFQPLNPEDVRAYPHKAVDFISAYYTNIESLPVLPNGRQGYLQDELSASPPTYSAPFDVTMKELRTSVVPGMTHWASPNFFAFFPSTNSAAAIAGDLIASAMNTVGFTWQASPAATEMEVLALDWLAQLLRLPTTFMNRTSTGRGTXGGGVILGTTSEAMLVTLVAARDAALRRSGSVGVSDIPRLAVYAADQTHSTFFKACRLAGFDPANIRSIPTGPETNYGLDPAKLLEVMQADADAGLVPTYVCATVGTTSSNAVDPVGDVADFAAMFSAWVHVDAAYAGSACICPEFRHHLDGVERVDSISMSPHKWLLTCLDCTCLYVRDAHRLSDSLETNPEYLKNDATESGEVTDLKDMQVGVGRRFRGLKLWXVMRTYGTAKLQXHIRSDVAMGPRCFEXFVRCXDRFEIGLPRXLAPVCFRXXQVDHDGEGSDKQVLMEI

SEQ ID NO: 122461 - protein, 103 aa, Triticum aestivum; identical to SEQ ID NO: 107316
  Clone ID: PAT_TA_16879.pep

SEQ ID NO: 122462 - protein, 479 aa, Triticum aestivum
  unsure (1)..(479): unsure at all Xaa locations
  Clone ID: PAT_TA_16880.pep
MPLPMRRLAAAPSLPAVHPHDSPAPPSVRLRRQHGRVSMERSSTTTARGVSCVMASGKEHAATTSGDEKKGGLRGKLKKVVLAYSGGLDTSVIVPWLRENYGCEVVCFTADVGQGDIELEGLEKKAKASGASQLVVKDLTEEFVGEYIYPCLRAGAVYERKYLLGTSMARPVIAKAMVDVAKEVGADAVAHGCTGKGNDQVRFELTFYALNPELKVVAPWREWDITGRXEDAIEYAKKHNVPIPVSKKSIYSRDRNLWHLSHEGDILEDPANEPKEDMYMMSVSPENAPSKPEYLEIGIVAGVPTSINGKDLSPATLLTKLNEIGGKHGIGRIDMVENRLXVGMKSSRGVYGTPGGTIMAAAVRXLESLTLDRGDDAAGRTCWPSSTTQLVYAGRWFDPLRLSMDAFRDTITAGRCDDVTLKVHKASVTVASRKGPYRLYREDISSFENGEIYDRDDPDSFIRLYGLPTRVRAMLEKGI

SEQ ID NO: 122463 - protein, 264 aa, Triticum aestivum
  unsure (1)..(264): unsure at all Xaa locations
  Clone ID: PAT_TA_16881.pep
MAMEVLYPFFLCLAVLTGRAASAPPHSQCHDNPPDITAARVEAGKVVHDFAGYTALVTGAIHSDRAVVLASDVYGFEAPLLRMKPDYFVVARCFVVCPXFNMGTLVRGSQMGSSHNRRXEHFPVKTAQDAKPIFATFRSWSXLSLGVGGYCWGGKNAVEIAKMNEVKAIVISHPYLVIVGDMREVKCPIEILGGENDLATPQKFIYKFLNVLRKRSDKIPYFGKIFQGVAHGFACRYNITNPFEVKTGEQALALMVGWFQKHLK

SEQ ID NO: 122464 - protein, 144 aa, Triticum aestivum
  unsure (1)..(144): unsure at all Xaa locations
  Clone ID: PAT_TA_16882.pep
ISSSRQSSADKRVTTPARTRRQSGTRCQWRGRCRWLRGAPPPPRRPTTSGATAPPTPSPTRPPRCSATGAPPPCPAPWRRPPCSGAAARGPSPAPAPXPTPGXTSGATAPPTSLSPTAPPRPRGPTPSPPPXAPGPPPAAVPLT

SEQ ID NO: 122465 - protein, 145 aa, Triticum aestivum
  unsure (1)..(145): unsure at all Xaa locations
  Clone ID: PAT_TA_16883.pep
SSHEFLTPELRGQESDHTRATRCQWRGRCRWPRGAPPPPPRRPTTSAATAPPTPSPTRPPRCSAPGAPPPCRAPRRRPPCSGAAARGPSPAPAPAPPXAEPPXATAPPTPPPTSLSPTAPPRPRGPTPPPPPQPPGPPPGAAPST

SEQ ID NO: 122466 - protein, 219 aa, Triticum aestivum
  unsure (1)..(219): unsure at all Xaa locations
  Clone ID: PAT_TA_16884.pep
HRRHFLTPAVHRQETTPARATRCQGRGRYRWARGARPPAPRRPTASPATAPPTPSPTRPPRCTRAXAPPPCPAPRRRPPCSGAAARGPSPAPAPAPPXAEPPVATAPSTXPPQAFPRTAPAQPQGAPTPPPPPQPPAPPPAPAAPTLEGLHPPLPPHWSTTRRPPPAPATTGKGRSRGCRGRSGWWPTRCTTWEGKVKGSVRRSVKWIKVKCSRAVYGW

SEQ ID NO: 122467 - protein, 277 aa, Triticum aestivum
  Clone ID: PAT_TA_16885.pep
WLQLRACDGIGDGTSSAAFSGCLAGLLELELRACRTVADRVLLIAADRCCALKSLLVYDGGSREALLQFIRRRGAALHTLDLRLPLDLHNDHLLAIGAQQGYDTRGSLAVLRLQSCVLVTGDGLRSLARTAIGAGIKDVALVSCDVVEREPGLLTFLSQSMRHLRRLDLSYNETLKDKEIGAMLSSCRNLIDIRFRGCRGITGESLLSLLRHCGQTVEVVDISRCPAIKVASVELFAQRATRLNHLVIEVSSVSEELKAIARTKGMKVGPLPCEGSF

SEQ ID NO: 122468 - protein, 194 aa, Triticum aestivum
  Clone ID: PAT_TA_16886.pep
MVVVGGGSGNAWAKEMTLRRRMASIFNKTREHFPSLKDYNDYLEEVEDMTFNLIEGIDVEAIEARIARYQQENAEQIYLSRAKRAEDLAAALKASRMVAVKAGPSDTAAGTSQGISGGAGVQGQYAPAAVPGGLNQPRPTGNAPQPIGGSSDPLHGYDEETMRLRAERGARAGGWTAELGRRRALEEAFSSIFV

SEQ ID NO: 122469 - protein, 616 aa, Triticum aestivum
  unsure (1)..(616): unsure at all Xaa locations
  Clone ID: PAT_TA_16887.pep
PGLLAPVPLCVRPGPRGPSHSTSERVDEFFRRNHPDHYLGQQAVYNANRYAKLVKQKERLQNWLDYYQLKFERHPEKRPTGRTGCFGFCGRQVDQIDYYRARISELDKRIASERHRVLNDPKAVMPVSFVTFDSRWGAAVCAQTQQSKNPTQWLTNWAPEPRDVYWQNLAIPFFSLSIRKFLISIAVFALVFFYMIPIAFVQSLANLEGIERVAPFLRPVIEVKVVKSFLQGFLPGLXLKLFLYILPTVLMIMSKVEGYVSLSSLERRTASKYYYFMLVNVFLGSIIAGTAFEQLDSFFHDPPSQIPRTIGVAVPMKATFFMTYIMVDGWAGIANEILRVKPLVIYHLKNMFIVKTERDRERAMDPRSISLGENLPSLQLYFLLGLVYAVVTPILLPFIIVFFAFAYLVYRHQIINVYNQEYESAAAFWPQVHSRIIASLLISHVTLFGLMSTMKAAYSTPLLIFLPXLLTIWFHKYCKSRFEPAFRKYPLEEAMEKDRMEHASEPSLNLKTYLANAYLHPIFQMFEQEDQKEEATIEVRIDKSEHQQQQQQQHVRSSHSQYEEETSAQTHYHHEERTSSQYQYQYQHQYQYQHEETHMRSEQSPPHFVYHPGVEH

SEQ ID NO: 122470 - protein, 200 aa, Triticum aestivum
  Clone ID: PAT_TA_16888.pep
QRQLQAHEPPWLGKGPKATPHPNPELRDQAPGDLEIPPRKLSKSHAPCPENSANLRRQGQILAVPHRGTGGGKEPRLPAIFQGRRGRRGQEAWAAAKAGDKWRKERRKNPKPKQSLLRIKALAAAAAAEIGQETHQKRAAPERQDDFSPHSPPTPESGGKPQQKTQLLRSLAISLSPPAPLGAFVSLLPHNFKPPSPAST

SEQ ID NO: 122471 - protein, 178 aa, Triticum aestivum
  Clone ID: PAT_TA_16889.pep
MAWSAAAAVSRFAASPAAEIRLPFSAAAAASVSFAGRRRFGPVAASLATSATVQKEAVQTEKAPAALGPYSQAIKANNLVFVSGVLGLNPETGKFVSESVEEQTEQVMKNMGEILKASGASYSSVVKTTIMLADLQDFKNVNEIYAKYFPAPAPARSTYQVAALPLNARIEIECIAAL

SEQ ID NO: 122472 - protein, 180 aa, Triticum aestivum
  unsure (1)..(180): unsure at all Xaa locations
  Clone ID: PAT_TA_16890.pep
PLAPRAAAALSPRAASPAAEIRLPFSAAAAASVSFAGRRRFGPVAASLATSATVQKEAVQTEKAPAALGPYSQXAIKANNLVFVSGVLGLNPETGKFVSESVEEQTEQVMKNMGEILKASGASYSSVVKTTIMLADLQDFKNVNEIYAKYFPAPAPARSTYQVAALPLNARIEIECIAAL

SEQ ID NO: 122473 - protein, 235 aa, Triticum aestivum
  unsure (1)..(235): unsure at all Xaa locations
  Clone ID: PAT_TA_16891.pep
MRRRPGIAGLQNAAATRDKFRQVGENVAKVRTDVMQEQLATFRSQLEEFARKHKSDIRKNSVFRQQSHEMCAKVGVDPLASNKGVWAELLGIGDFYYELGVQIVDICIATRSHNGGLIDLLELRKLLCQKRKTDLGSLSSDDCLRAISKLKVLGSGFEVIXLGKKKLVRSVPTEFNKDXHMGILELAQAKGYVXPLNKXEKDFPWSTGRAIHAPVTLXLKEGLAMIDPPRRGRNP

SEQ ID NO: 122474 - protein, 71 aa, Triticum aestivum
  Clone ID: PAT_TA_16892.pep
MSSSDDTCGKKASWPELVGKSIEEAKKIIMKDRPDVKIIEVFPVGTAVTGDFRPDRVRIFVDTVAEIPRIG

SEQ ID NO: 122475 - protein, 71 aa, Triticum aestivum
  Clone ID: PAT_TA_16893.pep
MSSSDDTCGKKASWPELVGKSIEEAKKTIMKDRPDVKNIEVFPVGTPVTGDFRPDRVRIFVDTVAETPRIG

SEQ ID NO: 122476 - protein, 201 aa, Triticum aestivum
  Clone ID: PAT_TA_16894.pep
GAFNALEYFEFRCGVLRLMFDEGAMPNLQRIKLGFNSHRGEQYRRLLVGIEHLSNVHEISGIIGSTVGAEEYDLQAAESAFKDATGKHHSNVSIKRSDIVVEEYGPLEKQHLVRGKHPSTSSEHPGSRKQESQQAIKQNSHNNSQLISRRSDGKKQASVELPNDPRSSVQVIVIKIVGHYRQAVGSPVPSKSFRSSMGPIR

SEQ ID NO: 122477 - protein, 211 aa, Triticum aestivum
  Clone ID: PAT_TA_16895.pep
RHEDDARRLAIHHPALLAPILEKVVLGVVKTMKNPRSAVLKTSVMACTDVFAAFGNLISSASADAFDKLLLQLLLKASQDKRFVCEEAEKAMRAMATSMPPLPLLRKLRAYVHHANLRVRAKAAVAMAHCAARMDVETMKEFGLPALLQVAAELLNDRLPEAREAARSIVGSTHAAFFFFEAAEKEQEKKENELKEQEKGKKEQKEQEEGK

SEQ ID NO: 122478 - protein, 97 aa, Triticum aestivum
  Clone ID: PAT_TA_16896.pep
LSSRLRKCLHILHTRRDEMRSIDKAQYPSFFFLSRLVQAGRQPYIYIVGVVTLFRRWRSCRWRCCGGGGRRRPCTSSRTSAASTPCRSSPRWARSWS

SEQ ID NO: 122479 - protein, 490 aa, Triticum aestivum
  unsure (1)..(490): unsure at all Xaa locations
  Clone ID: PAT_TA_16897.pep
MPGGGFAVSAPSGVEFEAKITPIVIISCIMAATGGLMFGYDVGISGGVTSMDDFLREFFPAVLRRKNQDKESNYCKYDNQGLQLFTSSLYLAGLTATFFASYTTRRLGRRLTMLIAGVFFIIGVIFNGAAQNLAMLIIGRILLGCGVGFANQAVPLFLSEIAPTRIRGGLNILFQLNVTIGILFANLVNYGTSKIHPWGWRLSLSLAGIPAAMLTLGALFVTDTPNSLIERGHLEEGKAVLKRIRGTDNVEPEFNEIVEASRIAQEVKHPFRNLLQRRNRPQLVIAVLLQIFQQFTGINAIMFYAPVLFNTLGFKSDASLYSAVITGAVNVLATLVSVYAVDRAGRRALLLEAGVQMFLSQVAIAVVLGIKVTDKSDNLGHGWAILVVVMVCTYXGPSSRAIWGSMRRLIASSTVASLAAPAGPAVTKKASQLYRSIAAQLVVCVRCAVSFTIVISVSTWVAVGDGLPAVGSQPVQSTMIDRRCEAVKNS

SEQ ID NO: 122480 - protein, 187 aa, Triticum aestivum
  unsure (1)..(187): unsure at all Xaa locations
  Clone ID: PAT_TA_16898.pep
MGTSDPLQGRERGGGSRPRRWGEMAAERDVDDLPRNAANYTALTPLWFLERAALAHPARASLVHGALRYTWADTYRRCRRLASALARRSVAHGSTVAVIAPNIPAIYEAHFGVPMAGAVVNCVNIRLNAPTVAFLLEHSSAEVVMVDQEFFSLAEDSLRIIADQKXSSFKKPLVIVIGDHTCDPSAL

SEQ ID NO: 122481 - protein, 147 aa, Triticum aestivum
  Clone ID: PAT_TA_16899.pep
GTAAPASASTGATATATTPASGTTTGPPPRPRPRPPQRHRRQRGASTGGSVAGTPAARAGAATRASLPARSSPRPSPRPGTWAPSRTPSSSSPPLPSRRWPCWKVAGARRVFWVGLGRGGVIYGASRQRRVLFAGRAQPGFFPGLTD

SEQ ID NO: 122482 - protein, 146 aa, Triticum aestivum
  Clone ID: PAT_TA_16900.pep
MRPFSLASIPRATRITTRINPFFTQPRNFSFTQATMGVEKTIITQGSGPSPQVGQKVTMEYTGWLQKEDGTKGDQFDTSVGRGDFVVNIGVGQVIKGWDEGVTQMKLGEKATLHISPDYGYGPRGFPGAIPPNSTLIFDVELKKIG

SEQ ID NO: 122483 - protein, 337 aa, Triticum aestivum
  Clone ID: PAT_TA_16901.pep
HVRSSARPAPAAGLASPAAADRPAAGRVPVRRAFCRGRRGRLRGSGAGPASRRASPGGAARRGRAGPPAGAAPRLPPPPAAAAAGRRGVGPPRRVHFSGRGFMVETAASPTYHRYLNALAARAGVLAVSVEYRRVPEHPLPAAYDDSWAALAWAVAGSAPGGPEPWLAAHGDASRVFLAGDSAGANIAHNVALRAAAEGLPRPCAAIVGVLLVHPYFWDPTNAMAPALEVRIRNEWRFMCARPDAGVDDPRFCPTCAEAAPRLAALPCERAARAGAGDDFLAVKGRAYHAALLASGWRGEAELVDTPGQDHVFHLMRPGTEAAADMLDRVAGFISRA

SEQ ID NO: 122484 - protein, 138 aa, Triticum aestivum
  Clone ID: PAT_TA_16902.pep
QAPQEEAGHGDTGSGISGVLYKWVNYGRGWRPRWFALSDGVLSYYKIHGPDRIDLSRDTDRGAKVIGEDSLRRLARPSFASAPHSNGHGHHQTPRKPLGEIHLKVSTVRERRSDDRRFSIFSGTKRLHLRAETREDRA

SEQ ID NO: 122485 - protein, 194 aa, Triticum aestivum
  unsure (1)..(194): unsure at all Xaa locations
  Clone ID: PAT_TA_16903.pep
AQIGGGELGFRRDSPRASVAARRRQELAAEGQRHLEETIASAFQILSSMNDELCNPALWSSSATATAASAASAASQHPHHQNAAPPPPHSADSDADAMGGAAGGSGXSLDEARHRYKIAVAALRASIAAVSPSTQGDGANRIQRXQPEIERWEERAPPWRKEIESKNKQLKLLIDQLRGSNIXDISMWQSPCSV

SEQ ID NO: 122486 - protein, 235 aa, Triticum aestivum
  Clone ID: PAT_TA_16904.pep
LTSSTWPTWPAWPWAHSDERGEVVTDDEETNCSGKFFPRDKAKLIQRVWVRSDIKQNEEHRELCKMLLDLGHEWSALPPFPMKVFPQATGACVLRGYCHHRIYKTHDTSTTRSTLGYREPNRMLQAFSLRLSSSASYPVSVYGIIAVRDSLEPLRNYVFNRPCRDDAITIDQDSFILPLCSPCRGMYLRQDALLEVDLWVKEEGDGSADKQILSAYAEIESCPAYDEMLYGQIRS

SEQ ID NO: 122487 - protein, 463 aa, Triticum aestivum
  unsure (1)..(463): unsure at all Xaa locations
  Clone ID: PAT_TA_16905.pep
MDSATSSSGDERGGVHVLLVPLPAQGHMNPMLQLGRRLVYHGLRPTLVATRYVLSTGPPPGDPFRVAAFSDGFDDGGMASCPDPVEYCRRAEAVGSETLAQVIAAEARAGRTPSVMVYDPHMAWAPLVARAAGVPTAAFMSQSCAVDLIYGEACAGRAPLPMAHGRALHCRGAVSVXFGPQDLPPFVVSPGLYPRSPDVSIRQFQGLEHAGDVLVNSFRDLEPQEAEYMESRWRAKTVGPTLPSFFLDDGRLPSNKAYGVNFFSSAAPCMSWLDRQPPCSVVLASYGTVYNLDAGELDELGNGLCDSGKPFLWVVRSNEARKISHXKLGRCEENGLIVPWCPQLEVLAHPTRPCFLTHCGWNSTTEALVAGVPMVAMPRSADQPTTAKYVESAWETGVRMRTDEKGLVRREEVERCIRKVMDEEGKVEYRKNATKWMRMAKEAMQKGGSSDKNIAEFAAKYLS

SEQ ID NO: 122488 - protein, 237 aa, Triticum aestivum
  unsure (1)..(237): unsure at all Xaa locations
  Clone ID: PAT_TA_16906.pep
TDPRVAIPSPARLHLPSSCRRSAALTNLQSVDRSTAACRWRGRLLPVAAAPLRLRAVHAAAAARQPFDNGSGVIEAEGEEDDDDEHPRLKIAIVGFGNFGQFLARTLVRQGHTVLAHSRSDHSAAAADLGASFYADPHDLCDCQPAVVLLATSILSTEAVLRSLPVHRFRRSTLFADVLSVKEFPRKQLLSRLPEDFDIICTHPMSGPESARDXWAGLPFVFDGVRVGDSPARRARA

SEQ ID NO: 122489 - protein, 112 aa, Triticum aestivum
  unsure (1)..(112): unsure at all Xaa locations
  Clone ID: PAT_TA_16907.pep
MAATRAAVMKLAIVLLAMSQLVHMATPTADPXLLHHRPYWSRAFPALLAGESILNPVMASGKRRCCSMRXQAQHPCSAPSPPHPTVQGKSLLTSRPGTVKVKCSWSSKCREQ

SEQ ID NO: 122490 - protein, 105 aa, Triticum aestivum
  unsure (1)..(105): unsure at all Xaa locations
  Clone ID: PAT_TA_16908.pep
MAGTKAAVMKLAVVLLAMSQLVHMATXQRPIQRLHRLCWLPAFPLLGESFLNPAMASGKRRCCSMRXQAQHPCSASSPPHPTMQGKRVLTSPHVEHQVKCSWSSK

SEQ ID NO: 122491 - protein, 101 aa, Triticum aestivum
  unsure (1)..(101): unsure at all Xaa locations
  Clone ID: PAT_TA_16909.pep
KSQPRRKRPGTRAAAMKLAVVLLAMSQLVHMATPTADPRTYCDLIGTCYDRIGPVRWEPFPHPGNQGGEGVCQQAQHRPXSAPSPPSPTLHGKSVLIPRRG

SEQ ID NO: 122492 - protein, 155 aa, Triticum aestivum
  unsure (1)..(155): unsure at all Xaa locations
  Clone ID: PAT_TA_16910.pep
MVKHNNVIPNGHFKKHWQNYVKTWFNQPARKQRRRIARQKKAVKIFPRPTSGPLRPIVQCQTRKYNMKARAGRGFTLEELKSAGIPKKLAPTIGISVDHRRRNRSLEGMQSNIQRLKTYKAKLVIXPRRARKVKAGDSPSEELAHAXQVQGDYMP

SEQ ID NO: 122493 - protein, 208 aa, Triticum aestivum
  Clone ID: PAT_TA_16911.pep
MVKHNNVIPNGHFKKHWQNYVKTWFNQPARKQRRRIARQKKAVKIFPRPTSGPLRPIVQCQTRKYNMKARAGRGFTLEELKSAGIPKKLAPTIGISVDHRRKNRSLEGMQSNIQRLKTYKAKLVIFPRRARKVKAGDSTPEELATATQVQGDYMPITRGEKRSVELMKVTEEMKAFKAYGKLRVERMNQRQLGARTKKAAEAEKEEKK

SEQ ID NO: 122494 - protein, 203 aa, Triticum aestivum
  unsure (1)..(203): unsure at all Xaa locations
  Clone ID: PAT_TA_16912.pep
MSACNTQYLGLAQLASLATRAAQSHGRKRAVNIQPRRASSPIVAISHDSALRVQHEGQGLAGHLPVWELQSAAHPKEGYSPAPLAFLWRHRRKNRSLEGYAVQTSKRLKTYKGASLSLFPKGVLARVKAGDSTPEELANXATQVQGDYMPIARGEKRSVEVMKVTEEMKEFKAYGKLRVERMNQRQLGARQKKAAEAEKEEKK

SEQ ID NO: 122495 - protein, 168 aa, Triticum aestivum
  Clone ID: PAT_TA_16913.pep
MAFSRLLPSRRLLSALLHTPTPIPAARVTGAAAATATLSAHTLHPARFFSATRRLGPGAPRQRAADIGARARQLQSRRLWTYALTFGCAAGFVVTVLATFQDQLVFYLTPTDALARFATDPSKTRCRLGGLVLEGSVAHPSSSSSEIEFVVTDLVTDVLVRYEGALPD

SEQ ID NO: 122496 - protein, 198 aa, Triticum aestivum
  unsure (1)..(198): unsure at all Xaa locations
  Clone ID: PAT_TA_16914.pep
MADTASAPLLTSHKTRPAKAPSIDDTIETYMGATGALQLLKAVLLAFAWAFDAQQVFISVFTDAEPQWHCTGADASCSAAAASPCALPSGAWAWDRPAVTSVVSXWSLKCAGPALVSLPASSFFAGCLAGGFLLTTLADSLLGRRKMLLVSIVSMSVPGVLAAFSPXVWVYAALRFMSGFGRPGGRPRTLVLSTELVG

SEQ ID NO: 122497 - protein, 207 aa, Triticum aestivum
  unsure (1)..(207): unsure at all Xaa locations
  Clone ID: PAT_TA_16915.pep
IANVNFSGNGHTQSPINGDAEAAVNPNIESVKSFFKERLDVDSKEESRAFLTFVIPHEKEPLLTRFFGELQDREREFGISDIQLGLTTLEEVFLNIAKQAELESSTAEGTLVTLNLSSGASIQIPXGARFVGIPGTETEEHPRGVMVEVFWDQDDSGTLCVSGHSDETPVPANVELTRPPSLSRRGSVGRGGPVGYVIDENQVPTAR

SEQ ID NO: 122498 - protein, 188 aa, Triticum aestivum
  unsure (1)..(188): unsure at all Xaa locations
  Clone ID: PAT_TA_16916.pep
ALQTCPPQPPPPPPCAGRXALQTCPPQPPPPPPXRWSVSSXACPAPPPPPQPPPPPPCAVPSALQTCPPSLPPCSDPLALXDCLPPPAPPPPPCADPLILQACRPPPPHCAAPSALPPHPPPAPCAGPLLLRLIRGLFLGAPFHGDGGISMYSEVTLCGGGCPAAGRSLGAGRRTATPRWRSSPSSLA

SEQ ID NO: 122499 - protein, 139 aa, Triticum aestivum
  Clone ID: PAT_TA_16917.pep
GTRYDDKVSGIALLHSYFWGNPPVGGELTDAAIRGGIDQVWHVACGGKLGLDHPYINPGASPEELSQLGCDRVLVATAEHCWFVERSRAYAAGVKACGWGGELEFYETKGDGHVYFLLKPDCDNAAKELAVVADFVRRC

SEQ ID NO: 122500 - protein, 211 aa, Triticum aestivum
  unsure (1)..(211): unsure at all Xaa locations
  Clone ID: PAT_TA_16918.pep
PPSPRPPSPFLARRRAAMTLPPQHPTPPLPAAAHHHLPGSGPQPRYRSRPPWLPTTPPPPPPVPHTQKSGHYRPASSSCCPARPSSHPPPPRLLLPPGKAPPHPPPAWRGPXPPGAAPPPPPXPAHLRPAMPPRRWPRPRSTPATAVFSTTVCVCVCSPPAPSSASDPVQPSDAVRHTNPLQLSPPQSMDPAPDPGSSLVHRTLLTRIERV

SEQ ID NO: 122501 - protein, 126 aa, Triticum aestivum
  Clone ID: PAT_TA_16919.pep
AGRPGRRTTHQTSDPHTHQSKNKLLRLPHRSKHSGIIVSIRTSLGRTLYLMGSSTTRVLLAVALAILLTSTSHVADAARPAPAADQAQLLDGGVVQAVTLADKARHTVELLMARLPAGPSPKGPGH

SEQ ID NO: 122502 - protein, 260 aa, Triticum aestivum
  unsure (1)..(260): unsure at all Xaa locations
  Clone ID: PAT_TA_16920.pep
MARTTNGWARGVVAFAAVAVAVSAGRRYSWDVEAAVAVFRRGRGALGPWAAPAHVAAHALTLALCPPYAIFFEGAAALFFGFLPGVVCVFCAKILGASLSFWIGRAIFKYFTSAMEWLQRNKYFHVVVKGVEKDGWKFVLLARFSPLPSYIINYALSATDVEFFRDFLLPTIVGCXLPMILQNVSIVSLADAAVASTTGSKKSHIYSYLFPIFGIVSSILISLRIKQYSSALAIPEELTNPPTNGNINEDTSSEKTTKRR

SEQ ID NO: 122503 - protein, 207 aa, Triticum aestivum
  Clone ID: PAT_TA_16921.pep
FGNEDNALTVEWTMAELLRHPAVMSKVRAKLQEVVGAEQYPDESNISRLPYLQAVLMESMRLHPPSPLLIPHQAMAEGAEVGGFVVPKGAMVIVNLWAIMRDPATWTQPEEFMPERFIGADMDFRGKDRFEFMPFGAGRRACPGMPMATRVVTLILASLLHRFEWRLPEGMQPCDVDVRDRYRMSLNMVTPIKAVPLPLVLVMDCYP

SEQ ID NO: 122504 - protein, 361 aa, Triticum aestivum
  Clone ID: PAT_TA_16922.pep
GRGRAGRGEGGRAAPRRSGARLAAFLALLLHLAAVIEGKSFYDVLQVPKGASEDQIKRSYRKLALKYHPDKNPDNEEATKRFAEINNAYEVLTDQEKRKIYDRYGEEGLKQFQSGRGGGGGGMNMQDIFSSFFGGGGGGMEEEEEQIIKGDDVIVELDASLEDLYMGGSLKVWREKNIIKPAPGKRRCNCRNEVYHRQIGPGMYQQMTEQVCDQCPNVKYVREGDFLTVDIEKGMQDGQEVSFFEEGEPKIDGEPGDLKFRIRTAPHDRFRREGNDLHATVTISLLQALVGFEKNLKHLDNHLVQIGSQGVTKPKEVRKFKGEGMPLHQSNKKGDLYVTFEVLFPKTLTDDQKAKLKEVLA

SEQ ID NO: 122505 - protein, 104 aa, Triticum aestivum
  Clone ID: PAT_TA_16923.pep
GTRTCRGLQLLIRHFSLCKSRASCPRCQRMWQLLRLHAALCRLPHGRCNTPLCTQFKLKEQQKEAVSAKAGDGSDGRWALLVKKVKAVSVMSSLGKRSPPPCQC

SEQ ID NO: 122506 - protein, 159 aa, Triticum aestivum
  Clone ID: PAT_TA_16924.pep
VRGANFRDLPGVIVGPDNVAKLDPTKERVLLPSGRPLVLDCVLTYEDGRCLRPFGRLWWDEVVGTVLTCPNICMQALIHPAQDRLLTVRESARLQGFPDSYRFRGTVKDRYRQIGNAVAVPVGRALGYALAMANLNKTGNDPLMELPPKFAFSHIEGTP

SEQ ID NO: 122507 - protein, 216 aa, Triticum aestivum
  unsure (1)..(216): unsure at all Xaa locations
  Clone ID: PAT_TA_16925.pep
MAPVKVYGLPMNGSVARVLACLEEVGAEYEVVAVDLHTGEHKRLPHLARNPFGQVPAFQDGDLVLFESRGNLKVYXSGKGSPDLLRENNLSESAMVDVWLDVESQKFDSVMLPIIFQGLVIPVYMGGTSDLKVLEENLEKLKEIMEVYEERLSKYKYLAGDFISLADISHFPMVHLLHETPYAAVLDSYPHVKAWIAGVMDRPTVKKVMGLMKTFG

SEQ ID NO: 122508 - protein, 224 aa, Triticum aestivum
  unsure (1)..(224): unsure at all Xaa locations
  Clone ID: PAT_TA_16926.pep
PTENLLPLLRPAHPTLGCRTLAAITLPRPRRRRGNPSPRGRPRQRPXGQGHQPSPTTPAAAKSKSSAAAGASGHGHNSSPATPAAGKSKVSAHAVAPGQASSSNQPHAVGGADAAASSLKRKRGVFQKDLQHMMYGFGDDPNPLPETVALVEDIVVEYVTDLVHKAQNVASKRGKLLTEDFLYLIRKDMRKLHRATELLSMNEELKQARKAFDVNEETLVVTNE

SEQ ID NO: 122509 - protein, 240 aa, Triticum aestivum
  unsure (1)..(240): unsure at all Xaa locations
  Clone ID: PAT_TA_16927.pep
NSIDNSKLSRASKRFSPGSARVARKPSAAETGGMSSSRRSLSPLFDPELLASIERELSEEGAHIKRVIGSEKPKQPKVIPAIVAEGKCPPGGADAVVLYTTTLRGIRKTFEECNAVRAAIEAHDVKVIERDVSMDSGYREELRLLXLGGRELRVPAVFVRGKHVGGAAEVTXMEEEGKLKALLQGLPRARVWCAGCAGVRFVMCRDCNGSRKVRVDGERKEMVQCGECNENGLVRCPICS

SEQ ID NO: 122510 - protein, 219 aa, Triticum aestivum
  unsure (1)..(219): unsure at all Xaa locations
  Clone ID: PAT_TA_16928.pep
LCESWERHKRSRGFLSEXKRAQILHQCKMANLIWIGQDRLGHLQPNQMERILGYPSNHTNLFGLNPPDRIAAMKYAFQTDTIAYLLSVLKDIYPDGLRVLSIYSGVGGAEIALHRLGIPLKCVVSVEESDVNRKILKKWWAKTEQSGVLRQLNGIWKLKTDALEDLFKEFGGFDLVVGGNYSSYRGGTTVNATMGMDSGKYFEYVRVLQRVRSMQHFYK

SEQ ID NO: 122511 - protein, 83 aa, Triticum aestivum
  Clone ID: PAT_TA_16929.pep
MAMESGAEAAAAAAAGYYGGNCGWETPKREECRIPATLPCPAAPRKAAADFGTPRRPPKNGYFQPPDLEALFALAPRRQASCA

SEQ ID NO: 122512 - protein, 81 aa, Triticum aestivum
  Clone ID: PAT_TA_16930.pep
MAMESGSEAAAAAGYYGGTCGWETPKREECRILATLPCPAAPRKAAADFGTPRRPPKNGYFQPPDLEALFALAPRRQASCA

SEQ ID NO: 122513 - protein, 189 aa, Triticum aestivum
  Clone ID: PAT_TA_16931.pep
MAMAVASSTMEVDQDLPGFRFHPTEEELLGFYLSRVALGKKLHFDIIGTLNIYRHDPWDLPGMAKIGEREWYFFVPRDRKAGSGGRPNRTTERGFWKATGSDRAIRSSGDPKRVFGLKKTLVFYQGRAPRGTKTDWVMNEYRLPDTGAPPPQEDTVLCKVYRKATPLKERVLGPLATLVFYQGRAPRGA

SEQ ID NO: 122514 - protein, 414 aa, Triticum aestivum
  unsure (1)..(414): unsure at all Xaa locations
  Clone ID: PAT_TA_16932.pep
MVPGARAPAASVLCGLVALAGAAVLWFSGAAEARVLLTLDDFGAVGDGIANDTQAFVDAWTAACGSEEQAVLAVPVAKAYQIWPVQLSGPCKKKLKLLIAGTIVAPASPDEWAGRDPMKWLYIYGVDGLSVSGGGTIDGVGQEWWARSCKRKKTQPCNTRPPPRALHFEECRGVSVQGVTLQNGPQFHLSFTRCVDVKANFLRLVAPADSPNTDGIHLNDSSRVQITDNLISTGDDCVSMVGNCSDVRVRDISCGPGHGISIGSLGKNRTTDRVENVRVDTCLLTNTTNGVRIKSSQGGDGLXRDLRFESIVMKNVSNPIIIDQYYCDQPTPCANQTEAVEVRKVEFVDVRGTSATAQAIKIACSDTLPCRVLELRNVNLTMVGGGAATASCYRASGKAVGAVAPASCLAKGDP

SEQ ID NO: 122515 - protein, 229 aa, Triticum aestivum
  Clone ID: PAT_TA_16933.pep
MATAAVLILLASLLPALAAGTDCRSPAADYGLALTPSHECGVVLPVAVGTYDMGTYAPGSAYEASLRHLVATIPAKANAESSGSSYYSDSYRDDAGADGRFFVGDARACGRSYGDVAGESPNRIVASADCSGHPDARSPDCGACIALAFQEAQRLCPFQRMAEAAVGGGACNCSAHFHDYDIMEQFHHGDRSSDPRWAPAHLVGVGAVAENEENITRLKWACRTLETTI

SEQ ID NO: 122516 - protein, 181 aa, Triticum aestivum
  unsure (1)..(181): unsure at all Xaa locations
  Clone ID: PAT_TA_16934.pep
SPPRSHPTPPPVQPPRPGAPPDGEGPRYHDAAAFPGVAQPPPYHPSPEPRTTTRPAHRRVLHRGATRRSRTPRAVGTSPATPAPYLRTTGGRDYYSYGGGGGGXRLPRAVTASRVTTTRSIRRRTCTRGAHGGGHPAPSLVGMYXXKXMAXSFRVRLKPCXCRNYSXPCIXSNVRSLFLLF

SEQ ID NO: 122517 - protein, 99 aa, Triticum aestivum
  Clone ID: PAT_TA_16935.pep
NPGVGEASSGPAAVPAPAPAYSAQSVEEIMKIVQEAQTVPKPDKPVSGYGWGTGDGEASDEEDGNQEGEEEEEYGEDEYDRTVREVHASGDFGMSKLQI

SEQ ID NO: 122518 - protein, 403 aa, Triticum aestivum
  unsure (1)..(403): unsure at all Xaa locations
  Clone ID: PAT_TA_16936.pep
TPSEWNIMDGFSEFGSSPLIVGVMLSLLEKSYRLVDIGPNPENRDEAIKFRKFWGEKAELRRFKDGAIAESTVWETETWERHTIIKRIADYVLTKHLLARREDLTHVVDQLDFCLLVGGQDPVSSSGALLEAFDTLAKQLRLLDDVPLKISTVQPLDSAFRHTSVFPPEPHPLAYEKSSQRLPNFAATCVRSLEVMIQLEGSGNWPLDPVAMEKTKSAFLLRIGESLEDRGMFVTASEDEVNVLTSGYSFLLKIFHEGGLVVQKQAGDSNIQSAPSEDKELFFRSQHSSMINGLHGIYQAYGPVVRLAKRWISAHLFSSFISEEAVELVAAYLFLRPFPFHAPSSRVTGFLRFLRLLSSFDWTFSPMIVDINNDFNLKDEKEINENFMLSRRSYEXNPHDIEP

SEQ ID NO: 122519 - protein, 146 aa, Triticum aestivum
  Clone ID: PAT_TA_16937.pep
MGRVRTKTVKKSAKVIIERYYPRLTLDFETNKRICDEIAIIASKRLRNKIAGYTTHLMKRIQRGPVRGISFKLQEEERERKDQFVPEVSALDFTQNSESGQLDVDTETKDLLKHLGFESIPVNVIPVTQQQIPERGQRYGNRPRRD

SEQ ID NO: 122520 - protein, 185 aa, Triticum aestivum
  Clone ID: PAT_TA_16938.pep
EETTRGCRWRGRPAFPGGRGPCLQGAWGQQPPCGDPPPRRLPHYPRSRCPRVQVLVPSRLEPGLPPPVPVSSTRPSLLGFYIGSILIRPELVAFLCFVPMLPQPPELNTVVRRMANHNFDDPKNLWIMDSRNGSIFTRRREGRELAYGVHRRELAYGLHRPLCPERGINVVPALPRAQGLQSPIF

SEQ ID NO: 122521 - protein, 332 aa, Triticum aestivum
  unsure (1)..(332): unsure at all Xaa locations
  Clone ID: PAT_TA_16939.pep
MESMEALERDQMLNAVELEQWESGKSVNDIAACQGIRIRRHCRPAASMAEIEAEMGAPRNILEKIIWDKEIGIIQGLPRSPLNEVIESAGKARFGRAIYWXSKAALGRHGVPALIAEVKKASPSRGVLRENLDPVEIAQAYEKHGAACLSILTDEKYFQGSFENLQKVRKAGVKCPLLCKEFVVDKWQIYYARAMGADAVLLIAAVLTDLDIKYFLRICKELGLTALIEVHDEREMERVLAINGVQLIGINNRSLETFIVDTSNTKTLLEKHGDAIREKGILVVGESGLFNPDDVAYVQNAGVSAVLVGESLVKQADPGRAIAGLFGKELVH

SEQ ID NO: 122522 - protein, 553 aa, Triticum aestivum
  Clone ID: PAT_TA_16940.pep
MMAMMSLLSSFLLVMAVWGGHHTNLASAEGIVISSSETALTEYWQTMVPNSPMPLAILELLLTSTGHDDHMGKQDTNNIHTPNKWTGEKYVGASLLKSRKNGLHPTIDANARTETDNQKNQIWFYGWGPQKINNEKTIKGLVREPVKDIYDKKKEVWFYGWGPLKISDEKTRNELVREPIRKIYDKKNQIWFYGWGPQKIKNEKNMRGLVREQVKNIHDKKKQVWFYGWGQLNISDKKTRKELVREPVRKIYDKKNQIWFYGWGQVQNSNEKMAKHLVMEPVKQVYEEKNQFRGPQAKDDGARESGMQEDDGHQGGSHIHGESTVSNIIFFEESLKPGSTITPYIQPSATSGAPLLQRDVANTIPMSTENFTDILAMFAPVSSAMADDVWVMLDLCERPSLVKGEKKTCATSVESMVEFAASVLTGGNTRGLRAFSSPDVPAEGVTSSRKYKVVAARRATESSKTMTCHGMSFPFVVFMCHAVNPTRTYEVTLESEDLTSRMVLLAVCHLDTSEFDPMKMPGHAKPGDAPACHFIPRDSVLWAPVAPAAATAA

SEQ ID NO: 122523 - protein, 491 aa, Triticum aestivum
  Clone ID: PAT_TA_16941.pep
MEMASSAKWFAVALVFITVILLRVIRGRRMAAAPASEKPPPPVVNGFALLGLLPRLLTMDLRTKINCLHDKYGSVFTVSPFGLTNVTFLIGPEVQSHFFQGLESEINHGNLLEFLVPMFGQEIGQGVDAATRTEQSRFYLDALKQSKLRRHLDPMLQEVESYFGKWGLEGEVDLKHEFEELLMLISSRCLLGKEVREKMFDEFYKLFRDVENGVNMISVFFPYIPIPANRRRDKARLKLIELLSGTVRSRKSSPSVEEDVLQRLIDSKYKDGRSTTETEVTGMIIALIFGGKHTSSLASTWTGACLLTHPKFLAAASQEQKEIMMKYEDKIEYDALLEMNTLHNCIKEALRLNPPTTMLVRKALKHFTVRTRQGQEYGIPKGHTLASPIIQNNYLPYIYKDPEVYDPDRFGPVRQEDVVGGKFSYTSFGGGRHFCSGDAYAYMQVKVIWSHLLNNFDLKLLSPYPKTDWSKLIPEPQGNMMVSYKRRQLLG

SEQ ID NO: 122524 - protein, 170 aa, Triticum aestivum
  Clone ID: PAT_TA_16942.pep
TGSHQASLTRARPHAWCSSPLPTAAVGVALAHDVGGGSLRGSALRRAPPSLVMHLVPPTLGTTTLPSARLQSTEPAHGGARDHGLWHTPLHPRSVERRGAVDHGADVGLQLPDERRPPAWLLGATAPPVKEMGRPDSDALRRARRGLALQRGTLCGVDRAVPYILAMRRC

SEQ ID NO: 122525 - protein, 185 aa, Triticum aestivum
  unsure (1)..(185): unsure at all Xaa locations
  Clone ID: PAT_TA_16943.pep
MASTTSFLAMIMACTLLASTTCHAARHLADTTPAAAPPAAVGLSLGLPAVPTMPTLPPMPGCPDXFPPLTTATYCRLVHPPRMPAVPPVPLVPMPPMPAIPPPARPLPPLPAAVVPNPPLPPLPAIPSVPKMTLPPMPSIPXVNVPMPFLAPPPSTLVRLVRADACAMSPVTGSHVPVATSLVAH

SEQ ID NO: 122526 - protein, 411 aa, Triticum aestivum
  Clone ID: PAT_TA_16944.pep
MGSYSPTSRFKDLDTIPLDPHYALKETFQADPDPRKVILGSGLYRDDDSKPWVLPVVKKAEVLIKQTQDSGRYEYLPISGYPAFVSSARQVLFGPQSLNESRLVSIQTISGTGANFLGARFLAETLKPSAVWLSDPSWVNHANIWGLVNVNVKRYPYWNAKTKSLDFNNMIEKLQTDAIAGDVILLHACAHNPTGVDPNKEQWRKIADVCERKQLFPLFDCAYQGFATGNLDDDAWAIRHFIDRGTMELAVCQSFSKNMGLYGERVGALHMFCATSTDAEKVRGHLCRLQRGQISQPPTNGARIAATILSDSKLFQDWVTDLGEMSSRIKEMRKSLYDNLMILDTPGKWDHIVSQIGMFSYTGLTPEQVAFIQQDSHVYILKSGRISVAGLNSKNVEYVAKALDMAVRGLP

SEQ ID NO: 122527 - protein, 286 aa, Triticum aestivum
  Clone ID: PAT_TA_16945.pep
LGVSPKPTPTGTITPVSGVRSRRSDSLGRCDTPTSEASMSTARRKFSTLSSVSYWMTQIRLAEAASKHSISLCFFKLALESECEPLDRMREELKAYVARHGLATELEEPVKEILQVYDIVEDFEKLKISLDSSQEPKKSDKSAVSAANVTPKGNLKPRSLNSVATQSKDGKKENIQKEKPDAKIRGSYNKNPAKNAPAKEGAKNTVKKTKKQAKEQQEDCNGGSEVSPVEADQESVDVVKEITYEDKENMGDAEMAIDAGNAVAHGGLEQMDRLQIQTFCLLNMKY

SEQ ID NO: 122528 - protein, 184 aa, Triticum aestivum
  Clone ID: PAT_TA_16946.pep
MEGLDDNKHEERDAAEGAEDERGEQSPPGSPEFDPEVISEFRKALGEASPPRDYEGNGECVKKREIQRFPGIVRARVSAFQQRIDAKLAKLARPPTPTPTPTQRKVVLYLTSLRGIRKTFEDCWATKSILHGYGVRIDERDLSLHGGFKDELHASLGSAGRLPQVFVDGAPRGPAVAAPCTRPG

SEQ ID NO: 122529 - protein, 385 aa, Triticum aestivum
  unsure (1)..(385): unsure at all Xaa locations
  Clone ID: PAT_TA_16947.pep
MAFSTPNALSASGPASPFHLRLQPQPFLRLPALPFHRSLPLHLPSLRLTRPLLPPLPLASSGGGSNIGSGGGGGGGDDDLRPSGGGGDEDEGEGGDDAAVNRREALFVLAQLGRKLESLPADMAAAVEGGRPPGEIVRRFADLEKSPMFRWXLLQFGGFRERLLADXLFLAKVAMECGVGIFTKTAAXKYERRRENFVKELDFVIADVVMAIVADFMLVWLPAPTVSLQPALSVNAGAIAKFFHNCPDNAFQVALAGRSYTFLQRFGAIMRNGAKLFAVGTSASLIGTGVTNAIIKARKTVNKDDAGEVEDIPIVSTSIAYGVYMAVSSNLRYQVLAGVIEQRMLEPLLHRHKLALSALCFAVRTGNTFLGSLLWVDYAKFIGIQ

SEQ ID NO: 122530 - protein, 212 aa, Triticum aestivum
  Clone ID: PAT_TA_16948.pep
LAWSRPRYTFDKLGALLGEDGASVAEARPTAVTDLSGISISDLQEGQLSSAKTASSIKELKEDGLREYADLKQSLLLYDISIVITGFSAFTLASNDGAAYSFLVGGIGGFLYLLLLQRSVDGLPAISSPSEASSSEPTMNFSGVRRPWLILSIVMVAGAVALKYRPGRPRVELTPTELFVGAAGFLANKVAVLLAAFKPLQSNLESDDGSVD

SEQ ID NO: 122531 - protein, 111 aa, Triticum aestivum
  Clone ID: PAT_TA_16949.pep
MERRAARGTSDHRRRMQMPPAQVEQKPQRRGGPKSCQRTPPPPGCFTIQLLMVFLWVAASLAFLPLVLPPLPPPPLSLLLVPVCLLAVLAALAFVPLDAHNNVVGGGSSCL

SEQ ID NO: 122532 - protein, 165 aa, Triticum aestivum
  unsure (1)..(165): unsure at all Xaa locations
  Clone ID: PAT_TA_16950.pep
MNIQHAIQVVILLVPSPSSYISIPSPMLLFSKSSLFLQFFLQRDGHGCPMPERRRPRTRRRLDPLLASPVSPNPATHAPPGPAPPSAPAPXSTAPPLLPPPTPPRAPGPPPXVPPAPSRAPSPAPPPSRPPPPASPPTRPPAPPPPPRHPISPKTCTKSRPEPAP

SEQ ID NO: 122533 - protein, 424 aa, Triticum aestivum
  Clone ID: PAT_TA_16951.pep
GCCIRLWPMGNCPPQPRSKVDTSTSSASTHGAEKSAENGSRNQPVVSVVSGSTSTSNAESSSSASKAGEEIKVSSKLRKFGFSDLKCATRNFRPESLLGEGGFGCVFKGWIEENGTAPVKPGTGLTVAVKTLNHRRLQGHKEWVAEVDFLGNLHHPNLVKLIGYCVEDDQRLLVYEFMPRGSLDNHLFRRSLPLPWSIRMKVALGAAQGLSFLHEEAERPVIYRDFKTSNILLDSEYNAKLSDFGLAKDGPVGDKTHVSTRVMGTYGYAAPEYVMTGHLTSKSDVYSFGVVLLEMMSGRRSMDKNRPNGEHNLVEWARPLLGERQRFYKLVDPRLEGNFSVKGAQKAAQLARACLSRDPKARPLMSQVVEALKPLLNLKDMASSSYFYQTMQAERMAHSSSMNGRNSHSLKVHGVFCPRKRKRA

SEQ ID NO: 122534 - protein, 138 aa, Triticum aestivum
  Clone ID: PAT_TA_16952.pep
SARGAIHFAIALAFLLWLARNVGGARTERYHCLPAGGQTPHRGSFACGRRRRRPTIASRRGEIDGNQVLLPQGRGGRAAPVQGGRGGARAPAPRGARPVPGGGGRRGARQDRGQQARAQEDGGRPRHRRRSGGRCGVC

SEQ ID NO: 122535 - protein, 58 aa, Triticum aestivum
  Clone ID: PAT_TA_16953.pep
KCIFHEVNYTTPCFTYLKCNRRFSKDGTYYFKSNSGSARTNPFVEINNKSRLHVAGSL

SEQ ID NO: 122536 - protein, 106 aa, Triticum aestivum
  Clone ID: PAT_TA_16954.pep
MAKGTPATGWAAKDPSGVLSPYSFSRRALKDDDVTIKVLFCGICHTDLHIAKNEWGNALYPVVPGHEIVGVVTDAGPGVKNFKAGDTVGVGYFVDSCRSCVSCGSR

SEQ ID NO: 122537 - protein, 185 aa, Triticum aestivum
  unsure (1)..(185): unsure at all Xaa locations
  Clone ID: PAT_TA_16955.pep
RPGPPSGTMDGIIDTVSVRHPVGALVGLLKPRGQLVVVGAPSTPLELPAYAIIGGGKRVAGNLVGSVASCQAMLDFAGKHGITADVEVVKMDYXQYGGRAAGEERREIPLRHRRRRQPAGRRRLVLPNTPYACRPLWLPTSFQPREVVICCFILTNGLVRAIAFEIIGAIFRASSIAKKKKKKAP

SEQ ID NO: 122538 - protein, 370 aa, Triticum aestivum
  unsure (1)..(370): unsure at all Xaa locations
  Clone ID: PAT_TA_16956.pep
MEKGTPAIGWAARDDSGLLSPYSFSRRVPKDDDVTIKVLFCGICHTDLHIAKNEWGNALYPIVPGHEIVGIVTDVGPGVKSFKAGDTVGVGYFLDSCRSCDTCSKGYENYCPTLVLTSNGVDYDGATTQGGFSDVLVVNQDYVLRVPESLSLAGAAPLLCAGVTVYSPMMQYGLNAPGKHLGVVGLGGLGHMAVKFGKAFGMTVTVISSSPRKREEALERLGADAFLVSRDAEQMKAAAGTMDGIIDTVSAGHPLVPLLELLKPMGQMVVVGAPSEPLALPAYAIIGGGKRVAGNGVGSVSSCQAMLDFAGKHGITADVEVVKMDYXQHGGGAAGEERREVPLRHRRCRQPAGLRRLVLRHVGSRRSPAT

SEQ ID NO: 122539 - protein, 310 aa, Triticum aestivum
  unsure (1)..(310): unsure at all Xaa locations
  Clone ID: PAT_TA_16957.pep
LFLEVVVKTIGACDRTLNLDAAKKKVLDFVEGKMGYIAPNLSAIVGSAVAAKLMGIAGGLGALAKMPACNVQLLGAKKKNLAGFSSATSQFRVGYLEQAEVFHXTSPALRTRACRVIGCKGNXLAARXDSTRGDPTGXAGRNLLEEIRKXKIEKWQRXPPAQVRHLHHFTGIQLSKPTGTGRPPSEKWKEKYAVTDMMKLANRLQFGIPEESSLGDGLGEGYGMLGQAGXGKLRVSAAQNKLAAKVAKKFKERSYGSGGATSGLTSSLAFTPVQGIELSNPHAHGNHLGSGTQSTYFSETGTFSRINNRP

SEQ ID NO: 122540 - protein, 199 aa, Triticum aestivum
  unsure (1)..(199): unsure at all Xaa locations
  Clone ID: PAT_TA_16958.pep
GTRLTFPPPLSPRREPRGSPMAHAAEGDKPREEEQEHEEEVIIVGAGPSGLAAAACLSLRGVRSLVLERDDCVGSLWRHRTYDRIRLHLAKQHSALPHAPHGPAAPTYLPRDDFVRYLDDYAARFGVRVRLRREVREARFDEAXGAWVVEAVDHATGLVERYAARYLVAAAGENDEKVLPEVPGLDGFPGNVMHACEYR

SEQ ID NO: 122541 - protein, 138 aa, Triticum aestivum
  Clone ID: PAT_TA_16959.pep
RSLHLLYPSFFKAYRWRNNVPKKVVARSGQGRRSGAGPGLQGPLPMLEAPTRTGLRSRQRGTARGRRPAPGRGRGDDRRGRTATGCMVSTCVGSRTSPTILIGARPLNLIPHHGAHHPHTSLPGLVDHGSTSTVLGRG

SEQ ID NO: 122542 - protein, 391 aa, Triticum aestivum
  unsure (1)..(391): unsure at all Xaa locations
  Clone ID: PAT_TA_16960.pep
MAPEVKVPLLEGRGATPAQTLGNIVVSIVGTGVLGLPYAFRAATSLLRALVXRARLRPHVGRYVHPGASSSSAGSGEQRGTDLVFSRAANLSSVPPRPRRRPRVVLAPSCCRPRGRASPFVRSLLRAGAPSSILADACTVLAVAAVVKEDVQLLAKRGRPFAGRSAFAGLWGVPFACGVAVFCFEGFCLTLALEASMSNRGRFRPVLFQAIVGVTIVYISFGVCGYLAYGDDTRDIVTLNLPDNWSTAAVKVVLCVGLALTFAVMMYPIHEIVEARLLAPGGWVRRRCGGVVQRAALHLSRVAVVAALAAIACFVPAFGDFVAFVGSTVCALLSFVLPALFHLSFVGPTASPWARAVDYFLLLAGLVFAGHGMYTVLAPIYNLKMDITFVK

SEQ ID NO: 122543 - protein, 261 aa, Triticum aestivum
  Clone ID: PAT_TA_16961.pep
RARRFEALARSRRAASLALSNRKEITTPHLGAVNSLQVDLTEGRYLLSGASDGSAAVFDLKDATEYEAGFIAKHRSILLVDKQHQHGHKFTVSKAIWYPVDTGLFVTASFDNYVKVWDTNSTQMVMDFAWPRPGYSAAMSPIATTHMLIATGSADVQVRLCDIASGAFTHTLSGHLDGIMSLEWSTSSEWILMSGGCDGAIRFWDIRRAGCFLVLDQLRSQLGRRPPILDGTTDNVCLPSPFTFYLLLGLVISSEYICSQG

SEQ ID NO: 122544 - protein, 244 aa, Triticum aestivum
  Clone ID: PAT_TA_16962.pep
TAICNFHAKEAQVDYLTMFQPPALRTASPVEKQAGLVFSRKVFDIFQEQFAESFGYHAERLEDRMLHKYRLTVDDGDEEAHIVSFSPDQSTVCCSCCLFESCGILCRHALRVFIIEGVRFLPKAYVLKRWTKHAKSTVTLDNYIELRGYCEDPSTSRYNDLCYDANKCAKEGSTSTERYKIAKEALCKALDEIMPTRNIREQNSQNCTTSLRSPVKKLGTSKGTSGKSIKRPAFKNSPRGEQWQ

SEQ ID NO: 122545 - protein, 115 aa, Triticum aestivum
  unsure (1)..(115): unsure at all Xaa locations
  Clone ID: PAT_TA_16963.pep
MLQCLEGVRHLGGVLLKCCDIDLKQPKGLEDPEVLARETVFSVSEVEALYELFKKISSAVIDDGLINKEEFQLALFKTSKKESLFAXDRVFDLFDTKHNGILGFEEFARALSVFH

SEQ ID NO: 122546 - protein, 240 aa, Triticum aestivum
  Clone ID: PAT_TA_16964.pep
MAMKARLLAAAATCVCLAAAASAFDVPTVAFEEGFSPLFGDGNLVRARDDRAARLLLDRRSGSGFISSDYYLHGFFSASIKLPRDYTAGVVVAFYLSNGDVYEKTHDELDLEFLGSRWGGQWRVQTNVYGNGSTSRGREERYLLPFDPTLEAHRYSILWAPTHIIFYVDDTPIHWDFRHPGMGGDFPAKPMAVYATIWDGSAWATEGGKYKVNYKYAPFASDFSDLSLRGCRVADPAALR

SEQ ID NO: 122547 - protein, 80 aa, Triticum aestivum
  unsure (1)..(80): unsure at all Xaa locations
  Clone ID: PAT_TA_16965.pep
DVVTVVAESCWVRHLLQELHRPISTATVVFCXNVSVVXLLKTPVQHXRTKXLELDIXFVPRRKLPLGVVPVLQVPFLKRG

SEQ ID NO: 122548 - protein, 388 aa, Triticum aestivum
  unsure (1)..(388): unsure at all Xaa locations
  Clone ID: PAT_TA_16966.pep
RALLFHPLKDTTVRGLEIQVRKLYCISRAAPRLPISVEDAGHSPMAFAGSGWREVPLPCVGQATRFWHRVIDLRTAAGQAVFRVQHQVENKFREYLSSNLLISIHTPPLISGSSEGGAAVFKLEYKNGKCACLAQSPQLHKEVAIXLGFDRVLKIGSVFRAEDSNTHRHLCEFVGLDAEMEIMRHYFEVCDIVDGLFIQIFRHLNENCKRELEAINRQYPFEPLKYLERTLRLSYEEGIQMLKEAGTEIEPMADLNTEAEKKLGQLVREKYDTEFFILYQYPLAARPFYTMPCYENPAYSNSFDVFLRGEEIISGAQRIHEPKLLAKRAAEHGIGMSSIKSYIDSFSYGTPPHGGFGVGLERVVMLFCGLHNVRLASLFPRDPQRLSP

SEQ ID NO: 122549 - protein, 184 aa, Triticum aestivum
  Clone ID: PAT_TA_16967.pep
GADVDIARRRSLGAEDRKRRGGGAGVSRSTALVEPGSGRAVATPRVVGLDGSSAQFAASVTAGEALGDAARAPTCPRSADRMALDAPARALADERALHQVRLCFALPKAILRRPLSGQEDDPLSLKPSSAHVVASGKGRIMARVAPLVIADDIGTGTSRLHLTDKQHIMPSYIYGFCLYLIAAD

SEQ ID NO: 122550 - protein, 128 aa, Triticum aestivum
  Clone ID: PAT_TA_16968.pep
PGFSPRPPSLRLPHLFVGRSLPLHVHPPRTSTRHGCGDIYILKSKEQTRVHPTASIGQGTLLFQFKFAYARHPNSKHTWWFTLRHRTTLFWLHARFILHVRIVLLHANNTDLPSGDHRALVQCYNVFF

SEQ ID NO: 122551 - protein, 80 aa, Triticum aestivum
  Clone ID: PAT_TA_16969.pep
SARGCFAMKAAPSFEAVKGLVEGLVKGGSAPGAKGVVAKMSFLVKGDAKVAWEKIAGELSLEEGAPKFRSMICWRHASQF

SEQ ID NO: 122552 - protein, 473 aa, Triticum aestivum
  Clone ID: PAT_TA_16970.pep
MLLPVRRPHAAPSRPASPRHVSSSLGPRSRQVDRVLRGSTVARASPAATDASASAGLGRRAVVGMALAVSLSAPAYCRAPPPSSALTEENLLFLEAWRAVDRAYYDKSFNGQSWFRYRERALRDDPMNTRQETYAAIKKMLATLDDPFTRLLEPEKFKSLRSGTQGALTGVGLSIGYPLALKGSPAGLSVMSAAPGGPAEKAGIVSGDVILAIDDTSAQDMDIYDAADRLQGPEGSSIDLTILSGADTRHVVLKRERYTLNPVRSRMCEIPGSEDSSKIGYIKLTTFNQNAAGSVKEAIKKLREKNVKAFVLDLRNNSGGLFPEGIEIAKIWMDKGVIVYICDSRGVRDIYEADGASTIAASEPLVVLVNKGTASASEILAGALKDNKRAVVYGEPTYGKGKIQSVFALSDGSGLAVTVARYETPAHTDIDKVGVTPDRPLPASFPTDEDGFCSCLRDPASCNLNAARLFVRS

SEQ ID NO: 122553 - protein, 272 aa, Triticum aestivum
  Clone ID: PAT_TA_16971.pep
MSIQGLLLEVRVTGCRKLRDTEFFSRQDPYVIVEYANTKLRTRTCTDGGRNPSFDEKFHIPLIEGLRELSINVWNSNTINTDDFIGSCRVPLNKVLTSGYDDSSWPLQTRHMKSAGEVKLIMHFDVSAMKNKMAGKTSGQYAPSPYGASSASYPAPSAYAAAPPPHQAYPAPSHAPYPAPSAYSTPPPQQPYPTPPPQQPYPQQGGPPTSHPPQPYGQPYPPQPYGQPYPPQPYGQQPYPPQPYGQPYPPPSAAQSPYPPAPYPGAYPPRPY

SEQ ID NO: 122554 - protein, 206 aa, Triticum aestivum
  unsure (1)..(206): unsure at all Xaa locations
  Clone ID: PAT_TA_16972.pep
MAGSPPPAEEVPMAPGFRFHPTDEELVSYYLRRRVLGRRLRIDAIAEVDLYRLEPWDLPPLPRPPSRDAQWYFXXAXDXQGGPAPGPGGRGGPRATAPTAPPXRGYWKTTGKDREVFHRGRAVGMKKTLVFHAGRAPKGDRTNWVMHEYRLLDNDGPQDMHVVCRIFQKVGSGPQNGAQYGAPYMEEEWEDEDDAIENTPTSGTST

SEQ ID NO: 122555 - protein, 140 aa, Triticum aestivum
  Clone ID: PAT_TA_16973.pep
ENIVSKMAKAAQKFGMQRALVVHSKGLDEISPLGPGYILDVTPGKIEKMLFDPLDFGIPRCTLLDLKGGDPAFNAKVLQDVLAGQRGSIADALVLNAAASLLVSGKVKTLQEGVALAQETQRSGVAINTLESWIKVSNSC

SEQ ID NO: 122556 - protein, 400 aa, Triticum aestivum
  Clone ID: PAT_TA_16974.pep
WPPPSLRLCATASLKLCSPKPLAPGAPSPLLRRPSTARPVARRLPPARVAVQPAAAPAPAASPGTATFEQVLEQLIGGADFTEDEAEATLQLLLNEKNEARIAAFLVLLRAKGETYDEIVGLAKAMMSNCVLVEGLHDAVDIVGTGGDGADTVNISTGSTILAAAAGAKVAKQGSRASSSACGSADVLEALGVNIELGPEGIKRCVNEVGVGFMMSANYHPAMKIVRPVRKKLKIKTVFNILGPLLNPARVPYAVIGVYHENIVTKMAKAAQKFGMQRALVVHSKGLDEISPLGPGYILDVTPGKIEKMLFDPLDFGIPRCTLLDLKGGDPAFNAKVLQDVLAGQRGPIADALVLNAAASLLVSGKVKTLQEGVALPQETQRSGVAINTLESWIKVSNSC

SEQ ID NO: 122557 - protein, 60 aa, Triticum aestivum
  Clone ID: PAT_TA_16975.pep
PTRRGRPRPPTAPAGRARGSAPGRRSPAPPASPGVPRPPPGAPRPPRRATRSSPSTPTPR

SEQ ID NO: 122558 - protein, 127 aa, Triticum aestivum
  Clone ID: PAT_TA_16976.pep
EEACVKAIGVLCFLVFVALSSYPHRAQADHCVADKSKVMRECWRNIGKNVGEHPLLHGSVCCQVIRAATDIHCVCDKFTTDELARISLAKFAMATHVCGNGLRAHTHCAGYTVPVITLPAPPPPGST

SEQ ID NO: 122559 - protein, 143 aa, Triticum aestivum
  Clone ID: PAT_TA_16977.pep
EDRHGALWLHNIRSRNNTKVAGVLCFLVLVALSSCSLHARAANDIDHCLLDKKKVMRDCWHHIEKKLGDQYPPLRSACCNTIRAAIDIHCVCDRFTAQELSLLSLAKLAMAIHVSGNGLHTCTHCAGYHVPEIKLSPPPAASN

SEQ ID NO: 122560 - protein, 87 aa, Triticum aestivum
  Clone ID: PAT_TA_16978.pep
GCRLRLFLALFAPPCSAVASDLAQRPTTAWRLPMHASVSPRRWKGMMMTSPRPMTLTSHRHATYQTARHSIGVESYRSMYVFCAVGV

SEQ ID NO: 122561 - protein, 383 aa, Triticum aestivum
  unsure (1)..(383): unsure at all Xaa locations
  Clone ID: PAT_TA_16979.pep
ITIEEPSTHYGQTRAKKAALAAGDARSTGKEGDKAPAKGGSDAPADGVVVSVPVHCDGCARKVRRSLLRLDGVEEVIVDHSTNTVVVTGQKALENPIMVVEAVKMKTGKKAVLLSPSPEKLPPPVKSEDTKKHRCRXPDMKKDAAEFDMEMVVVLKIELHCEDCSEEMKRRILKIKGVEEAVPHIKSSQMMVKGTVEPATLVGFIHKCTGRKAAILRAEPLHEDTPAAAMAEDAPAADANPEKQEPSDNLENKNGGAEEETKQEVKTGEEGAETEKPGKGDGDGVEKETVVEETQGKEHLFKLPVPASLVAVAPEAEKMTAMNGLYQYNYHPAAYPYAYPHYAYQQYHQYPYAANPATYYGPCPQHYPPQTFGDQSPDACTIM

SEQ ID NO: 122562 - protein, 69 aa, Triticum aestivum
  Clone ID: PAT_TA_16980.pep
MADWAPVFIGLVLFILLSPGLLFQIPGKGRMVEFGNFQTSGISILVHAVIYFALIAILILAVNVHVFLG

SEQ ID NO: 122563 - protein, 284 aa, Triticum aestivum
  Clone ID: PAT_TA_16981.pep
TRQREDVDRVFETKSRGEGQISEGSEEQIRELSRSCSRGGRGGGGGSGSEKEDIQPRSLTGEKPRYSNKHGRFHQITGDQCHHLRKLDMDVTLVNITRGSMTALRYTTRSTRIYIVVEGRDGYFEMACPHVSSSGRSERREHEQEREREHGHGRRSEERGQEHGRRSEEEEHGHGGEQEKSRGYRQVRAQIKVGSVIVLPAGHPATFVAGNEGNLALLSFGVGANNDEEVFVTGGNSVLKQLDEAAKALAFPQQARELADRVIRAQPESVFVPGPQQQRRVADM

SEQ ID NO: 122564 - protein, 497 aa, Triticum aestivum
  unsure (1)..(497): unsure at all Xaa locations
  Clone ID: PAT_TA_16982.pep
CVALVLSLCLSLSFASWDAEDVGRGSRRWQEGGGRRAXAEGGRPYHFGXESFREWAKSRHGHFKVLERFDHELLRGSIGDYRVACLDAAPXRAFLQPSHHDADEXAFVREGEGVLVFAEGTGRRESFCVREGDVIVIPXAGSIVYSANTHPVQXWFRVVMLLNPVSTPGRFQEFSPIGSGGEHPQSFFSVFSDEVIQAAFNTRRGAMVDRVFXESKSKGEGEIYEGXREQIRELSRSCSRGGRGXGGGSGSEKEDIQPRSLTGEKPRYSNKHGRFHQITGDQCHHLRKLDMDVTLVNITRGSMTALKYTTRSTRIYVVVEGRDGYFEMACPHVSSSGRSERREHEQEREREHGQGRRSEEREREQGRGRRSEEREEEQGRQEEEQGHGREQEKSRGYRQVRAQIKVGSVIVLPAGHPATFVAGNDGNLALLSFGVGANNDEEVFVTGGNSVLKQLDEAAKALSFPQQARELADRVIRAQPESVFVAGPQQQRRVADM

SEQ ID NO: 122565 - protein, 128 aa, Triticum aestivum
  Clone ID: PAT_TA_16983.pep
QVKQTVVNVEMSKVACCPTRERTQPTSHMAASRRCFCCSRRRSRRKRRRWWRVVAAVRAVLLGSHMPYRSRRSRHRPPTSMDKLNVGRTQDQCSGDDRPAPDRRGRRCHGLQRRGLGLQHFGVNSTVP

SEQ ID NO: 122566 - protein, 300 aa, Triticum aestivum
  unsure (1)..(300): unsure at all Xaa locations
  Clone ID: PAT_TA_16984.pep
MARWAIAIHGGAGVDPNLPEHRQEEAKRVLARCLQVGVDLLRAGATALDVVEAVVRELETDPCFNSGRGSALTRAGTVEMEASIMDGRGRRCGAVSGVSTVSNPVSLARRVMDXGPEHFPREQGLEVVDNSYFITEENVGMLKLAKEANTILFDYRIPLAGADTCSALAAAAEGHGSNGMVMNGLPISIYAPETVGCAVVDSNGFTAAATSTGGLMNKMTGRIGDSPLIGAGTYACGHCAVSCTGEGEAIIRSTLARAGAXMIXRAALKKPGLASRTVTRLPVPCRNARGTDGVRVAQQV

SEQ ID NO: 122567 - protein, 181 aa, Triticum aestivum
  Clone ID: PAT_TA_16985.pep
EQHILDQGLLDAQLELWHHTLGYVKSMALKSALDLGIADAIHRQGGAATLSQIAATATLHPSKISCLRRLMRVLAVSGVFGVDHPGDGGVEGEAVYALTPASRLLVGSASANMVHVTKMLLHPILVSPFSDLGTWFQHELPEPDLFKLKHGKTFWELADHDPAYNALVNDGMVSDSSFLMD

SEQ ID NO: 122568 - protein, 220 aa, Triticum aestivum
  Clone ID: PAT_TA_16986.pep
PAGERSSPDSRAMSKRGRDVWDMELGGLDTARLLMLLAQQHQQHQHQRAVAGAAQAMGGGRVFECKTCNRQFPTFQALGGHRASHKRPRLQQHPQKPHAIDSIDDGAALCLGRRAPQAPPLPAKPRAHECPVCGLEFAVGQALGGHMRRHRVEAEAATNAPSGKAAEPEMVVASCDAGGICLDLNLTPSENCAKCRSAAGLGAAAGQGVHKALAMLDCSL

SEQ ID NO: 122569 - protein, 481 aa, Triticum aestivum
  unsure (1)..(481): unsure at all Xaa locations
  Clone ID: PAT_TA_16987.pep
SPPISSLPYFFSLPAAANPSRPAAVAAPLPSRAVLRMVTPSARRGASVVASASMRRPKAVAAEAPSPVAERVNGAEVAGAGIARPDALRRFGEFRGKYVPETLMHALTGHHHALPALADDEDFQKQLDGILKDYVGRESPLYFAERLTEHYKRADGTGPLIYLKXREDLNHTGAHKSYNAVAQALLAKKLGKQRIIAETGAGQHGVATATVCARFGGCHSLYMGAQDMERQALNVFRMKLLGAEVRPVHSGTATLKDATSEAIRDWVTNVETTHYILGSVAGPHPYPMMVREFHKVIGKETRRQAMDKWGGKPDVLVACVGGGSNAMGLFHEFVDDQDVRLIGVEAAGHGVDTDKHAATLTKGEVGVLHGSLSYVLQDADGQVIEPHSISAGLDYPGVGPEHSFLRDIGRAEYDSVTDQEALDAFKRTSRLEGIIPALETSHALAYLEKLCPTLPDGVRVVLNCSGRGDKDVHTASKYLEV

SEQ ID NO: 122570 - protein, 177 aa, Triticum aestivum
  unsure (1)..(177): unsure at all Xaa locations
  Clone ID: PAT_TA_16988.pep
MTNPSPAPAKGASLWGSQLKQLRSLFDRFDMDGDGSLTQLELAALLRSLGLRPTGDESRALLLAIDADGSGTVEFDELARAIAPVLTAPRAAAXVDQAQLLEVFRAFDRDGNGYISAGRXSRAPWAKAWGQPLTFRGGCGPMMPGRRTPDGDXXISFRGFAAVMARSALDFLGVPAA

SEQ ID NO: 122571 - protein, 336 aa, Triticum aestivum
  Clone ID: PAT_TA_16989.pep
MGSAASAASDAAPPPPSPAQPHGAAPPYGVGLAGILPQKPDGDDKKEEKVDYLNLPCPVPYEEIQREALMSLKPELFEGLRFDFTKMLTQKFALSHSVLMGSLEVPSQSADVIKVPTSQYEFGANFLDPKLMLIGRLMTDGRLNARVKCDLTENLALKINAQLTSEPHYSQGMFNFDYKGTDYRAQFQIGNNAFYGANYIQSVTPNLSMGTEIFWLGQQRKSGIGFNSRYNTDKMVGTLQVASTGIVALSYVQKVSEKVSLATDFMYNHMSRDVTSSVGYDYILRQCRLRGKVDSNGVVAAYLEERLNMGVNFLLSAEIDHPKKNYKFGFGMTVGE

SEQ ID NO: 122572 - protein, 270 aa, Triticum aestivum
  unsure (1)..(270): unsure at all Xaa locations
  Clone ID: PAT_TA_16990.pep
ARXLLIGAGKXGRLVAKHLAAKGCTKVVIVNRSVERVDAIREEMKGIEIVYRPLTEMYEAAADADVVFTSTSSESPLFTKERAEALPPVSGALGGVRLFVDISVPRNVSACVSDVGHARVYNVDDLKEVVEANKEDRLRKAMEAQTIISEELKRFEAWRDSMETVPTIKKLRSYADRIRASELDKCLQKIGEDALTKKMRKSIEQLSTGIVNRLLHGPLQHLRCDGTDSRTLDETLENMHALNRMFGLDTEKAVMEQKIKTKVEKQQTQN

SEQ ID NO: 122573 - protein, 231 aa, Triticum aestivum
  unsure (1)..(231): unsure at all Xaa locations
  Clone ID: PAT_TA_16991.pep
MPPLLRPAAGGGGGGPPAPRCFFYFAAAAGAAPPTSGATCLLLRGEVVAADDGGGVILLPACGAPRIVVGGRGWGKKYVYLMNLPEVKEHTQKLXGLPTVHAPIWLRSFHSWNLGEWETSANFLAFRTFSKTIKMSLLKFAECVDPFIRVNEGIVGKRVPMQIGLRKSKAGTPLTVIAAPTTLPGPARAPQPPLLLCQSKKAHKARVWVSKKKNTIDQGNPAPTDLDNNSQ

SEQ ID NO: 122574 - protein, 189 aa, Triticum aestivum
  Clone ID: PAT_TA_16992.pep
PTRPDGSTIPVYDTPLGKIGALICWENKMPLLRTALYGKGIEIYCAPTADSRPVWQASMTHIAMEGGCFVLSANQFCRRQDYPPPSEYAFAGLGEEPSPDTVVCPGGSVIISPSGEVLAGPNYDGEALITADLDMGEIVRAKFDFDVVGHYSRPEVLSLVVDDHPHRPVSFTSAAEKAPAAKSDDPAKP

SEQ ID NO: 122575 - protein, 92 aa, Triticum aestivum
  Clone ID: PAT_TA_16993.pep
GRVGGRVGGRVGGRVGGRVGGRVGGRVGEALITADLDMGEIVRAKFDFDVVGHYSRPEVLSLVVDDQPHRPVSFTSAAEKAPAAKSDGTAKP

SEQ ID NO: 122576 - protein, 397 aa, Triticum aestivum
  Clone ID: PAT_TA_16994.pep
MPTSASNPTSTSSSQFVRKPQRRKYRDRASEFPGPTLMALVPSGSGGAPVIAEVEMNGGADQSATTVRATVVQASTVFYDTPATLDKAERLIAEAAGYGSQLVVFPEAFVGGYPRGSTFGFGISISITNPKDKGKREFQKYYAAAIDVPGPEVTRLAAMAGKYKVFLVMGVIEREGYTLYCSVLFFDPLGRYLGKHRKLMPTALERIIWGFGDGSTIPVYDTPLGKIGALICWENKMPLLRTALYGKGIEIYCAPTADSRPVWQASMTHIAMEGGCFVLSANQFCRRQDYPPPSEYAFAGLGEEPSPDTVVCPGGSVIISPSGEVLAGPNYDGEALITADLDMGEIVRAKFDFDVVGHYSRPELLSLVVNDQPHRPVSFTSAAEKAPAAKSNGMAMP

SEQ ID NO: 122577 - protein, 106 aa, Triticum aestivum
  Clone ID: PAT_TA_16995.pep
PAPPARPASGGAGRRRPPAAPAGPPPARPAAAPPRTPPPPSPTAPPPGWPSARPRRPSSTPRRGAGRAARRPAGPGRPGGGGRRARAACRRCTRRRIPPSVALAAH

SEQ ID NO: 122578 - protein, 114 aa, Triticum aestivum
  Clone ID: PAT_TA_16996.pep
QKQKCLAELVETNIAGIFTETLTADVQVVLANQTSTVGTDTTLTRSLAEGLGVRVPNVSVSHDNVLRTKKKKTTKRRKTIYKEQANLKLPVNRKASLLFIYCFSSFSSTCGTVK

SEQ ID NO: 122579 - protein, 363 aa, Triticum aestivum
  unsure (1)..(363): unsure at all Xaa locations
  Clone ID: PAT_TA_16997.pep
MAEEGNSAGSGGRGVRVCVTGGAGFIGSWLVRKLLQAGYTVHATLRSIGDEGKAGLLRRLVPGGAPPERLVLFEADLFDAASFAPAIAGCQFVFLVANPSAHEAAASKYXKTSAEAATDGVRIILRLCAESMTVKRVIHTASVTAASPLTKSSSAAAAVYSDFISESCWTLLDVDYPLRSVHFDKYIESKVLSEKELLSYNDGESPAFEVVTLSLGLVGGDTVLSHLPETVESMVAPVTKQEPYFMLPRILQRLLGSLPLVHVDDVCSALIFCIEQPALSGRFLCAAAYPTIHDILDHYSSKYPHLDLLREADEVARVQPEKNKLVELGFRYKYGVEEILDESIDCAVRLGSLDASKLIVQQE

SEQ ID NO: 122580 - protein, 93 aa, Triticum aestivum
  Clone ID: PAT_TA_16998.pep
VDDEYRSAYFPFDPVDGETHTGPFEFSTERRMDLDVYFTYIKSWSAYQTAKDNGVELLDDETVREFADAWGGDRQEVKTVTYPIFLRIGKVRP

SEQ ID NO: 122581 - protein, 260 aa, Triticum aestivum
  Clone ID: PAT_TA_16999.pep
MANLFLKQAKHYAAARPDYPAELFQFIASKTARHDLAWDVGTGSGQAAVSLAKLYKNVVGTDTSAQQLSYAPALPNVRYAHTPADLPLDGIHAAVAPPGSVDVVTVAQAFHWLDLPRFYAQARSLLRAHGVLAAWCYTEPRVGAAVDAVFWRLYDGSQPHWAPNRKMVDDEYRSADFPFDPVDGETHTGPFEFSTERCMNLDDYFTYIKSWSAYQTAKDNGVELLDAETVLDFADAWGGDREEVKTVRYPIFLRIGKVRP

SEQ ID NO: 122582 - protein, 237 aa, Triticum aestivum
  unsure (1)..(237): unsure at all Xaa locations
  Clone ID: PAT_TA_17000.pep
MANLFLKQAKHYAAARPDYPAELFQFIASKTARHDLAWDVGTGSGQAAVSLAKLYKNVVGTDTSAQQLAYAPALPNVRYAHTPADLPLDGIHAAVAPPGSVDVVTVAQAFHWLDLPRFYAQVRSLLRAHGVLAAWCYTEPRVGAAVDAVFWRLYDGSQPHWAPNRKMVDDEYRSADFPFDPVDGETHTGPFEFSTERCMNLDDYFTYIKSXSAYQTAKDNGVELLDRGAALARRSTR

SEQ ID NO: 122583 - protein, 230 aa, Triticum aestivum
  Clone ID: PAT_TA_17001.pep
MARSRVSIMSSRVLLLIVAVAALVSACAADPEPVQDFCVAAATNGSADHPSYPGFPCKPASAVVSDDFFFAGLARSGAADAAESPFGSSVTSGNVAAFPGLNTLGVSINRVDLAPGGVNPLHSHPRAAELVHVVSGQMLVGFVSTAGTFYSKVVREGESFVIPRGMVHFQFNTGKESARAVTVFNSQLPGVVLAAPSLFGADPEIPDAVLSKSFQVDGEIIKLLKSKFRT

SEQ ID NO: 122584 - protein, 185 aa, Triticum aestivum
  unsure (1)..(185): unsure at all Xaa locations
  Clone ID: PAT_TA_17002.pep
RPPRPSGLPPPPRAAARRALQRPASDAAAGPPPPLPAPAAVPRGPPXPAGPPPGAPPRPPPPGGPPHRPAPPAAALRAAAPPAPPRLGRPRPPPPRPPTPRPPPRARPRPPGPPPPPPRSPGPALAPAPPYSCASASASSRCPHGFRLILHLNLAVRLLPPVPASSALRSACPHASRASIWGRPI

SEQ ID NO: 122585 - protein, 299 aa, Triticum aestivum
  Clone ID: PAT_TA_17003.pep
WSGLNISKSFGSSKKFFSASVPGSRIASRATSPVSRRTSPPRSTTPTPTLGGLTSPRVVVDGAKPIKDSVSQEVIHLRSQVENLTRKSHLLEVELERTTKQLKEAISIAGEETAKCKAAKEVIKSLTAQLKGMAEKLPEGAGAGAGAGAGAGAVKHSRLPPLSGVPVNDISMATENLGSPRNSGEPYLNGSNGLIVSNGPSSVRNKTHLEVGKNGTKQPDSDSKPESEWVEQDEPGVYITLTALPGGARDLRRVRFSRKRFSETQAEQWWQENRARVYELYNVRVVDKSVTSIDSDVPH

SEQ ID NO: 122586 - protein, 130 aa, Triticum aestivum
  Clone ID: PAT_TA_17004.pep
AEAAGVGGFGGCGRGRAPGLGARGRHEEWKVEFVRRPVQQEQGANCGQWLTSISSLSLWLRRRPNRRRRIWLESLAKGTIKLGTMARSVASTVNTKRRKGIASSSGNPIVLLSFVLFLHTCKLVYSGASP

SEQ ID NO: 122587 - protein, 133 aa, Triticum aestivum
  Clone ID: PAT_TA_17005.pep
SSCVLAAAAASGAPSPSTPCEIEHPGGALTDPLMMASAGERHAWCSRLGRQRARRSRPRARRATMTSSATNNEVPFSLALSRPLAFPPPPLGPRPVGERCLPPKSSWLRLIVYLLVIAVELLLLLQDSYTLHL

SEQ ID NO: 122588 - protein, 131 aa, Triticum aestivum
  unsure (1)..(131): unsure at all Xaa locations
  Clone ID: PAT_TA_17006.pep
RSSAPCGSPGHPPRRSSPASPPAAPPPSPSPPPGWPSARRLPAPSRCPPPARPSRRPPPCPRRRRPAPPXLAPPPVPVPAPLPGAPAAXPPRPPAPSRWPPSPPPAGRAAPRRRSAPPPPAVPRPAPMHIM

SEQ ID NO: 122589 - protein, 96 aa, Triticum aestivum
  Clone ID: PAT_TA_17007.pep
MVILWVSCCCRRWLLLGGIGRERPRTGWRTTQSAGTQRGMAWVMDPHRESIKSDDDQVVEGKGIGRKVIDKMLQTYSSELAGKDFAYDGEKCLFTV

SEQ ID NO: 122590 - protein, 277 aa, Triticum aestivum
  Clone ID: PAT_TA_17008.pep
DMAFELPWERYGPYNFILHGWDEMVYDDKNWIGLNTGSFLLRNCQWSLDYLDTWAPMGPKGPVRIEAGKVLTKYLKDRPVFEADDQSAMVYILATQREKWGNKVYLENGYYLHGYWGILVDRYEEMLENYQPGLGDHRWPLVTHFVGCKPCSKFGDYPVERCLKQMDRAFNFGDNQVLHMYGFEHKSLASRRIKRIRNETSDPLDMKDDYGLLHPAFKALKDYYMITIVHYFPRLFGSSVLDPLGKKTYNSASWRLRVTRKWGFGNRGRIAMLYCEM

SEQ ID NO: 122591 - protein, 115 aa, Triticum aestivum
  Clone ID: PAT_TA_17009.pep
MSSIGSSNIGFQLLKKSGWKEGTGLGAQEQGRLEPVETRVKNNKRGLGSKEPKPKPKVEDDVETAPNKRPKQDAPATKKAKLAAKRIRKIQEEEKRAQEREFEIAFFREFWPDNV

SEQ ID NO: 122592 - protein, 264 aa, Triticum aestivum
  Clone ID: PAT_TA_17010.pep
IPMLSDSSSVCARQGAGMLLSLLVQGLAVELVPYAPFLVVPLPRGRSDPDGSVRQSVTHSFAALVPLLPLAKGVPLPSGLSERLYSSTEDAQFLEQLLDNSQIDDHKLNIHLSVELRRYQQEGINWLAFLRRFKLHGILCDDMGLGKTLQASAIVASDIAESRARNDDKDPKSLIICPSTLVAHWEYEVEKYIDSSIMKPLQYIGSSQDRMTLRAQFDKFNVIITSYDIIRKDIDFLESVIWNYCVLDEGHIIKNSRSKITSAV

SEQ ID NO: 122593 - protein, 139 aa, Triticum aestivum
  unsure (1)..(139): unsure at all Xaa locations
  Clone ID: PAT_TA_17011.pep
MAPQSPAAAEEGSYRSVARVWSSDSAPLPCDPAETVDMLPGDGPWIFVVRKRHLCDREHCSQASGVLARSGVRLVQATDFRRRTHGRCFRCLAPDHKAASCRDPIXCLACPRSGHRERDCRRRRISSVRAPPPPRAPPS

SEQ ID NO: 122594 - protein, 384 aa, Triticum aestivum
  Clone ID: PAT_TA_17012.pep
MSTAGKTITCKAAVAWEAGKPLSIEDIEVAPPKANEVRIQIYYTGVCHTDAYTLSGKDPEGAFPIVLGHEGAGIVESIGEGVTNVKVGDHVVALYTPECKECKFCKSGKTNLCGKIRATQGKGLMPDGTSRFKCKGKDLLHFMGTSTFSQYTVVADISVVAIEHDAPMDRTCLLGCGITTGYGAATITANVQAGDNVAIFGAGCVGLSVVQGAAARKAGKIIVVDVNPSKKEWGEKFGATDFVNPTELGDQSIQDKLIEMTDGGCDYTFDCTGNVGVMRAALEACHKGWGESIVIGVAAAGQEISTRPFQLVTGRVWRGCAFGGVKGCSQLNDLVADYKKGDLKVDEFITHRKTLGEINNAFDTMKQGDCIRAVVDMQKLEPKI

SEQ ID NO: 122595 - protein, 152 aa, Triticum aestivum
  Clone ID: PAT_TA_17013.pep
GPPPPASTCDCSSTGSCSSSLHRALLHRLLFNQPSPRAPIQPPLHGLLFILPSTVYCSSSPPRGGPVHPALHGVLFIQPQPARSIGVLFIQRQHHGVLFIHPHQELFIQPPRNAHCSSKGSIDRLQLAAVAKESLDRVQLTAIDRSLGFSNA

SEQ ID NO: 122596 - protein, 195 aa, Triticum aestivum
  Clone ID: PAT_TA_17014.pep
MEKNNLQDNPGESDVPKTQVVEVAQESPEASDEGDQISLPIREPVIKEVNVNKTVDNHVQTVDTQSQEEQDAFNSQVQQRDLDVASPDEAPEAEEKIAESKPEFSTDEEQSPKKDESNMAGEKTYDEKKKGAQEAKSLPDEAKTKVEEQGAGQKASPKKHNILSGVGSKVKHQLAKVKKAIIGKPGHTKSELPKA

SEQ ID NO: 122597 - protein, 314 aa, Triticum aestivum
  unsure (1)..(314): unsure at all Xaa locations
  Clone ID: PAT_TA_17015.pep
MAELLRAAGFFDLRAAAPFVAAAVALYFLAEQLSYLRKKGPLPGPSLVVPFLGSAVRMIRDPTGFWDVQAARARESGAGLAADFLFGRFIVFIRDSELSHRVFANVRPDAFHLIGHPFGKKLFGDHNLIYMFGEDHKDLRRRITPNFTPRALSTYAAIQQRVILAHLRRWLDQSAATGEAMPIRVXPXPKIEXXXTFXKRGFXGSYLTXXGEGKGFAKDYXXFNLGLMTVPVDLPGFAFRRARLAVARLVRTLGECARKXKARMPRPAASPECLXVDYWDKRCGKDGKRRGGPEHSFRGADYVRYVTLTFTPSP

SEQ ID NO: 122598 - protein, 142 aa, Triticum aestivum
  Clone ID: PAT_TA_17016.pep
RPTLQKAQELKQIKDLDLPKKGELNDIWKKEEIKARQWSREREILEGDLNTGYFKAVASQKRRKKQILMLESDEDIMAKNSFHFGLVGDQVRGPRQKEMSSPGATSGTNGASTAPPSVARPWLGLNQCSGATRPCFRPGVSL

SEQ ID NO: 122599 - protein, 92 aa, Triticum aestivum
  Clone ID: PAT_TA_17017.pep
GTAHVRPAGPGRAHSVIQSGVRARSAHHVGHKISDSLCHGGGISYQYQLHACALLHLEAWSVPSAMAHGRVSSTRWIRRWLAISILHQAAAS

SEQ ID NO: 122600 - protein, 250 aa, Triticum aestivum
  Clone ID: PAT_TA_17018.pep
QYYGRVGAPRPLFTTAIRDIKAVFVGSSAVMSAAPAGKPLIAADREKLVILGLGDGYIAIYRSNFPVYKPESNAVVWSGPALLFLLFLIGIWQVYVKKKDSLGWTPEETFNTSVTAPTGSILNHPASERAFADSTTRAADRSYVDGTTRASDRSYVDATARSTDRAYAEATRAVDLRGGALRSAPRRYVSPTRYAGAAGIPYRPVSAEPGLRGATPELKYRGPGMEPPGFPKKRETLFSNNQAVVDDHVE

SEQ ID NO: 122601 - protein, 340 aa, Triticum aestivum
  unsure (1)..(340): unsure at all Xaa locations
  Clone ID: PAT_TA_17019.pep
MPAAGTTVCVTGAXGYIASWLVKLLLSRGYAVHGTVRHLGEEKTGHLRRLENASENLRLFKADLLDYDAMAAAIVGCQGVFHVATPVPSGILTDPELQMLGPAVTGTTNVLKAASAADAERVVVVSSMVAVEINPKDWPQGKIRDESCWSDKEFCRSNESWYPVAKIAAEAAALEYGRETGLRVVTLNPALVFGPLLQPTINTSSQFLIYFLKGGPDETRDKLWHIVDVRDVADALLLLYEAPEATGRHICAPHFITARELLGLLKSMYPGYPCIAEESIRDMDHPAPMTSGKLEKLGWSSRPLRETITDTVEFCREAGFLEDADGDDTPCRFPPLLNKV

SEQ ID NO: 122602 - protein, 155 aa, Triticum aestivum
  unsure (1)..(155): unsure at all Xaa locations
  Clone ID: PAT_TA_17020.pep
SLGEFTLAPIPPXRAGEAVLECVFEVDVNGILKVTATEKTSGRSANITISNSVGKLTTDEIEKMVNEAEQFKSNDDAFQKKFEAKQQLESYIGRVEEIVSDPTLSLKLKRNQKEKIESTISDAMATLEISESTAEDLKKQELALKRLVTKAMSSR

SEQ ID NO: 122603 - protein, 246 aa, Triticum aestivum
  unsure (1)..(246): unsure at all Xaa locations
  Clone ID: PAT_TA_17021.pep
MVHLPHMGKLRRGLKEEAVDDDGDAAGAAGAEASPVHKRSRSAYQKQPPQQWSTGGASVSNQQSSQHDFLEEPSPLGLRLKKSPSLVDLIQMKLVQAGKAKDAPHGGTASASEKLKATNFPGSFLRIGSWEWVSRHDGDLVVECYLANRKLVWEVLDGGLTSEIEIQSSDICLRXLVHPDSGTGPVNIAVHRXNIAIEERNPQAYAHFVXESCAFTTGPASMHRQEFIQCAPESLNKHVASFLHFL

SEQ ID NO: 122604 - protein, 410 aa, Triticum aestivum
  Clone ID: PAT_TA_17022.pep
MELRLRAPASPASASPRGTSVSPSPRPHPRLPSQPIQKRLSGSAVSVSRRGTAARSSLCSALMAASYNTGTPDLVDFDWETLGFQLVPTDFMYIMKCSSDGVFTKGELVPYGPIELNPAAAVLNYGQGLLEGLRAHRKEDGSVIVFRPEENALRMRIGADRLCMPAPSVEQFLSGVKQTILANKRWVPPTGKGSLYIRPLLIGSGAMLGVAPAPEYTFVVYVCPVGHYFKDGLSPISLLTEEEYHRAAPGGTGDIKTIGNYASVVSAQRRAKAKGHSDVLYLDPVHKKFVEEVSSCNIFMVKDNVISTPLLTGTILPGITRRSIIEIARNLGIQVEERLIAIDELLDADEVFCTGTAVVLSPVGSIVYHGRRVEYGGGKVGAVSQQLYSALTAIQKGLVEDSMGWSVQLN

SEQ ID NO: 122605 - protein, 146 aa, Triticum aestivum
  Clone ID: PAT_TA_17023.pep
MASSRVFASRLASQMAVKAARPAVRANVAAASKRTISGVSPLQAMKRQTLLQATTRNAFQVQRRAYSSEIAQAMVEVSKNLGMGAAAIGLTGAGIGIGLVFAALLNGVARNPALRGQLFSYAILGFAFVEAIGLFDLMVALMAKFT

SEQ ID NO: 122606 - protein, 75 aa, Triticum aestivum
  Clone ID: PAT_TA_17024.pep
MRLFILQVDPWEELCRISPTLIIASVYDQCPSQFSIPSITRQPPLYRASWRQVHPCRITHVVIFWWWITGPARPA

SEQ ID NO: 122607 - protein, 554 aa, Triticum aestivum
  unsure (1)..(554): unsure at all Xaa locations
  Clone ID: PAT_TA_17025.pep
MLATGGGSFNIGDDFRENLGVXSLDKLDEMDSVVSGANFLLQNVPGAAFTHMSGKRNSIDISPDNLFPYLLVNIGSGVSILKVTGNRKFERVTGTHIGGGTMFGLAKLLTGCKSYDEFLQLSQKGDNFVLDLVVKDICGELACQKQGLSTSTLASSFGKVITSMKKLADYKPEDLASALLSAFTYNIAQISFLVASLLGLRRVFFGGSYIRGHKSTMDNISYALDFWSESQMQASFLQHEGYLGALGALMSYGDPRDENLNLEESQEENSHEAAGPTDVTSADEHNDSNIFPYLLVNIGSGVSMIEVIGKGKFERIIGSHLGGGTILGLARLLTGCSSYEEFLDLSRRGDNLAVDLTVGDIYGERGYPKIGLPASTTAASFGKVNSGKLSEYKAEDLAAALLNSFTYNIGQIAYFVANLSGLKRIFFRGAYVCGHEKTMDKISRSLKYWSKGEVQTTFLCHEGFLGTLGAFWSYENMGIDGLASHEVIREVLLGAPYTGQFPSSPLTPEQENGGNTTAEAEVERLRRDNAVLKSELEWLQRENAELKAQVSEIR

SEQ ID NO: 122608 - protein, 215 aa, Triticum aestivum
  Clone ID: PAT_TA_17026.pep
FSSGESDSLTAEVDVYGQRYEVESYDEKVNTWFSEAIGRHCTFMRCSSSKSRVCTSTGKNGRLCRDTRSKLSFVNEGQLLLISEESVSDLNSRLSSSNGNGKQHVLVDAMRFRPNIVISGSTPYREDNWKRLHIGDAYFTSMGGCNRCQMINLHQNAGQVIKSKEPLATLASYRREKGKILFGVLLNYEDGLSGGEETVAERWLQVGQEVHASTE

SEQ ID NO: 122609 - protein, 202 aa, Triticum aestivum
  unsure (1)..(202): unsure at all Xaa locations
  Clone ID: PAT_TA_17027.pep
MLRVAGRRISSHLAWRPAAAASAGSSPLAGGLPGDDFPRDQNPRFAIESPFHVAARGFSAESLVPRDXGCRVXELTPTTAALKNPCAKIVYDEYNHERYPXPGDPSKRAFAYFVLSGGXFVXRNPCWRLPLLKFVLSMSASKDVLALASLEVDLSSIEPGTTVTVKWRGKPVFIRRRTEDDVKLANSVDVTSLRDPQEDAVR

SEQ ID NO: 122610 - protein, 522 aa, Triticum aestivum
  unsure (1)..(522): unsure at all Xaa locations
  Clone ID: PAT_TA_17028.pep
TRPIQTRCRQFLARLDYSRTRKAAITTQCFWRGKVARKELRKLKLAARETGALQAAKNKLEKQVEELTWRLQLEKRMRADLEESKSQENAKLQAALQEVQQQYKETKDTLVKEREAAKKVAEIEPVIKEVPVIDTELMNKLRDENDKLKTLVSSLEKKIDDTEKKYDETNKISEERLKKAMDAESKIDDLNMAMLRLQEKISNMETDEKVQRQALLSTPVRSMSEHLSIPIVPKNLENGYHEAEEPKEPQSAPPALKDYGNGDPKLRKSSAEKQQENVDALIDCVAKNLGYCEGKPVAAFTIYKCLLHWKSFEAEKTSVFDRLIQLIGSAIENEEDNDNLAYWLSNTSSLLFLLQRSLKAAGAPGTVSRKKPPQPTSLFGXRMAQGLRSASFANMHVEATDVVRQVXGQXPALLFXKQHLTAYVEKDYGSSRXNIKKDLSPLIXLSIQAPXRTMESSMLRIPGRHLGKLKTTLGRIMRTWVPSNPTRYMYPLTQKLPIHNVYQNSLSLKMEFSWLFGQGTHG

SEQ ID NO: 122611 - protein, 99 aa, Triticum aestivum
  unsure (1)..(99): unsure at all Xaa locations
  Clone ID: PAT_TA_17029.pep
DVYSYXGLYWLELISDKKALDPSFSPYGNGFNIVAWACMLLQKGRAREFFIEGLWDVAPHDDLVEILHLGIKCTVDSLSSRPTMKQVVRRLKELRPPSY

SEQ ID NO: 122612 - protein, 137 aa, Triticum aestivum
  Clone ID: PAT_TA_17030.pep
SWLCSVPLPLSLATLSSSSNLPLHLIQTQIPERYPVVARGQGGRGTMARAFLASAAAAGFGAQAQQTPWLLLLLVVLVISVFLCGDTSKKKKASAKRAAATTASSSTKSAGGNTFLFLAAGGGGGGGGGGCGGGCGA

SEQ ID NO: 122613 - protein, 73 aa, Triticum aestivum
  unsure (1)..(73): unsure at all Xaa locations
  Clone ID: PAT_TA_17031.pep
CSVLNHPICSIIGFMLLLALEIEKSKTRRLRWRHTAPTRHELRLXSAQLDELSKYRHKQDLLGICTSTYAQRN

SEQ ID NO: 122614 - protein, 137 aa, Triticum aestivum
  Clone ID: PAT_TA_17032.pep
MPLTGSCMCGAIAYKSTTDPDVTALCHCTDCQKWTGGAFTSNAVVPEESFSITKGTPKQYDVTGASGKINHHFFCGDCGSSLYTRLDIMEGKIIIKAGGLDEGKANLDNKIGVEFYTRDRVPYIQPAQGAKQEQMFG

SEQ ID NO: 122615 - protein, 237 aa, Triticum aestivum
  Clone ID: PAT_TA_17033.pep
MSSEKQETASVRVLGRWPSPFVIRVLIALGLKSVDHELVEEAVGNKSELLLASNPVHKKIPVLLHHGRPVSESLIILQYVDEAWASQAPALLPSDPYARAAERFWAQYVDDKFPTAIRVLRGRLDGDKDEAAAQVCAALQHLEVAFADCSQGKDYFGGDGVGYLDIALGSHLGWIRAVERIAEIRLLDAAKVPKLAAWADRFCAHPAVADAMPEVDRFVEFSVKNGGAVKAASANYK

SEQ ID NO: 122616 - protein, 130 aa, Triticum aestivum
  Clone ID: PAT_TA_17034.pep
MQFSLATLVFGLAAIASAGTLDVEGVRNAPRSAVNVRRQNDNRPVPNGACCVANTSLKQDTCTAANGQTGRCVPGGNNCGSSLSCVAQSNLECDNNVIERGSSLCRAKAGNGGLFDGANIIQNLGQAKVN

SEQ ID NO: 122617 - protein, 266 aa, Triticum aestivum
  unsure (1)..(266): unsure at all Xaa locations
  Clone ID: PAT_TA_17035.pep
GQSCGFLQFPTFGLKAWKQTFFFDFSLTYVGAGMICSHLVNLSTLFGAVLSWGIMWPLISKQKGIWYPANVPESSMTSLFGYKSFMCVALIMGDGLYHFIKLTGITAKSLHAQSNRKHVKRAANEDTVSFHDLQRNEVFTREYIPNWLAYAGYASLSIIAIIVIPTMFRQAKWYYVVVAYVLAPVLGFSNAYGAGLTDMSMSYNYGKIALFIFAAWGGKDDGVIAGLVGCAIVNTSEVSADLXHDYKTGICTDITEILLSGSHQYG

SEQ ID NO: 122618 - protein, 250 aa, Triticum aestivum
  Clone ID: PAT_TA_17036.pep
APGQFVPGLPPPMPSTSADSVQTRLSKLLMSPRTGKTKASSGPITRREREGAGAPSRVHPPMQQLSSSCPIIGQRPLSGQKGGVDWRKLLDPPASTVGGAGLDQQYANVIVSAEELLQMEAEGRQEEANAERAEMYEMLPGKLRAAVRSKLRDWWRDPGPLDAGLAEGWKEAVERIMAWLGPMARDTVQWQSERNMDRTRRFDGGTRVYALQTLRWADKDKAEAAIVEVLVALSCVCWYEERRRGSVRVS

SEQ ID NO: 122619 - protein, 180 aa, Triticum aestivum
  Clone ID: PAT_TA_17037.pep
HTPRPGHGHDHGHGSEERPSQAHHVVVSQIMETGIVSHSVIIGLSLGVSQSPCTIKPLVAALSSHQFFEGFALGGCISEAQFKNFSALLMAFFFAITTPIGITVGAGIASFYNANSPRALVVEGILDSMSSGILIYMALVDLIAADFLSRRMSCNPRLQVCSYVALFVGAIAMSSLAIWA

SEQ ID NO: 122620 - protein, 310 aa, Triticum aestivum
  Clone ID: PAT_TA_17038.pep
AYADDRSWEALQEDESGLLRPIDTKNLVHSQYRRRLLLRSAAAAARIQKGLIRYLYIVIDLSRAASEMDYRPSRMAVVAKCAEAFIREFFDQNPLSHVGLVTIKDGISHRLTEIGGSPESQINALMGKLECSGDSSLQNALELVNGYLNQIPSYGHKEVLFLYSALNTCDPGDVMETIEKCKKSKVRCSVIGLAAEIFICKHLCEETGGSYTVALDESHFKELLLEHAPPPPAIAEYAAANLIKMGFPQRGAEDLISICSCHKKIKSGAEGYICPRCKVNVCELPTECRTCGLTLVSSPHLARSYHHLFP

SEQ ID NO: 122621 - protein, 96 aa, Triticum aestivum
  Clone ID: PAT_TA_17039.pep
IESTKTEDVMAGIEGTKTEDVMAGIEGTKTEDVMAGIEGTKTKDVMAGIEGTKTEDVMAGIEGTKTEDVMAGIEGTKTEDDMADIKGTKTENPSDE

SEQ ID NO: 122622 - protein, 200 aa, Triticum aestivum
  Clone ID: PAT_TA_17040.pep
APGRLRVRARPPPKPAAPTLFRFHTPAALSPQLLIPTSRRRRVRPWRTPAELAAAGCRRWTPSSPRRPTWSRWSRSPGSTRRTSPASTTRRSRPASSPASASSSPSPPPPRRPPRPWAAAPPRRRSAAAILLPTRSRNRTRTLPRPHRSPRRARSRRSSTLRRSGTVILVRRASPRPEKMATRRRRTWSGSSGQGAAGRR

SEQ ID NO: 122623 - protein, 206 aa, Triticum aestivum
  Clone ID: PAT_TA_17041.pep
MGISRDSRHKRSASGAKRAYYRKKRAFEAGRQGANTRIGPKRVHTVRTRGGNHKYRALRLDSGNFAWGSEGLTRKTRVIAVAYHPSNNELVRTNTLTKSAVVQVDAAPFRQWYEAHYGQAIGRRRQKAQAAKEGKTEEEVKKSNAVEKKQAARMSAGGKVESAIEKQFEAGRLYAVVSSRPGQSGRVDGYILEGEELAFYQRKLHK

SEQ ID NO: 122624 - protein, 175 aa, Triticum aestivum
  Clone ID: PAT_TA_17042.pep
KHQAAASTSLLPRRRRRSSRRHRSCPLLLLLLLLLLLLLLLHPSSSSRLHSLLLAGQQRRSRKHRPKHQAAASTRKQQQPRPPLLLLFLGHDSNKWSSTCASSISPVALTQGVRRRLLRATLHLAVLLLICAFPERRRPVRSSPTRPLRHYGDHHGCVGGAHAMGAAPATGFGHD

SEQ ID NO: 122625 - protein, 146 aa, Triticum aestivum
  Clone ID: PAT_TA_17043.pep
MSDVEDNTPEVADVVEVSGDAPKGQMSILDALKGVLKLSLMHDGLARGLREASKALDRRQAHMCVLNENCEEEAYKKLVVALCNEHNIPLIQIPDGKQLGEWAGLCVLDREGNARKVVNCSCVVVKDWGEESQERSILLNYFQTEQ

SEQ ID NO: 122626 - protein, 249 aa, Triticum aestivum
  Clone ID: PAT_TA_17044.pep
LPNKEESLDILENNDEGSQPLTNEDETSDIPLVQNNEACKSPSKAGKVCDASNEIIEDEVQGLSQSGNNGPNYQTLNVEDEAFVCSGRGAEAPPLLLKKEEPLDVLKNNDEGSQPLTNEDEVQNDEACESPSKSGEICDESNENIQASFSRYDTFRSCLDLTSQDDGDSGTELFSPEFDHQRDPELSLSIRSDVDIDLGEDGSETADCDPSNQLKHIEEVDVSSVTSDDNITRSEGCSPVYGKAADLSC

SEQ ID NO: 122627 - protein, 236 aa, Triticum aestivum
  Clone ID: PAT_TA_17045.pep
INIRQQAIQIISWLVKFKASFLKKNKLIVPILQVMCPLLTETANEDEDSDLAADRSAAEVIDTMAINLPRHVFGPVLEFASVNFRHVNPKYREAAVTSLGVVSEGCSEHFKDKLEECLKVVLEALKDQEQMVRGAASFALGQFAEHLQPEILSHYESVLPCILNALEDPSDEVKEKSYYALAAFCEDMGRRGRPFLEPLICRLVISLQSSPRNLQETCMSAIGSVAAAAEQAFIPY

SEQ ID NO: 122628 - protein, 106 aa, Triticum aestivum
  Clone ID: PAT_TA_17046.pep
GASSVRDDASLSGSSPSVPSYMAATKSASARAKLRVQSPTLTEGAAHAETLEKGWSSVGSAKKRLSFPAGTPPPVPSAAARRHSGPPKVRQAAVEGGTEGRDSALV

SEQ ID NO: 122629 - protein, 89 aa, Triticum aestivum
  Clone ID: PAT_TA_17047.pep
LSCDLPDCCQLPQLATLDWTATLIFPRRLNRVSSNLAPPRLKPCLSSSDHVSLRLQRYIQPDCSGTFGPLRLYCQISEHPQNQYAGYYG

SEQ ID NO: 122630 - protein, 376 aa, Triticum aestivum
  Clone ID: PAT_TA_17048.pep
MAVVVLLRVWESRDRCHLVLQSDIVCRKESMRIHMLDIFTLKKGLIKSRSRAHDIITKMLASLGDPYTRFLSSSDFSKMSKYDMTGIGLNLREIPDDNGSLRLVVLGLILDGPAHSAGVRQGDELMSVNGIDVRGKSAFDVSSMLQGPKETFVTIKVKHGNCGPVESMKVQRQMAARTPIFYRLEKRDNENSSVGYIHIKEFNAVAKKDLVSALKRLQNSGASYFVLDLRDNLGGLVQAGIEIAKLFLNKGDTVIYTTGRDRQVQNTIVADSGPLVTTPVMVLVNNRTASASEIVASALHDNCKAVLVGERTFGKGLIQSVFELHDGSGIVVTVGKYVTPNHKDINGDGIEPDYRRLPDLNEARDYLMRCQSKKLN

SEQ ID NO: 122631 - protein, 342 aa, Triticum aestivum
  Clone ID: PAT_TA_17049.pep
MGGDGRPSDGGGGGGGAGHPHQFQYQALLAAVHTQNPNHSHNLPFPLPPLNGPGPDASTHNAARQPPTPRGFADWSASTSAFTSLAVQSTPSTATANAYHYSLSPCYAFWTHYMLNKNAYSYYPAPNQEHTHPFSLDNNQAKDPGSIPSFGIESFNTTSLAPNMSAHMPPMEGPLPTKEPEAPEDMPARVATIKDEMDARNGVELKCETVDALPELKQGHESCASKFNSGEYQVILRKELTKSDVANVGRIVLPKKDAEASLPPLCERDPVILQMDDMVLPITWKFKYRFWPNNKSRMYILDSTSEFVKTHGLQAGDALIIYKNPVPGKYIVRGEKAIQQTN

SEQ ID NO: 122632 - protein, 72 aa, Triticum aestivum
  Clone ID: PAT_TA_17050.pep
MGKMPVRMKAVVYALSPFQQQVMPGLWKDITTKIHHKVSENWISATLLITPVVGTYQYAMWYKEQEKLSHRY

SEQ ID NO: 122633 - protein, 72 aa, Triticum aestivum; identical to SEQ ID NO: 122632
  Clone ID: PAT_TA_17051.pep

SEQ ID NO: 122634 - protein, 204 aa, Triticum aestivum
  Clone ID: PAT_TA_17052.pep
APNALGERHQPTPSPDVWSGSRRRASTPREAAAVGGVGDGGTSGEGGRGGAGTRKMGTMPVRRQAVGYALPPFPQQVMPRAVSQGHSSTQDPPQALRKQLDHQARAYSHPPSIGAYTMYAMWVQGAWRICPNTDTKCVSFLQYCMHVGIFPCSIIHPKGVFNIFKIPLLSCSPFCSFACCICNAASVTCKPILRPQMLSCPSLE

SEQ ID NO: 122635 - protein, 303 aa, Triticum aestivum
  unsure (1)..(303): unsure at all Xaa locations
  Clone ID: PAT_TA_17053.pep
APPGPPSSPPTTPRRSPPPPGTPSTPTRTTTAAWSSGGARRGPPPSRPPPPRRPGPTSGTPSSPAAAQRNPASRPPPPRPRRPGARYRNDFRDSGGVEAQSVQELEGYAXYKAEETTRRVDGCLRVAEEMRDTASKTLLQVHQQGQQIRRTHAMAIDIDQDLSRGEKLLGDLGGLFSKKWKPKKNGAIRGPMLTRDDSFIRKGSHMEQRHKLGLSDRPRRSNARQFLSEPTSELEKVEVEKAKQDDGLSDLSDILTELKGMAIDMGTEIEGQTKDLGHAEKDFDELNYRVKGANTRTRRLLGR

SEQ ID NO: 122636 - protein, 374 aa, Triticum aestivum
  unsure (1)..(374): unsure at all Xaa locations
  Clone ID: PAT_TA_17054.pep
MMMRRQLSVCVLLLLVLAGQQQAAAKKYAAIFNFGDSLVDAGNLVVDGIPEYLATAKLPYGMTYFGYPTGRCSDGRLVVDFIAQELGLPLLPPSKARNATFHHGANFAITGATALDTSYFVAKGLGKTVWNSGSLHTQIKWLQEMKPKICSSPEECRGLFRRSLFIVGEFGGNDYNSPLFAFRPLEEVHEFVGDVVNSIGEGIEKLIAEGAVDLVVPGVLPIGCFPVYLSIFRKQPEMYGGKSGCIKDLNTLSWVHNVALQRKIVELRKKHSDVRIMYADYYTPTIQFVLHAEKWGMLRQKPRACCGAAGLGVYNFNLTSKCGEPGAYACDDPXSNHWSWDGIHLTEASYAHIARGRRALAFADLPIVGNRNLE

SEQ ID NO: 122637 - protein, 251 aa, Triticum aestivum
  Clone ID: PAT_TA_17055.pep
VERRATVLAQQGFRPEVVSHLPSAPPYVEEAESSSPRSSPEEDRNARDGHGCSIELVDDFSALDGEVGKRLNDMVPVPHVPKTNGDIPSFDEAFSDHRRLLDRLVLYGLVELKVNGDGNCQFRALSDQFYRTPEHHRFVRQQVVNQLESHPEIYAGYVPMDYREYLKKMPKIGEWGDHVTLQAAADLYGVKIFILTSFRDTCYIEILPVVQKSNRVICLSFWAEVHYNSIYPEGELPVVENRKKRWWHLEF

SEQ ID NO: 122638 - protein, 190 aa, Triticum aestivum
  Clone ID: PAT_TA_17056.pep
MAAAPFPNWLMMERFVFRRDDKGSFPDATKAPIRASGTTSWNARFHIAFCLAEPPLPSRLYARLPRFPDPRKHTPLAILAAHRHLLLLRIGTDIPGLGLVQDFLIYSAYDTSSLKALPPCTEPYTDYTRTGDSLPRGPPLEQGKHRLLTVKSIGLLCRGGEGEQEFAVAELCVFKSVHSGVYADVCLLRS

SEQ ID NO: 122639 - protein, 212 aa, Triticum aestivum
  Clone ID: PAT_TA_17057.pep
MANVGPSGSELAPSTFEAFTKVPNVLRPHTQIFCTSEWVLGTREDLVKDIIAELRPDLGEEWWTYVCMGPSDPQPNWHLGMRGTQHRAVMWRAWKEGGTGFLYWGTNCYEKAMIPSAEICFRRGLPPGDGVLFYPGEVFSSSKEPVASLRLERILSGMQDIEYLNLYSSKYGREEALALLEKTGAYLGPDRYAHDHGPVDVMRGEVYRTCRS

SEQ ID NO: 122640 - protein, 129 aa, Triticum aestivum
  Clone ID: PAT_TA_17058.pep
VADDSLSEQTAVYFYLVRGADGKLSTHFCQDAFRSSRANDLVKAVYGSSVPVLTGEDLSVRILVDHSIVESFAQGGRTCITSRVYPTKAIYDSARVFLFNNATNVNVTAKSIKIWELNSAYIRPYPDSS

SEQ ID NO: 122641 - protein, 236 aa, Triticum aestivum
  Clone ID: PAT_TA_17059.pep
MVHPLHALHELLLQARSPHAALGLVFVLLVCPLLALLVVRRLATPSTAAATARAREELLGRLPSPPRRLPVIGHLHLVGSLPHISLRDLAAKHGRDGLMLLRLGAVPTLVVSSPSAAEAVLRTHDHVFASRPYSAVTEILFYGPTDAAFSPYGEHWRQVKKIATTHLLTNRKVRSYRYAREHEVRSVVAKIRDAASKCTVIDLTDLLNAFTNDIVCEAVSGRLFREQSHKKLFREL

SEQ ID NO: 122642 - protein, 253 aa, Triticum aestivum
  Clone ID: PAT_TA_17060.pep
MDDEQDRQENTNLTRQGRPNKRTASVLDSITDTVKEGNPEYNLDEPTMEQKLESLNLLNKSEFLEEQSASLAPPSADSVYILLKQALRADDHAELLKCMYNRDEKVIVKSVSLLTPGDALKLLKFFVSSIQSRGAKLVCLLPWLQTLLSRHMSSIVSQESSLLLLNSLYQLIEARTSTFKSALQLSTTLDYRFSEIADEETDEEEAAAPIVYEDKDTEDEESDIDAMETDGESEELGDVTDALRHSDGSERVL

SEQ ID NO: 122643 - protein, 174 aa, Triticum aestivum
  Clone ID: PAT_TA_17061.pep
THASGTNQSQKPQPCCGHALRLPPPTSSPPSSPPKESAPIRSTPTTSAASSSSTPTAIPPPTSSLPSSPPKESAPIRSTPTTSAASSTSTPAAIPPPSSTLPAAVPAPLPTPSSASSPRMAKPEPPPSPPQPRKEATAWWRRRNPPRRSLGTKQGKWMRATVNYGGTRTRTMTR

SEQ ID NO: 122644 - protein, 76 aa, Triticum aestivum
  Clone ID: PAT_TA_17062.pep
EKQSDATSVQPLWHSLVHLSIIGLYVVEGDDAGVTVRGGEEDQRPLETAPRVLLRCDGRFRRWSSSAKVYDDEAEA

SEQ ID NO: 122645 - protein, 333 aa, Triticum aestivum
  Clone ID: PAT_TA_17063.pep
FFFVPVSAVAIIVLVATCSIIALKIHRSGRSPFPSLTGKDYNDRRDNIKKILGNYGSLAPRRYQFSHLKKVTKSFGEKLGQGSYGMVYKGTLANGRHVAVKFLHDTTGNGEEFVNEVISIRRTSHVNVVTLLGFCLEGSKRALIYDYMPNGSLDKFIYTENSKQALGWETLYGIATGIARGLEYLHRGCNTRIIHFDIKPQNILLDQDFVPKIADFGLAKLCNPKESYLLSMDGMRGTVGFIAPEVFSRRFGVVSTKSDVYSFGMVLLEMVGGRRNLRASVERESEVYFPDWAHSHLAQFGSLQPFDLGFDGPEEIAKKMATIGLWCIQISPA

SEQ ID NO: 122646 - protein, 158 aa, Triticum aestivum
  Clone ID: PAT_TA_17064.pep
MRREGRQRGWVRVYDRELVDPEGKRRAVHVVEGPAVANGGFIRAPRKPTNQSKSGGLRALGRSGMAQEEEEEPQALPPTMAGRFGYYYSTGLQSPFKFESAMYTYKKVEIRPAAAARFGGRSSCKAGRKFRHDEVKKYYLDAADVLDGQLDYLCDFDS

SEQ ID NO: 122647 - protein, 158 aa, Triticum aestivum
  Clone ID: PAT_TA_17065.pep
GPAGRTPTRGTRCPGSPRARPSSTCYGCVEDIPGGYRHACKPREHYNRGRLLIRRGRRASSSSMRPGSLDVLRGGATASRASAATATSTRPQSSKQGPRRSTGRFPTSMLVVGAYGDPSKSSNSASAATKTDVAALPIARKEAATYTNAVLPHTSLWK

SEQ ID NO: 122648 - protein, 203 aa, Triticum aestivum
  Clone ID: PAT_TA_17066.pep
ALQQKAHIRDPQGRRVTRFFTGQVSVRKAVDDAAAVAPRARGRVEQVGEVAELVQLRSHVQRLEGRPRWPRRRSRRQLVAAGGARPPLLVGSAARPRARPVHRGRRRRHLGVLAGEPLHDGLEVSGVGADELRLDELDLHAAAPVALLHGRRHVCMLPLVTPLGCKGVAKLHARTSTTTLLRFTSGVCCMMTTNRRYVPARPA

SEQ ID NO: 122649 - protein, 275 aa, Triticum aestivum
  Clone ID: PAT_TA_17067.pep
MASSGGGAAAAARMDPEAATELARKGVTLLLLDVPQHTLLGLDTQVFSVGPRCRRIKMVPPGPHFLHYCSPSRRGNEFAPTVGFFLTTHPSQVVVRRWHAQEERLVTLSEEEEIRYSEAVKRFEFDDQLGPYNLDSFGDWKQLSSYLSHSVIERLEPIGGEITIALEASWMDRAPQTDMERRLMEQLREDKFAKKAPAQPERRGCYYTTIPASVKHRNISADELTLLNLDRTSLLETVLAKSYQGQEDLLLGELQVSFIAFMMGQSLEAFMQWKA

SEQ ID NO: 122650 - protein, 219 aa, Triticum aestivum
  unsure (1)..(219): unsure at all Xaa locations
  Clone ID: PAT_TA_17068.pep
MASDDDCYYYYDDDGDGEEDEEDEGEEAADWDGLAVGADEDDLGLLEDDPPHSERRVDCWAITEDTLSAAQQEDLSTMMNLLNIKQHQARSLFIHHRWKIDCIYDCLDRKGRDRMLREAGIVLQEKSSMLIGASRTPSTSVQCNVCFDDDLAPAAVSTMDCGHCFCNDCWTEHFNAAIDGGKKQIRCMEVKCLAICDEGIVQRLLGQKYPDAAKRXDRF

SEQ ID NO: 122651 - protein, 254 aa, Triticum aestivum
  Clone ID: PAT_TA_17069.pep
AEPIEEELSLAIESGKVSARVDFTSGARVLADDFGWDVTDARKIWTFGPDGTGANLLVDQTKAVQYLNEIKDSVVSGFQWATREGPVAEEPMRSCRFNILDVTLHADAIHRGGGQIIPTARRVLYAASLLAEPALLEPVYLVEIQVPEQAMGGVYGVLTRRRGHVFSEEQRPGTPLFNIKAYLPILESFGFNGDLRQATSGQAFPQSVFDHWQILPGGSPLDATSKVGAIVTTMRKRKGVKEIVPGVENYYDKL

SEQ ID NO: 122652 - protein, 127 aa, Triticum aestivum
  unsure (1)..(127): unsure at all Xaa locations
  Clone ID: PAT_TA_17070.pep
MSAAAGPVYEADAEAVVRRITPPLDRARHKGQAGKIAIIGGCREYTGAPYFAAISALKVGADLSHVFCTKDAATVIKSYSPELIVHPILEESYSVRDDERESVSSSILTEVIKWVERFDCIGVXPRP

SEQ ID NO: 122653 - protein, 337 aa, Triticum aestivum
  Clone ID: PAT_TA_17071.pep
MRTDENPDGELGAAELYRSLLDIRVWGVNNNDPGQAWNRRRRAQEGVKRIYDSTKTLVSEVEVARPRGIGLISAVSNRIGAKSYLKKDSLRSCGLKLVEELLAQGSSIDHVTDNLWLTAFGGIGVPVTAFYEVLAFFLRPENASIWAEVQAIAQKGDDATLHAYVAEALRMTSSQRNVRISKTPGEVDGQSIAPGTAVVLMLGEAGRNPKEIPDADKFNAQRKQQEVSAFSYGQHECVAKDVALAFVTGLIKLVADLKELRPAPGQMGTVKTIRVGTEKAYLNDSWSYLGFDASTWKVHFNGHGKGNFEGDRVPTSNTPIQEYYSLLQKRKDELLRR

SEQ ID NO: 122654 - protein, 55 aa, Triticum aestivum
  Clone ID: PAT_TA_17072.pep
PSSAAPTPSAATAETTAPVPDRLSYWCCIASSIIKDTVYLTVVVVTINKPIRAAF

SEQ ID NO: 122655 - protein, 204 aa, Triticum aestivum
  unsure (1)..(204): unsure at all Xaa locations
  Clone ID: PAT_TA_17073.pep
GIDGAGGQRPPRDLCLVVPGTTTGSTWAAAPRADAAAGEGLELAQFGAGCFLSVELAYQXRLPGVARTEVGYSQGHLDGPTYRDVCGGGTGHAEVVRVHYDPKECPYAVLLDVFWAKHNPTTLNKQGNDVGTQYRSGIYYYTAEQERQARESLAEKQREWKEKIVTEVLPARRFYPAEDYHQQYLEKGGQSAKKRCSDPIRCYG

SEQ ID NO: 122656 - protein, 163 aa, Triticum aestivum
  unsure (1)..(163): unsure at all Xaa locations
  Clone ID: PAT_TA_17074.pep
VLIIGHYCCCNGXDPWSSEIGVLXSDEQPRLVTTLKPVRKGTNGGVTLQGLLAATAGGLTXGLTFVAVGLMTAECSFDMSFQQLLVIPISAAAGLLGSLIDSLLGATLQFSGIXASVRNKVVSKRGPTVTKISGMTILDNDAVNAVSVLLTSVITAYACIFFF

SEQ ID NO: 122657 - protein, 154 aa, Triticum aestivum
  unsure (1)..(154): unsure at all Xaa locations
  Clone ID: PAT_TA_17075.pep
MDDEKLTTHTEHVTTHGTTVLEVVYTNDXRLERIIKMYEEWLKEEKNKFVGLDLEYTRKSSYRRRGVAVMQLAMREHVLVYHYCRSERCQALVEFLQRKAITFASVDTRSDKIMLARAWIRISDEHHVSIQRQFCIKGGGERDSMAGXSVAIID

SEQ ID NO: 122658 - protein, 264 aa, Triticum aestivum
  unsure (1)..(264): unsure at all Xaa locations
  Clone ID: PAT_TA_17076.pep
MAAAGVNREQRWSLAGATALVTGGSRGIGHAIVEELVGLGARVHTCSENAAELEECRRRWEEMKLPVTVSVCDVSVRAEREKLIETATQTFDGKLDILVNNVGRNLAKASVECTAEEYSHLMSTNLEAAFHLSQLAHPFLRDASVAGGGSIVNISSVASSLGYSDXSQVYCISKGGVNQLTRSLAAEWAXDKIRVNSVAPGGINTELQKSVDPEIVENTLSRTPMHRLGEPVEVASMVSFLCMPAASYVTGQVIYVDGGRTISG

SEQ ID NO: 122659 - protein, 193 aa, Triticum aestivum
  unsure (1)..(193): unsure at all Xaa locations
  Clone ID: PAT_TA_17077.pep
VLSIHIXEAHDXFFQAKVARGFPMYECLXEGCGXKLKTYKSRQQHLVDKHQFPNSFEFFKRAQPSQRHRQKYHRRQTAYKGEETRDTVMDVDGKNPRQSKPRYRPKQRDHKEPKENEHCHKESKENEHHEKEAKESDMEVEQKIDELSSAVSRLSTADSVPSSITFGHRRARGLTFVPRSIRQNKQVSQPEAN

SEQ ID NO: 122660 - protein, 178 aa, Triticum aestivum
  Clone ID: PAT_TA_17078.pep
MQQNPAEAMEVSAPSEAGAPKDMGPWLGFWEVSRRRLTPDDPFFAAGDMERELLAKHVALDLSDDDRYQLEKMDVASVSMVCCPIAGCGAHLDCLEDFEDHYSTRHTASCSVCSRVYPTSRLLSIHISEAHDSFFQAKVARGFPMYECLVEGCGAARAGIKEVGSSMLVDKHQFPNSF

SEQ ID NO: 122661 - protein, 286 aa, Triticum aestivum
  unsure (1)..(286): unsure at all Xaa locations
  Clone ID: PAT_TA_17079.pep
MAPPSQAATGKRKKQHKPAKSLAVKSTNPVSKKTHKQKKPRPPAEQDQTNAAAAAAGEPAGGGVLLSAALPPARQLEFLLRSFERAAKMRLSPLELGAYSEGCMVQLAEGASQDVESFGDHVKGAFGATWKGELCEGKLVEGSIDAGSPALLVISLGALRSLELLRGLKMFSCGCRPAXLFAKPLKVEEQVPLLKDRVNIACGTPSRIKKLIDMEALSLSRXKLVVLDMQRDPKSFNLFTLPQVSNEFWDLYKGYLDEKVRGGDTRICFYGAVSEKDASKVLTPAE

SEQ ID NO: 122662 - protein, 160 aa, Triticum aestivum
  Clone ID: PAT_TA_17080.pep
EDSKFSAGETQCLKELDKLKDLDNLNSKKELGNYNPLRKLRLHPRLRELENHSSVEELDSHDYPKELDDHNRLNDLGNHKNLKELHSAQNGQVTAVTHTDGLIDEQFNTRISNKEAMIMTSESDLVKESIALQSNGSSVDNVVPAELEMDIQVPLSLLTL

SEQ ID NO: 122663 - protein, 545 aa, Triticum aestivum
  unsure (1)..(545): unsure at all Xaa locations
  Clone ID: PAT_TA_17081.pep
MDTWHIFLGSILFAIPLILLLRGRKGGRLRVPPGPPSLPVLGSVVWLNNSLADVEPLLRRLFSRYGPIVSLRVGSRLSIFVADRRLAHAALVERGATLADRPALPSLKLLGENDNTITRASYGPVWRLLRRNLVSETLHPSRVRLFAPARSWVRRVLAEKLRDESSSGGAAVVETFQYAMFCLLVLMCFGERLDEATVRAIAAAQREPLIYRSRKMAVFAFLPSVTKHLYRDRLQTVHAMQRRKKDLFVPLINARREYRKRGGEPKKESTFEDSYVGALLDIKLPEVANRPLTDHEMILLCAEFLDAGTGTTSTVHHRILPELGDNAALLEXLCRVIRATEGVGQDEVSEEDLHKMPYLKAVVLEGPRKHPPAHFVLPHKAAEDMEIRGYLIPKGATVNFMVAEMSRDEREWEKPTEFVPERFLPGGAGEAVDVTGNREIKMMPFGVGRRICAGLGIAMLHLEYFVANMVREFEWQEVAGEEVDFAEKNEFTVVMKKPLRPRLVPRKGLRQSPSPSATSAIRPTVHADRFDRNRLVTESQRLDDD

SEQ ID NO: 122664 - protein, 128 aa, Triticum aestivum
  unsure (1)..(128): unsure at all Xaa locations
  Clone ID: PAT_TA_17082.pep
MLGDDDDDVSDDEDDDHEVLRGSLPDCVPESVHDVKLADADGSSIASIASDNQTPPSSGSSVKHTFSSRGAGSVELRNPSTLGSRGAMSFAAAAMAGLASVGSRGXIRGSQDRRGFHLELVHMNIRTN

SEQ ID NO: 122665 - protein, 336 aa, Triticum aestivum
  unsure (1)..(336): unsure at all Xaa locations
  Clone ID: PAT_TA_17083.pep
ARAGGRALGTLLFALVHSAKSLAGCVLCPGSYVPDALASGSRVHDGFVASLDFAAGGSAVRDRFGVCSGXMGQLAWSRPRSLGSTLDRYDGLLLSVGGNGRSYVVILETGPLADTSQSKKYFARMTTKVGFCRVRVPFSAFRPVKPEDPPLDPFLVHTFTIRFEPKRQRPGDGTQGATDPSNFELILEYIKALPNGSRNPLHTGTHVTGFRSISTLTHCKTMFSCLNXSPLRMXACRVSRKTKKKQDSSRNERIAFEAQKLLFNDDISSQAISCADVADICVKALHDSTAXRNKSFDVCYEYVSEQGNELYELVAHLPDKANNYLTPALSVLEKNT

SEQ ID NO: 122666 - protein, 202 aa, Triticum aestivum
  Clone ID: PAT_TA_17084.pep
HEARTRWSALAASALIQCFAGGSYCFGVYSPALKASQGYDQSALDAVAFFKDVGANVGVLSGLLAAWAPAGGRRHPWIVLLTGAALCAAGYLPMWLAVAGVVPAPLPLVCLYMLLAAQAQTFMNTADVVTAVENFPDRRGTVIGIMKGFLGLSGAILVQVQRTLRIDPGSFILMLAILPTAIALLLMYFVDVHSAHQRYNKK

SEQ ID NO: 122667 - protein, 208 aa, Triticum aestivum
  Clone ID: PAT_TA_17085.pep
SAKFGYSYFGTANGLIALQVSNLVTKRFSGCVIFNPALKIDVMLVFMEFDSRHRFCGFGYCKSAKNFKILMLQNGSIMVKSLGGHPSTQPRSILPSDNIAELDPSICLDNLVYMLEAGGHDNRIRRLIVFNLQEETSIKVDLPPEALHSGLMQLSGSICVASRADTNTDVVLWQLKLDQGWEKISVVAAPLPGKGLRGMEVTSHQADD

SEQ ID NO: 122668 - protein, 118 aa, Triticum aestivum
  Clone ID: PAT_TA_17086.pep
QVQTKLLYYMGVTFQYNKVQHSQTEFLRTITGASQCQSSSKTGGQSHLTTEGRGAATFIHKPVLLATRRASTNLTANKAYLEINVTLLASHTYDTHRYSYWEKLDHKTGKIQFSVYHH

SEQ ID NO: 122669 - protein, 387 aa, Triticum aestivum
  unsure (1)..(387): unsure at all Xaa locations
  Clone ID: PAT_TA_17087.pep
LPRRVSTIIPEPDEITDDLMQLASSYEASGGRRLAGSNITRRIRSSQENNPKFVSAFCQXSNCGDVSPNVLGAFCIDTHLPCDFNHSTCNGKNELCYGRGPGYPNEFESTRIIGNRQFLKAVDLFNSASEELQGKFDYRHTYLXDFSQLEVSVSTSTGGQQVVKTCPAAMGFSFAAGTTDGPGAFDFKQGDDKGNPFWKLVGGILKKPGKEQVKCQAPKPILLDTGEIKEPYDWAPTILPIQDXIELGQLAILSGPGKNQRQPPAGGLRRCCKKMLLDKVAAMVNFNXNTTLVLAGAGQTHILKYVTTFPKNTKSQKYXGASTXYXPQXWSAYIPKFQKXXTTXVANKGFQATNPTPXQFGKQSXGCKFSNPPGGQLIQDSNKSSES

SEQ ID NO: 122670 - protein, 141 aa, Triticum aestivum
  unsure (1)..(141): unsure at all Xaa locations
  Clone ID: PAT_TA_17088.pep
RAEFGTRTQTQTKRKISTESLSLLAAAATGLRKESKATMACRALALRSLLLPDPLHHLSLRAAASAPAAPFPCRRRRRNLRCCSSSSGGGPGEQGQPPQEAVLEAISKVAKSKGRGCTHNKYGHRWXLLQMIQLMNGXVLD

SEQ ID NO: 122671 - protein, 115 aa, Triticum aestivum
  Clone ID: PAT_TA_17089.pep
QHGPIVHAITNQSILSFNIVIPCPRERKSGAGGGQRLRTSSLDTDAGLAPVPSLGVVADGVASSEANPLGHRAVLLLRLGKLLLGSERLVARHGDGVDSRVGQSFFFFFFASLAG

SEQ ID NO: 122672 - protein, 120 aa, Triticum aestivum
  Clone ID: PAT_TA_17090.pep
QHGPIVHAITNQSILSFNIVIPCPRERKSGAGGGQRLRTSSLDTDAGLAPVPSLGVVADGVASSEANPLGHRAVLLLRLGKLLLGSERLVARHGDGVDSRVGQSLPNGDQIREVFPWPAR

SEQ ID NO: 122673 - protein, 185 aa, Triticum aestivum
  Clone ID: PAT_TA_17091.pep
ANDRKDSAEMMASGDEKQDDDKVPSCSKKEDIDQIMATDGCSVNVNPDMCCNEGVCANPPLVDAENTPPRNSPDIDTTEQPDSKTYHQECRNLNSSAVEFTSSSKQPHDFARHNDGHNVDVAAEETSAPVSCGDNDPASCSTTSDKKVESGGANAEEVVTSSLPPETQSILPSAKDNEDGFPRNT

SEQ ID NO: 122674 - protein, 170 aa, Triticum aestivum
  unsure (1)..(170): unsure at all Xaa locations
  Clone ID: PAT_TA_17092.pep
KSNKQQRSEEMVARILPYLTYGEPAAMEVLVEHFEPYLRDWSEFDRLQKQHEENKKDDNLSQKASMQRSAVENFVRVSESLKTSSCGERLKEIILEKGITKAALGHLKERFASAGLASSRTRAEWAAGLKLPSIPFILSMLKGLAXGHLPTQKCVDEEGILQLLHXLEGV

SEQ ID NO: 122675 - protein, 84 aa, Triticum aestivum
  Clone ID: PAT_TA_17093.pep
VCSLPPRPVPVQLSKGLGFVGVVFGGGAVSALLGGVLRPDFFTPRASHKGCTPCFHPLLVNNIKENVYLQSLTEFRESITSSSY

SEQ ID NO: 122676 - protein, 39 aa, Triticum aestivum
  Clone ID: PAT_TA_17094.pep
CHLSLGTIYEVTQGTSLTSTMPCPCLHGLHPKLAPTIYS

SEQ ID NO: 122677 - protein, 124 aa, Triticum aestivum
  Clone ID: PAT_TA_17095.pep
RAAARAGTGRQDLEDTLRRLESQHYDRVRGWVGFSVRLAHRMTAGADILLMPSRFEPCGLNQLYAMMYGTVPVVHAVGGLRDTVQHYNPYEEAGVGWTFENAEANRMIDALGHCLNTYLGRDHA

SEQ ID NO: 122678 - protein, 143 aa, Triticum aestivum
  Clone ID: PAT_TA_17096.pep
VPARAGAGGQVQQSSQWLLLDSWQFVASPKHSSYFSLLPPRPTLFFYELVTKDGFQGVVSCTPLDEPVTEAYSLFGLHLGWGTRRDGSSDCLCNTCNRLVDSEVPCVGKAFPCGHYKAECVCQMCYLQSEVLHPSPEKFAFGK

SEQ ID NO: 122679 - protein, 62 aa, Triticum aestivum
  unsure (1)..(62): unsure at all Xaa locations
  Clone ID: PAT_TA_17097.pep
ISEQASPXAKYQKVMFHRQHREICCRXVNARETKXQGWWSHPASVLDHGFDLNMCKXRSEKF

SEQ ID NO: 122680 - protein, 35 aa, Triticum aestivum
  Clone ID: PAT_TA_17098.pep
YMFTLLIRTKPLCSLCYLLDIMICLLGKTCMFDLN

SEQ ID NO: 122681 - protein, 233 aa, Triticum aestivum
  Clone ID: PAT_TA_17099.pep
VPNNKLKIFSIVGMGGLGKTTLVKAVYDKLEAQYHPMAFVKVGQNVDVKVVLKNILTGCGKDATNMEHLDVEQLTSQLQQLLMYERYFIVIDDLWDSETMNNETWDTIKFALPGNNYGIRVITTTRIDHVARACCYDEMKCIRMMNPLSDNDSRTLFLSRIFGPKEPCPDALKDISIHILKRCGGLPLAINSIANLLIGDQRRSTWDDVRQNWSAMMKGNALERMNQILDLSY

SEQ ID NO: 122682 - protein, 165 aa, Triticum aestivum
  Clone ID: PAT_TA_17100.pep
MLIPKADRKKIHEYLFREGVLVAQKDFNLPKHPDIDTKNLFVIKAMQSLNSRGYVKTQFSWQYYYYTLTPEGLDYLREWLHLPAEIVPATHIKQQRSHAPPRGMLGEGERERRPFGRGRGGDRGDREGGYRRRDAGEGKEGGAPGEFAPQFRGGFGRGRGAAPPS

SEQ ID NO: 122683 - protein, 109 aa, Triticum aestivum
  unsure (1)..(109): unsure at all Xaa locations
  Clone ID: PAT_TA_17101.pep
FFXFXNTKRFNXTSLXXXYQIYRIDKGGVLFISRFLKPAMQKRETSSPCSVRLQASKFSTTERPGPTDPGDPTAAVIPRRTPSHVHPLCHARACLARKEGVPMAMTELS

SEQ ID NO: 122684 - protein, 317 aa, Triticum aestivum
  unsure (1)..(317): unsure at all Xaa locations
  Clone ID: PAT_TA_17102.pep
TRDKNNVKILLDIENAKCSICLNLWHDVVTVAPCFHNFCNGCFSXWLRKSSSKSRDKSQSAACPQCKTPVQSVGKNHFLHNIEXXILQAFSSLQRSDDEIALLESYASVKSNLVLGKQKNQSRKRPLPPASDESNDAEFPCPQCGTEFAGFRCSPRAAHIQCNGCGGMMPARPNTSIQKCLGCDGSFCGAYWYSQGVNSSHCNLICNQETFRMISQHHISRLPDTLHGGNPYEKDXRCIQKSGKTLQAVISEWIAKFDNKELDRSRLQLNNVEAITSXTYLCNHCYNKFVDFLLYWFRVSXPRNLLPADAADRDSCW

SEQ ID NO: 122685 - protein, 106 aa, Triticum aestivum
  Clone ID: PAT_TA_17103.pep
RGAVRDGAPVRGPDGAAGGRVAAARRRARAGDQVGAGPAGAVAGRVRGRAPGQRLGRAGAAVRDARRGALLLPQQPPVAQGRRAYGHRRGVRHSLLATHLSGLAAR

SEQ ID NO: 122686 - protein, 79 aa, Triticum aestivum
  Clone ID: PAT_TA_17104.pep
MNPIYKTYSCPSYKFKTEFANLWCIAYWMEPIIGNLGQVTKPKDSFISLSVEQIRFFKRLPFGDIFLLQKLMLHIFIHP

SEQ ID NO: 122687 - protein, 70 aa, Triticum aestivum
  unsure (1)..(70): unsure at all Xaa locations
  Clone ID: PAT_TA_17105.pep
APXRYTDQAEKMAFLPNNQFLPIYHPISCKRTDPQNQTDKSLLKSTRGIALQLLASFKNGMGEHHRVLMI

SEQ ID NO: 122688 - protein, 118 aa, Triticum aestivum
  Clone ID: PAT_TA_17106.pep
SVAAEVLQQQPNVLSGSNNTVRSGGGNVLSGDNNTVISGNNNTLSGTNNTVVSGSNNVLTGSNHVVSGSNNVVSDTSHVVNGSNNTVSGRNNMVTGNNNTVSGSNHVVSGNNKVVTGG

SEQ ID NO: 122689 - protein, 196 aa, Triticum aestivum
  unsure (1)..(196): unsure at all Xaa locations
  Clone ID: PAT_TA_17107.pep
MGGVTSTVAARFAFFPPSPPSYGIQPLPPPDAAGAAAGEAKGGKEGSVVVELTGVPRRANVEARRLRTKRGTDVVAVYARQTGAKLTLLYSHGNAADLGQMYDYSGEGQSSGKPSEQNTYADIEAVYRCLIETYAASEENIILYGQSVGSGPTLDLASRLPRLRAVVVIVQFVWLKNDYPVKHTXLVDIYKNIXKI

SEQ ID NO: 122690 - protein, 415 aa, Triticum aestivum
  unsure (1)..(415): unsure at all Xaa locations
  Clone ID: PAT_TA_17108.pep
MRGLLACATLARRAAASSTGSGAATAARRHLAGAAEAAEAELKKTALYDFHVAHGGKMVPFAGWSMPIQYKDTIMDSTLNCRANGSLFDVSHMCGLSLQGRQAIPFLESLVVADVAGXLEDRTGSLTVFTNXKGGALDDSVLSKVSQHNVCAVGTAGCRSWDPALIGAHSEAVLETPGDVVWHALVQRSPRALSHPPAAPTPRARSGGPACAPAFGAGKMIDINGSACFLTRTGYTGEDGFEISVPSENAVDLAKALLEKSEGKVRLTGLGARDSLRLEAGLCLYGNDMEQHITPVEAGLSWAIGKRRKAEGGFLGAEVILKQLKEGPKIRRVGIFSQGPPPRSHSEIVSGTGENIGEVTSGGFSPCLKKNIAMGYVKNGLHKAGTEFKVVVRGKQYDAVVTKMPFVPTKYYKAP

SEQ ID NO: 122691 - protein, 83 aa, Triticum aestivum
  Clone ID: PAT_TA_17109.pep
GFAMEILLSESSVVTTFYFNWSTSTVAIFLAVLGLTVLPVNVIVGSYITNLFQDRQILVASEIMVLIGIASSFHFGSSYCVAQ

SEQ ID NO: 122692 - protein, 245 aa, Triticum aestivum
  Clone ID: PAT_TA_17110.pep
MAAAMEVDAGGEKPSEKELFLAAESGAAGVFSSLAPADLAAALSLRNEDGRSLIHVAASSARPEAVAALVAAGGDAVASAVNGKDEEGWAPIHSVASSGNAQIIDILLGHGANVDLTTDAGRTALHYAASKGRLNIAETLIAHRANVNKKDKFGCTPLHRAASTGNAELCEYLLEEGADIDAVDKLGQSPLMHAVICEDRGVALLLIRHGADVDIEDKEGYTVLGRASDSFRPALIDAAKAMLEG

SEQ ID NO: 122693 - protein, 117 aa, Triticum aestivum
  Clone ID: PAT_TA_17111.pep
MASSLLTTPSQTLALTPAAARARGSSPAAAQVSFFSSRLPGRRALRVRASVAIEKEVPENEAPTTFLREDGSGAGSGSVRERFEGMIRRVQGEICAALEEADCSGKAVVEDVWSRPR

SEQ ID NO: 122694 - protein, 399 aa, Triticum aestivum
  unsure (1)..(399): unsure at all Xaa locations
  Clone ID: PAT_TA_17112.pep
MASSLLTTPSQTLAPTPSAARARGSSPPGAAQLAFSSARLPTCRAPRVRASVAIEKEVPENEAPQNLVREDDSGAGSTTVRTRCXGMIPRVRSEECKVLDASINPREWLGVAEFVCSVSLCVMCCALLCSLVIHSHVLYLSGVDEFLLPAARRAAXGPANNGAADRVTAGAEPCFAVGVCAARNTXNLHPKNPHAHTLYFESRYFETDAPKDVPGAPGGGRFGGGTDLTPSYLIEEDVKHFHSVQKQACDKFDPSFYPRFKKWCDDYFYIKHRNERRGLGGIFFDDLNDYDQDMLLNFATECAGSVIPAYLPIIERRKDTPFNEEQKAWQQVRRGRYVEFNLVYDRGTTFGLKTGGRIESILVSXLPLTARWEYDHKXPEEGSEEWKLLDACINPKEWL

SEQ ID NO: 122695 - protein, 60 aa, Triticum aestivum
  Clone ID: PAT_TA_17113.pep
WSLYVGDQLTGDLPGHLLSYPVAVNKAGTVSTLTGFEFFPDTEARVLGKPTGVDDYFLST

SEQ ID NO: 122696 - protein, 67 aa, Triticum aestivum
  unsure (1)..(67): unsure at all Xaa locations
  Clone ID: PAT_TA_17114.pep
RTQIRQVPLSPPRIDFTTTFTAVARTTTFSTNSNRFENAXLGRYNCRSDARGQMFVMCCMRCSYLAG

SEQ ID NO: 122697 - protein, 91 aa, Triticum aestivum
  Clone ID: PAT_TA_17115.pep
PPTHTAGAVLSDGTKGGEAKDERKAGLKSKEKPTLGASCNARKLNIAEAEKSMLDEARCCNKSDASPLEATRALNLVLSSGVHETPAGATA

SEQ ID NO: 122698 - protein, 227 aa, Triticum aestivum
  Clone ID: PAT_TA_17116.pep
TRDHSIFVGDLASDVNDTALLETFSSRYSSVKGAKVVIDANTGRSKGYGFVRFGDDSEKTNAMTEMNGVYCSTRPMRIGPATPRKSSGTSGSTGSSARSDGDLTNTTVFVGGLDPNVSEDDLKQTFSQYGEISSVKIPVGKQCGFVQFLQRKNAEDALQGLNGSTIGKQTVRLSWGRNPANKQLRSDNGNQWNNGMSTGPAALRGGARRTFLRHYPLPTYRLRNNTN

SEQ ID NO: 122699 - protein, 179 aa, Triticum aestivum
  Clone ID: PAT_TA_17117.pep
MPRSTSRLLLLALAASHLLLAGAGAGCGPSGTLRPSRGHSCEDCCKAGQAYPTYTCSPPVSSSTRAVMTLNDFDAGGDGGDPSECDGAFHHNSERVVALSTGWYSGGSRCGKSIRIRANGRSVLAKVVDECDTVNGCDREHAFQPPCRNNVVDASQAVWDALGITGEEVGEYNVTWADA

SEQ ID NO: 122700 - protein, 166 aa, Triticum aestivum
  unsure (1)..(166): unsure at all Xaa locations
  Clone ID: PAT_TA_17118.pep
RRATCCSPPPXAGCGPSGTLRPTQSHACQDCCKAGQAYPTYRCSPPVSSSTRAVMTLNDFDEGGDGGDPSECDGAFHRSSERVVALSTGWYSGGSRCGKNIRIRANGRSVLAKVVDECDTVNGCDREHAFQPPCRNNVVDASQAVWDALGITGEEVGEYNITWSDA

SEQ ID NO: 122701 - protein, 55 aa, Triticum aestivum
  Clone ID: PAT_TA_17119.pep
LIVINELTPFCTSATSRTAWTCALFTPIYMCARACQNKHYAHAPADGRASGCLNV

SEQ ID NO: 122702 - protein, 108 aa, Triticum aestivum
  unsure (1)..(108): unsure at all Xaa locations
  Clone ID: PAT_TA_17120.pep
TYPWEVLFSIAICILGLILFALLIGNMQTYLQSVAIRLEEMRVEKRDAEQWMHHRSLPPDIRERVRRYERYRWLETRGVDEENLIQTLPKDLRRDIKRHLCLGLVKRX

SEQ ID NO: 122703 - protein, 82 aa, Triticum aestivum
  unsure (1)..(82): unsure at all Xaa locations
  Clone ID: PAT_TA_17121.pep
XXGSMLLTLFSFVQRNHHQSSKQNKSEKYGTTIPYYYXHILNHTHTHTHTHTQTPFIVGKQAVDHAAADGMKILTRITVGCT

SEQ ID NO: 122704 - protein, 77 aa, Triticum aestivum
  unsure (1)..(77): unsure at all Xaa locations
  Clone ID: PAT_TA_17122.pep
TSNHVFQAFPELPLSVLIVAYLRGILVDNIENQVPNYQLDQDNPVPMSLDVYQITKPNLRLLLSXMLXPFLFATVPV

SEQ ID NO: 122705 - protein, 203 aa, Triticum aestivum
  Clone ID: PAT_TA_17123.pep
MTAAELQAELLRAQLEDHDIEGDEPIVEDDDDDDEDDDEDEDEKDDDDVAGGDASGRSRQSRSEKKSRKAMEKLGMKVITGVSRVTIKKNKSVMFVLSKPDVFKSSNSDTYVMFGEAKIEDLSTQLHSQAAEQFKAPSPSSVILKGEPSMAAAHDDEEVDETGVDKKDVELVMMQASVPRSRAVKALKAAGGDIVSAIMELTN

SEQ ID NO: 122706 - protein, 329 aa, Triticum aestivum
  unsure (1)..(329): unsure at all Xaa locations
  Clone ID: PAT_TA_17124.pep
ARGSDANLLGQGGFGFVHKGVLPDGTEVAVKQLRDGSGQGEREFQAEVEIISRVHHKHLVTLVGYCISEDKRLLVYEFVPNNTLEFHLHGRRGPTMDWPSRLRIALGSAKGLAYLHEDCHPKIIHRDIKASNILLDYRCEAKVADFGLAKLTSDNNTHVSTRVMGTFGYLAPEYASSGKLTEKSDVFSFGVMLLELITGRRPVSSKQAHMDDSLVDWARPLMTQALEDGNHDALVDPHLGIDFSDNEMARMIACAAACVPRPAPRRPRMSQVVRALXEGDVSLDDLHEGXPAWHSRFMGSHATXRFDTNQYNEDLKNSRRXARTTLQNQ

SEQ ID NO: 122707 - protein, 51 aa, Triticum aestivum
  Clone ID: PAT_TA_17125.pep
PAHVVPLTNLDYIATCILVKPWAHKPGARLITQCVTPDRVAAFHQGMLDMN

SEQ ID NO: 122708 - protein, 251 aa, Triticum aestivum
  Clone ID: PAT_TA_17126.pep
GKSTKQKKKKKKKKRNSIPDPNGVIIGSLPSPASAKRLEYLAMGGSADYINHFKSQYNSSHTGSWCSAFEVLVAKAWQSRTRAAGFEEDSIVHLCFAMNARPLLHASLPRAGAGFYGNCYYIMRVSAPAGKVSGSTIPEVVKIIKDGKRRMPSEFGRWATGEAGADGGVDPYQITSDYRTLLVSDWTRLGFAEVDYGWGPPAHVVPLTNLDYIATCILVKPWAHKPGARLITQCVTPDRVAAFHQGMLDMI

SEQ ID NO: 122709 - protein, 54 aa, Triticum aestivum
  Clone ID: PAT_TA_17127.pep
LKTVACCSFAYGNRITVAWVQSIFFSFGLFFFSLYFFHRCVPAQCHQDLASTKF

SEQ ID NO: 122710 - protein, 97 aa, Triticum aestivum
  Clone ID: PAT_TA_17128.pep
YHRCPSRKSRNRQNKIDRWPVRARRLVLSSPSPSWWWWWPHHPCRWSRGMTSLLASASTPSSAATRTPRAPPWSRRPATMMPTASRPSRACSTSWPR

SEQ ID NO: 122711 - protein, 255 aa, Triticum aestivum
  unsure (1)..(255): unsure at all Xaa locations
  Clone ID: PAT_TA_17129.pep
QISFEFVMYVAQITAAIVILILSRHELPHAPLVAWIIGYTVGCTASLPLVYWRYVHRNRPSEEEPEQPPTTYPTLTSSSSEGRNQRTSGTVLHLGCITIACPRPSILVYHSKTAVDCFFAIWFVVGNVWIFGGRGTSSDAQDAPNMYRLCLAFLALSCVGYAIPFIMCAAICCCFPCLISVLRLQEDLGQSRGATQELIDALPTYKFKPKRSKNWVLDHASSSENLSEGGILGPGTKKERVVSAEDXVCCICLTK

SEQ ID NO: 122712 - protein, 347 aa, Triticum aestivum
  Clone ID: PAT_TA_17130.pep
DAPTTPSSARRPASRAPRRAVARAAVAVQAEAQPKVSLIRIGTRGSPLALAQARQTRDELKAAHTELAEDGAIEIIIIKTTGDMILDKPLADIGGKGLFTKEIDDALLQGSIDIAVHSMKDVPTYLPEGMILPCNLPREDVRDAFICLTAKTLGELPAGSVIGSASLRRQSQILYKYPSLKVVNFRGNVQTRLRKLKEGDVHATLLALAGLKRLGMPETATSVLSVDEMLPAVAQGAIGITCRSNDDKMMEYLSSLNHEDTRLAVACEREFLSVLDGNCRTPIAAYAYRDKDGNCSFRGLLASPDGSIVYETSRSGTYSLDDMVAIGQDAGHELKSKAGPGFFDGLQ

SEQ ID NO: 122713 - protein, 184 aa, Triticum aestivum
  Clone ID: PAT_TA_17131.pep
EQHDRASSRGDEEPGSVPREMRVEDGYGVIGRREGGPASSYWDLLRAHLSDPLTGILMDDAMILSCGHSYGSSGMQHIYRMKACGKCGQPITENSIRPNLALGLAVQAFRREEESAKALKRKRDRLEQDKCGNDDPGPAEVSRGKGVQYPFAVFDRVIIKGNKRTPERFVGRVAVVTAQCLNGW

SEQ ID NO: 122714 - protein, 194 aa, Triticum aestivum
  unsure (1)..(194): unsure at all Xaa locations
  Clone ID: PAT_TA_17132.pep
RCSTSQCLLAHVWKKATXARGLDLEEFTQVRVAVNCRGRANPXVPMDFFGNMVLWAFPRLQVRDVLGLSYGGVVGAIRDAAARIDEEYIQSYVDFGGVADANGEELAATSTFGTMLCPDIEVDSWLGFRFHQLDFGTGPPSAFLPPGLPVEGLMVFVPSRTVEGSVDLFMALAEDHVAAFKRICYSLDILPSRM

SEQ ID NO: 122715 - protein, 359 aa, Triticum aestivum
  unsure (1)..(359): unsure at all Xaa locations
  Clone ID: PAT_TA_17133.pep
NHGCRSTLCTRSYAERNQQQQSTMLRPVYRVPHPLAGDKVQLTVFDRAAIDTYVPIVLAYLAPAPPNEALKEGLLRAIALYPHLLGRFAVDGHGRRFLHLNNEGVLVIEADVPADWADVLATGGMTTDVGGFYPTAPEESAGAALLQVKLSRYRWGRPPAPGVICHHHISDGHAASTFYGAWATXVREGKGFSVPSPFIDRAATAVPRSTPKPVFDHRSIEFKGGEGSGSSQPHAVLPMDKIRNITVHFPAEFIAELRSRVGARCSTFQCLLAHVWKKATAARGLDLEEFTQVRVAVNCRGRANPPAFLPPGLPVEGLMVFVPSRTVEGSVDLFMALAEDHVAAFKRICYSLDILPSRM

SEQ ID NO: 122716 - protein, 317 aa, Triticum aestivum
  unsure (1)..(317): unsure at all Xaa locations
  Clone ID: PAT_TA_17134.pep
MEATYAETGQQVAATSRSAMLKPAYAAPHPLAGGKVQLTVFDRAAIDTYVPIVLAYPAPAPSNEALKEGLLRAIAPYPHLLGRFALDGHGRRVLNLNNEGVLVIETDVPADLADVLAAGGMATDVAGFYPTVPEESVGPALLQVKLGRYRCGGLLLGVICHHHIADGMAASTFYGAWATAVREGKGFSVPSPFLDRAATAVPRSTPKPVLDHRSIEFRGSSISQSHALVPMDKIKNIAVHFPVEFIAELKSRVDAPCSTFQCLLAHVWKKITAARGLNPEXHQVRVGVNCRGRASQPCNGLLGKWCSGLPSSPDCWD

SEQ ID NO: 122717 - protein, 134 aa, Triticum aestivum
  Clone ID: PAT_TA_17135.pep
EVKISYPASIPSSFSIRLVSDPDAVEDQGSKNRRLLNTEKIIFKAESTKLVYVLVTVEPEGVVAKPNVKERELALFNIVCDELLLGIPRFAWWVGIAAVICLVLASLAPYFLPIHKLLSYETAKSGNADAAKLS

SEQ ID NO: 122718 - protein, 71 aa, Triticum aestivum
  Clone ID: PAT_TA_17136.pep
RGIGCYLPERDRQSSVNCTSALVASLPILSRKGKLRYLLLHPCIAFRCRIFSALNIMSVCLSMRPPWHDMW

SEQ ID NO: 122719 - protein, 43 aa, Triticum aestivum
  Clone ID: PAT_TA_17137.pep
GAVACLCECAAVTVCYVSEVFRQFLTEQFFLRYKEDTGPLFFF

SEQ ID NO: 122720 - protein, 171 aa, Triticum aestivum
  Clone ID: PAT_TA_17138.pep
MNEEAEGRGARPGVLKVVVAQGTNLAIRDFTSSDPYVVVRLADKSAKTKVINSCLNPVWNEEMVFSIRGPGLIRHVELVDRDRFKYDDKMGHAFLDLQPVAAATKLRRALKLTTGETRLRKVAPTADNCLLSDSFVTYADGVSVLDSRLRLRDLESGELFVTVKWIDAGAT

SEQ ID NO: 122721 - protein, 104 aa, Triticum aestivum
  Clone ID: PAT_TA_17139.pep
IILSNLASNVPTVLLMGDEVAASAATISAAAVTRSWLLLAWVSTVAGNLSLLGSAANLIVCEQARRAPRNAHDLTFWSHVVFGAPSTLVVTAVGIPLIGIINAA

SEQ ID NO: 122722 - protein, 181 aa, Triticum aestivum
  Clone ID: PAT_TA_17140.pep
MPADHKARCCNWCDQEMSLHSCPAAAGDAPTGTAEDLLERARGLVPAALDAARAATGFGARWKAIAARLERVPPCLSDLSSHPCFSKNALCRELLQSVAATLAEAAELGVLCREPPKAGKLQMQSDLDALAGKLDLNLRDCALLVKTRVLSDVTVPSPPAEAAAAEASQTDVRELLARLQI

SEQ ID NO: 122723 - protein, 486 aa, Triticum aestivum
  Clone ID: PAT_TA_17141.pep
AARSLQVQPGRAAAAAVLALVGFFSLAAGAGRRAGAGASGGASSGGERIAGRDHKARCCNWCDQEMSLHSCPAAAGDAPTGTAEDLLERARGLVPAALDAARAATGFGARWKAIAARLERVPPCLSDLSSHPCFSKNALCRELLQSVAATLAEAAELGVLCREPPKAGKLQMQSDLDALAGKLDLNLRDCALLVKTGVLSDVTVPSPPAEAAAAEASQTDVRELLARLQIGHAEAKHRAVEGLLDALREDEKSVLSALGRGNVAALVQLLTATAPKIREKAATVLCLLAESGSCEGLLVSEGALPPLIRLAESGSLVGREKAVITLQRLSMSPEIARAIVGHSGVRPLIEICQTGDSISQSAAAGALKNLSAVPEVRQALAEEGIVRVMISLLDRGVVLGSKEYAAECLQNFTSSNDNLRRAVVSEGALPSLLAYLDGPLPQESAVGALRNLVSAVSPDNLVSLGVLPRLAHVLRDGSVGAQQAAA

SEQ ID NO: 122724 - protein, 116 aa, Triticum aestivum
  unsure (1)..(116): unsure at all Xaa locations
  Clone ID: PAT_TA_17142.pep
LHVDISRPESSKSLQFLCGLYPDAVGIHSVCLRSKTAASGAGALAAASGGGGPHQGRIFQELDEKVRDAFHFYIEARGINEXLFPFLQPWLFVKDHRNLIRWFKSVGAVISEPKPE

SEQ ID NO: 122725 - protein, 412 aa, Triticum aestivum
  unsure (1)..(412): unsure at all Xaa locations
  Clone ID: PAT_TA_17143.pep
MFTGLCVFEPQEHRNRAQKQETEQDFYRFLCNLRSIQFTASKMVAKEAIPLLTPHRMGRFELSHRVVLAPLTRCRSYANVPQPHAAAYYSQRATKGGLLIAEATGVSATAQGYPETPGIWTQQQVDAWKPIVDAVHRKGALFFCQIWHVGRVSTNDFQPDGQAPISSTDKQITPDAESGMVYSKPRQLQTDEIPLIVDDFRRAARNAVEAGFDGVEIHGAHGYLLEXQFMKDSSNDRTDEYGGSLENRCRFAVEVIDAIVHEIGADRVGIRLSPFVDYMDCFDSDPHALGMYMVQQLNKHQGFVYCHMVEPRMAIVDGRRQIPHGLLPFRKAFNGTFIAAGGYDREEGNKVVADGYADLVAYGRIFLANPDLPKRFELDSPLNKYDRNTFYTQDPVIGYTDYPFLEGGSNAE

SEQ ID NO: 122726 - protein, 255 aa, Triticum aestivum
  Clone ID: PAT_TA_17144.pep
DAADGCKHCACKKSRCLKLYCPCFAGGGYCSEKCGCVPCFNKSDFAETVQTTRKVLLSRQKRMSLKINRRLEANAETMEDAHNSSSSTPPRRGCNCKKSSCLKKYCDCYQDGTGCSLFCRCEDCKNPYGKNEGFMADESKRFIYTGADLDHSEDEHDFVVERSPRLQSPISKESSFQHTPPRSKASSRDTHLLPQVLSQWQPRSWQLSLKRQGNDHRAVDDSGENHKSSSHEWQLAKHQVQEDAYSISRCVQILN

SEQ ID NO: 122727 - protein, 225 aa, Triticum aestivum
  unsure (1)..(225): unsure at all Xaa locations
  Clone ID: PAT_TA_17145.pep
GIARGLEYLHHSCNTRIVHFDIKPPNILLDKDFNPKIADFGLAKLCQTKESKLSMTGARGTIGFIAPEVHSRTFGVVSTKSDVYSYGMMLLEMVGGRRNVKSTVAKSSEKYFPDXIYDHFAQDDGLQACEVTREIEEIARKMTFIGLWCILVLPMYRPTITKDLELFERSSDDMDMPPKQNFSGLLESSAHNMDVQSSSSKRSVVISLVTRSIVIQSNTLWAQAL

SEQ ID NO: 122728 - protein, 65 aa, Triticum aestivum
  unsure (1)..(65): unsure at all Xaa locations
  Clone ID: PAT_TA_17146.pep
TREPRILCDPSNPGWIGYEPRNPGLRILCKVATTRIAAIERNFSVRFKVERGKXLSMVSXXPXTQ

SEQ ID NO: 122729 - protein, 231 aa, Triticum aestivum
  unsure (1)..(231): unsure at all Xaa locations
  Clone ID: PAT_TA_17147.pep
SHILIRSKIELGRNDVEXISIXKRTDGFLKWMWXNVAIAQLTCAMKYGKKRCSALMHSCNYCYQIYLAEERHCSSCHKXSNPFIIILSXTSQCDEKRRTDPNWKMQIADYSVPIGMRLLKLQLATIEASIPSEALQPFWSDGYRKSWGVKLHSTTSVEEIFQMLTLLEGAIRRDYLSSDFETSNELLNNSKTEDMPSQNPSSLPGTSVLPWVPDTTAAITLRMLDPDYAVS

SEQ ID NO: 122730 - protein, 177 aa, Triticum aestivum
  Clone ID: PAT_TA_17148.pep
MGSMALLRSLACVLILLCSSLGAANGMYRRAGGAEGEEAGGRVAGGARGGVRSAWPGYLYTRAVGRCTPQFWSSGVEQWPNIVPQEAAVSKVFGSRSMDKYGPRLTLLEATMRTDDDGSPFVKLVKHGSAALINAYTRTGFPFDSWEVKALLLEALVSEDAAAAQAERFQQANESCV

SEQ ID NO: 122731 - protein, 139 aa, Triticum aestivum
  Clone ID: PAT_TA_17149.pep
MEELDEFEVLWPEYCAGLAHADDDQYKTPAAASSVQSTATSWQRRAARSRPVDVPPSRAAVLLLRWKDGNTEDDSVEKDGGGKIIVPPHLLVSGRRLSDGEAAAAYTLLRSGAARHGKRARDLRHLRNSVLRMTGFIEG

SEQ ID NO: 122732 - protein, 224 aa, Triticum aestivum
  Clone ID: PAT_TA_17150.pep
HASGVFYGHGGSRAAEYLKEHLFENLMKHPKFLTDTKLAISETYQKTDADFLESESSAFRDDGSTASTAVLVGGHLYVANVGDSRAVISKAGKARALSVDHKPNRSDERKRIENAGGVVIWAGTWRVGGVLAMSRAFGNRLLKPFVVAEPEIQEELINGELESLVLASDGLWDAVENEEAVSLAKTEDVPESAARKLTEIAYSRGSADNITCIVVQFHHDKIAG

SEQ ID NO: 122733 - protein, 248 aa, Triticum aestivum
  Clone ID: PAT_TA_17151.pep
IPSDGAWTLPRYYLADSAVGRPDLDFAPVRYGFRTGSIFHGSVARTVSWGRRISTVMGVPRGFQCQDRGWSPAVGAYLRKVHHFLMGQDQVPRIGGYNTPIPSETLESEGGAASKYPPDSRRLDHNRDRNLPHDFGVILLEVISGRPISSIYEVEIMKEQLQSALSAQGPSKRSNFVDPAVSKGCSDDSMRTVMEICLRCLAKEPTQRPSVEDVLWNLQFAAQVQDDSRSSDESPLSPSQPHAQSAHG

SEQ ID NO: 122734 - protein, 202 aa, Triticum aestivum
  unsure (1)..(202): unsure at all Xaa locations
  Clone ID: PAT_TA_17152.pep
MSDLDHFDLLPIQMDPQSKAITSQTASRSLAAELEALNTLHRSLLTIEHPSGAPPPPVPVNPKRTANVTKLRDSGNNEYRKGKFPEAIKFYTLGVQMAMQRPMWEPAALVREEISGLLANRAQAHMAMQNWAEGAVDAHASVEARWVGNAKAWWRRGRCLAEMXRLEEARDWIRRRLEVEGXEGELVQLLREIEERIEKQQG

SEQ ID NO: 122735 - protein, 221 aa, Triticum aestivum
  Clone ID: PAT_TA_17153.pep
MAEKGVKVFGMWASPMAIRVEWALRLKGVGYEYVDEDLASKSDALLRHNPVTKKVPVLVHDGKPIAESTIIVEYIDEAWKDGYPIMPADPYDRAQARFWARFADDKCNAAIFPVFTATGEAQREVVREAQRCLKTLEKALEGKKFFGGDAVGYLDVVVGWYAYWLPIIEEVSGADVVTDEELPLMKAWFGRFLAVDVVKETLPPRDKLLALNKARREQLSA

SEQ ID NO: 122736 - protein, 119 aa, Triticum aestivum
  Clone ID: PAT_TA_17154.pep
MRREGRQRGWVRVYDRAVVDPEGKRRAVHVVDGPVVANGGFIRAPRKPTNQSKSGGLRALPRDALEVQAPRPPPAAARSGGRSACKGSRKFKHSEIKMYYVDAADDVDGRLDYLYDFDS

SEQ ID NO: 122737 - protein, 119 aa, Triticum aestivum
  Clone ID: PAT_TA_17155.pep
MRREGRQRGWVRVYDRALVDPEGKRRAVHVVDGPVVANGGFIRAPRKPTNQSKSGGLRALGRDALEVQAPRPPPAARSGGRGASCKGSRKFKHSEIKMYYVDAADDVDGRLDYLCDFDS

SEQ ID NO: 122738 - protein, 155 aa, Triticum aestivum
  Clone ID: PAT_TA_17156.pep
RVPRLRSSGTTSTRSTAPLRTGSSSPSRRSSRPPLFRLRTDLRPWVTSLAPSSPRRMVSRLSRSARVSSMDDGPSLMLYRTTFPCLTSSLHPATSSPSSSSTVSPTVSTSRAMLASRLTTATTVAPRAPCTSCTTPLALRTPTRSARTCTRTSER

SEQ ID NO: 122739 - protein, 92 aa, Triticum aestivum
  Clone ID: PAT_TA_17157.pep
HISHPLESGFVEDMKYCQVTLLLALIVLASSPAMATKCPPEYTCTKYINQGPCDAAKCMMDCVSAYKGAGEGQCFPQGCRCSYCCKPHQRTI

SEQ ID NO: 122740 - protein, 205 aa, Triticum aestivum
  Clone ID: PAT_TA_17158.pep
MRRSRMPDKKRAAVIDDLPDDIIFGKILITLPPKDIGRCRMVRTSWRSATFTPEFMAEHRRRQVSLPRVDGKGQRASFVTLRDAAAAGATSQQLWPFLSRCRKSCCKIRLHASSDGFLIVSRGDRFYICNPTTRMHAHLPFPRPPLPRSSCINDIYIHGLYHHISTGKYRLLLSNIHKKEATLYVLTLERANELRSIQIVMPTLP

SEQ ID NO: 122741 - protein, 153 aa, Triticum aestivum
  Clone ID: PAT_TA_17159.pep
PPFSTNTTKHGSFQPHTYSTSEAGTYQARSISVTHIRARQAQLWRSAQLTMVCTLHRSHAPEFYTTYVQLHSSSAIIRQLARDTPCGYHLLHLLANSHLITWQDESGRRVVHLLPAPLIGLLDLQQLVADVPREAPELLLSRPAVVRVIGHPV

SEQ ID NO: 122742 - protein, 104 aa, Triticum aestivum
  Clone ID: PAT_TA_17160.pep
AGRSVRAIQEYQYTVYVAIAMLGRRNNGPPTTSKPRPDGAGLAGASTVVADGGQAEVAASQFVVQLDEAARERLERMNRRLRLLEQQMEMLEAEVGRASSTADD

SEQ ID NO: 122743 - protein, 106 aa, Triticum aestivum
  Clone ID: PAT_TA_17161.pep
VTTRHCTNKPAGPCDPRVSVYCIRRYSHARGEKQWAVDDVEGPSGRRWPRRRQHRRRRRRAGGGRRRLGVAAPDASPCTFIPVLNHCLSQPNLTWRCEFLLGVIEC

SEQ ID NO: 122744 - protein, 88 aa, Triticum aestivum
  unsure (1)..(88): unsure at all Xaa locations
  Clone ID: PAT_TA_17162.pep
QPLACAIRPTSAITWLYVGPFGXFIYIKSKCRFLFLEVIPLGAIVLAATTFLXXWMYGSRVIVPLNFLKFNLFSSGGDYYGTHVFHWY

SEQ ID NO: 122745 - protein, 93 aa, Triticum aestivum
  unsure (1)..(93): unsure at all Xaa locations
  Clone ID: PAT_TA_17163.pep
KHLSHIILSNYPKTSKSXPCGIXXIIMASLQAKYQSPQATTAPHWPAPHHYLACGCHHPLVNHIAGSMYHPLAKALAVETGTSLLADLTHPPV

SEQ ID NO: 122746 - protein, 206 aa, Triticum aestivum
  Clone ID: PAT_TA_17164.pep
CSTDQLRGHTVAPGALGALGRDVPKGAYVWPAWATDRAESARRGNHGYSAGGNCPTEVLLYRGWPGSGPWSWRCGSASSPWTAAKSTSRGSSLRPFQRPDRSCLLGLGGMKTRSTSFLPVASWRLLRRRSGSAVASRRTSSVSSVADRSSTATTPGASARLFRAELTLGVHPSHRQCIDTLSTSSLAIALSPLARLRVPHRLTLSR

SEQ ID NO: 122747 - protein, 75 aa, Triticum aestivum
  Clone ID: PAT_TA_17165.pep
MDLLQPAEFKNPCHCLLLLLLLDVKPETTVPYTSEELMKVTEEQLAASAIAAWNAQQPPSSEQQEAAAATTPSES

SEQ ID NO: 122748 - protein, 115 aa, Triticum aestivum
  Clone ID: PAT_TA_17166.pep
MTSTIGIPIKLLNEAQGHIVTLEITSGQTYRGKLLDAEDNMNVQLKDITVTARDGRVSHLDQVYICGSHVRFFIVPDMLRNAPMFRSRNVRGRGVGLARGRATVSRARAGGRGGR

SEQ ID NO: 122749 - protein, 117 aa, Triticum aestivum
  unsure (1)..(117): unsure at all Xaa locations
  Clone ID: PAT_TA_17167.pep
MRREGRQRGWVRVYDRALVDPEGKRRAVRAVDGPAVANGGFIRASRRPTNQSKPGGXRARQGRPRASGGGGAGAGAAAPSAAGRRGGRKFKHNEIKMYYVDAAEDVDGRLDYLHDLL

SEQ ID NO: 122750 - protein, 115 aa, Triticum aestivum
  unsure (1)..(115): unsure at all Xaa locations
  Clone ID: PAT_TA_17168.pep
MRREGRQRGWVRVYDRSLVDPEGKRRAVHAVDGPVVANGGFIRAPRKPTNQSKSGGXRARQGRPRARGGGAGAAAPSAAGRRGSRKFRHSEIKMYYLDAAEDVDGRLDYLYDFDS

SEQ ID NO: 122751 - protein, 60 aa, Triticum aestivum
  Clone ID: PAT_TA_17169.pep
DAHVYSTHVQALEEQLQKQPKPFPILKINPLKKDIDSFVASDFKLVSYDPHQKIEMKMAV

SEQ ID NO: 122752 - protein, 209 aa, Triticum aestivum
  Clone ID: PAT_TA_17170.pep
RRTTRRMAAKAAVTAGDVCVLKRCQQHGGQDLKEKKGTKRKAEEAPEGDESPLEVCSIRRKTAGIDCSELGQGATPATAAAARREEAPERKMTRLPQEEVDSILTKEMDDDSLPPEYKALKRHNPALIPSPEEEMDEDVVSFYNVVRFFYEIGEDFREFQAWVRTEYAKNGYVEVDDDYLRHQQEMEAMNEAARKEALKAFDFSDLLDF

SEQ ID NO: 122753 - protein, 207 aa, Triticum aestivum
  Clone ID: PAT_TA_17171.pep
MTGVQVMPGVGAVTTVDVRTEGGKAVAGLARRRVAVGSSSSTSLFAGDWRRRPRRATCSVRLRQCGRGRGGRSGGLAIVSNLGGSYDVGFGDVDLQLMNYFTYKAVRTVLTQLYEMNPPSYRWLYNFVAVNKPTDGKLFLRALGKERQELAERVMITRLSLYGKWIKKCDHAKMYEKISEENLELMRERLMETVIWPTDDTNTEKIG

SEQ ID NO: 122754 - protein, 91 aa, Triticum aestivum
  Clone ID: PAT_TA_17172.pep
TNQDPIFVNFSECSKYRTEQLFTMAQSTSCCATFSSLGTNTLRFLQHHLRAAADNFHTRICRTFVHTHPYSRDLEYISTGFNMKNLVHVVA

SEQ ID NO: 122755 - protein, 155 aa, Triticum aestivum
  Clone ID: PAT_TA_17173.pep
ADGRRFSAEFQLVFRLIKGLIFITFISIIIILTAIAHMTVLDIFVCILAFMPTGWGLLLIAQAIKPVVEMVGLWGSVKALARGYEILMGLLLFTPIAFLAWFPFVSEFQTRMLFNQAFSRGLQISRILGGHKKDRATRNKEYVERRSRLAPADFV

SEQ ID NO: 122756 - protein, 141 aa, Triticum aestivum
  unsure (1)..(141): unsure at all Xaa locations
  Clone ID: PAT_TA_17174.pep
MLPVMKGEGIYMKLRRRVGDIERSSNGDIAFLVAIEDEKVLGIFLSILAFQFKEPGLLMVALAVKNVVEMGEIWGKANTFLSSKSTVVAPPVFSPIAFLGYFPFXGEFQSWMLFNQAFSRGLQISRILGGHTKDRATRNKE

SEQ ID NO: 122757 - protein, 80 aa, Triticum aestivum
  Clone ID: PAT_TA_17175.pep
RAAARAGTVLVLFMIVVFMALEIGKLFESDRPAALEIDKLFESDRPVTFQILLDKSALIHGLVRSFPAMPLLPLMAKSFG

SEQ ID NO: 122758 - protein, 196 aa, Triticum aestivum
  Clone ID: PAT_TA_17176.pep
DAWAACRGETPAATPCFDRSLVKMPAGDELASDVLRKFAPNLPSVALASSVFEDRKRLTRRTFTLDEGDIQRLKQRIVHLNESGGTPLPRPPSAFAAVVALAWTCFARCKSFSLDDDVWLFFFADIRERLDPPVGAGYIGSCLTKCLARLPARELHGERALAVVASAVQDEINKMKEDLSLGGISSHSIPCLPWTG

SEQ ID NO: 122759 - protein, 86 aa, Triticum aestivum
  Clone ID: PAT_TA_17177.pep
GCFFLAPSLESLADGEGEEAKELFLGSTLTSEHPQQNPIDALLSFYTTKISPSLSFFLSFLCSPSLEKTQVFSATDRVSVCAYVFL

SEQ ID NO: 122760 - protein, 106 aa, Triticum aestivum
  Clone ID: PAT_TA_17178.pep
TPTGPSHALLGHYIVLCASVPGPRRLRPLTTRPVCFDEAGPTANGEDVERGERGKVSQGSVNGASATKPRSRARKMEASKLRTGPWVAVKGVAWSGVEPGWHRATR

SEQ ID NO: 122761 - protein, 65 aa, Triticum aestivum
  unsure (1)..(65): unsure at all Xaa locations
  Clone ID: PAT_TA_17179.pep
TRAPSPSCCCSGXPAGAGNRRRTSAISQLLGYLSAKQKVRLPFTENFNLCSEILLLEFRLFNWTG

SEQ ID NO: 122762 - protein, 166 aa, Triticum aestivum
  Clone ID: PAT_TA_17180.pep
GTRGAGSCLVSDGDGEEKFQPCVDAKEVDDDGKQMAAAEAVESELPPHEFAAGEEEEGKKEEDGAPPECVVFSVGKLRVNAVGALCSFGVAAATVCVFLVGGRLQHQKQHQHHQQQKIQLQFLGDDKRIQQVVQQTSRLNQAMSSMMGAGASTRANISFGGFYDGF

SEQ ID NO: 122763 - protein, 80 aa, Triticum aestivum
  Clone ID: PAT_TA_17181.pep
MASSSSSQFDDPSARRPPPPQRKPPVLMLLPLIYAPVLPLIRIGLRHNPVWRDRLFYGVLAGAFVHGTYLISELYDVESK

SEQ ID NO: 122764 - protein, 83 aa, Triticum aestivum
  Clone ID: PAT_TA_17182.pep
TRNTSMATMVKAMVVAVLLVQCCNVVLAARLLEGDGGWLHGDVGAAGALITQILAGHSPGAGTPNPCTHDPINNNPPGAVCHG

SEQ ID NO: 122765 - protein, 81 aa, Triticum aestivum
  Clone ID: PAT_TA_17183.pep
MASSATMARAVVVALLLMQFCDVVLAARLLEGDGGWLHLHGGVGAAGALILQILPGGSPGAGAPNGCTNNPKHPPGGKCHG

SEQ ID NO: 122766 - protein, 79 aa, Triticum aestivum
  Clone ID: PAT_TA_17184.pep
MATMVRAVVVAVLLVQCCNVVLAARLLEGDDGWLHGGVGAAGALIMQILPSGTPGPGKPNPCTHDPINNNPPGAVCHGG

SEQ ID NO: 122767 - protein, 79 aa, Triticum aestivum
  Clone ID: PAT_TA_17185.pep
MGSSATMARAVVVAVLLVQFCNVVIAARLLEGDGGWLHGDIGAAGALIMQVLPGGSPGAGASNGCTNNPNHPPGGKCNG

SEQ ID NO: 122768 - protein, 162 aa, Triticum aestivum
  Clone ID: PAT_TA_17186.pep
PAGSGTLQARPFIHRTCVRSPASPLSATFAPYRTYRRCTLRDSKSYTRKISMGSSAKMTKAVVVAVLQRGPRGEAARGRPRLATRRRWHRRGAYHAGLARRLSGSGSTQRLHQQPQPSPRRGMQRRALSRRRSSTSQLVRDARTCVDRGRLSFSGLLLVWFG

SEQ ID NO: 122769 - protein, 81 aa, Triticum aestivum
  Clone ID: PAT_TA_17187.pep
MGSSATMARVVVVAVLLVQCCNVVLAARLLEGDRGWLHGGVGTAGALIMQVLPGGSPGAGTPNGCTNNPNHPPGGPCNGGR

SEQ ID NO: 122770 - protein, 129 aa, Triticum aestivum
  Clone ID: PAT_TA_17188.pep
HYMRPGREWKGRRGVAMAARSRLLFFFSLPRSFFTPCCCFFLPPSAESLAGDDDEEDVDDNEEVLFGSTLTSEGPQQNPIAALLKLMLHYLFPFFLSFLCSLSSLCSSVLQLTFYRGGEPRLLILCLDS

SEQ ID NO: 122771 - protein, 121 aa, Triticum aestivum
  Clone ID: PAT_TA_17189.pep
HYMRPGREWKGRRGVAMAARSRLLFFFSLPCSFFTPCRCFFLPPSPESLAGDDDEEDADDKQVLFGSTLTSEGPQQNPMAAYYCTIFSPSSFLSSALFSLRKTQLFSAADPVCVYVLRPGR

SEQ ID NO: 122772 - protein, 135 aa, Triticum aestivum
  Clone ID: PAT_TA_17190.pep
HYMRPGREWKGRRGVAMAARSRLLFFFSLPCSFFTLCWCCFLPPSPEPLAGDDDDEDVDDKKEVFFSRTLTSEGPQQNPMAVLLKPEANAALSFPLLPFFPLLYQLTLFLCSFFSSRRTQVFSAAVLIRVRSLCF

SEQ ID NO: 122773 - protein, 105 aa, Triticum aestivum
  Clone ID: PAT_TA_17191.pep
HYMRPGREWKGRRGVAMAARSRLLFFFSLPCSFFTPCCCFFLPPSPESLAGDDDEEDVDDKQEVFFGSTLTSEGPRQNPMAALLKLLLHYLFPFFLSSLCSLSSL

SEQ ID NO: 122774 - protein, 377 aa, Triticum aestivum
  Clone ID: PAT_TA_17192.pep
MDLSSLARPQALRGGSTGALGAHAARRRSVQLLHPRRPTFRCSVEAAKQQVQGTLAAEAEAARKECFGVFCTTYDLEADEKTKSWKKLVNVSVSGAAGMISNHLLFKLASGEVFGQDQPIALKLLGSERSLQALEGVAMELEDSLYPLLREVSIGIDPYVIFEDADWALLIGAKPRGPGVERAALLDINGQIFAEQGKALNAVASRNVKVIVVGNPCNTNALICLKNAPNLPAKNFHALTRLDENRAKCQLALKAGVFYDKISNMTIWGNHSTTQVPDFLNAKINGRPVKEVIKDTKWLEEDFTITVQKRGGVLIQKWGRSSAASTAVSIVDAMRSLVTPTPEGDWFSTGVYTTGNPYGIAEDIVFSMPCRSTGGAC

SEQ ID NO: 122775 - protein, 160 aa, Triticum aestivum
  unsure (1)..(160): unsure at all Xaa locations
  Clone ID: PAT_TA_17193.pep
DHRRHRQVLLQGRDIEEGSTRGRKQVWFSNVPHTWLVADKGGQNWITKAKGXMKKTNSGLHQLPLLTPLPLLNXFEAHVSLFSQMVPSGSRTRVFLDVGFGVTSFGPYLISREFEHGVPAMVATHLSTAIIQCSHCRINSTCDGELRYSHASSNTPESFS

SEQ ID NO: 122776 - protein, 153 aa, Triticum aestivum
  unsure (1)..(153): unsure at all Xaa locations
  Clone ID: PAT_TA_17194.pep
SEKGFAQWELDLLYRHHACSNLXSCVATLESLSSLVQSLPRMIVMDEIGRQVELSLEAASLAQRNATLGIGDSSAVSATRARALAEDAFFHPSIMSISYASVEHYFAIYMPFFAPVCLHVLLAAIKELKRYKVERAKYSAFLLASQSRATTSS

SEQ ID NO: 122777 - protein, 114 aa, Triticum aestivum
  unsure (1)..(114): unsure at all Xaa locations
  Clone ID: PAT_TA_17195.pep
HMEXPXPDGPTSPPTEKRTMVHGVTIHVGSVEDHITTRCHSFTFCVFDMVDGTSPSPFEDGGHGFAGGRLEIFRFNCLNTYISFHIVSSLAYYSLRXIRFKFVNGGVLHMSFYL

SEQ ID NO: 122778 - protein, 217 aa, Triticum aestivum
  Clone ID: PAT_TA_17196.pep
MEVKVLGSKLVKPAYNAGAAPAPSTEYIPLSIFDKVTFNMQMAIIYAFAAPAPSTAAIENGLATVLAQYRAFAGQLGEAPDGTPSFILNDRGARLVEATVDADLIDMAPAKPTPELLKLHPDLEAEHEEVVLLQLTRFRCGSLAVGFTSNHVVADGHATSNFLIAWGRATRGLPIGLPPVHHTRTSSSRSSPRVEHDHRNRQYYLPSPTDVVGHHGD

SEQ ID NO: 122779 - protein, 86 aa, Triticum aestivum
  Clone ID: PAT_TA_17197.pep
TRLFSCGTSNHGDSHLVEWNETEGAIKRTYNGFRKRSLGVVQFDTTRNHFLAAGDDFVVKFWDMDNTNILTTIDCEGGLQATTLLY

SEQ ID NO: 122780 - protein, 182 aa, Triticum aestivum
  unsure (1)..(182): unsure at all Xaa locations
  Clone ID: PAT_TA_17198.pep
GPSCLYVGPIETASQEMLEALYRQARASWQGGQPLIVDDMFDKVELKLRVYGSPSVVKYPRCSLKRQSAYADAEGXEDHSMFMALSSIWTLLLLFGTSAFLVPSFYTLSLAFGDAFGARSLFSGAKSLDGITRVNHMVLIGLGYLIGYPVCIPRQVWCTARPADKQCGLHQKGLRAQSGEAS

SEQ ID NO: 122781 - protein, 123 aa, Triticum aestivum
  Clone ID: PAT_TA_17199.pep
SSVGTIAYMSPERINTDLNDGNYNGYAGDIWSFGLSILEFYLGRFPLGENLGKQGDWAALMCAICYSESPAAPPTASPELRSFISCCLQKNPAKRPSAAQLLQHRFIASPPPQQPQALAAPPC

SEQ ID NO: 122782 - protein, 131 aa, Triticum aestivum
  Clone ID: PAT_TA_17200.pep
MSSMEKDRVDTDDQTMSSEEAPRRERRSKKKSSKSRRQGTQQQQGGGGSGPLDQLPLAGDLGNTVGGVTDGVSNTLGGVTGGLGGLTGGQQGGGGGDAGKDTLRLRLDLNLDIEIQLKARIHGDLELSLLN

SEQ ID NO: 122783 - protein, 301 aa, Triticum aestivum
  Clone ID: PAT_TA_17201.pep
GQIPFCACAVGTVDGCLYVLGGFYRATAIKSVWKYDPAVNLWQEVNSMSTARAFGRTGLLNNKLYVVGGVIREETGLAPLQSAEVFDPATGIWADVPSMPFSKAQTLPTAFLADLLKPVATGIVSFGGKLYVPQSLYSWPFFVDVGGEVFDPATDSWSDMPVGLSEGWPGRQAGTKLSAVVDGDLYALEPPTCSDSGKIKMYDPNEDTWKAVVSQVPVGDFAESKCPYLLAGFLGKLHLVIKDANSMISILQTDALKPMDATGSTCQNPDVSWEQDVDIWRMVGSKKFAAAELVSCQALSI

SEQ ID NO: 122784 - protein, 140 aa, Triticum aestivum
  Clone ID: PAT_TA_17202.pep
PSRQWSSGQQSYTPAEPSRQWSSGQQGYTPAEPSNQWSSGQQGYTPAGPSNHRSSGQQGYTPAEPSRQWSSAQQGYTPSDPSVQQGYTPAEPSRPWSTASQGAQNPDTSRQWSGAGKQDYYNTPSDGRSPYDPRRRRRWE

SEQ ID NO: 122785 - protein, 128 aa, Triticum aestivum
  Clone ID: PAT_TA_17203.pep
MQIFVKTLTGKTITLEVESSDTIDNVKSKIQDKEGIPPDQQRLIFAGKQLEDGRTLSDYNIQKESTLHLVLRLRGGIIEPSLKALASKFNCDKMICRKCYARLPPRATNCRKRKCGHTNQLRPKKKLK

SEQ ID NO: 122786 - protein, 128 aa, Triticum aestivum; identical to SEQ ID NO: 122785
  Clone ID: PAT_TA_17204.pep

SEQ ID NO: 122787 - protein, 122 aa, Triticum aestivum
  unsure (1)..(122): unsure at all Xaa locations
  Clone ID: PAT_TA_17205.pep
RTKEIPCGCFRFLVWMFNPSIVGANSHVPSFYLFVFFSADVSPSGIEGHALSSRSRGCESTLRVQAQTADASATATDVAIRVGVCCFTAKTPDSAGAAHGRELRDALDARAPLRCPXFLSLA

SEQ ID NO: 122788 - protein, 318 aa, Triticum aestivum
  Clone ID: PAT_TA_17206.pep
HASGSRTTAQERKEGHHIYGSRELISGLLFLRLAWFSVDRRSFGFCSIVGVGIMVAAVDAVAEKVVAQLREECATPATRLDGVATAMEEEMRAGLHQEAGSKIKMIISYVDNLPNGSEEGLFYALDLGGTNFRVLRVQLAGKDKRVVKRESREVSIPPHLMSGSSAELFGFIASALAKFVADEGDNKVLDDKQRELGFTFSFPVRQSSIASGTLIKWTKAFAIDDAIGEDVVMELQMAMEKQGVDMRVSALINDTVGTLAAGSYNDEDAVIGVILGTGSNAAYVEKADAIPKLEGELPKSGNMVINTEWGNFSSSCLP

SEQ ID NO: 122789 - protein, 256 aa, Triticum aestivum
  Clone ID: PAT_TA_17207.pep
MAAASLSRLSRRASAAAAPSLRRILSSTATAPAAPSSSPPPVAAAAAGADRVRWDYRGQRQLVPLGQWLPKVAVDAYVAPDAVLAGQVTVHDGASVWSGSVLRGDLNKITLGFCANVQERSVLHAAWSASTGLPAETLVDRYVTVGAYCLLRSCTIEPECIIGQHSILMEGSLVETNSVLEAGSVLAPGRRIPTGELWAGNPARFVRKLTNEEIMEIPKLAVAINDLMQSHFSEFLPYSNAYLEVEKLKKSFSIPL

SEQ ID NO: 122790 - protein, 122 aa, Triticum aestivum
  Clone ID: PAT_TA_17208.pep
CTHVHAGLHGRATPPWIHGRATSPAADRQADEAGGEGGSASSKVEEVGGRECWRRSCSFRVSSRLEEQGAASPGAAPTPGVLLVATLHAIIGRIASRRWPHCTPSLAKSMPVRMERIMPWLG

SEQ ID NO: 122791 - protein, 91 aa, Triticum aestivum
  Clone ID: PAT_TA_17209.pep
HFPDWTAAADMVSEQDRLENLFFTQGFRVSFVLYENVAKDFGLDLAPQREQCGRVLFVAEQLRFSDAQMESFWTHFERTEEDADEEGFEEL

SEQ ID NO: 122792 - protein, 86 aa, Triticum aestivum
  Clone ID: PAT_TA_17210.pep
MSSQRMGRHQRRASQSVFALPENFAALDDVPASDEHRKADGGGATEQQQQGAGRHRRAMSMAVASSRDLEMIKEDVGGYSNYKIGA

SEQ ID NO: 122793 - protein, 74 aa, Triticum aestivum
  Clone ID: PAT_TA_17211.pep
YIHHKYSVTQHADEDLYRSTKASVTTRAAEWSEVTLHPYLPLWTNDSDPPAIAAPPPGQREIGYHGGFITAEID

SEQ ID NO: 122794 - protein, 102 aa, Triticum aestivum
  Clone ID: PAT_TA_17212.pep
SIYQPTPAGNSGVGSAYQPPPTGNNGVGSAYQTPPTGTNGIGSTYETPLASSNGVGSAFQPPLTGDDNGVRSAYQPGMTPSSASTRYGQLWFLLPAALVFFK

SEQ ID NO: 122795 - protein, 85 aa, Triticum aestivum
  unsure (1)..(85): unsure at all Xaa locations
  Clone ID: PAT_TA_17213.pep
LTCGXXGSNMIXNHITCLSHLTHDTLSKXXKNXHNQKINTDNLNQQAKAYMPHCSILLMASSDSISIIIMCVCILDQIGRYIGSS

SEQ ID NO: 122796 - protein, 148 aa, Triticum aestivum
  unsure (1)..(148): unsure at all Xaa locations
  Clone ID: PAT_TA_17214.pep
XRXXMKRPATTRQCRACKNNGRMLGSSYKLATDXRRYAGPNLGRSHHQRSIKQALAARLPSFLPANVFFQEKIPIRAAIKETRPALKHHQCVLACGCPRHRSPSLTSSLVAIVAAGRRRRLRACSSLRRRLPPPGAPATAPVRRPQLR

SEQ ID NO: 122797 - protein, 283 aa, Triticum aestivum
  unsure (1)..(283): unsure at all Xaa locations
  Clone ID: PAT_TA_17215.pep
PASGHPQQEXXPAEVIPHQMIGFSDPAMSTVKAAETFIHDSNESXVTHMDLDHSFLPVPSAVNACAFESFVRQEQGTLLFPLGTNGHYISAAKFVNASTLTIPTTFSSGFKIEPKVLADTLKNVSRPWVYICGPTINPTGFLYSDSNIQELLSVCAEYGATRVAIDTSFXGLEWXMDGWSRWNLEGCLFSLKCSKPSLSVVLLGELSFELIAAGHDFEFVILNDPSLVDAFHSFPSLSRLHSTXFKKLLGLKNXKDQHFSDLMAEHQYELMIILLYMLMIILL

SEQ ID NO: 122798 - protein, 64 aa, Triticum aestivum
  Clone ID: PAT_TA_17216.pep
MLVMPNILSLTCICFNSVLYPTSFFFAKLPEAYAIFNPIVDIMPVIPLFFFLLAFVWQAAVSFR

SEQ ID NO: 122799 - protein, 282 aa, Triticum aestivum
  Clone ID: PAT_TA_17217.pep
RTMTHRLPPAVAAVAVVLVALTCLHRPAAASGHAADRIARLPGQPAVDFDMYSGYITVDEGAGRSLFYLLQEAPEDAQPAPLVLWLNGGPGCSSVAYGASEELGAFRVKPRGAGLVLNEYRWNKVANVLFLDSPAGVGFSYTNTSSDIYTSGDNRTAHDSYAFLAKWFERFPHYKYRDFYIAGESYAGHYVPELSQLVHRASNPVINLKGFMVGNGLIDDYHDYVGTFEFWWNHGLVSDDTYQRLTEACLHDSFIHPSPACDAATDVATAEQGNIDMYSLYT

SEQ ID NO: 122800 - protein, 189 aa, Triticum aestivum
  unsure (1)..(189): unsure at all Xaa locations
  Clone ID: PAT_TA_17218.pep
IRTLLDASRSRKLTWDLRVGIIQGIAEGLSYLHEESETRIIHRDIKASNILLDDKYKSKITDFGLARAFAADVTHLTTGVAGTFGXQLPHDLFHCHVEWTQRGLLILQSLNKFVAKHTWLLTISCMIDLIIYKDTIRHMFLFLVQIGLLCTLANPGDRPTMTKVVELLRSHKHDVEIVLSDPPFLNVEG

SEQ ID NO: 122801 - protein, 167 aa, Triticum aestivum
  Clone ID: PAT_TA_17219.pep
MEVEAFPIGFTKGVRAHWRRRKYQRLEAGEGGGSRSQGTQRLGGSGARRVGWRVRLRGLLIRRARAVRAIVTAPRRLLARARDAYVGGMLAVARKASATALPGGGPEGIWARRVPRRKQLPSATAARTSEFEQRLVMEIYKSIVASKELTTMLHSSTAHLQPPPARA

SEQ ID NO: 122802 - protein, 237 aa, Triticum aestivum
  Clone ID: PAT_TA_17220.pep
MPNLCKSPSTSRVVWDPPPNSHFTQHLRKLNTSKAAPNSIDSPVKQHASQSAPHPHLAAEQTRNARAGPAMEVEAFPIGFTKGVRAHWRRRKYQRLEAGEGGGSRSQGTQRLGGSGARRVGWRVRLRGLLLRRARAVRAIVTAPRRLLARARDAYVGGMLAVARKASATALPGGGPEGIWARRVPRRKQLPSATAARTSEFEQRLVMEIYKSIVASKELTTMLHSSTAHLQPPPSRA

SEQ ID NO: 122803 - protein, 96 aa, Triticum aestivum
  unsure (1)..(96): unsure at all Xaa locations
  Clone ID: PAT_TA_17221.pep
RGLFFFFFSKCFSSFDHSTCALSVSGRYLALEDIYLPFRAAFPNYSTRRRRFTEIWHPXQTGLSPSMASRSREXEGTASKSSSTNYNSGPKARFQI

SEQ ID NO: 122804 - protein, 257 aa, Triticum aestivum
  Clone ID: PAT_TA_17222.pep
MRGSVLRLNRQLTRSSHRLLSAPLTRYHISYQGSIRLCSSCHSPSNSISSPQTHSAKMSESGAWGAWQVETSSFTKAVVASIQKLYPEEIADRSWDNVGLLVGNSEEDTKKKKRVLVTNDLTYQVAMDAIEQDVSVIVSYHPFIFGGLKSITNNDPQQATLLKLTKAGIAVYCPHTAVDAAPEGLNTWLADIVSGPHESKRSVANPAVNAPSSHAGAGYGAIGRFDSSVSLSEIIIRLAEKLGGLKHVMVASPVGAD

SEQ ID NO: 122805 - protein, 331 aa, Triticum aestivum
  Clone ID: PAT_TA_17223.pep
MKFSTIALAALTQVASAHYFFDVATVNGKDSAPFQYIRDFTRPTKYNPIKFSSNPSADIRDNSFADGEDIVCNQGAATKGASTEVADVKAGDVITFKLGVGAKMGHPGPTLAYMSAAGSDVKSYKGDGDWFKIMEEGVCNAGGDFTKDAWCNYDSPSADVKIPEGTPDGQYLLRVEHIGVHRSHVNQPEHYVSCMQVSVTGGGSGKVDAEMVKFPGAYKATDEYANFSIYNGAKAFPMPGPKVWGGATSAGGATGGNDAPASTPAAGNDAPATTPDAGNGAAAPEAGNGQQQGGEQQQAPPQGNQGGFPGQQQGNQGGFPGAQSAGSPCSA

SEQ ID NO: 122806 - protein, 85 aa, Triticum aestivum
  Clone ID: PAT_TA_17224.pep
REAKSSAPRSSSIVTVSQTSRSGAPPPDPATDASTDRCRNPPPRQLPARPGQRPYPLPMLQLPAHFILSYFFFAFDFSCLILFHL

SEQ ID NO: 122807 - protein, 236 aa, Triticum aestivum
  unsure (1)..(236): unsure at all Xaa locations
  Clone ID: PAT_TA_17225.pep
XFGLSALSESKSQDGMLHTTCGSPAYVAPEVISKGGYDGAKSDIWSCGVILFVLVAGYLPFQGQNLIEMYRKIEKGDFRCPGWVSQKLQKLLYKIMDPDPNKRISIQKIKESTWFRKGPGENLTVKERLPSENANTDAVPTLGVRRRKNSHEDAKPLAVTNLNAFEIISFSTGFDLSGLFVEKESKKEARFTSEQPASAIVSKLEAVAKTLNLRVRKKDNGVVKMQVRKEGRNGVL

SEQ ID NO: 122808 - protein, 447 aa, Triticum aestivum
  unsure (1)..(447): unsure at all Xaa locations
  Clone ID: PAT_TA_17226.pep
MENSGKIVMXGYELGRLLGKGAFGKVHYAKNLESNRGVAIKILDKEKVLKVGLAEQVRREITTMRLVEHKSIVQLHEVMATRSKIYFVMEYMRGGELFETESPRLAGSESVLHTSIPSKLISAVDCCHSRGVYHRDLKPENLLLDENENLKVSDFGLSALSESKSQDGLLHTTCGSPAYVAPEVISKGGYDGAKSDIWSCGVILFVLVAGYLPFQGQNLIEMYRKIEKGDFKCPGWVSQKLQKLLYKIMDPDPNKRISIQKIKESTWFRKGPGENLTAKERLPSENATTDAVPTLGGRSKKNNDDAKRLAVTNLNAPLIISFSTGFDLSGLFVEKESKKEARFTSEQPASAIVSKLEAVAKTLNLRVRKKDNGVVKMQVRKEGRNGVLQFDSEIFEISPSYHLIEMKQTSGDSLEYQKLLEESIRPALKDICLXAWHGADGQQEHQG

SEQ ID NO: 122809 - protein, 130 aa, Triticum aestivum
  Clone ID: PAT_TA_17227.pep
HQELDAINDLKADMNKLQQGMSSMQRMLEACMDMQLELQRSVRQEVSAALSRFPGPEGMFLDLHDDGTRWDQVRKGTCCVCCDTQIDSLLYRCGHMCTCSKCANELVRSGGKCPLCRAPIVEVVRAYAVL

SEQ ID NO: 122810 - protein, 223 aa, Triticum aestivum
  Clone ID: PAT_TA_17228.pep
LKLKFFLSPSHCLSIGKCVGLAMADQKVDSAEFEILTPRNGHLCTEAYRLFFAQQFNDFFRDCPDAFAGLTGLHLQYMRFGESDITNILSYCKQLESLSLFMCDEGVSSVLRVEHARLVELVISYCEFKTVELTFLPNLQRMTFNSWPSCAEHPLALGFVPELSKLSLAKACFSHKTLKLSQLLANVLSVNDLSLEFQSEKIWIRPESPKVLSPWLAKLRFVN

SEQ ID NO: 122811 - protein, 142 aa, Triticum aestivum
  unsure (1)..(142): unsure at all Xaa locations
  Clone ID: PAT_TA_17229.pep
RGFAFVQDVSYAGFLDRVRDGELKLXRASGLWDVPHPWLNLFLXAXSRVLDFAAGVFHGILRRDSTTGAMGPVLVYPMNRNRWDADTSAVLPGEEDGVLHRGDLRSSVXASTDGGRQLLRRLEEQNEEILRFCEEAGIPCVQ

SEQ ID NO: 122812 - protein, 152 aa, Triticum aestivum
  unsure (1)..(152): unsure at all Xaa locations
  Clone ID: PAT_TA_17230.pep
KRELDSPVIENGENWSVGQRQLVCLGRVILKRTKILVLDEATASVDTATDNMIQKTLRENFSEATVITIAHRITSVLDSDMVLLLDNGVAVERDTPXKLLENKSSLFSKLVAEYTSRETHAWRSMRSAPGFVLPRGASCVSLAVDNSRKITW

SEQ ID NO: 122813 - protein, 172 aa, Triticum aestivum
  Clone ID: PAT_TA_17231.pep
TSHTGNNKARLPSRLSSFQRARGESSARETRDRAGDRWLERSGAGRCRRGWAPARRGSWPSTSSWAPSSPCRRVRSRSRRRRAAAAAGAGSRAGPRRRCCSASAPSASSPSRPRPSTRRSLARAPPPRPPSEKQRTPGRRPGGRQLHRVTVYHAHTRRQSRRKRTPWKTRTR

SEQ ID NO: 122814 - protein, 81 aa, Triticum aestivum
  Clone ID: PAT_TA_17232.pep
QETAIHTGIGIPLSGQMNQTQAPPQGNPWFEVLKGKNHLKHANWTLNATSPYSSMLGSGSAEVRARILILLSPTVPPHSRC

SEQ ID NO: 122815 - protein, 162 aa, Triticum aestivum
  Clone ID: PAT_TA_17233.pep
MSRMGSNGGGKLASWLWRAPRRALGRARDLYVRSLTSCAGQFPSDASFGYPSFAAAPAPCSRAAGYHSFSASASPSSSSRSYDGDGDLRELMRAASERREAPERPPAVPRSRSVAMAKIDEDGPCDFGLAGAGVPFARSRSCAVSAGRASGQRGRAAHVPVA

SEQ ID NO: 122816 - protein, 45 aa, Triticum aestivum
  unsure (1)..(45): unsure at all Xaa locations
  Clone ID: PAT_TA_17234.pep
RGGGXGXGSNFKTKXXXXFTKGSCTFGDRCHFAHGENELRKSAAA

SEQ ID NO: 122817 - protein, 271 aa, Triticum aestivum
  Clone ID: PAT_TA_17235.pep
SHSTTRTRPHSPPGSPPLRRQPKNPRERSEERTAMAEARRSHPSQYVKLTKDQDASACGPGVEDIRPGELNLPVAVPQLERMKCIQCGQVLPEGHQAPADEPWTTGIFGCAEDPESCWTGLFCPCVLFGRNVQALREDIPWTRPCTCHAVCVEGGIALAILTAIFHGVDPDTSILIGEGLVCSWWICSQYTGIIREKLQKKYHLENSPCDPCIVHCCFHYCANCQEHRERKGRLAENSVVPMTVVNPPPLQEMSMAENNAPTSENEGSKAA

SEQ ID NO: 122818 - protein, 217 aa, Triticum aestivum
  Clone ID: PAT_TA_17236.pep
GPEFPGRPTRPRTRGFTQSEQGGENSNTNDMMAFYRRSLLSQSTVVLPSRYQDVSDNSVSRAGSASCSSGNLHNPIETPQGIPQIYGTTDPSPIGHQQMSLERDSSIKEQGEATVVNCESTTKPDSRKRKLSFEHAASIPVINLEPEPAPPSSHVATEVGNDIYWDDAFFENLDFDAIEAQATEQLRLQKAQSAQKPTETKRASDVSFTPPSFDLGI

SEQ ID NO: 122819 - protein, 166 aa, Triticum aestivum
  Clone ID: PAT_TA_17237.pep
KPCYEPNTLVAHASYAFNDFYQRKGRASGTCDFSGAASIVFQQPAGICDPSISWCVANAAAGDARLQGGRGRGRGRGGGRGGRAPGARCFDPDTKVAHASYAFNDFYQRNGRADGSCNFNGAGSVVYQQPKIGSCVLPSSHQQATEEMVEKSQGQTARLKCTRLRQ

SEQ ID NO: 122820 - protein, 161 aa, Triticum aestivum
  unsure (1)..(161): unsure at all Xaa locations
  Clone ID: PAT_TA_17238.pep
MVTYDPDELGRLVYLHAALCESLRLYPPVPIEHKGVAAAEALPSGHEVRPGDKRHGSLYAMGRMEAVWGKDCREFRPERWIGEDGKPRYVPSYRFASFNAGPRTCLGKDXALVQLKAVAAAVVRNFKFERPPGQVVEPKISIILHIKNGFRARIKRRHAGA

SEQ ID NO: 122821 - protein, 184 aa, Triticum aestivum
  unsure (1)..(184): unsure at all Xaa locations
  Clone ID: PAT_TA_17239.pep
MGSMGPAAGKPHAVCLPYPAQGHITPMLNVAKLLHARGFHVTFVNTEYNHARLVRSRGLAAVAGLPGFRFATIPDGLPPSDDDDVTQDIPALCKSTTETCLGPFRSLLARXNDPAAGHPLVTCVVSDVVMGFSMEAANELGLTYVQLWTASAISYLGTATTASSSGRGIVPLKGTYAEQLTNGY

SEQ ID NO: 122822 - protein, 293 aa, Triticum aestivum
  unsure (1)..(293): unsure at all Xaa locations
  Clone ID: PAT_TA_17240.pep
MASSPAPAGEKAHAVCLPAAAQGHIIPMLDVAKMLHARGFHVTFVNTEYNHARLVRARGAAAVAGVPGFRFATIPDGLPPSNDDVTQDVTSLCKSLTETCLGPFRRLLAELNDPATGHPPVTCLVADIIMDFSMEAARELGLPYVQLWTSSAVSYVGDRHYRLLFVRGIAPIKGLQAADTSLTDGYLDMPVEDVPGLRSMRLRDFPAFIRTTDPDELMVRVGPWGPGPTAGAAAVARNSLADLDGGSAGPVGALGLPRVSSLGPLPLLAREEXPRRAPAINLSLWKEQEECLQ

SEQ ID NO: 122823 - protein, 147 aa, Triticum aestivum
  Clone ID: PAT_TA_17241.pep
MGDAVIEGSNWRLVEVGRVVVINGDHPFAGHLATIVEIIDHKRILVDGPSANASLATPRQAVPLNKVLLSSLVVEGLNRGSRTGVVRKLWEKSEIDSKWEQTNWAKKRDQMERRKALTDFERFQVLRLKKQRRFEERKALAKVKASA

SEQ ID NO: 122824 - protein, 113 aa, Triticum aestivum
  unsure (1)..(113): unsure at all Xaa locations
  Clone ID: PAT_TA_17242.pep
PPATAHRAXXXCGXPLLFRRXPPGTAPVAHKATAAKTLAAKXEHEPDHDDGSXXVALFFGTQTGTSEGFAKIXPSCNTLLFPRLAPIRLDVLWAMDKMKAWTWRLGTCPRASS

SEQ ID NO: 122825 - protein, 204 aa, Triticum aestivum
  Clone ID: PAT_TA_17243.pep
MSSRMAGATLLRHLGPRLFAAAEPASGLAASARGIMPAAARIFPARMASTEAAAPHAKQEDDAGTPQAAATPEQQSKKAVVSYWGIEPRKLVKEDGTEWPWFCFRPWDTYRPDTSIDVTKHHEPKALADKVAYFVVRSLRVPRDLFFQRRHASHALLLETVAAVPPMVGDVLLHLRSLRRFQHSGGWNRALMEEAENESMHLMT

SEQ ID NO: 122826 - protein, 275 aa, Triticum aestivum
  unsure (1)..(275): unsure at all Xaa locations
  Clone ID: PAT_TA_17244.pep
RPGQVSVSYQINTNSKQKSFPSPPTKTDFPFDPLTSFSIGLVVQQSTANSSRMAGATLLRHLGPRLFAAAEPASGLAASARGIMPAAARIFPARMASTEAAAPHAKQEDDAASPQAAATPEQQNKKPVVSYWGIEPRKLVKDDGTEWPWFCFRPWDTYRPDTSIDVTKHHLPKALADKVAYFVVRSLRVPRDLFFQRRHASHALLLETVAAVPPMVGGVLLHLRSLRRFEHSGGWIRALMEEAENERMHLMTFMEVXSPRWWERALVLAAQGVFF

SEQ ID NO: 122827 - protein, 244 aa, Triticum aestivum
  unsure (1)..(244): unsure at all Xaa locations
  Clone ID: PAT_TA_17245.pep
MSSRMAGATLLRHLGPRLFAAAEPASGLAASARGIMPAAARIFPARMASTEAAGPRAKQEEATEKPQGATTPEQNKKAVVSYWGIEPRKLVKDDGTEWPWFSFRPWDTYRPDTSIDVAKHHEPRAVADKVAYLIVRTLRKGSDLFFQRRHASHALLLETVAAVPPMVGGVLLHLRSLRRFEHSGGWIRALMEEAENERMHLMTFMEVTQPLWWERALVLATQGVFFNAYFVGYLISPKXAHRFV

SEQ ID NO: 122828 - protein, 124 aa, Triticum aestivum
  Clone ID: PAT_TA_17246.pep
AGRVGSNHFKLVIHPTARRTQSSACLCLQHSLTTNPSIRSTKKVYMASSATMARAVVVAVLLMQCCNVVLAARLLERDGGWLHGGVGAAGALIMQVLPRGGGSAGAPNCCTNNPKHPACGKCHG

SEQ ID NO: 122829 - protein, 239 aa, Triticum aestivum
  unsure (1)..(239): unsure at all Xaa locations
  Clone ID: PAT_TA_17247.pep
ARGLLVAHFIKKSERSANNDDKYTNLYMKNIDDDMTEELIKLKFSQHGQVTSVKIMKRDDGTSKGFGFVSFKNPESAKKAKEAMNGMALGAKTLYVARAQKKAERKQYLQLLHEEKRNEIITKSNGSNVYIKNISDEVDDDTLRERFAEFGNITSVKIMRDDKGISKGFGFVCYSTPDEAKCAVSSMRGVMFYGKPLYVAIAQRKEDRKARLEXRFAELATMAGTSVIPTGYPHVYLPA

SEQ ID NO: 122830 - protein, 288 aa, Triticum aestivum
  Clone ID: PAT_TA_17248.pep
AGLNTQTISELVTVITRINYGRHAGISGLAGAVSLAGSESGLWSIKGGNWQLAAGLLKAANATLHLQEGIESISDAGDYYVLKSNKGHEYNCTVTVVATPLDEVNITFIPPISIPPRKMQHTHTTFVRGLLDPKFFGLSSVSDIPELIGTMELPDIPFSCISVRKKHGEHDMTYKIFSRAKLEDALLDRIFSTRKETIRIDWPAYPHYQAPEDFAPIILDGRHLYYVNTFESAASAMETGAVAAENVARLVISRLPLGLRAGLSTAAAPEPHIESFPSEEEVSRRVDL

SEQ ID NO: 122831 - protein, 84 aa, Triticum aestivum
  Clone ID: PAT_TA_17249.pep
QEAAIQKKTRPFYREVDKHSRMYAGGLDRPIERAFVLRDWRFGHYEIEGLQDPLSRFVRCVMRPFPRKKIHYIEDDAISYSISS

SEQ ID NO: 122832 - protein, 157 aa, Triticum aestivum
  unsure (1)..(157): unsure at all Xaa locations
  Clone ID: PAT_TA_17250.pep
VHSTPQNQRKSQREHQRLKERARNKTLTPPPISLTNLHFTVTARAVRSSERRQTTLALRPCPCCACPMPRFSTTLVVSYTGSSSLYPAPGGTAAAANSPARTGRSWRRCSPRRPPRRSHLXRRSTSAQRHLRGQPGTSXGSRRCHNXRRCVPXSRVL

SEQ ID NO: 122833 - protein, 60 aa, Triticum aestivum
  Clone ID: PAT_TA_17251.pep
STKSCDHPAAVEWLDFTVVVAQWLEIRSVSDLKTKLGHVIVLVLLVGISEKSKRVTITSC

SEQ ID NO: 122834 - protein, 121 aa, Triticum aestivum
  Clone ID: PAT_TA_17252.pep
FCCFVDKHTEGIISFSPRGRWRGLLQLQRGPGAHGVPHTVPQLPVRLMEQKGRCASNGAGSMRKRTGRGGSTRCHIQKARTHGCDSKVGEECAVYLGAMQDGYGTVVGPTWSILIIMENDG

SEQ ID NO: 122835 - protein, 178 aa, Triticum aestivum
  Clone ID: PAT_TA_17253.pep
MQDHIQMPGGRYDGRESFSNETDQLPGPFSNLTALQGSFAAKGLTSDEMVTLSGAHTIGRARCLFFSSRFSEMDSALAAKLRAQCGNDNDNVNQDDVTPNVLDKQYYQNVVDKKVLLTSDAVLNSTETITQVTENANMDGAWERKFEKAMGTMGKIGVKTIGNQQGAEIRKVCWRVNN

SEQ ID NO: 122836 - protein, 328 aa, Triticum aestivum
  unsure (1)..(328): unsure at all Xaa locations
  Clone ID: PAT_TA_17254.pep
GYPPTTRCSVAPGRTFRRGRRRPAPSGSGLTSGYYNTRCAXARIRFVTDAVKKAVDANPGIGAGLXRLFFHDCFVRGVRLGSVLLNTTNLQGTGDTERXGPPNQNSLRGFEXVVDEAKAAXEAACPDTVSCADIVAYAARDASYFLSDXKINIQLAGAGRYDGRXSPFSNETDQLPGPFSNLTALQGSFAAKGLTSDEMVTLSGAHTIGRARCLFFSSRFSEMDSALAAKLRAQCGNDNNNVNQDDVTPDVLDKQYYQNVVDKKVLFTSDAVLNSTETITQVTENANMAGAWERKFEKAMETMGKIGVKTIGNQQGAEIRKVCWRVNS

SEQ ID NO: 122837 - protein, 276 aa, Triticum aestivum
  unsure (1)..(276): unsure at all Xaa locations
  Clone ID: PAT_TA_17255.pep
MYRDPNPFDEGADDSAFSNGGGRGGAAGGGGGKSQFQFRPTEPVGFGAGGNGDAAVDIPLDNMNGSNGKQSELSQWQADLKRREADIKRREEALKSAGVPMEDKNWPPFFPIIHHDIAHEIPXNAQRLQYLAFASWLGIVLCLVWNFIAVTVCWIRGGDSKLFFLATIYGMLGVPLSYLMWYRPLYRAMRTDSAFSFGWFFLCYMLHIGFCIIAAIAPPIVFRGKSLTGILAAIDTFSDHALVGILYFVGFALFSLETVVSIWVLQRVYMYFRGHK

SEQ ID NO: 122838 - protein, 103 aa, Triticum aestivum
  unsure (1)..(103): unsure at all Xaa locations
  Clone ID: PAT_TA_17256.pep
CCVXQTCQAPGSPSRSFSCHRALACISLSSVSRFSPTFAPTIGLSSSELGRSLFPLLLSRLVAAVGLNPAVLGLDLLHVSVCRWPCPAMFRYVFVALYSFHES

SEQ ID NO: 122839 - protein, 162 aa, Triticum aestivum
  Clone ID: PAT_TA_17257.pep
LAAYSRKQRRQAAAAQRVLRTRRHGVHDGRRLRGGLRAQERLQGEAEAHGPSRSRGGARRRKEQQGRRRGRWREEGGWWCEHQGAILWPHEEEGAPQTQSGGGGGHFLLIILLLYLPCHEIVSRSFLLARSVCVGLFFRSASLGGVCKASSFVNCSKQVDGN

SEQ ID NO: 122840 - protein, 119 aa, Triticum aestivum
  Clone ID: PAT_TA_17258.pep
SRGSSRRCFGFGVHLLLDEAKEASPAARTTTNSSLILSSGAGGLHVLPALRAVERRRRGFGLVHAPQLLLVGVLEHVGLHKVSSHHGRHISFSNKFFLRCLLLPNCFGTCVGGFRPPAG

SEQ ID NO: 122841 - protein, 168 aa, Triticum aestivum
  Clone ID: PAT_TA_17259.pep
INLLRLQSKKKKKKKETLDGPGDPPTHKSQSNLEAPSILARLPVASSLLKEAAAAAAQRVLRRRRHGVHDGRRLRGGLRAQERLQGEAEAHGPSRSRRGARRRKEQQGRRRCRWREEGGWWCEQQGRILWPHEEEGAPQTQSGGGGGHFLLIILLLYLPCHEIVSRSC

SEQ ID NO: 122842 - protein, 114 aa, Triticum aestivum
  Clone ID: PAT_TA_17260.pep
GEEELIRNGVHDGRRLRGGLRAQERLQGEDEAHGPSGSCGSGARQRKERQGQGGCRRRWREEGCWWWWCEQQGRLLWPHEEEGAPQTQSGGGAHFLLIILLLYLPCHEIVSRSW

SEQ ID NO: 122843 - protein, 167 aa, Triticum aestivum
  Clone ID: PAT_TA_17261.pep
TNEQNNLQTLQPVTYTLLQHKVSLASEKLIERTNIHTHTLLARRKLRLTTWWHGEYSSIIKRKWPRLLLWVWGAPSSSRGQRSLPCCSHHHRRQQQPSSSLQRHRRRPWCSLRRRSFGLVHAPQLLLVGVPEHVGLHEVSSHHGRHALSAPPLLLLNYSCCCRCFLV

SEQ ID NO: 122844 - protein, 234 aa, Triticum aestivum
  unsure (1)..(234): unsure at all Xaa locations
  Clone ID: PAT_TA_17262.pep
CSAVNGLLKKXYELSVLCEAEIALIVFSARGRLYEYASNSTRTTIDXVQEVLXASASGSAPAIDVNSQQYFQQESAKLRHQIQSLQNANXXLMXXNXVGNLTLKELKSLEXTXLDKXHXGRIRAKKHELLFAEIEYMQKLEADLQSENMYLRAKXADAERLALAAPPPSSGGAELEVLPTFDARTYYHHQAVSMLQDAAAASSSSRYSQSSQAAAAAATTALHLGYQIKGGQLN

SEQ ID NO: 122845 - protein, 234 aa, Triticum aestivum
  Clone ID: PAT_TA_17263.pep
MEKPGVDEHPLLVERDENTAAPEAKRLLRLAGPLVASGILQCALQLVSVMFVGHLGELPLAGAALATSLANVTGFSLLVGMASALDTLCGQAFGARQYHLLGVYKQRAVLVLALACIPIALVWANTARILLLLGQDPAIAAEAGAYARWLIPALVPYVPLTCHIRFLQTQSIVVPVMASSAVTSLSHVAVCWALVHRAGMGSKGAALATAVSYSANLAILSLYTRLSGVCKTTW

SEQ ID NO: 122846 - protein, 103 aa, Triticum aestivum; identical to SEQ ID NO: 107316
  Clone ID: PAT_TA_17264.pep

SEQ ID NO: 122847 - protein, 72 aa, Triticum aestivum
  Clone ID: PAT_TA_17265.pep
MVTRWSQKSPGLKILWIWTLGTAAIMITNVVRTRVNDMQMILREEDEAVGSGGGGTGGGPSGERVMRDDELN

SEQ ID NO: 122848 - protein, 229 aa, Triticum aestivum
  unsure (1)..(229): unsure at all Xaa locations
  Clone ID: PAT_TA_17266.pep
CGGISFLIGAALNAAAADLTTLILGRVMLGVGIGFGNQAVPLYLSEMAPAHLRGGLNMMFQLATTLGIFSANMINYGTQKIXPWGWRLSLGLVAAPALLMTVGGFLLPETPNSLIERGHVEEGRRVLELIRGTTDVDAEFTDMAEASELANTIKHPFRNILERRNRPQLVMAVCMPAFQILTGINSILFYAPVLFQSMGFGASGSLYSSMLTGAGLLFSTLISIATGDR

SEQ ID NO: 122849 - protein, 107 aa, Triticum aestivum
  Clone ID: PAT_TA_17267.pep
MTVHVIKNLAEFRDHLEKHEVVIVDFWAPWCGPCRFISPVVERMSEQHGNDKVFFVKVDVDEAEDISQEYGIRAMPTFMVFKDGEKVGEIVGADPNKLEQMVRQFAS

SEQ ID NO: 122850 - protein, 106 aa, Triticum aestivum
  Clone ID: PAT_TA_17268.pep
MAQKVVLRIPTMTDEKTKQKAMEAVADIYGIDSIAADLKDNKMTVIGAMDTVAIAKRLKKLGKIDIVSVGPAKEEKKPAPAAEKKGEEKKDDKKEEKKDDKKADKK

SEQ ID NO: 122851 - protein, 374 aa, Triticum aestivum
  Clone ID: PAT_TA_17269.pep
MHARNTRRTHARMQACNTATHPFNRDPTHPVILTTGASPLLRSTRARARPAAMTAKGGASPAPGGAGAAANGRFFTVGLVTAWYSSNIGVLLLNKYLLSNYGFKYPIFLTMCHMSACALFSYAAIAWLRIVPMQLVRSRVQLAKISALSLVFCGSVVSGNVSLRYLPVSFNQAVGATTPFFTAVFAYIMTVKRESWITYLTLVPVVTGVVIASGGEPSFHLFGFIMCIGATAARALKTVLQGILLSSEGEKLNSMNLLLYMAPIAVILLLPATLFMEDNVVGVTIELAKKDFTIVWLLLFNSCLSYFVNLTNFLVTKHTSALTLQVLGNAKGAVAVVVSILIFKNPVSVTGMLGYTLTVIGVILYSESKKRSKP

SEQ ID NO: 122852 - protein, 57 aa, Triticum aestivum
  Clone ID: PAT_TA_17270.pep
EISHRGQMFMLRRPSEELTGHAAAVMSDVLVNAECNGVIDAAQKRLLLHEIALRLSS

SEQ ID NO: 122853 - protein, 277 aa, Triticum aestivum
  Clone ID: PAT_TA_17271.pep
MDNEVISNGSAKDYLDPPPAPLVDAGDLGKWSLYRAVIAEFTATLLFVYVAVATVVGHKRQTDAQACSGAGVLGIAWAFGGMIAVLVYCTAGISGGHINPAVTFGLLLARKVSLPRAFLYMVAQCVGAICGAALVRAVHGGHQYVLYGGGANELAPGYSRTAGLIAEIAGTFVLVYTVFSATDPKRIARDPHVPVLAPLLIGFAVLMAHLATIPVTGTGINPARSFGAAVVYNGGKAWDDQWIFWVGPFIGAAVATVYHQYILRNSAIFRSNYDASV

SEQ ID NO: 122854 - protein, 123 aa, Triticum aestivum
  Clone ID: PAT_TA_17272.pep
GANSVAPGYTKGDGLGAEIVGTFVLVYTVFSATDAKRSARDSHVPILAPLPIGFAVFLVHLATIPITGTGINPARSLGAAIIYNKKQAWDDHWIFWVGPFIGAALAAIYHVVVIRAIPFKSRD

SEQ ID NO: 122855 - protein, 143 aa, Triticum aestivum
  Clone ID: PAT_TA_17273.pep
NPDNESFLVPVISQIYRRLVDLLSVPAFDAQAAAVSALYNVSEVNMDCRLKLASERWAVDRLLKIVKAPHPVSEVCRKAAVILESLVSEPQNRMHLLVHENNFAEILTSEGKYSDTFARILYELTARPSNKVTSGQAIWGNIN

SEQ ID NO: 122856 - protein, 104 aa, Triticum aestivum
  Clone ID: PAT_TA_17274.pep
VGTFVLVYTVFSATDAKRSARDSHVPILAPLPIGFAVFLVHLATIPITGTGINPARSLGAAIIYNKKQSWDDHWIFWVGPFTGAALAAIYHVVVIRAIPFKSRD

SEQ ID NO: 122857 - protein, 225 aa, Triticum aestivum
  unsure (1)..(225): unsure at all Xaa locations
  Clone ID: PAT_TA_17275.pep
MEGKEEDVRLGANRYSEHQPIGTAAQGGGADEKDYKEPPPAPFFEAGELTSWSFYRAGIAEFLATFLFLYISVLTVMGVVGNPSGSKCGTVGIQGIAWSFGGMIFVLVYCTAGISGGHINPAVTFGLFLARKLSLTRAVFYIVMQCLGPICGAGVVKGFQXHLATIPITGTGINPARSLGAAIIYNKKQAWDDHWIFWVGPFIGAALAAIYHVVVIRAIPFKSRD

SEQ ID NO: 122858 - protein, 295 aa, Triticum aestivum
  unsure (1)..(295): unsure at all Xaa locations
  Clone ID: PAT_TA_17276.pep
MEGKEEDGRLGANRYSERQPIGTAAQGGGADEKDYKEPPPAPLFEAEELTSWSFYRAGIAEFLATFLFLYISVLTVMGVVGNPSGSKCGTVGIQGIAWSFGGMIFVLVYCTAGISGGHINPAVTFGLFLARKLSLTRAVFYMVMQCLGAICGAGVVKGFQTTLYQGNGGGANSVAPGYTKGDGLGAEIVGTFVLVYTVFSATDAKRSARDSHVPILAPLPIGFAVFLVHLATIPITGTGINPARSLGXAAIIYNKKQAWDDHWIFWVGPFIXAPALAAIYHVVXVIRAIPFKSRD

SEQ ID NO: 122859 - protein, 292 aa, Triticum aestivum
  Clone ID: PAT_TA_17277.pep
MEGKEEDVRLGANRYSERQPIGTAAQGGGADEKDYKEPPPAPLFEAEELTSWSFYRAGIAEFLATFLFLYISVLTVMGVVGNPSGSKCGTVGIQGIAWSFGGMIFVLVYCTAGISGGHINPAVTFGLFLARKLSLTRAVFYMAMQCLGAICGAGVVKGFQTTLYQGNGGGANSVAPGYTKGDGLGAEIVGTFVLVYTVFSATDAKRSARDSHVPILAPLPIGFAVFLVHLATIPITGTGINPARSLGAAIIYNKKQAWDDHWIFWVGPFIGAALAAIYHVVVIRAIPFKSRD

SEQ ID NO: 122860 - protein, 292 aa, Triticum aestivum
  Clone ID: PAT_TA_17278.pep
MEGKEEDVRLGANRYSERQPIGTAAQGGGADDKDYKEPPPAPLFEAEELTSWSFYRAGIAEFLATFLFLYISVLTVMGVVGNPSGSKCGTVGIQGIAWSFGGMIFVLVYCTAGISGGHINPAVTFGLFLARKLSLTRAVFYMVMQCLGAICGAGVVKGFQTTLYMGNGGGANSVAPGYTKGDGLGAEIVGTFVLVYTVFSATDAKRSARDSHVPILAPLPIGFAVFLVHLATIPITGTGINPARSLGAAIIYNKKQSWDDHWIFWVGPFTGAALAAIYHVVVIRAIPFKSRD

SEQ ID NO: 122861 - protein, 292 aa, Triticum aestivum
  Clone ID: PAT_TA_17279.pep
MEGKEEDVRLGANRYSERQPIGTAAQGGGADEKDYKEPPPAPLFEAEELTSWSFYRAGIAEFLATFLFLYISVLTVMGVVGNPSGSKCGTVGIQGIAWSFGGMIFVLVYCTAGISGGHINPAVTFGLFLARKLSLTRAVFYMVMQCLGAICGAGVVKGFQTTLYQGNGGGANSVAPGYTKGDGLGAEIVGTFVLVYTVFSATDAKRSARDSHVPILAPLPIGFAVFLVHLATIPITGTGINPARSLGAAIIYNKKQAWDDHWIFWVGPFIGAALAAIYHVVVIRAIPFKSRD

SEQ ID NO: 122862 - protein, 323 aa, Triticum aestivum
  unsure (1)..(323): unsure at all Xaa locations
  Clone ID: PAT_TA_17280.pep
MEGKEEDVRLGANRYSERQPIGTAAQGADDKDYKEPPPAPLFEAEELTSWSFYRAGIAEFLATFLFLYISVLTVMGVVGNPSGSKCGTVGIQGIAWSFGGMIFVLVYCTAGISGGHINPAVTFGLFLARKLSLTRAVFYMVMQCLGAICGAGVVKGFQTTLYMGNGGGANSVAPGXYTKGDGLGAEIVGTXFVLVYTVFSATDAKRSARDSHVPILAPLPIGFAVFLXVTWATIPITGTGINPARSLXGAAIIYNKKQSWDDHWIFWVGPFTGAXALAAIYHVVVIRAIPFKSPRLAYSIGHGTDGILSFIRPSVCADRCSLR

SEQ ID NO: 122863 - protein, 295 aa, Triticum aestivum
  unsure (1)..(295): unsure at all Xaa locations
  Clone ID: PAT_TA_17281.pep
MEGKEEDVRLGANRYSEHQPIGTAAQGGGADEKDYKEPPPAPFFEAGELTSWSFYRAGIAEFLATFLFLYISVLTVMGVVGNPSGSKCGTVGIQGIAWSFGGMIFVLVYCTAGISGGHINPAVTFGLFLARKLSLTRAVFYIVMQCLGAICGAXGVVKGFQTTLYQGNGGGANSVAPGYTKGDGLGAEIVGTFVLXVYTVFSATDAKRSARDSHVPILAPLPIGFAVFLVHLXATIPITGTGINPARSLGAAIIYNKKQAWDDHWIFWVGPFIGAALAAIYHVVVIRAIPFKSRD

SEQ ID NO: 122864 - protein, 294 aa, Triticum aestivum
  unsure (1)..(294): unsure at all Xaa locations
  Clone ID: PAT_TA_17282.pep
MEGKEEDVRLGANRYSEHQPIGTAAQGGGADEKDYKEPPPAPFFEAGELTSWSFYRAGIAEFLATFLFLYISVLTVMGVVGNPSGSKCGTVGIQGIAWSFGGMIFVLVYCTAGISGGHINPAVTFGLFLARKLSLTRAVFYIVMQCLGAICGAGVVKGFQTTLYQGNGGGANSVAPGYTKGDGLGAEIVGTFVLVYTVFSATDAKRSARDSHVPILAPLPIGFAVFLVHLATIPITGTGINPARSLGXAAIIYNKKQAWDDHWIFWVGPFIGRGAXRAIYHVVVIRAIPFKSRD

SEQ ID NO: 122865 - protein, 292 aa, Triticum aestivum
  Clone ID: PAT_TA_17283.pep
MEGKEEDVRLGANRYSEHQPIGTAAQGGGADEKDYKEPPPAPFFEAGELTSWSFYRAGIAEFLATFLFLYISVLTVMGVVGNPSGSKCGTVGIQGIAWSFGGMIFVLVYCTAGISGGHINPAVTFGLFLARKLSLTRAVFYIVMQCLGPICGAGVVKGFQTTLYQGNGGGANSVAPGYTKGDGLGAEIVGTFVLVYTVFSATDAKRSARDSHVPILAPLPIGFAVFLVHLATIPITGTGINPARSLGAAIIYNKKQAWDDHWIFWVGPFIGAALAAIYHVVVIRAIPFKSRD

SEQ ID NO: 122866 - protein, 292 aa, Triticum aestivum
  Clone ID: PAT_TA_17284.pep
MEGKEEDVRLGANRYSEHQPIGTAAQGGGADEKDYKEPPPAPFFEAGELTSWSFYRAGIAEFLATFLFLYISVLTVMGVVGNPSGSKCGTVGIQGIAWSFGGMIFVLVYCTAGISGGHINPAVTFGLFLARKLSLTRAVFYIVMQCLGAICGAGVVKGFQTTLYQGNGGGANSVAPGYTKGDGLGAEIVGTFVLVYTVFSATDAKRSARDSHVPILAPLPIGFAVFLVHLATIPITGTGINPARSLGAAIIYNKKQAWDDHWIFWVGPFIGAALAAIYHVVVIRAIPFKSRD

SEQ ID NO: 122867 - protein, 340 aa, Triticum aestivum
  unsure (1)..(340): unsure at all Xaa locations
  Clone ID: PAT_TA_17285.pep
RTRGRTRGSTFQKFKSFLNKGNDPSCLREFLLPILSQNSPSGNIGLQMLDRHWGAGWNLLALLLATKSDKRISCVDALRHPFLCGPKWRISPTVNVVRWGLGSTAVRLAEEYSKGDGPRRGLAYFIELMXEVLNPNSSTENWLRLLPGRWCLLYCTGRHIGLTLRQPTPRVLISDAFLTFAEAPESVDPILSLTSDIXFKIMPESDWPHDKSGTEGNLSVTTSARITPGRIYTNAEDGKESSSRITSSRYLGGKWGKAAKMKELPASLPTASVNVDEDDVDVSMSCGSTLNVKSARNVLQEVRTQTPPEMFDLSKIVCGTYIDPRLMVLRGVKGPAKLCR

SEQ ID NO: 122868 - protein, 258 aa, Triticum aestivum
  Clone ID: PAT_TA_17286.pep
MDDYAREMMELKTLVTRTLEKKGVLAKIRAELRASVFEAIEEEDRVIEENEDGGNPALLGSCNDRAKQLHASPSGRLLTALIGEYLEWAQLSHTMKVYLPECNLPKDFWKNELKDFSNKNGAEGSRSAESGPMLLDVLEGYLKYENLSQTRMAGRRMINSEPEPTLNTEHRNMRRPPSSSSVAGMPPMGRQMPPSQTSDRRGGSSASNTRKDEYNWGYDADDLSEEVLRTSTALENIQLDRKARNLTTSWRHPGNGAE

SEQ ID NO: 122869 - protein, 121 aa, Triticum aestivum
  Clone ID: PAT_TA_17287.pep
RVYRILQSTSCQTQGKEEAGATMMNPSRCALERTSSVTGEEGGVPWRRQPGPHLLDLTVTRIWGGDNLLVSHQLLLGRAWRRSTCVGAPCCLGRAIHGDIAQVPVRSAGGWRRGMMGEDDL

SEQ ID NO: 122870 - protein, 56 aa, Triticum aestivum
  Clone ID: PAT_TA_17288.pep
MCRKATCGTCNKTSWWGCGSHIPSVMDNIPDADRCACEPKVEVGGVSYPPMAASPN

SEQ ID NO: 122871 - protein, 353 aa, Triticum aestivum
  Clone ID: PAT_TA_17289.pep
MGSISDDEAACIYAMQLAAAAVLPMTLKNAIELGMIEILVGAGGKMLSPSEVAAQLPSTANAEAPAIVDRMLRLLASHNVVSCEVEEGKDGRLARRYGTAPVCKWLSPDEDGVSLAPMVLLNDKVMLESWYHLKDTVLNGGLPFEKAYGMTAFDYQGTDPRFNRVFNEAMKTHSMIITKKLLEFYKGFDGVGTLVDVGGGVGATIHTILCRYPSIEGVNFDLPHVISEAPSFAGVHHIGGDMFKKVPSGDAILMKWILHDWNDEHCTTLLSNCYDALPAHGKVVIVEYILPVKPDETATAQRSFEADMIMLTHTPGGKERYLREYEELARSAGFASVKATYVYSNIWVIELNK

SEQ ID NO: 122872 - protein, 240 aa, Triticum aestivum
  Clone ID: PAT_TA_17290.pep
MLPGRIAPPAHRRPVLPTPPPPTLHLRLGARLPPHGGRRLAVRLGSRRRRNRYRIPHDHPAPHPHADRPSTLLEHRPTHPLPSPQPQRVRSFGIAGVGSVACIPNMRARNPTNMCSPDLDELIAPLNSKVKGMVDTLNTNLPRAKLIYIDNFEMISEVLRSPFNYGFSVVDRGCCGIGRNRGVITCLPFLRPCPNRNTYIFWDAFHPTERVNVLLGKAAYSGGTDLAYPMNIQQLAAWQP

SEQ ID NO: 122873 - protein, 126 aa, Triticum aestivum
  Clone ID: PAT_TA_17291.pep
RDEAQIGHDQHPQPGSRSCSSSIFFSAGSPGKGRTLPSIEPILSSRDGSRGERRRARCRRGAGRSEQGGGVGGRGRRRQEGRPGRGLPAHGRRARRHLPRALIDRSVDGRRLGEFIFVSLHLCINL

SEQ ID NO: 122874 - protein, 71 aa, Triticum aestivum
  unsure (1)..(71): unsure at all Xaa locations
  Clone ID: PAT_TA_17292.pep
MVFVDSVLYIKKKKKNSRGGPVPNSPYSESYYNSLAVVLQRRDWENPGVTQXNRLAESPFRSWRNXERXDD

SEQ ID NO: 122875 - protein, 70 aa, Triticum aestivum
  Clone ID: PAT_TA_17293.pep
RQNIVRTAGIHPSIGCISEGSPFYLAANTSSRYRSNTCIHRSQPYGSQQTRMLAMMVRWIKPQVCRRRWH

SEQ ID NO: 122876 - protein, 209 aa, Triticum aestivum
  unsure (1)..(209): unsure at all Xaa locations
  Clone ID: PAT_TA_17294.pep
GTSHFFTGGPQTDNIMVAATATEMFLVCFESLCPCFRSKRKDGSEDPVLAKDGNSLSSSEMRSISDRIPSSPLRVPASPSRFSLSSPPSRNDPLNLSLETVIKLTRNFSPALMIGESYFGKAYRXXLQNGLVVAIKRARKEHFASLHAEFKNDLXLLXKIEHRNLVQLLGYIDKGNERIVITDLCQMXTPXEHLDGXHGLIMGFSQRLE

SEQ ID NO: 122877 - protein, 217 aa, Triticum aestivum
  unsure (1)..(217): unsure at all Xaa locations
  Clone ID: PAT_TA_17295.pep
LAWSRPRSGTAVQKSGGWFGFISDAMEVVLKILKDGLSAVHVPYAYGFAIILLTIVVKAATLPLTKQQVESTMAMQNLQPQLKAIQARYAGNQERIQLETARLYKQAGVNPPXQGCLPTLATIPVWIGTLXKALSNVANEGLLTEGFFWIPSLGGPTTIAARQSGAGISWLLPFVDGHPPIGWHDTICYPVLPVLLVASQFVSMEIMKPPQSTDPSQ

SEQ ID NO: 122878 - protein, 88 aa, Triticum aestivum
  Clone ID: PAT_TA_17296.pep
LEKKIKKLVDLYYLALDAPKAGTKINVPAELTPKKYPHYMDRKESYHSTSILGKIYDEAEKKQSEKVEPVEILLDPYFTERAASSGYK

SEQ ID NO: 122879 - protein, 202 aa, Triticum aestivum
  Clone ID: PAT_TA_17297.pep
TTATTRAAAAAPHESPYCRGCRLVPDFPFAGEEGRRTRSLQSTAARFGEQPSHPLQTDHVAPVGHPPTREGLRHHGMGTLLPATTRWALPPQARPRQVGRGWTRRLPSLQSTRAASRGSSEDEQCGVGRTWKGSMPGAGGEAVDVQIGTDPRLLVGGEAAGRPEHGRRLSRRLDRTTMEELQNLMVPHRQKGLLRPKVARGR

SEQ ID NO: 122880 - protein, 101 aa, Triticum aestivum
  Clone ID: PAT_TA_17298.pep
WLGRYWSIILACTLYVLGYGMITLASTLLTQRPSSTLDNDSSSNPMSPQCRQHVHGLAQQLLALPASPSLLRFSVGVGGAMEGEISDICLGAWLRAACVVK

SEQ ID NO: 122881 - protein, 124 aa, Triticum aestivum
  Clone ID: PAT_TA_17299.pep
MRTAAEAHQSRLLYELGALLLTILRSPLGPGEEGQGPPRQVTAAGVASMMLGASMALMLCGSVTFMLGFFLMPWVVGLACVFLFVGFLTNLSGIWRAILCWPAASSSPHKDASTWHIFPKPPFM

SEQ ID NO: 122882 - protein, 126 aa, Triticum aestivum
  Clone ID: PAT_TA_17300.pep
YRLSNIEETNTLKSQLPLRFLFDTLRVFDVLVSTTGFDTTKLALPCAENQYILYGSSGCWTKDSIASVCIASSACCKLRSLRAAFEQWGAQLMVNFRYGWVFLCALVLVALLRGAEIWQVKTHGDD

SEQ ID NO: 122883 - protein, 99 aa, Triticum aestivum
  unsure (1)..(99): unsure at all Xaa locations
  Clone ID: PAT_TA_17301.pep
MYGDGSTTTGYFVSDLLQYNQVAGDGQTRHGNGSXXFGCGAQQGGDLGNTNQALDGIIGFGQSNTSMLSQLAAAGKVKKIFSHCLDTITGGGIFAIGEV

SEQ ID NO: 122884 - protein, 196 aa, Triticum aestivum
  Clone ID: PAT_TA_17302.pep
MTQPSAQPQLTPQFCFSYGTLRDFLRLSRSSIDDSITQNLNALLTPSRFGFDPSSTLQRTSRPVSKQIDSRSCSEFKEKVLFPSWEARAQVLNYCALVAASPDPDDPDRTIRELEREQDRDRIVDERLDPYSGRFFPREARTERLASLVRQERGVEDIVRHRTWEVVQERCGGEPFKNWEDNISKWRKAQNSKPSV

SEQ ID NO: 122885 - protein, 183 aa, Triticum aestivum
  unsure (1)..(183): unsure at all Xaa locations
  Clone ID: PAT_TA_17303.pep
RAARAEFGTSSALCRKDGGVVRALDPMGTPSKPLHRCSIPVADDPDAVVIPKRTPNAIVKKLSYITVDKRDKDSPPLFGGRQTWKQREESFKLNATMKVHCGFMKNSGADMDAVDVEYIQKCKFVVASGIFDGYDVPHQPSNISFRSQKLFCFLMVVDEXVSFDFMEQNVTVKVDSAXGKWVG

SEQ ID NO: 122886 - protein, 61 aa, Triticum aestivum
  Clone ID: PAT_TA_17304.pep
SPSLSNLYRSRMPVLCSFKISVLWHLLNKFFLLRLIQVEVVLWFNTGGLTNTKWESLCNMC

SEQ ID NO: 122887 - protein, 137 aa, Triticum aestivum
  Clone ID: PAT_TA_17305.pep
PPSSSSSSSSKPSSGLVLLVAMALRTVAAKLKAPVASLKQAWAVCRPQAKHPLEGLNVDPLTLQEMKALERAVRAGEMKQTLVTIGFMGCLTGTVVHVLHSDLAAREATAEADAEAAVREVLESLDSDVNAVGTNKD

SEQ ID NO: 122888 - protein, 76 aa, Triticum aestivum
  Clone ID: PAT_TA_17306.pep
PPSSSSSSSSKPSSGLLVAMALRTVAAKLKAPVASLKQAWAVCRPQAKGPKLSKGLDVDLSDATHPPGFCTRTQSY

SEQ ID NO: 122889 - protein, 129 aa, Triticum aestivum
  unsure (1)..(129): unsure at all Xaa locations
  Clone ID: PAT_TA_17307.pep
TDKSSEACIILCCERXXQSCMCALFPFPEDKSGEVAAIAVSEECRGRGLGDKLLERPPGQALSLGLGRLFLLTTRTADWFVRRGFSECSIESIPEQRRKRINLSRGSKYYIKQLQPKHAGVPVNNFAGR

SEQ ID NO: 122890 - protein, 158 aa, Triticum aestivum
  Clone ID: PAT_TA_17308.pep
MDITVSDLHNKSSHGNNVPKEGEGISQAVKLELGKEKSSSGNQELNRKHSKGDKSSTHPAESVDSWKKPAPDPGNNSTAGPPGPVHKKVEMFVKENIRPLCKSGVITVEQYRWAVAKTAEKVMKHHSEAKNANFLIKEGDKVKKLALQYVEAAQQKIS

SEQ ID NO: 122891 - protein, 95 aa, Triticum aestivum
  Clone ID: PAT_TA_17309.pep
EDLAALDSRRRRRRCAASSPRRRAASPPSRRATRRLDAGDLLRHTGLLTGGLLRVFAAFQAGVRCFPRAPWPSHLRLIRLSLCLLWWMRSMALCS

SEQ ID NO: 122892 - protein, 91 aa, Triticum aestivum
  Clone ID: PAT_TA_17310.pep
YLLVSLQDISSFLGSLYDTAPPYNDERNKSFLLGVFVVTTTDNRVHPSRVQKLVYKFGKGMKPPQLQSIGSTPRCNQAASWVLFFEHVTVR

SEQ ID NO: 122893 - protein, 142 aa, Triticum aestivum
  unsure (1)..(142): unsure at all Xaa locations
  Clone ID: PAT_TA_17311.pep
MALLQYQRENIHYLSEEVXRLQECLSKYQRTDVGNTPQVDLVHLLAARDPARGALSAEMNQVHSELQLARGLIDEKDSEIQRIRLSNSQYVEENDRLRAILGEWSSRAAKLERALEAERLSNIELRKNIAKFRGQLHKEQHA

SEQ ID NO: 122894 - protein, 93 aa, Triticum aestivum
  Clone ID: PAT_TA_17312.pep
TRRRQELGLDNKPQNQQLNQQQQHQQQQQQQQQQREDHGEATSAVKDSSSSSNNKSSNLQVVKKKRTVSMGVEEAAFLLMALSSSSTPPLLHG

SEQ ID NO: 122895 - protein, 139 aa, Triticum aestivum
  Clone ID: PAT_TA_17313.pep
GGRGGVASGGGGGRRQERQALMLAFAVALLMGTAVYFRIWARQSDDPSFTADDREELRRQFEHANLEAMDESAEWRMKYDTELAKNRDLQDELLKVKTSLSDSTKRFEELQKDNEMLKRQTESMKLECNCTVPLNINQE

SEQ ID NO: 122896 - protein, 71 aa, Triticum aestivum
  Clone ID: PAT_TA_17314.pep
LGVDTDECIVIEDALAGVQAAKAAEIRCIAVTTSLDEDALQQASPVFIRKDIGDISINDILYGGSNASHSM

SEQ ID NO: 122897 - protein, 104 aa, Triticum aestivum
  Clone ID: PAT_TA_17315.pep
TLTRRKLPTSSRPLHRQFFSGHLPDYILHSSPASALATFGTDATRPRMLITRCRARPEQLSAELGPASMTLSYSVSCWIYHIGPPSSDHHGKSIDRNSICKTGT

SEQ ID NO: 122898 - protein, 211 aa, Triticum aestivum
  unsure (1)..(211): unsure at all Xaa locations
  Clone ID: PAT_TA_17316.pep
AVSYLFRSLLPIPTAASAAARVRLSPPAAAPAGRNFEGYIPRSCSRSSLQIYTTRSSPLSLSPSSALMVSAQLPPADVAQRSEEWFALRKDKLTTSTFSTALGFWAGNRRSELWSEKVFGPTDVKLADAAMAAMAWGTNHESMAVEQYTSITGRSVGSLGFAVHTEAKLGWLGASPDGVLGCDPDGGILEVKCPXXKGKPELALPWRIVPY

SEQ ID NO: 122899 - protein, 41 aa, Triticum aestivum
  Clone ID: PAT_TA_17317.pep
KEAHIWMIGGVARAYERGMDSLATMLNGTRTTFFVNQKILK

SEQ ID NO: 122900 - protein, 219 aa, Triticum aestivum
  Clone ID: PAT_TA_17318.pep
YNKDGIVVYDGKGLFSAARVWWMFRAYGHDKVWVLDGGLPEWRASGYDVESSASSDAILKASAASEAIEKVYQGQSVGPATFEAKLQPHLLWNLDQVKENIEAQTHQLIDARGKPRFDGAVPEPRKGIRSGHVPGSKCVPFPQVLDSSQKLLPADDLRKRFEQEGISLDQPIVTSCGTGVTACVLALGLHRLGKTDVAVYDGSWTEWGAHPDTPVATAV

SEQ ID NO: 122901 - protein, 264 aa, Triticum aestivum
  unsure (1)..(264): unsure at all Xaa locations
  Clone ID: PAT_TA_17319.pep
AFSAAGSSLGIYNKDGIVVYDGNGLFSAARVXWMFRAFGHVKVWVLDGGLPQWRASGYDVESSASSDAILKASAASEAIEKVYQGQSVGGYEVEAKLQPHLLWNLSQVRENIETQKHQLTDAPGKFEAKFEAHLLWNLVQMKEKIETKTDPLTDARGKPRFDGAVPXEPRKGIRSGHVPGSKCVPFPQVLDSTQKLLPADDLRKRFEQEGISLDQPIVTSCGTGVTACVLALGLHRLGKTDVAVYDGSWTEWGAHPDTPVATAV

SEQ ID NO: 122902 - protein, 234 aa, Triticum aestivum
  Clone ID: PAT_TA_17320.pep
MPKSKRNRSVTLSKTKKKPGLERKGKVVTEIKDAIERHSSAYVFTFNNMRNQKLKDLRDQLKSSSRIFLAGKKVMQIALGRSPADEAKTGLHKLSKFLQGASGLLFTNLPRDDVERLFREFEANDFARTGSIATQTVELKEGPLEQFSHEMEPFLRKQGLPVRLNKGVVELVADHVVCEEGKPLSPEAAHTLRVLGRKMATFRLYLVCRWSSDDFEVYKEGLAHLGGEEADESS

SEQ ID NO: 122903 - protein, 157 aa, Triticum aestivum
  unsure (1)..(157): unsure at all Xaa locations
  Clone ID: PAT_TA_17321.pep
DAWADAWERVDDRGIIIRSWAPQTAILAHASXGAFVTQCGWNSVLEAVAAGVPMLTWPKVYEQFITERLLTDVLGIGERLWPHGAGLRSEDYEKHEVIPADDVARALLTFMHPGGPGEVMRTRVMDLASKSRAAMAEGGSSQNDLHRLVNDLIAARG

SEQ ID NO: 122904 - protein, 240 aa, Triticum aestivum
  Clone ID: PAT_TA_17322.pep
MASSTTSSGSKTLRVLLLPHFATGHIHPFTELAVSLAVSSPNATVEAIIAVTPANVPIVQSLLERHSAATVKIVTYPFPTVEGLPKGVENLGKAATQADSMRINIAASTESLMRPAHETLVRAQSPDAIITDLLFTWSADIADELGVPCVTFHVTGAFSMLAMRHLMMEDAAIDGDDTVTVPPFPTPQIRVPRTELPDLSIFRYIFGKVHSMQAACFGLAVNTFSGLEQQYCDMYMGQGY

SEQ ID NO: 122905 - protein, 474 aa, Triticum aestivum
  unsure (1)..(474): unsure at all Xaa locations
  Clone ID: PAT_TA_17323.pep
MAACPTMPPQQHSPCPAIAQLCHCPHPPLDRAPPWPRPRRPRPNATGRSNHRSDPGERSDLTSPFLRIVRYPFPTVEERPAGAENNGKAATDEEAMLINLAASSGAPLRRGPGRRSSGRSPDATITDMLFPWSSDIADALGVPCVPIHVPLALPMLAMRHRMMEDAAIDGDDIVTAPPYPTPHIRVPRTEXLPDLSIFRDSLLSRFIPCKAACFGLAVNTFSGLEQQYCDMYTGQGYVQRSYFVGPQLQSSESPTGDSKSQCIGWLDTKSDHSVVYVSFGSCALVSDAQLDQLALGLEASGKPFLWVVRAADKWTPPKGWEKRVEDRGVIIRSWAPQTAILAHPAVGAFLTHCGWNSVLEAVAAGVPMLTWPKVHDQFVNERLITDVLGIGDRLWPHGAGLRSEDYEKHELIPADDVARALLTFMHPGGPGDVMRTRVMDLASKSHGALAEGGSSQQDLHRLVNDLMAAKEGRN

SEQ ID NO: 122906 - protein, 103 aa, Triticum aestivum
  Clone ID: PAT_TA_17324.pep
NSRGKSMDRAAAATAAFSRVRPLGSGKLTMDPPACAFPGRRPPQLRGQGRSVVKDHDLAAGAFHRGARWLQRGGDRPAAAFPLRWRRSLRQLVGQDRHRLYQL

SEQ ID NO: 122907 - protein, 155 aa, Triticum aestivum
  Clone ID: PAT_TA_17325.pep
SSQQSVIFMLISSKVHEGRTRDLDSVHFSQTLNLRTVWLMWLLVELKRKSMDHAAVAAAAFSRRVRPLGSGKLTMDPPACAFPRRWRRSLRLLRPHELVGQDRHRLYQLNQLGEERGWSGGRHCCAWPSRQFTVHRLGDRGRERRRCPALLFRAN

SEQ ID NO: 122908 - protein, 148 aa, Triticum aestivum
  Clone ID: PAT_TA_17326.pep
LARKRSAGHHLLSLSTAITETVNSELPRRPRAAMASTAPPAFLPQLVQLVQSVSVLPDQLTERSPPPQREGRSGAIAPTLQPSSAPVEGTGGQVMVLNDASSLAPQLRRTSPGEGTSGRIHRQLAGPKRPDPREGRGGGGGAIHAFSS

SEQ ID NO: 122909 - protein, 123 aa, Triticum aestivum
  Clone ID: PAT_TA_17327.pep
MSSTKKPSGKTQRSAIADVVAREYTIHMHKRLHGVTFKKRAPKAIKEIKAFATKSMGTSDVRIDPQLNKKVWEQGIKGVDYRIRVRISRRRNDEEGAKEKLYSYVQAVNVKDPKGLPTVVVEE

SEQ ID NO: 122910 - protein, 123 aa, Triticum aestivum; identical to SEQ ID NO: 122909
  Clone ID: PAT_TA_17328.pep

SEQ ID NO: 122911 - protein, 131 aa, Triticum aestivum
  unsure (1)..(131): unsure at all Xaa locations
  Clone ID: PAT_TA_17329.pep
STATRAGGGREKKKTAAGAGGATLGPASSPPACPPPAGPGPRPPPGTGSRRRTPPTPGSSASRRRRRSSSPPRRPGWACRSGRGRQSSWRSSSQCHSSPWQRVSRPEGSALLCFALLSFGVLGSYAGXRPA

SEQ ID NO: 122912 - protein, 131 aa, Triticum aestivum
  Clone ID: PAT_TA_17330.pep
RCSTRTPATFAPWCSSSPASPRPPPARSPALPSSTSAGPPAYGFAPQQQPGRPPCPSTTTSTSSGSSTPARHSATGTTCSTPSPAATRSPTGSARRTTGCSSRACRRRRCPGRAPLTTAPMATLLDRSSDY

SEQ ID NO: 122913 - protein, 193 aa, Triticum aestivum
  Clone ID: PAT_TA_17331.pep
IRRFTVIISRESATQQVLWFVVSKERQNKTAHVLTSAHLIREKDPSVKNHWKSQWTGKYHRGAGVNVHFLDKRVVPGQLVYLQEHYELALYEVEVNKPVQLPTFNDCVRSGQDVFRLGRDENLDLKITHGMTAYEVPSWYERCHYMYFCRDASSRKLLDDDGGPIIDLEGKVVGLVNNHINETFIPSSILHKC

SEQ ID NO: 122914 - protein, 190 aa, Triticum aestivum
  unsure (1)..(190): unsure at all Xaa locations
  Clone ID: PAT_TA_17332.pep
AGIPVIDLLLAPAAPXEAARLRDAAQRLGCFRVAGHGVPRALQDDMKAAVRALFDLPDDAKRCNADVISGSGYVAPTATNPLYEAFGLYDAASRADVDAFCASLHAPPHIRETIRRYAEKTHELIVDVAAKLAASLGLEESESHRMFQDWPCQFRINRYKYTPDTVGETGVQVHTDSGFLTVLHEDDRVG

SEQ ID NO: 122915 - protein, 119 aa, Triticum aestivum
  Clone ID: PAT_TA_17333.pep
VTPPGDLRCGAGILPLVHLVDSLTRSSCNVRPVVVCCQVRPPPRTPEGAVLPGHLVAREGPPPLPGGGAEFCLVGCFEVGTKDKAPCMFLRLTMFSLKCSKSGDLTLGESRPGSVLQAS

SEQ ID NO: 122916 - protein, 138 aa, Triticum aestivum
  unsure (1)..(138): unsure at all Xaa locations
  Clone ID: PAT_TA_17334.pep
MASYRLLVILVFSALLLDVAVADTYPADCPYPCLLPPPTPPASSADCPPPPSSPSGSGYVYPPPSSSGNSPPTPSSWSYPPPSGGYIPGFYQPPAGGGGGGGGGGGGXXNFGPAPPPPNPILPWYPWYYRSPPSSSAT

SEQ ID NO: 122917 - protein, 136 aa, Triticum aestivum
  unsure (1)..(136): unsure at all Xaa locations
  Clone ID: PAT_TA_17335.pep
MARTKQTARKSTGGKAPRKQLATKAARKSAPATGGVKKPHRFRPGTVALRXHRKYQKSTELLIRKLPFQRLVREIAQDFKTDLRFQSSAVSALQEAAEAYLVGLFEDTNLCAIHAKRVTIMPKDIQLARRIRGERA

SEQ ID NO: 122918 - protein, 250 aa, Triticum aestivum
  Clone ID: PAT_TA_17336.pep
MELVSSSRSTLSSCSRLVAPSRSSSTTASAAARRHGKRLLCVLGGDRNGELKIGKRAALALLLATPTLSLPFSAHAKTKTINPYDERRLLQQNKKIQEANRAPDDFPNFIREGFQVKVVTPDNYITRDSGLIYEDVKVGTGDCPKDGQQVIFHYVGYNESGRRIDSTYIQGSPAKIRLGNKSLVPGFEEGIRDMKPGGKRRLIIPPELGPPVGPSTFFSAKQFEVFDVELLSVQDCQRRTIAFYSDVVCT

SEQ ID NO: 122919 - protein, 132 aa, Triticum aestivum
  Clone ID: PAT_TA_17337.pep
LPRLCSAIQPFLPPLSVFVTALCVGSPLAINIKAVLSPYGLSIVFLLFAFHTTSFVAGYHLAGTWFRKSADVKALQRTISFETGMQSSLLALALANRFFPDPLVGVPPAVSVVLMSLMGFGLVMLWSKKTQV

SEQ ID NO: 122920 - protein, 151 aa, Triticum aestivum
  Clone ID: PAT_TA_17338.pep
ASPPLPSLSVPDSALPLPSLSLPPSDPTVEMEVPFGDIPLFLEPNEQVRNYAIRASRRAAGAKVSWTTNILPLSEVSDDIMNDKFFVETIFRNHNGGTRRFSFILNGGSTIDHVDSSVKSNIRPLLNKQLVKTLPATTTELYFCLSEFCHV

SEQ ID NO: 122921 - protein, 339 aa, Triticum aestivum
  unsure (1)..(339): unsure at all Xaa locations
  Clone ID: PAT_TA_17339.pep
MFPPMLQEVEDFFAKWGEEGVVDLKLEFEQLRYVDIRXCLLGKEVRENMFDEVYTLFREIEKGVTLISFLFPYLPTPANWQRDRARIRLTEILSNVVESRKSSGRVEEDTLQKLIDSKYKDGRPTTVEEVVGLIIGLLFAGKHTSSHTSTWTGACLLSHPAFLRAAIEEQHQVAKKYKDGLEYNAFLEMDTLHNCIKEALRKNPATPXAGSQXHKRFTVQTKEGQQYDIPQDYIVATPTIVNNNIPYIYTDPQVYDPNRFGPERREDKVGGKFSYTSFGGGRHVCTGEAYAYMQLKVIWSHLLRNFDLELVSPFPNTDWSKFLPDPQGKLLVRYTRNGI

SEQ ID NO: 122922 - protein, 228 aa, Triticum aestivum
  unsure (1)..(228): unsure at all Xaa locations
  Clone ID: PAT_TA_17340.pep
AVDGLAGXSLCKADIKPWLFSKKKGSKSLDADGAKVDIFWDLSAARFGAGPEPLEGFYVALLFDLELALLLGDMKKDAYRKTGANRPALNAAFVARKEHIYGKKIYSAKAQFCDNGQFHDLVIECDTVGLKDPCLEIRIDKKPVMQVKRLAWKFRGNQTILVDGLPVEVFWDVHSWLFGPTTASNAVFMFQTCQAPEKSMPWSYSQIFRESQLQGLGFSLILHAWKIE

SEQ ID NO: 122923 - protein, 180 aa, Triticum aestivum
  unsure (1)..(180): unsure at all Xaa locations
  Clone ID: PAT_TA_17341.pep
MQPPFPKDYIHLLKATSRGRSYYGGPDLCCQRCGALFWFREGSIHHAEATSHSPIYMGCCWAGMISLPKFGDXPTPLDRLMRFDGDAVSSQFMXLIREYNSMFCFTSLGCTXDRSINVGGAPYVFKINGVVYHRIGSLFPVEGAIPKFVQLYMVDSADEVDCRLNVFDGEETALVPNSAR

SEQ ID NO: 122924 - protein, 130 aa, Triticum aestivum
  unsure (1)..(130): unsure at all Xaa locations
  Clone ID: PAT_TA_17342.pep
GXPTXRLMASHQPAPGXSPCGHTPKPMRKGLASATLLIPWMLWKHRNDCVFDRASPSIPTLLDKDQGGGDPLGQSRRVGLRALIPQTWDVRLLLHPLSAQPPPRRRVLKPLPFQCNETQIFCVFSKKKKK

SEQ ID NO: 122925 - protein, 144 aa, Triticum aestivum
  Clone ID: PAT_TA_17343.pep
TNSSFNACTKQEYYLRVTVKEVNILSRPKHRRQHIIIHQEKEGCSSVSLFSVQFRRPLGGIVQYVHWHPSETHSPTEERPMPPWQSSMHFLGVHMPGMVGSTLQSMGSPSQWRHRRSPSPPSSPHLNIAPQGRGLVASCRTASS

SEQ ID NO: 122926 - protein, 175 aa, Triticum aestivum
  Clone ID: PAT_TA_17344.pep
MARVRNPLVVGKVIGEVIDNFNPTVNMTVTYNSDKQVSNGQEFLPSAVVSKPRIQVPGGDMRSFFTLVMTDPDVPGPSDPYLREHLHWIVTDIPGTTDASFGSEVVSYDSPMPNIGIHRFIFVLFKQKKRQAVNPRAPSTRDWCNTRRFADENDLGLPVAAVYFNAQRETAARRR

SEQ ID NO: 122927 - protein, 173 aa, Triticum aestivum
  Clone ID: PAT_TA_17345.pep
MARVLEPLVVGKVIGEVIDNFNPTVKMTVTYSSNKQVFNGHEFFPSAVVSKPRIEVQGGDMRSFFTLVMTDPDVPGPSDPYLREHLHWIVSDIPGTTDASFGREVVSYESPKPNIGIHRFTFVLFQQKKRQAMNPPSTRDYFNTRRFANENDLGLPVAAVYFNAQRETAARRR

SEQ ID NO: 122928 - protein, 217 aa, Triticum aestivum
  unsure (1)..(217): unsure at all Xaa locations
  Clone ID: PAT_TA_17346.pep
WISWYRRSRDKSISPPKSSLPSLHHYISDTHSLVSCLLFPREAVYHAFQYIHKPYTASSVQNKSFSPCFRTRADTRQQTRKGRTRSGAGTSPPPSAASSAGDPTCGPRQRRGLCSTCSAAPGRGTPTEALPLPSLQAPLRPSSGSGHAPLAKEGRQSRIRWHQDGGGAHAAVTGAEGWAPHCGGAGHHRCCFVRVGAQHSXDAPLXXEEWPXXPXPR

SEQ ID NO: 122929 - protein, 149 aa, Triticum aestivum
  Clone ID: PAT_TA_17347.pep
TKKIEIAVGEGALPMLEWLRYSASAERKDAASLVPWRRNSCPLLKFVGCCLDCTNSSYREVKEAKQALRQASGTRPNAVYLDLDIEEESYDEEAGRFIDNLVEVLGGLERPGKEGIPADEADLRDTWFGQTRGCGPCCCTPGGKDTSHD

SEQ ID NO: 122930 - protein, 87 aa, Triticum aestivum
  Clone ID: PAT_TA_17348.pep
ISATDLLILMVLTSACKFSAGASGGTRAAAAEEGRCSAIHQRGGGHSSKVDEKAWTRGLTEMLMSMKTMRRRRYFFIKVFSSIICRT

SEQ ID NO: 122931 - protein, 310 aa, Triticum aestivum
  unsure (1)..(310): unsure at all Xaa locations
  Clone ID: PAT_TA_17349.pep
MIKNAVSSLMVRLLHLPRAAPTLTYRPLLPLPPPRLRVAASASAPLAAMSTAAQQAVADQKRAVRSDVRRALKALSLDQRTSEDLAIQNNILNSSWFKASKRLCAYISCAQLREVDTSKIIAEVLSXDPEHDGQSKWDSLMFLGCGKITTARCASPYARPRMLYLGCFRYILRAASLGPPPGDARGSAGGAASSPSSPFVLLPGXQAFDRTGPGRXLGGGGYYDTSLYEIPKNLLKRKGWSQPLLVALSYSVPISGGGLLPGYPTXVPLVPRAPPPGIIPIMSCSTGGCVNEADWFPLWPCSSWQWHTLS

SEQ ID NO: 122932 - protein, 142 aa, Triticum aestivum
  Clone ID: PAT_TA_17350.pep
TTATTKTFNALRPAPANNVIALETSMNDFLHSDNASKGDSILSSFNFSMASMSLRVTIGSISIWFDFLITSGFNFSMASMSLRVSAGSIFKFREVTSLLLQKESSFLPQLAHPLRLCAFGGKEVKREGGAKDARRRRVGIDN

SEQ ID NO: 122933 - protein, 152 aa, Triticum aestivum
  Clone ID: PAT_TA_17351.pep
MAPKAEKKPAAKKPAEEEPAAEKAEKAPAAKKPKAEKRLPAGKTASKEGGEKKGKKKSKKSVETYKIYIFKVLKQVHPDIGISSKAMSIMNSFINDIFEKLAGEASKLARYNKKPTITSREIQTSVRLVLPGELAKHAVSEGTKAVTKFTSS

SEQ ID NO: 122934 - protein, 77 aa, Triticum aestivum
  unsure (1)..(77): unsure at all Xaa locations
  Clone ID: PAT_TA_17352.pep
MGLCSCCCRCLEIMCAILLPPLGVCLRHGCCSMEFWISVLLTILGYLPGVLYAAYVICSVDPDRVRRRXDDDYIYVA

SEQ ID NO: 122935 - protein, 106 aa, Triticum aestivum
  unsure (1)..(106): unsure at all Xaa locations
  Clone ID: PAT_TA_17353.pep
QGVDAEAATVMAQHLLAAADRYGLDRLKLICARELSGGINIDTAATXLALAEQHNCPELKATCADFIIXPLPLLMXVLATEGFKHLEESCPLVVIDLLKSARGRKT

SEQ ID NO: 122936 - protein, 45 aa, Triticum aestivum
  Clone ID: PAT_TA_17354.pep
CYLTYFSPYGDQRLAIQHDLSKCDSVLSFLGEPTLLLPSNIERPS

SEQ ID NO: 122937 - protein, 46 aa, Triticum aestivum
  Clone ID: PAT_TA_17355.pep
PGIIQHASYKSLIQDITTVPKCMAKRIIVHLLPINQQKKFRPLPSP

SEQ ID NO: 122938 - protein, 94 aa, Triticum aestivum
  Clone ID: PAT_TA_17356.pep
VFMHILVAVCQLMRRQFCPLFRKYTRIEHQNFDSSPALPLRELIRRVSCQSNHTWTEAISSCRQSYHVKVVTFVRDLIISNLCRGLNFPCYLSV

SEQ ID NO: 122939 - protein, 194 aa, Triticum aestivum
  Clone ID: PAT_TA_17357.pep
MAAEDVEFVDYERDDGDEEDGGMEDGEVSARALPVPHIAAPAVPRTSRGRFVGRSRSVIASTRDRFDSLPFAGTSAHGGPQRSIEGWIIIVSGVKEDAEESDLYDAFAEFGEVKDLHLNLERRTGYGKGYALVEYGIFEEAQTAIRRMNGTELLTKTIHVDWAFNRGPIQNVMSAGPAQRRSRTPPRRLAAMTY

SEQ ID NO: 122940 - protein, 139 aa, Triticum aestivum
  Clone ID: PAT_TA_17358.pep
MAKISRGAPGGKLKMTLGLPVGAVMNCADNSGARNLYIIAVKGIGARLNRLPAGGVGDMVMATVKKGKPELRKKVHPAVIVRQSKPWKRFDGVFLYFEDNAGVIVNPKGEMKGSAITGPVGKEAAELWPRIASNSGVVM

SEQ ID NO: 122941 - protein, 82 aa, Triticum aestivum
  Clone ID: PAT_TA_17359.pep
EQIKKDGITKLVVLPLYPQFSISTSGSSLRLLESIFREDEYLVNMQHTVIPSWYQREGYIKAMATLIEKELLKYHNLRSRSR

SEQ ID NO: 122942 - protein, 296 aa, Triticum aestivum
  Clone ID: PAT_TA_17360.pep
KLVVLPLYPQFSISTSGSSLRLLESIFREDEYLVNMQHTVIPSWYQREGYIKAMTTLIEKELLKFPKPQKVMIFFSAHGVPLAYVEEAGDPYKAEMEECVDLIMEELEKRGMANPCTLAYQSRVGPVEWLKPYTDETIIALGQRGVKSLLAVPISFVSEHIETLEEIDVEYKELALQSGIKHWGRVPALGCEPTFISDLADAVIESLPYVGAMAVSNLEARQSLVPLGSVEELLAAYDSKRDMLPPPVIVWEWGWTKSAETWNGRAAMLAVLALLVLEVTTGQGLLHQWGILPPFP

SEQ ID NO: 122943 - protein, 105 aa, Triticum aestivum
  unsure (1)..(105): unsure at all Xaa locations
  Clone ID: PAT_TA_17361.pep
KLTERFESLDLVDLEMDDDERYNRKLEVGLYTLQLXVALILGHIWHSGNSQMRTRIELLLRQNKLDXSGRPGRLQEYHDNIGDLDGPEEKEKAQGRTKEIIAALS

SEQ ID NO: 122944 - protein, 129 aa, Triticum aestivum
  Clone ID: PAT_TA_17362.pep
FERPPGQVQNSHGILAQNNVDPVFDDPNLNWKEVFHKKHAEHISWSAASNRAICRQCRSVLWLSNLTCAAPHHCPKKGKDEIKLMPLLPYAVACYILNAQDRPSSSSDSSDSDSDSENNVPRRLWNSRV

SEQ ID NO: 122945 - protein, 64 aa, Triticum aestivum
  unsure (1)..(64): unsure at all Xaa locations
  Clone ID: PAT_TA_17363.pep
SLWFIIGPSXPEKYKHNLFRQHHIPNEHYNYLGNKSTSKNQIAXPXASSXRVNLFXGICTFKFV

SEQ ID NO: 122946 - protein, 323 aa, Triticum aestivum
  Clone ID: PAT_TA_17364.pep
MEAIAGDVHAHGYGWAGVWSAVASLIFLWSMVQQYLPAQLEEYLTALTRRLQAAITPYVTISIDEHVPDSFGRSEAYLAAEAYLSATCASGARRLRADLAADSDRMSVAVDDHEEVADDFRGAKLWWRKTKTLPRGNVISWSAHEEERRTYCLTFHQRHRGLVDALYLPHVLAEGRAATVRNRQRRLFTNNPSSDWSGYDARVWSHVKLEHPSTFATLGMHPDKKRDIIDDLDMFRDGKDYYASVGKAWKRGYLLFGPPGTGKSTMIAAMAKYLDYDVYDLELTSVKNNTELRRLFIETKGKSIIVVEDIDCSLDLTGKRKKK

SEQ ID NO: 122947 - protein, 96 aa, Triticum aestivum
  Clone ID: PAT_TA_17365.pep
FDMASYMKTVAEGPLGTGKAFICLAMLMLLVLSSGKMGAHGCEKRKSGRWTNDTCIIAGTCNGPCRDEGYDNGHCHNTWECICYKNCGLSLQPPHA

SEQ ID NO: 122948 - protein, 57 aa, Triticum aestivum
  Clone ID: PAT_TA_17366.pep
TARKMGVLATAPWWASLAPPGAVSPAIGFYVSVRGKNDGPVKVGPWCGFGGHAPYDV

SEQ ID NO: 122949 - protein, 85 aa, Triticum aestivum
  unsure (1)..(85): unsure at all Xaa locations
  Clone ID: PAT_TA_17367.pep
XVLIVYMTDDINNSGSQXTHGAQKRRWKNNQSSLVKRRFCPNDFLSVSKRLISHLPPTRLSCRNGVAPEKMKKWRRRHARPSMFS

SEQ ID NO: 122950 - protein, 337 aa, Triticum aestivum
  Clone ID: PAT_TA_17368.pep
MGWKGILGFDYGVVQAPLGPDISGPELAAAVANAGAIGLLRLPDWPAPDHVRELIRRTRSLTERPFGAAIVLAFPHEENLRVVLEEKLAVLQVYWGEFPKERVDEAHRAGVKVLHQVGNLEEAAKAKEAGVDGIIVQGREAGGHVIGQEGLLPLLPRVVDLVSDSTVSVIAAGGIVDGRGYAAALALGAHGVCLGTRFVATEESFAHPLYKKKLIEMNCTDYTTVFGRARWPGAPQRVLKTPFYVEWKNLPDHETEENQPIIGHSIIHGVHKDIHRFAGTVPNATTTGDIDSMAMYAGQGVGLITGIVPAREVVERLVAEAQRVIGTKLSGFPKSSE

SEQ ID NO: 122951 - protein, 290 aa, Triticum aestivum
  unsure (1)..(290): unsure at all Xaa locations
  Clone ID: PAT_TA_17369.pep
MGWKGVLGFDYGVVQAPLGPDISGPELAAAVANAGAIGLLRLPDWXAPDHVRELIRRTREXLPERPFGAAIVLAFPHEENLRVVLEEKLAVLQVYWGEFPKERVDEAHRAGVKVLHQVXGNLEEAAKAKEAGVDGIIVQGREAEGHVIGQEGRLLSFRPRVVDLVXDSTVSVIAAGGIVDGRGYAAALALGAHGVLLXGLRFVATEECFAHPLYKKKLIEMNCTDYTAVFGRARSRNGGKSNLIIGLFLSVRWVCTRNIRSVCSVLVPNATTNRSISHSMAMYAGPRVLG

SEQ ID NO: 122952 - protein, 85 aa, Triticum aestivum
  Clone ID: PAT_TA_17370.pep
TLCQVHDVKEKIHPSVRPFTIADHLLTYCNHREWATGLMFHEYYTIPKSYEELWKTIRAQDSEVRISRVPDSIRKGKRSVELKKE

SEQ ID NO: 122953 - protein, 165 aa, Triticum aestivum
  Clone ID: PAT_TA_17371.pep
EILFEACKLNYTAKLQTREHFRYSTTSLQSITELKLEPTLQLHIGRAAVGLGHAIAEAEPGAVAVVRSARAVAPVELLAGVDAAWEWGTQPLPPGGGRPPVGPVGLLAGEDLAGDVPALDAPDDGGGRQRVPEHHQRGEEEDEGECQLHGGGHACAIRPLTMNPT

SEQ ID NO: 122954 - protein, 135 aa, Triticum aestivum
  Clone ID: PAT_TA_17372.pep
FISVLRRGGALVGGAAVEVEHAALAVLGRALAVAPVELLPGVVVAGDVPSLHAHHGARRLLGVAERHQRCSIRDKNKQSKHRASERAHHTGVRAWLKHMDTAGDVPETRRRKATVSFNVAAMIVCCVCAVRFVFA

SEQ ID NO: 122955 - protein, 110 aa, Triticum aestivum
  Clone ID: PAT_TA_17373.pep
FGVFSVSFLIMLFSPVLSPATKLDQRIAFHFIPRHKLTFHSLFTPCTYDTRAALFSSNSNSRAEMKMTNACNPVQYLVHLLVEPLSRWSTQPLPSSGAHTQAHPSSFWPG

SEQ ID NO: 122956 - protein, 103 aa, Triticum aestivum
  Clone ID: PAT_TA_17374.pep
FISVLRRGGALVGGAAVEVEHAALAVLGRALAVAPVELLPGVVVAGDVPSLHAHHGARRLLGVAERHQRGDEEEEGDCELQCGSHDCVLRLRRAIVFAEARPA

SEQ ID NO: 122957 - protein, 88 aa, Triticum aestivum
  unsure (1)..(88): unsure at all Xaa locations
  Clone ID: PAT_TA_17375.pep
RLNLEWGATLRAPKKIIGGFFVPKNPFWGEVWGWGFGGPXXXXXXXFFFFFFFFFFFFFFFFFFFFFFVVRQQACRALLNSNSNQQFS

SEQ ID NO: 122958 - protein, 116 aa, Triticum aestivum
  Clone ID: PAT_TA_17376.pep
GISRIRMLCVAITTADTWLGSFIIARSTPYMISDLGYGAYFFFGSILVLMGIWSLFFVPETKGITLEDMDALFAKPVYKTVWAQMRGKPVLEGNAANRSDSPFDEDDEKARELRIP

SEQ ID NO: 122959 - protein, 120 aa, Triticum aestivum
  Clone ID: PAT_TA_17377.pep
VLSHSARKFYSKRVKLNYTAKPQTREHFRCSTPSLQSLIELRFKPTIQLELFGRAAVGVGHAVVEVEHAALAVGRRALAVAPVELLAGVVVAGDVPSLEAHHGARRLGLGVHDLPEHHEP

SEQ ID NO: 122960 - protein, 156 aa, Triticum aestivum
  Clone ID: PAT_TA_17378.pep
HPPASRRRLASAPGADPPVAAGGSFGLSAPGGLLVWPAAALPASAEWSGRLAAPRGPLTAGSSAGHTWPVPSGRFSLRVPALLRPCSANCLACNQGRQSSQETQDDNTQRVDFRSKICNFGMLTLFLQPGDHQPALTARLPYLEPELLTTGELTPL

SEQ ID NO: 122961 - protein, 93 aa, Triticum aestivum
  Clone ID: PAT_TA_17379.pep
DLVTSSFSRYVHVVGHDLHIMMMDTMKQMASIHLDPIDYDEREARKVMRESPFNWQGTLKDKPIFYPARYYSQPSLLRLTQSATADIIPEISG

SEQ ID NO: 122962 - protein, 95 aa, Triticum aestivum
  unsure (1)..(95): unsure at all Xaa locations
  Clone ID: PAT_TA_17380.pep
QDITLPFACRHGXCCTSCAVRIKSXGQIRQLEALGISADLREQGYALLCVGYPXSDLEVDTQDEDEVYWLQFGRYFARGPVDRDDYALELAMGDE

SEQ ID NO: 122963 - protein, 184 aa, Triticum aestivum
  Clone ID: PAT_TA_17381.pep
MAACPAATTARVGAAHGGGLWRRSGRSPSFPARPARGTSTAARASELQQAPAPAAAAAVPTHKVTVHDRERGVVHHFLVPQDQYILHTAEAQDITLPFACRHGCCTSCAVRIKSGQIRQPEALGISADLREQGYALLCVGYPSSDLEVETQDEDEVYWLQFGRYFARGPVDRDDYALELAMGDE

SEQ ID NO: 122964 - protein, 85 aa, Triticum aestivum
  Clone ID: PAT_TA_17382.pep
KKLLRLNVSLTLPMPRAAPTPPSAAGRQISRPLPTKPTMSWKTSAMRRCADDHIRGPSSEMEHDKQAEKDYEEEEENGEDEDEQG

SEQ ID NO: 122965 - protein, 89 aa, Triticum aestivum
  Clone ID: PAT_TA_17383.pep
LFHDREMFLLLQAQPQCVLGVKSLFNQVNQMLLFHVVATMFQGSLACLGNLVAVAYEQDHSASIALHNQFRICCPPFVGLPIFRCWRQL

SEQ ID NO: 122966 - protein, 121 aa, Triticum aestivum
  Clone ID: PAT_TA_17384.pep
PWSTNHSRKNRDLPLSRSPGQHSMCPTCNPRKGPNLSRKSQDRSHLTSSKKEDHQRGISITNHRSASQLLTSFSLPLSHEQIREEISSFCRHWRETCIMKWQKVKMVEENLIHGTETCSTT

SEQ ID NO: 122967 - protein, 166 aa, Triticum aestivum
  Clone ID: PAT_TA_17385.pep
MVAGCFITDECALAVSTERMWKAVFSGEDTAVLPKACAGFIDAVDVEGDGGPGSVSTMTLSPAAAELAGSGVMRSRLVARDNAARVIKTELLEGSKVSAQLKSQVAEVKLEAAGEGACVAKLRVEYERLDGGGALSAEDQATLAAGYLDVLKMVEAYLVAHPAEYA

SEQ ID NO: 122968 - protein, 372 aa, Triticum aestivum
  unsure (1)..(372): unsure at all Xaa locations
  Clone ID: PAT_TA_17386.pep
ARGSKVQRDFEELPSEAFRPLQDSLYGLLKKFNKGPPKVRTQICIAIAALAVHVPVEDWGGGGIVNWLGDEMKSQQEFIPSFLELLIILPQETSSYKIAARPERRNQFENDLCSSANVALSLLTACLGFDELKEQVLEGFASWLRFCHGITAATLASHPLVHTALSSLNTDQFLEAGGGVTSXELIHFTVSXDSCGIPEQFPLIQILIPHVMGLKEQLKDSFKVQVDKSSKCSNVTTSQLRRFLKIHKLLEVWKIYKLLWSFTLVILVGVSADKPLYANFGWVARFPYLKHMDFAFRGRVANPEGFQPVSEEDRRDFRYARYAVSDVLLDATDVLGGDSTLKILFMKLIQACGSGAEQNQNWQPLEAALFCI

SEQ ID NO: 122969 - protein, 91 aa, Triticum aestivum
  unsure (1)..(91): unsure at all Xaa locations
  Clone ID: PAT_TA_17387.pep
LRHWSRRPMTSAKEQLTNLEKSISRTHPVAGILKDLYPHSWEGIQSAIQVEVGSRSPDWTFSSTCQGERQVEIGSRSPDWTFSSXXXXGKF

SEQ ID NO: 122970 - protein, 46 aa, Triticum aestivum
  Clone ID: PAT_TA_17388.pep
GQMIWWICMNFAHSATIMHNYASHTISLGLDSFFISVYNEIGPLNI

SEQ ID NO: 122971 - protein, 193 aa, Triticum aestivum
  unsure (1)..(193): unsure at all Xaa locations
  Clone ID: PAT_TA_17389.pep
TRSFWVFVWEALQXTTLIILAICAFVSLVVGITMEGWPKGAHDGLGIVASILLVVFVTATSDYRQSLQFKDLDKEKRKIQVQVTRKGFRQRISIYDLLPGDVVNLAIGDQVPADGLFISGFSLLINESSLTGESEPXLLXNEENPFLLSGTKXVQDGSCKMLCLQVGAKPSGGKTNGLLRKAGEGKPNCKKNM

SEQ ID NO: 122972 - protein, 67 aa, Triticum aestivum
  Clone ID: PAT_TA_17390.pep
AGRVGSALVIALQDAAVLLQPQPVVAAIASHRSVPGMILLMLKGIAAAGVRPEASCPMHCSLREVTL

SEQ ID NO: 122973 - protein, 162 aa, Triticum aestivum
  Clone ID: PAT_TA_17391.pep
MARLYVGNLDARVTAGELEDEFRVFGVLRSVWVARKPPGFAFIDFDDKRDAEDALRDLDGKNGWRVELSRNDRGDRGGRGGGAGGGGGGRDRGGSDMKCYECGESGHFARECRLRIGSGGLGSGRRRSNSRSRSRSPRYRRRPSYGRTSYSPRDRSSRRRSA

SEQ ID NO: 122974 - protein, 56 aa, Triticum aestivum
  unsure (1)..(56): unsure at all Xaa locations
  Clone ID: PAT_TA_17392.pep
XWQTEIYLCVDNQNRIHNLDIKREKPTQKARIKPLTNTRWLKXATMAHSITRTQKL

SEQ ID NO: 122975 - protein, 80 aa, Triticum aestivum
  Clone ID: PAT_TA_17393.pep
FWPPNLPGAPPPGLPRFEGPWRTGHAPRAVPLLLLRTYYGRLSLSLPASPEALKLTWKKGASSDEQYFTGFFSLATTTTD

SEQ ID NO: 122976 - protein, 265 aa, Triticum aestivum
  unsure (1)..(265): unsure at all Xaa locations
  Clone ID: PAT_TA_17394.pep
MAHPGSQISKRRKFVADGVFYAELNEFFQRELAEEGYSGVEVRVTPTVTDIIIRATHTQEVLGEQGRRIRELTSLIQKRFKFPENSVSLYAAKVQNRGLSAVAQCESLRYKLLNGLAVRRACYGVLRFIMESGAKGCEVVVSGKLRAARAKSMKFTDGFMIHSGQPAKDFIDHATRHVLLRQGVLGIKVKIMRGSDPEGKAGPQKTLPDAVTIIEPKEEQAVLQPVSQDYGAKAAQAAQAAQDARVAXEEGGEXVQAVEHRVLNH

SEQ ID NO: 122977 - protein, 72 aa, Triticum aestivum
  unsure (1)..(72): unsure at all Xaa locations
  Clone ID: PAT_TA_17395.pep
LSPISHSTYIFDNQHTQCSTSSYHPLVFCSIEYVKRCEIVTHSNSIYYSELYVLPPXHTMANSGGXHHTSTV

SEQ ID NO: 122978 - protein, 114 aa, Triticum aestivum
  Clone ID: PAT_TA_17396.pep
TSTSTRGTPSTGTPPSLHSWGAPTATARSQNEMTNSIRSKPFLPECGSSSHPLFLADVMLWDCNLRSLYAVYRILFAFPFVGSFDLFVSQSTWCSSEILKLIVMIRICFSREIL

SEQ ID NO: 122979 - protein, 182 aa, Triticum aestivum
  Clone ID: PAT_TA_17397.pep
TKFGHFIPLAHPYSALQVAQLFYNHIYKLHGLPSGIISDRDKVFTSNVWQSLFKMTDVKMNMSSAHHPQTDGQTEKLNQCLETFLRGTVHASPTKWSQWLPSAEHWYNTNFHSALGKSPFEVLYGYKPRQLGIAHIPESTPSDLAGWLQEREMMQELVKQHLLRAQHRMKQQEDKHRSDRVF

SEQ ID NO: 122980 - protein, 199 aa, Triticum aestivum
  Clone ID: PAT_TA_17398.pep
MRMYQVLLFMNSFGNCILQIGVAAASLQDGSAVTVDAQRFIQGSLYKSAMESKKQSYLANLALYPGRTELPFLPANTQALILQPIGDKGIAVIGGDTIRGFTNLDQAWIGMIADKLDATLSKVLSSHSPLDIRLMIISLFNWPIHPDHICLDPRKSSGYMWELKPEFTKEHLPHPNITGSAIWGNLVDQNYGIIYMPNR

SEQ ID NO: 122981 - protein, 163 aa, Triticum aestivum
  unsure (1)..(163): unsure at all Xaa locations
  Clone ID: PAT_TA_17399.pep
XEEEXRSXISXQAKLVRLESDRSASGASHVHEAELKNELSRIRRSNSEYQRKIQSLEQEIEDLTRKQEIGDSTDLQSKIQILETKLAEALEENKMYRGQQXIXLPXSNLLVGTXFXLEXDLRDMXERLXNXSLQXHXRGXPGALXMELKXSXKGXGSNMMTCI

SEQ ID NO: 122982 - protein, 96 aa, Triticum aestivum
  Clone ID: PAT_TA_17400.pep
KSRTDAALQVWRDAEKIVNTPNWAPRPEFVKRFLKHFEEAKDVDGMESFCACLEKLECLDADARDALSRTYVAAGRTNPSSIIHRTEEDQVETRPG

SEQ ID NO: 122983 - protein, 211 aa, Triticum aestivum
  Clone ID: PAT_TA_17401.pep
KIIDGKELLMGRTYTDNHHVKKAVTTVEARSQHPSGESSKLTGRSAWRGGRTRTIGKRRRPSHRGLGNHLQRHYVRRGAKTFGRDTLVVFSLRAGRQEGNPNKEGGPLATCTRMERTRRSPPERVLQAGGIDTTLAPPGAQNQRKPQLEHQPAPSIGCQAGAARKAGRRGQLFLPDDGRATEQTGPKRKTTTEKKKRAGGPGTQVAHKRNE

SEQ ID NO: 122984 - protein, 84 aa, Triticum aestivum
  Clone ID: PAT_TA_17402.pep
AEEGVPPRSVEAARFRPAESWVLMMEDEEKEPELKVVSRMKRRPTVGEVENMMYNLMAANSPVTKSARFLRELVSNVTGRKGKP

SEQ ID NO: 122985 - protein, 252 aa, Triticum aestivum
  unsure (1)..(252): unsure at all Xaa locations
  Clone ID: PAT_TA_17403.pep
MIHCKEACVLESEVGAYNVILEAIREWNIDRKLFCLTSVSEIRNSGRRPRAEDMLIQRNCLPIRGELYNIACVDDMLDSVLSKGQSLLYRVGDLLERFIQACASSSLTQQQLLEVANDVGMKCPHEDAQGWHKIYFRLEVLLRFKKLLACEEFGSVEEMKIVEPIYKIVRVFYRVGEVMSGPVCLTANLYXHEVWKVXXXLQEEACTEHSDVASMIREMQEAFNEYWAKSYLWLSVPVVLDPRFKITFIEFR

SEQ ID NO: 122986 - protein, 82 aa, Triticum aestivum
  Clone ID: PAT_TA_17404.pep
YQLLQQKDRIVIPATLCTGQKQHCIADLATKSHHFFLLFEDLAGCEASADAASSALAILELLLGTAVDGPACSASSASSALT

SEQ ID NO: 122987 - protein, 123 aa, Triticum aestivum
  Clone ID: PAT_TA_17405.pep
PPRPPPPGLEHYRPSRSTHLSGFWPPLPSFCGLWCSGLFLRRSRPSRLALAHTSVDDVPPARPHGPASDVHSDVASRSQRTRYNSFPVSLLPSGCGCAQKRYVHTVPHSPLTSPTAKLPFGRG

SEQ ID NO: 122988 - protein, 187 aa, Triticum aestivum
  Clone ID: PAT_TA_17406.pep
ATFLVCCGPGLAPRRRRRSRRGPHRSRGRVPRGSKVAARPRRGPGGGSQEARCPGSPRHLRREGIELRSKVTTGTLSPNKEGHRQQLESEVTAKSAGSQITDGLALGVPARRQLGILDLSRGERGGAGRRSVVGWGGAQGHGWATDPRPRPRITHELTRPPAGRPIGCAPFAKVAMQVITYETPFMQ

SEQ ID NO: 122989 - protein, 294 aa, Triticum aestivum
  Clone ID: PAT_TA_17407.pep
MDDRIPPPSHLQQYSQSPVHSSPHHHHLNSMRYSASSDRERYLAELLAERQKLGPFIQVLPYCTRLLNQEILRASSLPPNHNFVDAERIEHGSPLRLPGHPVNGQPMDLEGWSGRQAEHMGVLQASPMSWNGAPALGGTPVVKKLVRLDVPVDKYPNFNFVGRLLGPRGNSLKRVEATTQCRVYIRGRGSVKDSVKEEKLRDKPGYEHLNEALHVLVEAEFPADIIDVRLNQAVTILEDLPSPVAEPWVYYKKQQLRELAILNGTLREESPSPHLSPSVSPFNSAGMKRPKTGR

SEQ ID NO: 122990 - protein, 73 aa, Triticum aestivum
  Clone ID: PAT_TA_17408.pep
PPSPFPSPPPPPSWSPGPTTSSTPAPAPAPGPTTTRIHRASRARQRPTGPRQLWISGSGPDSSRRDDQGQTST

SEQ ID NO: 122991 - protein, 371 aa, Triticum aestivum
  unsure (1)..(371): unsure at all Xaa locations
  Clone ID: PAT_TA_17409.pep
NAIVVGDKTYVIGRTDDDSKSTFGIKILDKLTQTWIVPTVLGAQPPYKSHSAILINDEKILVVEKCLSLNAFFXHLQIDTPFVKQQRKIKGSEVVSWSKGVLGVAQKPVVISGPSGVGKGTLIAKLMKEYPSKFGFSVSHTTRSPRVKEIDGVHYHFAGRSKMEQDISEXEFLEFAHVHGNLYGTSIEAVESVTDEGKRCILDIDVQGARSVRASSLEAIFIFVCPPSFEELEKRLRARGTETEEQIQKRLRNARAELDQSNSPGLFDHLLVNDNLEACYENLKKMLSLDDDHKDSDGCFIEDGKATACYSILSKTESEVFLQSETGEVVKGAASLLAVDLSSLTGGAPGRTRGLKIHSINSIDNDLKGIR

SEQ ID NO: 122992 - protein, 216 aa, Triticum aestivum
  unsure (1)..(216): unsure at all Xaa locations
  Clone ID: PAT_TA_17410.pep
RTRGLRRRGRWRRRRRESSRQRPHLVSTTPTAMALRAVLGAAFRGVRSARQHSLGVTRTVEVSGPKISASRSPWLVGSRFFSTKESDTLLRESIKNGVHRGLKEALAKNDGKSVLKLSVIKSGVNAGVKESLKEYHVFIDFAESDLRPEVKSAIEESVLQGLDNFVLQLHKVPPQGGQXXXPYLLKLALKEAIDEGMDVIYQKFSVYVGXXVDXLX

SEQ ID NO: 122993 - protein, 193 aa, Triticum aestivum
  Clone ID: PAT_TA_17411.pep
MKYIHSQELLEIPEGVKVAIKSRIVTVEGPRGKLVKDLSHLAVNFTSTKKNQISIEIHHGVRKNVATLRTVRTLINNLIIGVTKGFKYKMRYVYAHFPINVNVSQNSETDLYEVEIRNFIGEKLVRRIVMHPGVDVEASTTQKDELVLSGNSLENVSQSAADIQQICRVRNKDIRKFLDGLYVSEKGNVVQDE

SEQ ID NO: 122994 - protein, 136 aa, Triticum aestivum
  Clone ID: PAT_TA_17412.pep
PTHLQYWGVGMVLQGIGEAFGGKIIRVPSGVMHGKSSPVYYEEVLGKSICEGLSNPFTAARYHSLVIEEETFPHDELEVTAWTEDGLVMAARHKKYTHIQGVQFHPESIITPEGKKIILNFARYVEEFEKQTSEGK

SEQ ID NO: 122995 - protein, 303 aa, Triticum aestivum
  unsure (1)..(303): unsure at all Xaa locations
  Clone ID: PAT_TA_17413.pep
MACTHLAAASSPATTAAALRARATAPAAGFARLPATLHPENGGLALRGRRAVTPVVLAAGPAAAAPVADRDGTPAAVKQPIIVIDNYDSFTYNLCQYMGELGLNFQLNRNDELTIEEVKRMKPRGILISPGPGXPQESVISLQAVLEHRGHARRIPEVRQSYAKSIGEKELEESHSFGFLEYIIXKEIPFKLHSVKEVRRGTPSQILFRRKQNIGEAFGGKIIRVPSGVMHGKXSSPVHYDEVLGKAIFEGLANPLTAAKHHSLVHEKESFPHDELEITAWTEDGLNIDDSQNKYNRGSRDYC

SEQ ID NO: 122996 - protein, 135 aa, Triticum aestivum
  Clone ID: PAT_TA_17414.pep
CFVLTPVQVYNVHTYFNNIFSRSSTLLTNSCSNLGITITGYKNWGRRRKGKKIAAAAGVRVPPRRRAPSPLPSTCRLLPSGEHRRARPMSYQRGKPRYEYGPGEVPNIPPFLKCGLPPSRYHEDFAQDPMVLGDP

SEQ ID NO: 122997 - protein, 320 aa, Triticum aestivum
  Clone ID: PAT_TA_17415.pep
LASTIKQRREAESNVSQIIYSAAASAMAGIKAALEISEVGEPVVLVVVVEVVAVAVEVLVGEAVAAAPVLERRLRLLHVAHHRLVRRVDPLEVDGVVLASVPAAPAHDVRVVLQREAVEGLLDLAPGGARLQPQSPVVVLLQHPVRGRRRPPFPRRPAPHRRRRRHPTQPPHRRRRRGRRAAQAQHHSASGADPGSDASCAPPAASTATGRQVRVGGRLRGSGGETGDIGIRAGGAEGEPGARRLSATPPPAATAMDVLLCAHARQQTESIARSIDRDERRRSCGRLGDLDPDVLFPRLTACGAGCVAANEWGAAGGDRG

SEQ ID NO: 122998 - protein, 170 aa, Triticum aestivum
  unsure (1)..(170): unsure at all Xaa locations
  Clone ID: PAT_TA_17416.pep
GLPSPPCSPPHQQRRPSPSRSPRLAPTRRRRFTRRQPAAGATSSRARAXGAALLLALWPQRARAASDDEYLTETTEVIGKVRSTISMDKTDPKVADAVTELREMSNSWVAKYRREKALLGRQSFRDMYSALNAVSGHYISFGPTAPIPNKRRIRILEEMDAVEKSLKRGR

SEQ ID NO: 122999 - protein, 246 aa, Triticum aestivum
  Clone ID: PAT_TA_17417.pep
MAAIATMTRDAYPAPAQHPLLRLNPHDCIPFLDEIFADGQEAKLERLPSPRLMNTHMPHTLLPESVTGADVAGCKVVYVCRDPKDMVVSLWHFLRRRQPDLPFAELFEHVCDGAVAVGPIWDHVLSYWRASLARPDRVLFLRYEDLLLDTGKHVRRLAEFMGRPFSPAEEGAGAVEAVVELCSFEKMKGLEVNKKGSAGAYHAMPRDSFFRKGVAGDWVNHMTPEMATRLDEVVRDKFRGTGLAAP

SEQ ID NO: 123000 - protein, 339 aa, Triticum aestivum
  Clone ID: PAT_TA_17418.pep
MAAIATKWTSGPVPFTDVDDGTVPKRPAKEEFGSLVAALPRKNQAGLELRLYQGFWLPDHWVAGTVVFQRRFVPRADDVILASYPKCGTTWLKALAFATMTRDAYPAPAQHPLLRLNPHDCIPFLDEIFADGQEAKLERLPSPRLMNTHMPHTLLPESVTGAAVAGCKVVYICRDPKDMVVSLWHFLRRRQPELPFAELFEHVCDGAVAVGPIWDHVLSYWRASLARPDRVLFLRYEELLQDTGKHVRKLAEFMGRPFSPAEEGAGAVEGVVELCSFEKMKGLEVNKKGSAGAYHAMPRDSFFRKGVAGDWVNHMTPEMATRLDEVVRDKFRGTALAAP

SEQ ID NO: 123001 - protein, 203 aa, Triticum aestivum
  unsure (1)..(203): unsure at all Xaa locations
  Clone ID: PAT_TA_17419.pep
MQHRPQQQDRRSSRTRRDRXRSSRRGRDPSLESPARRNGRRDHPRSSRPRQAPSDRAARRRPRHRRXHEEPLQLARVGRHPAIVAIPRRLNDRGGAPSSVTTESGELSLPPSPPSREPGSKPKPPSLSATAGSKHSPSPSQNSVRSMSSKSNSNPSIKPKSKSRSSTXPTRRRRPWRKYARTSTKVRSMSRPTSARKFPNQAR

SEQ ID NO: 123002 - protein, 303 aa, Triticum aestivum
  Clone ID: PAT_TA_17420.pep
DTTRHMTTPFVDEMYDLLKNTLTEYEVIICRWPEYIFVLENAIADIEKAVIDSLEKQYVDILAPLKDCIAPKKFGLKYVQKLAKRNSTCPYVVPEDLGILLNTMKRLLDVLRPRIESHLRSWSSCIPHGGNSAAIGERLSEVTVTLRAKFRNYMQAVVEKLSENTRMQNTTKLKKIIQDSKGLVLESDIRGRMQELNDQLIGAINHMHKVSEVHVFVAICRGFWDRMGQDVLSFLENRKENKAWYKGARVAVSVLDDTFASQMQQLLGNTLQQKELEPPRSIMEVRSILCKDAPRQKNSGFYY

SEQ ID NO: 123003 - protein, 117 aa, Triticum aestivum
  Clone ID: PAT_TA_17421.pep
GASVSSAFVGWVLQKDGIKQARKMYKRFLALPRPSLKFFQFCIELEASLASIGNNDGLVNARKLYDSAISLYPQERELWRKYYNMELTAGTSETSNAIYWRARKVLNDSTALDIPRS

SEQ ID NO: 123004 - protein, 272 aa, Triticum aestivum
  Clone ID: PAT_TA_17422.pep
MHSSSPSSAAVAYSSSSPSHLSPADGFLCVKEGVDEMIKHVANEPSLGLYFVQQHAQASMPILLDVKGKVTEKTREITLHTEDIEDSICAVRSMAEFGLPIADDMIKDINKSLKIMSKTQPKKGLIQNPIWGFQSDKSSEAWNDLDTTNGGSSKNYLSSMLNTAKQKASSLRWPQTDFAMNDGVSEKSVSSTAQESSQAGGHGASTPSDAERDEVSISSRLLENKNAGTMNQGLSASDISHTAESYNKFKEEQELKLQEWLRESKEADDNRG

SEQ ID NO: 123005 - protein, 86 aa, Triticum aestivum
  Clone ID: PAT_TA_17423.pep
DGREVLGCGCCIVFCSAHGSSDAMARLPPALEEMARTGKIAIERLILETPVEGRSCGRETCYISPCYTPGCYCTYPLCMRPSVVPA

SEQ ID NO: 123006 - protein, 268 aa, Triticum aestivum
  Clone ID: PAT_TA_17424.pep
MTADEFRRAYASSRVSHHRMFSRKEGDGGFMHGSARDVPPSVDWRQKGAVTAVKDQGQCGSCWAFSTIAAVEGVNAIRTKNLTSLSEQQLVDCDTKSNAGCNGGLMDYAFQYIAKHGGVAAEDAYPYKARQASSCNKKPSAVVTIDGYEDVPANDETALKKAVAAQPVAVAIEASGSHFQFYSEGVFAGKCGTELDHGVTAVGYGATVDGTKYWIVKNSWGPEWGEKGYIRMKRDVKDKEGLCGIAMEASYPVKTSANPKHASANDEL

SEQ ID NO: 123007 - protein, 364 aa, Triticum aestivum
  unsure (1)..(364): unsure at all Xaa locations
  Clone ID: PAT_TA_17425.pep
MARAIVLAATMAAAALFMLLAHAPAPASAMDFGEHDLASEDSLWALYERWRERHTVARDLGEKARRFNVFRENVRLIHEFNRGDAPYKLRLNRFGDMTADEFRRAYASSRVSHHRMFSRKEGGGGFMHGSARDVPPSVDWRQKGAVTAVKDQGQCGSCWAFSTIAAVEGVNAIRTKNLTSLSEQQLVDCDTKSNXGCNGGLMDYAFQYIAKHGGVAAEDAYPYKARQASSCNKKPSAVVTIDGYEDVPANDEAALKKAVAAQPVAVAIEASGSHFQFYSEGVFAGKCGTELDHGVTAVGYGATVDGTKYWIVKNSWGPEWGEKGYIRMKRDVEDKEGLCGIAMEASYPVKTSANPKHAGAHDEL

SEQ ID NO: 123008 - protein, 96 aa, Triticum aestivum
  Clone ID: PAT_TA_17426.pep
FFFFAFRPKCSFIPGKTELQWRIRVHKWCSRASNHPPHKLQNRPKHDEMNYFLGSKLDTHDESNEERACRWKHIIFLCFDVHAPRHGEALPERQGQ

SEQ ID NO: 123009 - protein, 528 aa, Triticum aestivum
  Clone ID: PAT_TA_17427.pep
MALEAAYHYLQRAVGHGTSTEALLLTVLLLLIIRVAWVRAFTTTTASTKCKQQLPPTPPGKLPIIGHLHLIGSHHHVSFRHVAAKHGHDGLMVVHVGAVPIVVVSTPAAGGAVVGTHDPMVASGPRHPDADFIRYNSTDIAFAPYGDYWRRARKVVNTHLLSVKMVYSKRHDREEEVRLVVAKICELAMAAPGKALDMTELLGGYASDFVCRAVLGESHRKHGRNELFRELTEISASLLGGFNLEDYFPRLANLDVFLRVVCSKAMGVSKRWDNLFNELIAEYEHGKEDNAEDFVHLLLSLKKEYGLSTDNVKAILVNMFEAAIETSFLVLEYSMAELINNRHVMAKVQKEVRESTPKGEKLDLIMEEDLSRMPYLKATIKEAMRIHPPAPFLLPHFSTNDCEVNGYTIPAGTRVIVNAWALARDPSHWERAEEFYPERFLQEGRDAEVDMYGKDIRFVPFGAGRRICAGATFAIATVEVMLANLIYHFDWELPSEMEAIGAKVDMTDQFGMTLRRTERLHLVPKIYK

SEQ ID NO: 123010 - protein, 235 aa, Triticum aestivum
  Clone ID: PAT_TA_17428.pep
MAGGDDLKLLGAWASPFVARVKLALSFKGLSFEDVEEDLSNKSELLLSSNPVHKKVPVLVHNGKPICESMIIVQYIDEAFLVGPSLLPSDPYERAIARFWAAYIDDKLVTPWVQSLRAKTEEEKSEGVKQTFAAVETLEGALRECSKGEGYFGGETVGLVDISLGSLLSWLIATEVMSGTKIFDPVKTPLLAAWMGRFSELDAAKAALPEVDRVVEFAKKRQAQADAAAAASETK

SEQ ID NO: 123011 - protein, 121 aa, Triticum aestivum
  Clone ID: PAT_TA_17429.pep
SPRVREEGQQRKKSHGALLQQQLRQHKGEEACAEEGAAEAADREDHQQPHGAEERRRRRGQEGVRPHQLRRLQLNLSKTPSSVCQLSFSFLLGSFILGFLPKSSPRIVQSSAIVQMNREVM

SEQ ID NO: 123012 - protein, 113 aa, Triticum aestivum
  unsure (1)..(113): unsure at all Xaa locations
  Clone ID: PAT_TA_17430.pep
PXASEQRDQTQHTHTHKKKKKKKKKEHNTGGSHGALLQQQRRHQQLRRRKGEEAPAEEGAAEAANRQDHQQPRAAKERRHGRGEAGIGSHQLRRLQLNLSKSKPHPSSVKSRL

SEQ ID NO: 123013 - protein, 118 aa, Triticum aestivum
  Clone ID: PAT_TA_17431.pep
AGRAGTLSKEASTTHTHSEEEEEEGQHRWWSHGALLQQQQRHQQLRQREGEEAPAEEGAAEAADRQDHQQPRAAKERRHGRGEASIGSHQLRRLQLNLSQVQTTSVVSQGSRAVQAKP

SEQ ID NO: 123014 - protein, 95 aa, Triticum aestivum
  Clone ID: PAT_TA_17432.pep
PAGSGPQTHSLTRRRRANKKRRKDNRERRAMEHSYSSNSGITTNYGGAKERRPALKRGQLKRQIVRTISNLMAPRNDGAGAGKGASGCTSFGAYN

SEQ ID NO: 123015 - protein, 122 aa, Triticum aestivum
  Clone ID: PAT_TA_17433.pep
APLEAAGSQPDSTHHNKKRESKKRRKDNSQQRKKSHGALLQQQQRHEQLRQHKGEEAAAEEGAAEAADREDHQQPHGAEERRRGRGQEGICRSHQLRRLQLKLKAPSSVRCTRTDAPFFRPD

SEQ ID NO: 123016 - protein, 95 aa, Triticum aestivum
  Clone ID: PAT_TA_17434.pep
MAIPSAEPPRRFPPRTAPLPRSTGPPKATRRLPQLPPPPPLAWPLPRVPPVHRAPRAAAPPPCAPPCRPRGRHGELRWAASRRRRVAGLPCLRCA

SEQ ID NO: 123017 - protein, 138 aa, Triticum aestivum
  unsure (1)..(138): unsure at all Xaa locations
  Clone ID: PAT_TA_17435.pep
TVRIVQVFGEEYLRSPTAEDTARLLAMNKARDFSGMLGSIDCMHWSWKNCPKAWHGQFHGQKEVPXIILEAVADXETWIWHAFFGMPGSLTDINVVNRSPLMNKIANGELPPVQFVANGRTYNYGYYLVDGIYPKWQT

SEQ ID NO: 123018 - protein, 194 aa, Triticum aestivum
  Clone ID: PAT_TA_17436.pep
GRSSRRAGALPHPYIQPAHPLLVTSPVSSPSTSTGGMAASKGARKSLVSRTLERCRSGLNSGGRSAAAVAPGCFSVYVGPERERFVVRADRANHPLFRRLLDDAEQEYGYAAQGPLALPCAVDAFLDVLWHMDHDVQDDDDSEATVAPSTPICGLQRAGSGNIKVRPAGYRVLSPAKSTPASFFFSQTAAGGRR

SEQ ID NO: 123019 - protein, 94 aa, Triticum aestivum
  Clone ID: PAT_TA_17437.pep
SVITLKFRVLMSLSCYHHLFSWITNQRIEQPFHQHKNQNQIGYEKHTDNDVLKTTRPASGREARASPSANLKSKRFTLRATQHLQCHCNGKEAA

SEQ ID NO: 123020 - protein, 138 aa, Triticum aestivum
  Clone ID: PAT_TA_17438.pep
MASQLVESHRAGAEVHKGNDICKKKTVELLEELGLPKGLFPMDDIEEVGHNCESGFVWILQKKEKEHTFNKLNQTVSYDTEVTAFVEKGKMKKVTGVKIEDLSLVEVYVDESSADKVTIKTDTGLSDTHDAAVFALGE

SEQ ID NO: 123021 - protein, 137 aa, Triticum aestivum
  unsure (1)..(137): unsure at all Xaa locations
  Clone ID: PAT_TA_17439.pep
MASQLVESHRAGAEVHKGNDICKKKTVELLEELGLPXGLFPMDDIEEVGHNCESGFVWILXKNKKEHMFNKLNQTVFYDTEVTAFVEKGKMKKVTGVKVEEFSLVRAPLEAAGGSVHKLIYQSTNLENPLPKQTIPS

SEQ ID NO: 123022 - protein, 190 aa, Triticum aestivum
  Clone ID: PAT_TA_17440.pep
MLVSGRRRLLVLCTSFVILSLLTLPSDGSSNSTEDPDQSRNKTGHPLELTPRTAFQLKLHALFHWSSFGLLMPVGILLVRMSSKSKSGRCSRGPLWRLVPSPGAPRLRPAGGAAPSFPYFGHSVSFSHQSVGLALYGFMWLQPIIGFFRPERGVKGRSLWFFFHWLLGIAVCATGIANVYSGLRTYHKRT

SEQ ID NO: 123023 - protein, 239 aa, Triticum aestivum
  Clone ID: PAT_TA_17441.pep
MRYTTVPILFNLLLSSTSLAAPNEPCYGPSGIAGVCITDAACSSAGGTSISGACPADTANIKCCSKPKCSSGNCRWTSDCAGTSAAGQCPGPSQMKCCSSAATGFGGYSAPTIPAVGACKAVSVNAAKKVVAAFPGRIREIGCKRDCSCPGSSDHCCGLATDFMCSDGGGSATLSGKEIAEWCMKNRSALNLKYVIWGQKIWTTSVDKTEEKWENWRTMEKRDGLTQNHWDHVHVSYNG

SEQ ID NO: 123024 - protein, 289 aa, Triticum aestivum
  Clone ID: PAT_TA_17442.pep
MLMPFLAQTSQTTRPVASCFGLNRCHPARNFGRYCRWWGARSKAIHSPRSIFGPTNGAPSSDIVKKRKIVEHIILLRAKPNISDAEEKDMLDYLYTSQYQMRGILTVSLGRIEGPNSESFTHAVFMRFQQKEDIAKFQSSSYYSKVLDEHVKPVSYGLVSVDFESEVEDDIIPLFRRGEDFNYGVEFMLLISFLETASRESVEDALAHLQKLIIHYSSFIVQATSGCCLDHMDGLYSHAAVIRFPSIDDFKLFKESTEYKDMWTSKFHPVTERCLELHFVVDPVGNQLM

SEQ ID NO: 123025 - protein, 302 aa, Triticum aestivum
  unsure (1)..(302): unsure at all Xaa locations
  Clone ID: PAT_TA_17443.pep
FRSQGFELEEKFRKSQEELEQKNLELSKLREELEGLEGGETGGARGYQFREDLEDNESETDILKTRVQLQQQENDDLRRYKVETENLMSEIQAEKSLLEERLAASVKESSITSKCRARGQQDILVLSSSIDSHVSANKVLERKINELESCKAELELHISELEQENIELSERISGLEAQLSYITNEKESSELQMHDSKSLVISLKDKVERQQVEMDTQRVEFKQKQQETQRKLSEAQDDSEVLRXRSNSNLQSXVEXLIEEXSSLQNXAXDLKXKKLELLGRLSTRAGIGYKGPCFNWVLTSF

SEQ ID NO: 123026 - protein, 96 aa, Triticum aestivum
  Clone ID: PAT_TA_17444.pep
SRARSVALWPPPTLALVHLLHLAVLGDGVQGPGGARCPKSGKGGMMNWGGSDRRAELSWSAARTKTGKGGVVAAADNRERKERADAGGAAATGIYL

SEQ ID NO: 123027 - protein, 89 aa, Triticum aestivum
  Clone ID: PAT_TA_17445.pep
MGSGKKRAALASLFGFKNKRQEEEEATAATRQQQHAAAPPQQRYHHHRVRPSDDDDYARHWYAERDIDRKASEFIDKVHRRMLANEQDG

SEQ ID NO: 123028 - protein, 72 aa, Triticum aestivum
  Clone ID: PAT_TA_17446.pep
SLSLAPPSTVAEFLELFVSHHCLIAPSVEGEEPDAEKIKDLMNNIEKYTLASHLVWGLWGIISEHVNDIDFD

SEQ ID NO: 123029 - protein, 202 aa, Triticum aestivum
  unsure (1)..(202): unsure at all Xaa locations
  Clone ID: PAT_TA_17447.pep
RGSTLRFWGTDEANQQQRAMRPSTMARALAAAAAILAAVVCGGATPETTCRAAARSDRRVDYHFCVSKAEPAPRQAPTPDTWGLAKVAADVGVLMAGNGAYDIKAMLAGKKEQPAAARGPLEQLRGAVRQDGLRVRRGVTTGLTXARLRDGQGEGGRRLRPSRAGCAARLSPGAGVPYPVPAGEAQRPPAPGXKWAIXWXRP

SEQ ID NO: 123030 - protein, 195 aa, Triticum aestivum
  unsure (1)..(195): unsure at all Xaa locations
  Clone ID: PAT_TA_17448.pep
MLGRALTSVMWGVVADKYGRKPVLVTTLFSVIIFNTLFGLSSSYWMALTTRGLLGLLSGMLGPMKAYASEVCRKEHSHLALSLMSSSRGIGLIVGPAIGGYLAQPADKYPGIFSVNSIFGRFLYFLPCLCISLLAIAAVIACFWLPETXLHKHTEDTMLNSSTEAVEEPCSDLNAEQSGSDCLSLFTNWPLMSTR

SEQ ID NO: 123031 - protein, 128 aa, Triticum aestivum
  unsure (1)..(128): unsure at all Xaa locations
  Clone ID: PAT_TA_17449.pep
LTDNESSLLSDXFYHTRAAKASVLVSLIWESNLGAFARKPLLHPCASDWEMPTTFIYGHDDWMNYQGAQQARKDMKVPCEIIRFPQGGHFVFIDNPVGFHSAIFYACRKFLSGDAEEGLSLPDGLISA

SEQ ID NO: 123032 - protein, 99 aa, Triticum aestivum
  unsure (1)..(99): unsure at all Xaa locations
  Clone ID: PAT_TA_17450.pep
IRHNYTCISTSTTKPLIHXPVKFLDYILFEAWITPTNLPQLTATSNSVNSPVCTEIHAAQSHRTSAAAARAAAAPEALQATRGSPAALRPCDPDAALPA

SEQ ID NO: 123033 - protein, 216 aa, Triticum aestivum
  unsure (1)..(216): unsure at all Xaa locations
  Clone ID: PAT_TA_17451.pep
ENVGIIGAREPSKVADLKTSPTITFNLKREDGTWFGYREVEKLASLSGIHLRTGCFCNPGACAKYLGLSHSDLVSNFEAGHVCWDDNDVIKGKPTGAVRISFGYMSTYQDAEEFLKFLQSSFVSKPIASSNGHALSMNTLNLLDNQSQQVVPDVRXKPIIIYPVKSCQGFSVQSWPLAAGGLKYDREWLLQGSGGEILTQKKVPELASIRTLINLE

SEQ ID NO: 123034 - protein, 254 aa, Triticum aestivum
  unsure (1)..(254): unsure at all Xaa locations
  Clone ID: PAT_TA_17452.pep
MGKGGGCVPSKKRQLPPTTVAAAPSSSSATAVPRDAPEEALDAPTGESRRTLRLYIVFYSMYGNVEAPARDPAAEPASEAGSGESATIHXAESLATDLPAKMQAPSNAXAVPVMPVPAHLEYSYSVLVASSTRYGPMAAQLKAFFDSTGSLWEKQRLAGKPAGFFVSTGTQGGGQETTAWTAITQLVHHGMLFVPIGYTFGLGMFNMDDIRGGSPYGAGVLAGDGSRQPSEAELALAEHQGKYMAAFVKKLGQA

SEQ ID NO: 123035 - protein, 133 aa, Triticum aestivum
  unsure (1)..(133): unsure at all Xaa locations
  Clone ID: PAT_TA_17453.pep
MSVSWPAPSTCAAAGALLAAAWLLCFRLLPAAARPRRRAMKTGAQLPPGSFGWPVVGETLDFVSCAYSPRPEAFVDKRRLRYGGAVFRSHLFGSATVVTADAEVNRFVLQSDARTFVPWYPRSLXXLMGKSCI

SEQ ID NO: 123036 - protein, 173 aa, Triticum aestivum
  unsure (1)..(173): unsure at all Xaa locations
  Clone ID: PAT_TA_17454.pep
MDRSLQWSRPASLLLLGAAFLAAAAVASANPAYNPDPYSVVDHFNRAVHRSTSPRRALSSEKKSKKAKYTGPCMATNPIDRCWRCRQDWATDRQRMARCAKGFGRETTGGPXGKIYIVTDANDDDFTNPRPGSLRXGAVQXEPLWIIFARDMVINASXXIIIQXDKXIXXRGA

SEQ ID NO: 123037 - protein, 208 aa, Triticum aestivum
  Clone ID: PAT_TA_17455.pep
PTLLAFVLQLRLLQLVWSGRRRPADQSKSATPSPVVSERIVLQICLPLYVLGGALAAAVHVINVRAASEEPLVVRIAGEPATIWEDLVSYGGLILDGFLLPQIILNASLAGSGVRAISPWFYAGVTMTRVMPHVYDVVRRQIYEPSMSSSDLYASPRGDLFGVAWDIIIPCGAGVLAVLVFLQQRLGGSAVLPSQRRRSGGYEMVSSI

SEQ ID NO: 123038 - protein, 367 aa, Triticum aestivum
  unsure (1)..(367): unsure at all Xaa locations
  Clone ID: PAT_TA_17456.pep
PSRVSLPTQETTSEPQSAPLPRPAPLVSLPLPTPQPPATSISIQLPPLSGHPAAAATASPSFDLRRYXTSLISEVEGRGSIAGDAHPPAGRXIHNAMRHAVLPGAGKEGAAKRAPPVLCVAACELLGAPRAAALPTAXALEMLHAASLVHDDLPCFDAAPTRRGRPSTHAAYGTDMAVLAGDALFPLAYTHVISRTPSPDPVSHAVLLRVLAELARTVGSTGMAAGQFLDLAGASALGEAEVMQVLTKKFGEMAECSAACGAMLGGAGPDEEAALRRYGRTIGVLYELVDDMRSASGNGKMRSNASVLRSLGMDRALGIVEELKAQAKTEADRFGDKYGDRVLPLYSFVDYAVERGFELQDAATAKL

SEQ ID NO: 123039 - protein, 280 aa, Triticum aestivum
  Clone ID: PAT_TA_17457.pep
VEIAASRAMFTTYHKDDGTVRLKSKAYDKFMKFDTNWVTPVGRDDAGDKRTLFKVIKVGDYYGLKCMGNHKFCKSLSADGKTDCLNAADSHITEEVKLWVTEPVLSREIYDVVYHGVDKARVYDMKTINMATSSAVNRTSENNKVKLSLSITQTQTSTWDASVSLKAGVKTTVTAGIPAVMDAEVEVSFEVTSEYHWGKTEVNETKQQIVYDVVVPTKKKVTVSAIASQAKCDVPFSYTEKDVLPTGEVRITKHHDGIYTGMNTFNLQYETKEEDLPATE

SEQ ID NO: 123040 - protein, 787 aa, Triticum aestivum
  Clone ID: PAT_TA_17458.pep
MGGARSQVNKAHKTRFASKASRHSHKIDKVRSGKPAGSHRAALKGARAARLQHSKAIRDQKRAALLKEKRSSNGSSSAPRVIVLCGLSSSANIGPLAEDLLTFAAGGDEKLTSNTVASPAYKVRTTVLQAPYGDLTSCMELAKVADLLAFVVSANSLYNSNSGNPIDEFGSQCLSVLRAVGLPSTAVFIRDLPSDTKSKQELKKAAVSFLSPELPEDCRFYAAETKDDLHMFMRLFKEQHLSSPHWRNQRPYVMSEEACIKPGDSMGLCTLLVSGYLRAHNLSVNQLVHVSGAGDFQLGQIDILKDPCPVSGRKNSDVMDSDDNQIQIIDTFVPDPLNQEPLLVENIPDPLAGEQTWPTEAEMEEAYESNKQRKVVKRKLPRGTSEYQAAWIVDDTDDEGDDSENDNPDGAGMVIDEKDHSEHDSDSSDIDAVSHFTEKFDQETIGGSEMGDDENLTKEQIEEDIKRIKESNADDEEFPDEVETPLDVPARKRFAKYRGLKSFRTSSWDPKESLPPEYARIFAFDKFTRTQKHVLAKRAELDEESSKDCARIGSYVMLHVKNVPTDVASKLCHPSRRLPVVVSGLLEHESKISVLHFSIKKHDSYEAPIRSKEPLIFNVGFRQFTARPLFSSDNINCNKHKMERFLHHGRFSIASVYAPISFPPVPLIVLKNIDGQQPVIAAVGTLKSVDPDQIILKKIVLTGYPQRVSKLKAMVRYMFHHPEDVRWFKPVELWTKHGKRGRIKETVGTHGSMKCIFNSSVQQHDTVCMSLFKRAFPKWPAQFYHQI

SEQ ID NO: 123041 - protein, 198 aa, Triticum aestivum
  unsure (1)..(198): unsure at all Xaa locations
  Clone ID: PAT_TA_17459.pep
MGGRVDHEYSYLFKMVLIGDSGVGKSNILSRFTRNHFSLDSKSTIGVEFATKSLQMEGKTIKAQIWDTAGQERYRAITSAYYRGAVGALXVYDITKKQSFDNVNRWLRELRDHADSSIVIMMVGNKSDLTHLRAVSEDQGKALAEKEGLFFLETSAMEAVNVVEAFQTIITEVYGIVNKESTGRQRSSSSSCSIAFPG

SEQ ID NO: 123042 - protein, 134 aa, Triticum aestivum
  unsure (1)..(134): unsure at all Xaa locations
  Clone ID: PAT_TA_17460.pep
MQIQRGDVQPGSSNRRRKKMRISSENMIRVNPLEEEFGTSSDSGEGVWRLLSEEVAAHIDDSVVSLASFHKDNAKSVYFACTGIIIESNSTTTSFLTSLSLLRSIDDDSKIFQDMMIKVRLPNNHLSMGWXGIL

SEQ ID NO: 123043 - protein, 154 aa, Triticum aestivum
  Clone ID: PAT_TA_17461.pep
PERHESVALGAAGEAVRDDDGLQDVAVLLEVLPEALRRRLPRQPAHEHLRLRRVAEPRPVRGRGRRRRRHQHRIPHALLRVVARRRLAGVECRPAILLDLGELPCALRSNWLVDSGAPPQPPSVRALLLCCVWQPRQWRSALPYINLARCDVLA

SEQ ID NO: 123044 - protein, 100 aa, Triticum aestivum
  Clone ID: PAT_TA_17462.pep
QSGINAALQVNTHSSKQLPLKIKHLFSQVQCFLDLAHCRLVLLLVPLVNPNVLLCQRILAVHLLFLHLGAMNYIMHLFGSLIVEAGRCLRVRLSSLGHAC

SEQ ID NO: 123045 - protein, 215 aa, Triticum aestivum
  unsure (1)..(215): unsure at all Xaa locations
  Clone ID: PAT_TA_17463.pep
ARGRLPAPRRAPWPAAFVLALPVPLPVPAAARALRRHRAGTGAVDRGRAPGVRAAAAGSEGAHEDAAAGVHGGGGADDRAQHRDHRGHHARALLGPAWPLLCRAGSGGTWISTAPSSTWVILCILGRVACSCHCSSWCSLVRSLANTQPIYRLTPHTAXALPQTAGPSSXQGKLPCLPTAXRLIYPXQSVXMLHPTEIFRXQHLPCNIWXPXXGR

SEQ ID NO: 123046 - protein, 108 aa, Triticum aestivum
  Clone ID: PAT_TA_17464.pep
QQLTISTSSNKSLLLVHVSYIRFNRKMGKARLAEDYACATNLLLRRSISSMNLTQYSIHKGPVSKYSVLTFQFWLEVSQMKEHNPFHHFSTYWHSELGAEKRSQSEES

SEQ ID NO: 123047 - protein, 223 aa, Triticum aestivum
  unsure (1)..(223): unsure at all Xaa locations
  Clone ID: PAT_TA_17465.pep
HEAPPQPQPHRAAAALPLAPPGRGTSLRIAEPAPPARPRRRSAPAAAGPAPPPSPVPVLPPSPPPPPPLPPPPGRLPPSPPPPPPRSPRSPAPPRPPLRPPPLPAVGCPLRLRSVSGDPIPHFRTAPSLPSGPPQSRPPPTPPPPPPPPTEPRPTSPHRGXRLPAARDAASAAAPLPPQPPAGGAPPACAPRAPHADAPLRRLRDLEELLSQLNPMAEEFVPP

SEQ ID NO: 123048 - protein, 121 aa, Triticum aestivum
  Clone ID: PAT_TA_17466.pep
MHLRQQQQQHHRAEMVAPKGCVTVRVGAEGEEQRRFAVPLDHLKHPLFGALLDEAEREYGFRHQGAIAIPCRVDRFVHVERLIDRDLGAHGHQLVDLDCGAATAHGHGHLHLPRFVGCFRA

SEQ ID NO: 123049 - protein, 145 aa, Triticum aestivum
  Clone ID: PAT_TA_17467.pep
MHLRQQQQQQHRAEMVAPKGCVTVRVGADGEEQRRFAVPLDHLKHPLFGALLDEAEREYGFRHQGAIAIPCRVDRFVHVERLIDRDLGAHGHQLVDLDCGAATAHAHGHLHLPRFVGCLPRSDGDDGDASSALGSLAVSLLGLVL

SEQ ID NO: 123050 - protein, 224 aa, Triticum aestivum
  unsure (1)..(224): unsure at all Xaa locations
  Clone ID: PAT_TA_17468.pep
MAASPATASSAAGATASAWASLAPLPAPRPGAVSFPFPNSARPAPLVAVARACRLPVVDAAAAALEPLGLTGSLTNTVGFSFGVVGSRFNEIVILLLRQGELLASERYSIKAVXMTVVMFSXCFSISVAAQHLEKSGKYDAILCIGXAVIRGDTTHYDAVANSAASGVLNAGLSAGVPCVFGVLTCDDMDQALNRAGXGKAGNKGAETAITAIEMASLFRHHLT

SEQ ID NO: 123051 - protein, 153 aa, Triticum aestivum
  Clone ID: PAT_TA_17469.pep
HYASCMLRVLLLSHGDDTVAAANHLDNGVKGEDVWAVLAGQLFLGDCLILLVLYTSSVFCSGSLDTFHSLGGCSSCFVLYTSPVFCSDFSECEASVQYQWMCFLMSVLLQLTIFPGLFMTMTRQQTTIQLGQTLTKFFLPKSSSSFTFFVTSS

SEQ ID NO: 123052 - protein, 137 aa, Triticum aestivum
  unsure (1)..(137): unsure at all Xaa locations
  Clone ID: PAT_TA_17470.pep
PRGVQGAATPCLGGASPDAIDLCAIRPGIFWFGGVPGLLESQIRAILLLDSTQSAAPSTKPSWDGXDTLTHLLHRRRAGGDGXAESSTSXSXXTKXRQVLGXSVLPPGFNPSWEXLQISGLPXPTGRPRKEWDXPXG

SEQ ID NO: 123053 - protein, 135 aa, Triticum aestivum
  Clone ID: PAT_TA_17471.pep
EGRFLSSSLTKLRLWELSREGMKRFTKEQEDALQLLSSLQTLEFLHFEDLQQLPAGLRNLTSLKILSVSCCPAISSLPNDALPDSLEMLDVYNCSEELKQQCRGLVGTIPKIIIDRILLIQGQCLGVPLYILLAL

SEQ ID NO: 123054 - protein, 175 aa, Triticum aestivum
  unsure (1)..(175): unsure at all Xaa locations
  Clone ID: PAT_TA_17472.pep
MKVSWVWQRGSKDMTAMPHPRHRTAKKPMWIIVLLSIVCVSLIGAYVYPPRRYSTCYFFASSVCTPFKDWLPAVTRRELTDQEVFSSVVIRDLLAMPMPVSKKPKIAFMFLTPGSLPFEKLWERFLQGHEGRYSIYIHASREKPVHSSPLFVGREIRSEKVVWGRVSMVDAEKXC

SEQ ID NO: 123055 - protein, 79 aa, Triticum aestivum
  Clone ID: PAT_TA_17473.pep
AWSRPRYNMVSPREKRLAFFIGVTKEDGQVFVFSLTCRFNWRYFVAIFQQPATQKEGGRIYLLGYLIIPINGFLVCALR

SEQ ID NO: 123056 - protein, 218 aa, Triticum aestivum
  unsure (1)..(218): unsure at all Xaa locations
  Clone ID: PAT_TA_17474.pep
MRGLLGLGRQPPPLPLFPAGKRASPATTLLLRLRPRLPSSRLFRLLLLLAALSLVPPAFFHFRLRRFNRMRERSCGWTPSPPLVCAHGGDSTNAFPNSMDAFTMALDARVDCVEVDVSRSSDGTLLALHXQLGICKECLVILQQKLATGALMSLHXIKAVTTRFQLSKTVRNQEVPKAEDALELISQSVRQVILDVKVGPPSFEKGLAEDVMSIVSSR

SEQ ID NO: 123057 - protein, 125 aa, Triticum aestivum
  Clone ID: PAT_TA_17475.pep
TNDRSKFLRSQLALQLLKNSFCLKVANVERILKSVTSINVKEKECNFFVLYVHIVLVDNLLFSSDAFRNKTAIIDAWRNFLRNCSTQIGCTDWRFYASKVRNKASYLLQGAMLKRPAGSGSIPAK

SEQ ID NO: 123058 - protein, 81 aa, Triticum aestivum
  Clone ID: PAT_TA_17476.pep
ATFTYTVDEKKLKQPCSPQKLCRAWSFFPECKKAKKIIILNLPKYPQKARGLGPGRMIYKRRCMPDQAFMNQWILNCKHEP

SEQ ID NO: 123059 - protein, 156 aa, Triticum aestivum
  Clone ID: PAT_TA_17477.pep
MANAGLKPVAGLLLMLNFCMYLIVAAVGGWAINFAINNGFFIGSGLELPSHFSPIYFPIGNAATGFFVIFAVIASVVGMGAALAGFHHVRAWSHESLPAAASSAFIAWMLTLLAMGLAVKEIDLNGRNARLITMEAFTIILSGTQLFYILAIHGGR

SEQ ID NO: 123060 - protein, 253 aa, Triticum aestivum
  Clone ID: PAT_TA_17478.pep
NSDRKLLPQVFHTQFHGREVHSLCFIDPASYSIPQKSTDLWIATGCEDGTVRLTGYSASSAGRWCSSKLLGEHVAAPPVRDTCFIPKTYTLADKSRNSSVSSADTWVENKDTTYILISVGSKQVLTAWILEPRIAENNKQVCSSGRDLDTKQSSECSHNSGSAVTFQWLSTHMPPKLATNRLKADLVKRNFEEGGEGNSSAQPNLAIMDQMENDWRYLSVTAFLLKHPATELTVCFVVVACSDATVIVRALLL

SEQ ID NO: 123061 - protein, 212 aa, Triticum aestivum
  Clone ID: PAT_TA_17479.pep
MEESQEVEELVDTRLSLVIGAASRPPPTVLALLPAASPENEAAARGKRKGVKGPENGAGGAAAASREHSKRSKTVHDSSDVDDDDRGDAAGGDGTRKKLRLTVEQAALLEESFRAHNVLSHGEKHDLAGQLGLKPRQVEVWFQNRRARTKLKQTELDCELLRRWCERLSDDNARLRRELAETRAVLLVGGSQDSTLTGCPSCNRLAGGRRAA

SEQ ID NO: 123062 - protein, 156 aa, Triticum aestivum
  Clone ID: PAT_TA_17480.pep
RQRGDAAGGDGTRKKLRLTVEQAALLEESFRAHNVLSHGEKHDLARQLGLKPRQVEVWFQNRRARTKLKQTELDCELLRRWCERLSDDNARLRRELAETLSSSPAFLSRLTMANDKAVCSSCNSSPAPGCRHNGPRARLLLPSAAPEWMRRSFVEK

SEQ ID NO: 123063 - protein, 111 aa, Triticum aestivum
  Clone ID: PAT_TA_17481.pep
RMVDTKLELAYIEKKKKTAQAGSLLSSNPTNIIITKTNDTMPGITIRWEDPGKWQSTMEQVDQLLEQHTGHKNYPSTKSIPPIIFGVNMPQKGIDELKGLDGVIAVINDDD

SEQ ID NO: 123064 - protein, 112 aa, Triticum aestivum
  Clone ID: PAT_TA_17482.pep
GPFFFFFFFFQCMQAPIWYLPCATIEKWPSQLFIRMLYHFFHYVHSHVCLTCLMRDRSRDVLIMYSDETLSRNRDVSQVLSGLDNNGFSACSKSSRWCKKRRRGYSKSRETC

SEQ ID NO: 123065 - protein, 130 aa, Triticum aestivum
  Clone ID: PAT_TA_17483.pep
MVDTKLELAYIEKKKKKKGPYKSCLFEKKKKKNSFQSILFIRKKKKKKTLFNQSCLFEKKKKKKNTFQSILFIRKKKKKKYFSINLVYSKKKKKKILFKQSCLFEKKKKKKLFNQPGLFKKKKKKPLGPG

SEQ ID NO: 123066 - protein, 125 aa, Triticum aestivum
  Clone ID: PAT_TA_17484.pep
CVRCCHRPDCKQSMETFHPAFHGGQEAPCPRHICYPAALSAPFLIPWRSPPTLAKEERRPSIDLDFQNQRDGPELAKSSIALEQILTIAQVPRRQRIFIAKHGPIGHDALGLRASTYHTTASAPN

SEQ ID NO: 123067 - protein, 216 aa, Triticum aestivum
  Clone ID: PAT_TA_17485.pep
MAEQQTPTFKLVLVGDGGTGKTTFVKRHLTGEFEKKYMATLGVEVHPLGFTTNFGQIQFDVWDTAGQEKFGGLRDGYYINGQCGIIMFDVTSRITYKNVPNWHRDLVRVCENIPIVLCGNKVDVKERKVKAKTITFHRKKNLQYYDISAKSNYNFEKPFLWLARKLVGNPQLEFVAAPALAPPTAQVDEKLLEEYRKEMDEAAAMPLPGELSDDDL

SEQ ID NO: 123068 - protein, 124 aa, Triticum aestivum
  unsure (1)..(124): unsure at all Xaa locations
  Clone ID: PAT_TA_17486.pep
PPPRCRAPGSGGIVRGVAVSCGLVLLASRHLPTSPPLPVIAAAPICVRRSPAVVQPYFGDLFPEXISMRCEAHQKKYPDAKVISLGIGDTTQHIPSIFTSIMTKVSRIIDGDMDDSCGLDKANA

SEQ ID NO: 123069 - protein, 119 aa, Triticum aestivum
  Clone ID: PAT_TA_17487.pep
MLDRSLRPAEAGAGAAGPGEVRGNVDRVLFKDLVDMVPLVESLMDRRTNPSYSRRASLVYTPAPAKKGGDLKSAKTPQTVSAKKRRDPGDTGNKSTPDSNGRERVGCPRIDSIGSRKNK

SEQ ID NO: 123070 - protein, 323 aa, Triticum aestivum
  unsure (1)..(323): unsure at all Xaa locations
  Clone ID: PAT_TA_17488.pep
MANAEDAPTAVAAGSCRWPSALRWIPTSADGIVAAEKRLLSLVKTGYVQEKVNIGFAPPGSKARWFRSSEEPRFINTVTFGSSKENAPTLVMVHGYGASHGLFFRNYDALASRFRVIAIDQLGWGGSSRPDFICKSTEETDAWFIDSFEEWRKANNLSNFILLGHSLGGYVAAKYALQHPEHVQHLILVGSAGFSSETDHSSEWLTKFRATWKGMLVNHLWESNFTPPRIVRGXGPWGPYFVRRYTTTRFGSCYIHFQXELLTKHESILLTDYIYHTLVSKASGELCLNYTFSLGAFARKPLLKSASDWKVPTTFIYGQDDWM

SEQ ID NO: 123071 - protein, 173 aa, Triticum aestivum
  Clone ID: PAT_TA_17489.pep
LGKQTFINNSMPPHMGPRPTCHRLPSPGMATPAGFGASSTAKVSVDASLAGAIIGRGGVNTKQISRVTGAKLAIRDHESNEALKNIELEGTFDQINNASAMLRELIFRISGGANAPPPGVIPAGGSHRGGGGSGQGSNFKTKLCDNFTKGSCTFGDRCHFAHGENELRKSAAV

SEQ ID NO: 123072 - protein, 256 aa, Triticum aestivum
  Clone ID: PAT_TA_17490.pep
EGSSIPLDARRLPISSESDGSNYAGSAIRAYSPNVLGSFGSTTLQNPTMSGLSTMMVGRSYYDPTTILGGESGGSSAYPKKYHSSPDVSAVIAASRNSLLNKANMGSAAGNQPYLSRLACERSHNVGTANMSQSSVQSSMNTKPASLWSRQPFEQLFGVPSAELNNRSPVNTERRSNGTKDDFSYKESEAKLLQSLRFCIMKLLKLEGSRWLFRQNGGCDENLIDQVAAAERVSQETADGMDANCTHGRLGCGVEC

SEQ ID NO: 123073 - protein, 204 aa, Triticum aestivum
  Clone ID: PAT_TA_17491.pep
HEGESLIKAKEWLVDLVEISLEAGKMSEAELTQSASNKGGPVTPVSRTNLATFKVVTNRTLFRKAKEWMVYFTEECLKAWPDASQDDLPQLFCKDGDPDGTVPRTVPGSLTSLAENSAIASVKKPDALFSQTMLGTLTNPAEDSGMSSVTNAGAYKPLSEEYFSSSRKNPRMELATIRQDFDPKRRRTTLTSQIETGTEDQQAT

SEQ ID NO: 123074 - protein, 328 aa, Triticum aestivum
  Clone ID: PAT_TA_17492.pep
MGDHTTVAEVQVDDNARSDSEDSSYDADSITDSASIASSVLKYNWKNGRRYHSDRAGEYSFPNDDEEQDRLDMVHHVFTRLINDRLFTAPIDPEGARVLDIGTGTGLWAIQFGDKHPSAVVIGNDLSPIQPDWVPPNVRFIIDDVEADWVDPVPYDYIHCKYMAGSIKDWPRLIKQAYASLKPGGWIELHETANTLYSEDDSLQPDNALVEMMEHLTIACEKIGRTMDPAPSFKQWVGEAGFESVKEDRFKLPIGPWPKDERLKEIGTLMGINMIEGVAAFTAVLFTEVLGWSRERVELFNARVRQASRQRSVHPIFDCLVVTGRKPG

SEQ ID NO: 123075 - protein, 148 aa, Triticum aestivum
  unsure (1)..(148): unsure at all Xaa locations
  Clone ID: PAT_TA_17493.pep
MAVAALKVQLNALLSNMFATGMVDEQFQQLQSLXEGGTGPSGFVEEVTTLFIDDADRIIPTSPTFWTLPVVDFDKVDAHVHQLKGSSSSVGAQKVKLACMHFRQFYEAKRKEGCLMALALVRSEFCDVRNKFQTMMQLEQQIEACSPK

SEQ ID NO: 123076 - protein, 118 aa, Triticum aestivum
  Clone ID: PAT_TA_17494.pep
YVRAGEGAKITWMINRKTTSFDGGDGKGKGASRSLKSWAASTGVSCDGAVRVEEGFIREGDTASVIGVLKRHHAFDVVDAPDGVVATGCQPARCMFPVLVGGLVLIGSDDPDEGVYMV

SEQ ID NO: 123077 - protein, 198 aa, Triticum aestivum
  unsure (1)..(198): unsure at all Xaa locations
  Clone ID: PAT_TA_17495.pep
MSREFSAAEIANPCLQSAGILLQKADVWLLNLEQRGGHILARQYCKHIERETIPIAFXNNVLPNLLDHPGFGGGDDPRWTIFMEDCEEEVCSKIRXAFLPLLKNAKCNPCLEYIKYIILPWFGKFEVLQTVENSGIKTFMCMEELAADYESGALHPIDVKQALVKAINMMLQPVRDHFSSNDEAKELKEAMQIFNSNI

SEQ ID NO: 123078 - protein, 344 aa, Triticum aestivum
  Clone ID: PAT_TA_17496.pep
MERFRFRAPPLSLKLAFAAVSLSLGVSFAAVSCSSSSSPLPSSAASSSPRPSPRTVAADLLAVLAGPRAAARVPAREASRLSSCLRFLSPANPASVPSAYPWRGSRKVLLEGCDAAEADAMVMWPPAPVLELARLAVDSGGDPGAIHRLLDPTMLPVPDVEGTKKSKCHLTRTPYGRHFADEEINSYFAFLFELIAARGPSVGLNVSLTRYDLFHGHLFLASGTGRLGILFHAKEYPAFDKESFPYNLGYCQTESDVPYDDSMNLRNILWLAPLPSSETKAWLAPGVLVVLDAHPDGIIYQDMIRDYVQIVRTIYEDDFGKHAVDVNYLNVANAAAPADRIFIC

SEQ ID NO: 123079 - protein, 527 aa, Triticum aestivum
  Clone ID: PAT_TA_17497.pep
MALEAANHYLQLAGVHGTSTPAVLLTVLLLLIIRLAWVRTTTASTRFGKQQQLPPSPPGKLPIIGHLHLLGSQTHISIRDLDAKHGRNGLLLLRIGAVPTLFVSSPSAAEAVLRTHDQIFASRPPSMAANIIRYGPTDIAFAPYGEYWRQARKLLTTHMLSAKVVHSFRHGRQEEVRLIINKIRAAATRGTAVDMSELLSGYTNDVVCRAVLGESHRKEGRNRLFSELTEINVSLLGGFSLENYIPPNMVMADALLRLVSVKAQRLNKRWDDLFNEIIEEHLHPSKPSSGEQQAADFIDLLLSLKEEYGLTTDNIKAILVDMFEAGIETSYLTLEYGMAELMNNRHILTKLQEEVRSQGKKLDMITEEDLSSMAYLRATIKETLRMHPPAPFLLPHFSTADCKIDGYLIPANTRVLVNAWALGRDPSSWERPEDFWPERFLQDQDGDVDTQMRGKDLRFLPFGFGRRICPGMNFGFATMEVMLANLMYHFDWDVPNMVGTGAGVDMAESFGLTLRRKEKLQLVPQIP

SEQ ID NO: 123080 - protein, 275 aa, Triticum aestivum
  Clone ID: PAT_TA_17498.pep
SLPFPSPSAVTAAPGGLSRHGPVAAGSGVPPAQGLHQGSGREYRALPAAVQDRVLPHHVPWAPTSVCKDISVSDEGELVVSGPPRRTRSSSWGSSPTRKYKEFAGGLICALPLRGGCFCFPKPNTLTKVGPWGGNGGTPFEIPQAELPQRLESVTIQSAEVIDSIAFTYIGLDGARRTVGPFGGGGGTKQPILQLGPSESLKEIFGTTGNFLGLNIVTSLSIVTNVKTYGPFGKQSAGNTPFRTTAPDRHSIVGFFGRAGQFVDQLGAYVRPTPN

SEQ ID NO: 123081 - protein, 106 aa, Triticum aestivum
  Clone ID: PAT_TA_17499.pep
MEAGAGPPKPGAAAKVASSSSSFSSVAATAASLVAVGLGGAALLVWWALAFHPAHARLWMVPAGLVLLGTPVLAWLSLFASGPCRCGRRRPVDAPEPPAPGAHAAA

SEQ ID NO: 123082 - protein, 193 aa, Triticum aestivum
  Clone ID: PAT_TA_17500.pep
STPFFFHPDHTNLFHPNQIAGEGVCGGQPVDLGGMPVVRESGTARGCWARKGEEQSRLRRGMSKRRAQRGIAAAIAGEGVAAACPRISAMAPARESRSTRGCVARRERAAADLTPPPSAAAALQRRHVVEVNQKVDDALPLAAELLVDVDAVFFPAMCRRGTARRESPMARARRRVQLGARRAPLVAGRHGRA

SEQ ID NO: 123083 - protein, 221 aa, Triticum aestivum
  Clone ID: PAT_TA_17501.pep
VDLESSRRHAEKTEAELRDEKKCTEELDDALQRAIYGHARIIEHYVELQELYNDLLERHRGVMGGIAEVKAPAATARESGGRTAPPAALAPAPSPLRILPVDARAPPREQSRRLRVQLRDTAEAVHAAGELLVRLREPEEASTQEKERSAAMLQENQKLKKQVEKMRRKHEVEIETMKHYLAESRLPESALGGVLPRRGCAPGSPPTGHDDDQSWRSAFKS

SEQ ID NO: 123084 - protein, 288 aa, Triticum aestivum
  unsure (1)..(288): unsure at all Xaa locations
  Clone ID: PAT_TA_17502.pep
STPSYHSPPQPHTTPSPPGSTTPSYPTPPSSSSTPSYHSPPQAYHPPSPHPRAPTPPYPTPPSGSTPPPPHPPPRPPPTPRPYAAPPXPPPAPRCKPGGPSAPPPTTGRPSRTRRPPPPTAPXRPYGSLRTPPPXPPPTPASPGLPTRRGHQPPPRLQQGPPRTPPPPHPRPHQPPSPPGTTTPPPPRHCPPPSPAGANLPFPPVYGVAYGSPPPPMKPXQLIPPDPPPEPPPTPDRRQYNTSPRARSAITRSIFFHLGFLFHLFFFLLLNLLRVFDPRSTEREIGWS

SEQ ID NO: 123085 - protein, 285 aa, Triticum aestivum
  Clone ID: PAT_TA_17503.pep
MRSARDLRLAVSALLLLLLLSAGVLAARAQHEIDDESEFSYIRGSENGPENWGKIKEEWATCGTGQMQSPIDLSDRHAAQAPNLRYLNHSYLPVDASIINRGHDIMVKFNGDAGSLWINGTAYHLKQVHWHSPSEHRVNGRRYSLELHMVHLSADNKTAVIGILYKIGRRDHFLHELEPYLKRIADTKEKEEMVGMVDPWEARGDAEAYYRYMGSLTTPACDEGVIWTVIKRVATVSTHQLKLLTDAVHDGFEMNARPLQKVNGRDINFFCPDDHHERYYAAADQ

SEQ ID NO: 123086 - protein, 222 aa, Triticum aestivum
  Clone ID: PAT_TA_17504.pep
MHSARQLHLAVWALLLLLHFSSFVPAARAQQEIDDESEFSYVCGAKNGPENWGEIKEEWATCGTGRMQSPIDLSDRRASRAPHLGYLNHSYPPAEASIVNRGHDITVMFHGDAGSLWINGTAYHLRQVHWHSPSEHRVNGRRYNLELHMVHLSAENKAAVIGLLYNIGRPDHFLHELEPYLRRMADMKEKEENVGVVDPWVARGDGEAYYRYMGSLTTPACG

SEQ ID NO: 123087 - protein, 162 aa, Triticum aestivum
  Clone ID: PAT_TA_17505.pep
MAKLHRLVSVVLRLVAAVTAAAAAIIMVTSRETTSLFGLEIEAKFSHIPSFIFFVVAYAVACVYSLLVILVPPGGAASRLVVMADVAMGMVLTGAVAATGAIAEVGRNGNEHAGWLPICEQVHGYCNQVMGALIAGFVALVVYFLIIMHSLHAVTDTMCPCH

SEQ ID NO: 123088 - protein, 161 aa, Triticum aestivum
  unsure (1)..(161): unsure at all Xaa locations
  Clone ID: PAT_TA_17506.pep
MAAVVRSVWQGIREKGLTNFLRHAREEGYLKCLGDGNLLQTKIHNIGATLVGVDTFGNKYYEKLHXTLKYGRHRWVEYADKGRYNASQVPAEWHGWLHHITDSTGDKLLEEKTKKFIREHRQNYTGQGDDLIYHSKGHALNPGQRDWTRYQPWEPKKEEAT

SEQ ID NO: 123089 - protein, 287 aa, Triticum aestivum
  unsure (1)..(287): unsure at all Xaa locations
  Clone ID: PAT_TA_17507.pep
MSFSSVSAASQPRVGVVQMTSVGDLDANYATCSRLTKEAAAAGVKFLCFPEVFSFIGSKDGESVKLAEPLDGPIMQRYCSLANESKXWVDIGRFQIRRPXLSLGGLQIXVTDEFAKVRHSYRKIHLLNREELKQCIVPTEGDTLLAVNRSYVRCRLTVCFEMILLRFCAYHLYTHRYLGXLAANAFTKVTEEAHWEILLRARAIETQCYVIAAAQAGKHNEKRESYGDSIVIDPWGTVIARLPDRLSTGFAVADIDLSKVEAVRTKMPISGHRKFETHLEVLITIIS

SEQ ID NO: 123090 - protein, 123 aa, Triticum aestivum
  Clone ID: PAT_TA_17508.pep
VELDTSWDVIKAGDLWEDDDDNGYVLVKPEDAAEGIAFFVATYLSTLTKTKELSPDRLQKALKKTFSAEKRKGKLRKAWDGTKVIYNVASWGATAVGIYNNQAILKAAGTAIQMSWRVVSKFL

SEQ ID NO: 123091 - protein, 222 aa, Triticum aestivum
  unsure (1)..(222): unsure at all Xaa locations
  Clone ID: PAT_TA_17509.pep
MPTELKRAAEDGDDSTPTRLRRKIVVPEKPVYLVVAHKAEPAYSILSVGTMAPKIPLHLSQRGMSFTAMESPQGSWIVGVGGDXQIHTTIFDVTASKEWQGPWLHTNKMEPILFPHXAKLYVLSKXPSVERGAMGLDYLPWFEQIXTSRTAALTKXEVCLELEPPPIFPCRITPPEYRNPPAIRVASYAMVGSHILLSVQLDNVTSPDKVARKYRKYMGTCG

SEQ ID NO: 123092 - protein, 329 aa, Triticum aestivum
  unsure (1)..(329): unsure at all Xaa locations
  Clone ID: PAT_TA_17510.pep
MVIKLDFRKAFDSISWSSLTSILQARGFPPIFCAWVQNILHTGKTAILLNGTPGSWIQCRAGLXQGDPFSPYLFIIVANVLQRLIAQAFRQNELCHPLRSNEPPVTLQYADDTLIIAAASVAATTILKNTLHDFALATGLVINFQKTSLLTIATDDLTQNNIAATIGCNLSFPLIYLGLPPSPLKLPLSAFDPILDSFRKLLFGWVARLLSRGARLTLLTAVLDSLTIYFMSVFRLPKSILVKLDXSXRAFFWSNEETCTGAKCLVAWKNVCRPKELGGLSIKNLEIQNRWLLMKFSFKLQHKPLGPMVSSTIPTWDCNKTLGFFLGRL

SEQ ID NO: 123093 - protein, 122 aa, Triticum aestivum
  Clone ID: PAT_TA_17511.pep
MTRHVTCLSNPSLFSSNEIQFGCCTVDILKQLSGDEISRKPPGGKAADRIGRLATHIVKQQSYYPLYPPGCWVCPMDFLTCQGKQLGDSRQAPGWFLLLPSWILPHPGERVLSVKRKTPGEH

SEQ ID NO: 123094 - protein, 109 aa, Triticum aestivum
  Clone ID: PAT_TA_17512.pep
MKHLAAYLLLGLGGNTSPSAADVKAVLTSVGIDADEDRLNKLISELEGKDIQQLIAEGSEKLASVPSGGAGGASGGAAAAGGAAEEAKEEEKEEEKEESDEDMGFGLFD

SEQ ID NO: 123095 - protein, 109 aa, Triticum aestivum; identical to SEQ ID NO: 123094
  Clone ID: PAT_TA_17513.pep

SEQ ID NO: 123096 - protein, 71 aa, Triticum aestivum
  Clone ID: PAT_TA_17514.pep
NKIKIPSSPQAYKLQVQEDVQIKAVMTAFCFKMEMTARLTVVPTCSDPRSGNKYLGTRSLGGGTTFLQVFA

SEQ ID NO: 123097 - protein, 100 aa, Triticum aestivum
  unsure (1)..(100): unsure at all Xaa locations
  Clone ID: PAT_TA_17515.pep
PCARAGAWVSNADWVLLTPWLQGRVAPAGPAGGRSGGGGAGGQGVKKAAAACDVEPLRKCLQENKGDRXQCQAHIDAFRSSCSVSPTTTSDSHPAVKKGM

SEQ ID NO: 123098 - protein, 267 aa, Triticum aestivum
  unsure (1)..(267): unsure at all Xaa locations
  Clone ID: PAT_TA_17516.pep
MGPGRRPRRRPRPAAPARGAAPAPGARPHTVTITEFGAVGDGTTLNTLPFQNAVSYARAFADKGGAQLYVPKAPWLTGSSTPSSHLPLGLVWDPCLLGAEGXNGLIPGQGLVWWDWLRSHELNHSRPHLVEFLYSEEIVISNLTFLNSPAWSIHPVYCSNVKVHNVTIKTLLDAPLTDGIVPDSCLNVCIEDSTISVSHEAISVKSGLDKYGISIGRPTSDIHISRVDLQASSGAALAFGSEMSGGISGIHADHLRIHGSDKGFSLK

SEQ ID NO: 123099 - protein, 122 aa, Triticum aestivum
  unsure (1)..(122): unsure at all Xaa locations
  Clone ID: PAT_TA_17517.pep
SWSESAALKAALLRVTTDRQGASNHSGDPGVRARLSRLHCYASPPTDRAPHPLLVCRGRARAPLRCSPARPLRQTEHQKSFWCSWSESVALNAALLCVTTVXLLVFRVATVVRGTTFLELXX

SEQ ID NO: 123100 - protein, 232 aa, Triticum aestivum
  unsure (1)..(232): unsure at all Xaa locations
  Clone ID: PAT_TA_17518.pep
MRLLSGVPASASSRLTSPRISFARSSRRSMGANGPTTGTASSSSSSSATASAGAGAGAAQKPWLFVGLGNPGRMYKGTRHNVGFEMIDAIAEAEGISVSTKQFKSMVGKGLIGDVPVMLAKPQTFMNASGESVGQLVSYFKIPLNQVVLIYDDLDLPFAKLRLLPKGGHGGHNGMRSVIHHLKQSRDFPRLRVGIGRPTGMMGAIGFVLRAFSKEEQEXLDSTFLRGLQRCG

SEQ ID NO: 123101 - protein, 138 aa, Triticum aestivum
  unsure (1)..(138): unsure at all Xaa locations
  Clone ID: PAT_TA_17519.pep
ARGFGLYHTDLTMAYDAGLTSSSSGGGGGSAPATPTPTTPTSPSKGSGGWCVASAGATDAQLQTDLDYACSQVGVDCGAIQPGGACFQPNTVRAHAAYAMNQLYQAAGGHPWNCDFRPAATLTSTDPSYGSCVFTGXQ

SEQ ID NO: 123102 - protein, 94 aa, Triticum aestivum
  Clone ID: PAT_TA_17520.pep
MTKGTSSFGKRHNKTHTLCRRCGRRSLHIQKHECSSCGYPSAKIRKYNWSEKAKRRKTVGTGRTRYLKDVSRRFKNGFQTGTPKGARGLTAEKA

SEQ ID NO: 123103 - protein, 144 aa, Triticum aestivum
  unsure (1)..(144): unsure at all Xaa locations
  Clone ID: PAT_TA_17521.pep
MAATGSAQSRRFAAACGVLSRCIKAAEARPAXVLPLMPGAEVPAQDEHAAGPAPANAQMTIFYGGQVLVLDEVPDDRAAELLRVAAVSGAPRGNSEAADGDLPMARKASLQRFMQKRKGRLAARAVPYSRPDGDAVPYHLTLTL

SEQ ID NO: 123104 - protein, 140 aa, Triticum aestivum
  Clone ID: PAT_TA_17522.pep
MAATGSAKSRRFAAACSVLSRCIKAAEARPVALPLMPGAEVPALQDEHAVGPAPEHAQMTIFYGGQVLVLDEVPAERAAELLRVAAAAGTAPGDGDLPMARKASLQRFMEKRRGRVAARAVPYSRPDGDAFSCNRLTLTL

SEQ ID NO: 123105 - protein, 147 aa, Triticum aestivum
  Clone ID: PAT_TA_17523.pep
MAATGSPKGLRFAAACGVLSRCIKAAEARPAATVVLPLMPGAEVPAQDDHEAGPAPANAQMTIFYGGQVLVLDEVPADRAAELLRVAAVSGTPRASCEAADGDLPMARKASLQRFMKKRKGRLAARAVPYSRPDGDAFSSNRLTLTL

SEQ ID NO: 123106 - protein, 147 aa, Triticum aestivum
  unsure (1)..(147): unsure at all Xaa locations
  Clone ID: PAT_TA_17524.pep
MAATGSAKSRRFAAACGVLSRCIKAAETRPVALPLMPGAEVPAQDDYAAGPAPEHAQMTIFYGGRVLVLDEVPADKAAELLRVAAVSGTARGSCEAEDGDLPMARKASLQRFMEKRRSXKGRLAARALPYSRPDGDAFSCNGLTLTL

SEQ ID NO: 123107 - protein, 87 aa, Triticum aestivum
  Clone ID: PAT_TA_17525.pep
VDCELSQRDQLPRVNKKDSSEEPSMAAARCSSFPALCVVVVVVVLIGGCGAASGADEEGLIHLHFYFHEVNAGTPNATVLNVASLHK

SEQ ID NO: 123108 - protein, 64 aa, Triticum aestivum
  Clone ID: PAT_TA_17526.pep
PQNLCGWRLRSSAVASRPPDPWPGSPPGHWPPRASPQDPPASASARPAPPLALSPCRHEPEPGH

SEQ ID NO: 123109 - protein, 369 aa, Triticum aestivum
  unsure (1)..(369): unsure at all Xaa locations
  Clone ID: PAT_TA_17527.pep
MSTRNNIMSSVTPALTRRIILQCRHQIGQNDGVSKAADIDMINAFNDITAKINGHVAFGTSHQDVEEVIVLMREMQKIATASTLDAPILWYLPTRRDMHVRRLNKQLRSKIMXIMQARLAADGAKYGRGDTGGCGDDLLGLLLEAWTPHRQGSGGDTMTTDEVIDECKTFFAAGQETTATLLIWTMFLLAVHPQWQDKVREEVLREFPGGDGDDVIPNADILAKLKLLHMVLLETSRLYPPVVYIQRKAASDTVLGGIKVPQGTIISIPIGMLHRDKEVWGPDANEFNPMRFEQGVTKAAKDSKALLTFSLGPRVCTGQNFGIVQVQVVMAMILTNFSISLSPEYVHKPKYLLSLTPRLGMPLILRNLL

SEQ ID NO: 123110 - protein, 318 aa, Triticum aestivum
  unsure (1)..(318): unsure at all Xaa locations
  Clone ID: PAT_TA_17528.pep
MCFCGSASCVQKKDFGPRKVWLLLIIPRKGKRYELRATWIPAYFMEIPLAGLLRTTSISESANSFFKRFICRKLTFVEFWLRFDTXLKCQRQNELIADNTSEYTTSELVTPWAAACRARAVFTHEIFELFQAQVLAARDDCDVQDTKNHEEIKIMFVSDQYKKIRXVSYDTVSMTAKCSCKLFESNGIVCRHIIRVLRGAKINELPRIYVLKRWERNCKRDIIFDGEGNMLEENLIDPVDMAMKRKIALIRNKLEDLIQKSKGSMEGIEFLHTSLCNAEMALAHLVPAVACNTRENEESFIGSIIPKHVTIHTPADIN

SEQ ID NO: 123111 - protein, 374 aa, Triticum aestivum
  unsure (1)..(374): unsure at all Xaa locations
  Clone ID: PAT_TA_17529.pep
MLAAAASVKFSPASAGTSSTTKLAFKPVHLPFLPNAVPRPLSLSARPLYRQEPFLAAARNDRAASTAPPAATADGARPVETAAAPEAAKSAKIGVYFATWWALNVIFNIYNKKVLNAFPYPWLTSTLSLAAGSAIMLVSWATRIAEAPQTDLDFWKALSPVAIAHTIGHVAATVSMAKVAVSFTHIIKSAEPAFSVLVSRFFLGEHFPLPVYFSLLPIIGGCALAAVTELNFNMIGFLGAMISNLAFVFRNIFSKKGMKGKSVSGMNYYACLSMLSLVILLPFAFAMEGPKVWAAGWQNAVAEIGPNFVWWVAALVVFYRMRSQVXIMSLQHIEAHLGHRGNPMNRISVSCSPIILFRAAIAILGTFIYSQAKQ

SEQ ID NO: 123112 - protein, 285 aa, Triticum aestivum
  Clone ID: PAT_TA_17530.pep
LPRDPYEQLDLARRITALAVAGRVTGLEREAARLREGAAERDRENAELRDRVALLDRALQETNARLRAALEDNIQLSKERDSLAQTSKKQARDLHKLESFKRHLMQSLRDDSTSPQETVDITTCDQSVSSKTSSCGDGSISHTAANLLNGSGDLGSTTREAARTPVQKYALSPHINQRLTPEATPNIMSTSASPRGMSTTATPKLVSGATSPSRTRIEGHMSMTPWYSSKQSSAANSPPRGRPNPGRTPRIDGKEFFRQARSRLSCEQFGAFLANIKELNAHKQS

SEQ ID NO: 123113 - protein, 307 aa, Triticum aestivum
  Clone ID: PAT_TA_17531.pep
AVVWPDIPSFVVYKASDWSVVDSGTGKLFAWDSCRDRYALVESALAPRMPLIVKGGSSKKAKEAAAAAAQAAAAAASAASSATVQVRILLDDGTAHVLQRSIDGRSEPVVGLHGGALLGVTYRTSRRISPLTATAISTVQSMPLPPSRPSGSSFASDDPFSSREGPPQNFSVIHAGETYQPVSGLLAQPEWTVWDQTVEYCAFAYQQYIVISSLRPQLRYLGDVSIPSATGAVWHRRQLFVATPTTIECVFVDAGVAAIDIETKKRKEEMKAREAQGRADADHGDLALITVEGPQVTASEKISLRPP

SEQ ID NO: 123114 - protein, 128 aa, Triticum aestivum
  Clone ID: PAT_TA_17532.pep
MATKNSAVFLLGLLLSCVAMSSAARILEETVPSKEEHQPEVPPLPKVELPPFPEVHLPPKPELPKVELPPLPKVHLPSKPELPKVELPPKPELPKVELPTFPEVHLPPNAGDAHCSRVPPPGSRQAKP

SEQ ID NO: 123115 - protein, 217 aa, Triticum aestivum
  Clone ID: PAT_TA_17533.pep
SNDEEMGSKQDMQDLLLSVGIVSPVTKETAGALYHQQLSRQLADFVRVPVERAGGMMALVDVYCLFNRARGTELISPEDLLQACSLWEKFDVPVMLRKFDSGVKVIQTKTHSDDEVFARISSLAQKPDALLKGISPSDAAFTLGIAPALAKEHLLNAENKGLLCRDVSPDGFRFYINLFNEIDLQNIHLPKAHGLYHTWDLSGNGSTLTHFGRGGFS

SEQ ID NO: 123116 - protein, 378 aa, Triticum aestivum
  Clone ID: PAT_TA_17534.pep
LCSPAAMGNCFGSRIGSDSPYKSAGGSASPSSSSGEGGASVSSSRVSSSPPTTVPPTPRSEGEILQSANVKSFAFNELKTATRNFRPDSVLGEGGFGSVFKGWVDETTFAPARPGTGMVIAVKKLNQEGFQGHREWLAEVNYLGQLSHPNLVRLVGYCLEDEQRLLVYEFMPRGSLENHLFRRGSHFQPLSWNLRMKVALGAARGLAFLHSDMAKVIYRDFKTSNVLLDSSYNAKLSDFGLAKDGPTGDKSHVSTRVMGTHGYAAPEYLATGHLTAKSDVYSFGVVLLEMLSGRRALDKNRPSGEHNLVEWARPYLTSKRRVFHILDARLGGQYSLSGAQKTAALAMRCLSGDARARPGMAEVVTALEQLQDAKEAAA

SEQ ID NO: 123117 - protein, 232 aa, Triticum aestivum
  unsure (1)..(232): unsure at all Xaa locations
  Clone ID: PAT_TA_17535.pep
PRTSSGPSLAPPPPPAPPAAPPPPRAPRRPRPCPAPPLPLPPPVGALPXPSPPGPGPPAPPAPPDSPPXSPAAPAALPPPRPRRPPPPLPRPPRGQVPAPAPPRHRPPPTAPGGRPPRAPAWACRRPSRVPGFPPPSVPPCAASRGXPASAPLRPACRWPSPPRPQAPAPAPPSRVAPPPAFPCFDRALAPDTRAGPSPHRRPPRTPPPPRLRLVHVGRSATTILPPDHCGK

SEQ ID NO: 123118 - protein, 214 aa, Triticum aestivum
  unsure (1)..(214): unsure at all Xaa locations
  Clone ID: PAT_TA_17536.pep
MAAYYHGGAGTDIHQAGSDGLQTLYLMNPSYGNGSYGDAGPSGANMMLLNSAVSSMTPASFGGHQASPPPGQHFVGIPLQAPPSGYNLWTPATTGIADVMSPPTQQAHGVSAVLSLSSRETPPVTVASIAGDEGRYHLGSTTAASQGQVVMNSKYLRAAQELLDEVVSVSKGVDDVDPKAKSAVSVKKKEDXGGLXXRGXEEGASGAKGGAPAP

SEQ ID NO: 123119 - protein, 362 aa, Triticum aestivum
  Clone ID: PAT_TA_17537.pep
FRHTRDRQVSMRVATVSQAGPSAPVILSVMFHNVTNSIVARAAFGKNRKNAAEFQAAIKSGVGLASGFNIPHLFPTWTTVLAKLTGMKRILQDIHKTVDAILQEIIDERKAARIEKIMAGAENVDENLVDVLIGLQEKGGFGFHLHHSRMKAIILDMFGGGTGTSASAMEWGMSELMRNPRVMKKLQGQIREAFKGKAVVTEDDLQESNLQYLKMVIKEALRLHPPAPLLVPRESIDQCELEGYTVPAKSRVIINAWAIGRDPKYWEAPEEFRPERFEDSTVDFTGSSYEFLPFGAGRRMCPGFNYGLASMELALVGLLYHFDWSLPDGVAEVDMEEAPGLGVRRLTPLMLLATPFVPAAVA

SEQ ID NO: 123120 - protein, 106 aa, Triticum aestivum
  Clone ID: PAT_TA_17538.pep
DHGTDIVDDIDSRCSSQFARTLKSAVWCLTSPEKHFAEMIRESVVGLGTYEDMLTRVVVSRAEIDMKQIKEEYRARFKTTVTCDVVDDTSFGYKDILLALVGCEEE

SEQ ID NO: 123121 - protein, 349 aa, Triticum aestivum
  unsure (1)..(349): unsure at all Xaa locations
  Clone ID: PAT_TA_17539.pep
KTYGASEPSPYSSTFRSPILMPRNTSAPPSPLPKLFPENQISRTEVNGSASLHPLPLPPSAISPMQTSFSNQPAPKVEMPSVSCQWQKGKLLGSGTFGCVYEATNRNTGALCAMKEVNIIPDDAKSAESLNQLEQEIKFLSQFKHENIVQYYGSDTIEDRFYIYLEYVHPGSINKYVKQHYGAITESVIRNFTRHILRGLAFLHGQKIMHRDIKGANLLVDINGVVKLADFGMAKHLSSAAPNLSLKGTPYWMAPEMVQATLAKDVGYDLAVDIWSLGCTIIEMFGWKTPWSDLEXPAAMFKVLHKDQQFLENLPLEGKXFLQCCFKXDPTKRPPKXXFXXPFSRIKSL

SEQ ID NO: 123122 - protein, 167 aa, Triticum aestivum
  Clone ID: PAT_TA_17540.pep
MATPARRPSAQQQQPLTVDFEALSYISRLVEAFQAFDSDNDGLVTAPELRGLLASLGLDKSEAEARDMLARADADRDGRLCVEEFLDVMNAGELGLGALGALLQAAVPALESFAGPDGALGPDELARVLGLMGTASAEDCAEIIACMDGDGDGAVSVEEFKLMADLL

SEQ ID NO: 123123 - protein, 170 aa, Triticum aestivum
  unsure (1)..(170): unsure at all Xaa locations
  Clone ID: PAT_TA_17541.pep
ALPPSRRSXTDFGRPVFTAAAFYLCAKRHKLKVDKLKLIDLCGTSSSEFTTVSTSMGDLCFDVFGIAKEKKDPTSIKGNRELLDVLPSKRKHEDDSDHSDESSGDDNDDELDLPTHKRHKKMEKQAYNQWKSSVISTNKQTKPXDPTKPRKQAQLNFKKKLPLEVPPPAN

SEQ ID NO: 123124 - protein, 123 aa, Triticum aestivum
  Clone ID: PAT_TA_17542.pep
GCGMAAAGGYGSCRVAAPEAEGAASDGGEGWVLSSSHAVAEGSRRLLLFLLAAAPASDLSGSCSCSPLVNLLHRCAPVASVDSTRGLRRWPNRPPWRASAACYCTTTSASGGAAAGRCSSTLF

SEQ ID NO: 123125 - protein, 182 aa, Triticum aestivum
  Clone ID: PAT_TA_17543.pep
MPLLEELRRGQGPLRPGPPPLVTHAMALKKLQIWNVQVLHSLENFVSVVELDLGNIPELAMISNLPKLQKLIIKYCPKLETLQEMAALRRLELRVSRWENQLPVYLQTVKPSHLLLTCNLEVLTSMAEGESSSEWDKFSHIKQVEAYAKDGRDEKKWHVFYTSEPCNIQTNIHQGRLVEEED

SEQ ID NO: 123126 - protein, 233 aa, Triticum aestivum
  Clone ID: PAT_TA_17544.pep
MSPSTPLQKPVSSPSTPWSRKSSGSAKGIQTEAMLDQFLATLDENIDNVTDSANKTATPPATITSFGIASPVSVTTSTTPSGATRSTPLRPVRMSPGSHQKYSTPPKKGEGELPPPMSLEQAVDAFESLGVYPDIEQWRNNLRQWFSSVLMSPLVEKIKSSHIQVKQTTASIGASVNVSQVGSDLPSTAPPVSLSPLGGTKDWQPTVTVDEDGILNQMRAALLQSRNAPVAQT

SEQ ID NO: 123127 - protein, 343 aa, Triticum aestivum
  unsure (1)..(343): unsure at all Xaa locations
  Clone ID: PAT_TA_17545.pep
MAMRSRGLQLRSRRQHSVLVAAAVVVGVLLLATAAPRVAAAGLSRNYYAKTCPNVEALVRGAVTQKLQETFNAAPGTLRLFFHDCFVRGCDASVLHLRAGRRTQRGGADTTLSPDAVXAINSAKAAVEALPGCAGKVSCADILAMAARDVVSLTGGPSYGVELGRLDGRSFIKSIVKHVLPGPGFDLNQLNALFASNGLTQFDMIALSGAHTIGVTHCDKFVRRIYTFKQRLRYNPPMNLDFLRSLRXVCPMNYPPTAFAMLDVTTPKTFDNAYFDNLRYQKGLLASDQVLFTDRRSRPTVNLFAANSSAFFDAFVAAMAKLGRIGVKTGSAGEVRRVCTAVN

SEQ ID NO: 123128 - protein, 278 aa, Triticum aestivum
  unsure (1)..(278): unsure at all Xaa locations
  Clone ID: PAT_TA_17546.pep
LQETCNAAPGTLRLFHHDPCVRGCDARVLNSEPGDEHSPGADTTLSPDALDLITRAKAAVDAVAGCSNKVSCADILALATRAVVQQAGGPFYPVELGRLDGKVGTRAVVKHSLPGAGFSLDQLNKLFAANGLTQTDMIALSGGHTIGVTHCDKFVRRLYTFKGXRPQYSPPMNLAGLRHMRGTCPLNYNPTTVAMLDAVTPNKFDNGYYQTLQQQKGLLSSDQVLFADRRSRATVNYFAANQTAFFDAFVAAMAKLGRIGVKTAGSDGEIRRVCTKVN

SEQ ID NO: 123129 - protein, 189 aa, Triticum aestivum
  unsure (1)..(189): unsure at all Xaa locations
  Clone ID: PAT_TA_17547.pep
AGLHDKGKAXILEIETTTSLKDSGEVLCMNRSTIFLRGAGGFSDSSRPYSYTTYPANQISRISIPNSTPSAVYEDQTQQSQALLYRLSGDYNPLHSDPMVAXLQGFAARAVIKSFCNGDPAAVRNIFGRFLLHVYPGETLVTEMWVDGQRVQYQTKAKERDRAVLSGYVLLKHIPSSLSSGADNGGGRL

SEQ ID NO: 123130 - protein, 333 aa, Triticum aestivum
  unsure (1)..(333): unsure at all Xaa locations
  Clone ID: PAT_TA_17548.pep
MATNGRTVASVDPDVALAYKFPEASFAYDERDVALYALGVGACGADAVDDKELHLVHHRDGQRHIKXLPTFAGLYFLTRTAMGVELLMXPGIHFDASLLLAXGNKYIEIYKPIPSCASVXTRLRVAGLATTKGKATILEIETTTSLKDSGEVLIVMNKGVLFSLRGXAGGDFSDSSRPYSYTTYPANQISRISIPNSXPSAVYEDQTQQSQALLYRLSGDYNPLHSDPMVAQVAGFTRPILHGLCTLGFAARAVIKSFCHGDPAAVRNIFGRFLLHVYPGETLVTEMWVDGRRVQYQTHPLERVRAVLSGYVLLKHIPSSLSRRRGKEKARGY

SEQ ID NO: 123131 - protein, 196 aa, Triticum aestivum
  Clone ID: PAT_TA_17549.pep
TTIFKQQPPRRFLQRIHKNSSSPPAQEKTEKMSSMSCYTLAEGGSIFPSGDELVGNQKTEQGNYWTQWNSRLSDDLNTTSLYSDEHENGIEQCFDDADEHERSSQQERSSACARVASSDCSTGPSEEQSEGPAPLELQHCKETNDIFLSQFSDDEMRMMDAPFQALDMFPGSMHRLLSYENMLSGVLTDSQNQETN

SEQ ID NO: 123132 - protein, 353 aa, Triticum aestivum
  Clone ID: PAT_TA_17550.pep
MAAPQIPSQQWAQIFEKTAGPIEYKQIPVQKPGPDEVLVNVKFSGVCHTDLHAWQGDWPLDTKLPLVGGHEGAGVVVARGELVKDVKIGEKVGIKWLNGSCLSCSYCQNADESLCAEALLSGYTVDGSFQQYAIAKAIHVARIPEECDLEAISPILCAGITVYKGIKESGVKAGQSLAIVGAGGGLGSIAVQYAKAMGIHAIAIDGGEEKEKMCMSLGAQTFIDFTKTKNIVADVKATTNDGLGAHAALLVAAAEKPFQQATQYIRSKGTVVCIGLPAGAQFSAPVFDTVVRMIQIKGSYVGNRADTAEAIDFFRRGLIKVPFKTVGLSELNEVFKLMKAGQVAGRYVVDTSR

SEQ ID NO: 123133 - protein, 354 aa, Triticum aestivum
  unsure (1)..(354): unsure at all Xaa locations
  Clone ID: PAT_TA_17551.pep
WPSPGAALHSIEDEVKEILASAGVQIHSCYPRGVPPMLPLPMAALVSLTITFKXDRXSTTFTGSIGSRHWENCAGGSSWAKACPSXGLVGTQKVRRGHDFIVLSCIRSPFGRDKDAVAQLIQSCFSSFLRSSPSSGSDITASRGVGALMGESITGHQGLHFPMAPGFIYLRTCRTFHDTYFVSEMILRQVIDCSHKLANGWSSNXLQHLKSGRPPLSGAASMASQVAMLGAGLLCVAGGPLLVQVLYEETLPTLLLSAQEQMLEDPGPVASTLQGYAMANMLFFCGSLLWGSEKTSPIMKLSLLSRRPRVAGTHMDFIAGVLDGHILLGCDRVRGWVRIVLCIPGGNFPMVRTN

SEQ ID NO: 123134 - protein, 135 aa, Triticum aestivum
  unsure (1)..(135): unsure at all Xaa locations
  Clone ID: PAT_TA_17552.pep
KSTFAATCRFFRCGASLAVAGSDEVLPHPGHSADLLPEAQGAGGRSPSRFPSTKARAAAAEDAMEQHTRRASKRATWVEERSMITSQCFSQGMVALGELDYGWCCTEVLDTYDLFLFFFFFFFSRKXGRASKRPP

SEQ ID NO: 123135 - protein, 215 aa, Triticum aestivum
  unsure (1)..(215): unsure at all Xaa locations
  Clone ID: PAT_TA_17553.pep
HTPNPASNPMADSAGSKICNAKLVLLGDVGAGKSSLVLRFVKGQVVEFQESTIGAAFFSQTLAVNDEXTVKFEIWDTAGQERYHSLAPMYYRGAAAAIVVYDISNQASFTRAKKWVQELQAQGNQNTLVARAGNKADLLKAREIXIEEAKTYAQENGLFFMETSAKTATNANDIFYEIAKRLLQGQAAQNPQAAGMVLSQRPNERVVSAASCCSS

SEQ ID NO: 123136 - protein, 145 aa, Triticum aestivum
  unsure (1)..(145): unsure at all Xaa locations
  Clone ID: PAT_TA_17554.pep
MAGRMALAAVLLXAAAAAAAAQSASNVRATYNYYSPEKINWDLNAASAYCATWDAGMSYAWRSKYGWTAFCGPAGPTGQASCGKCLLVTNTATGAQITARIVDQCSNGGLDLDFDTVFSKIDTDGQGVAQGHLTVSYQFVDCGDN

SEQ ID NO: 123137 - protein, 144 aa, Triticum aestivum
  unsure (1)..(144): unsure at all Xaa locations
  Clone ID: PAT_TA_17555.pep
SQMIIYIIHHLKRLIALARKEDEHKNIFLQFXPVCKAPYVYITNAXLFIIHDFLLLLLFSFSEELGTRRSQARSQAAHTIRGFRRXGFYAVLLSPLLEQFLTWSPSGSCFCSMVPLHNGYXFMGDXFHYYFYQVPPXINSYIXA

SEQ ID NO: 123138 - protein, 83 aa, Triticum aestivum
  Clone ID: PAT_TA_17556.pep
ARGRTRTPAVPTRPCPPRSQSPPTAPSWSAPTGSSTTRRRRERRRPRRRRASCTAAACSRCPASPPRTSSSSWPSAAAAASAR

SEQ ID NO: 123139 - protein, 327 aa, Triticum aestivum
  Clone ID: PAT_TA_17557.pep
MRDLHLPLNQTQRVRLEAALHELQTLAPAAASAAAVTVADNIPVNHEDNILKGHGTTDQDGEVVATLCGVVERVNKLVYVRTLRARYKPEVGDIIVGRVIEIAPKRWRLEINFSQDAVLMLSSMNLPDGIQRRRTAVDELNMRSIFEENDVVCAEVRGFQHDGSLHLQARSQKYGKLQRGQLLTVPAYLVKRRKLHFHHLEQYDVDLILGCNGFIWVGEHVVVREIADLKEDEQKLSAEAETFTPIETRRHICRLANAVRVLSALGFTLTVELIIQTAEASVSSNVEINDMLGAEFYVQTAEREAKRRGDLLGKKSKSFWPCLPGLL

SEQ ID NO: 123140 - protein, 226 aa, Triticum aestivum
  Clone ID: PAT_TA_17558.pep
MAIRCFYATLVQILLCLMLCQPCYSTVTDIQCLKRLKASVDPNNKLHWTFDDNKEGSICTFNGVECWHPNENRILSLRLSSMDLKGQFPDGLENCSSMTSLDLSSNSLSGPIPVDISKRLPYITNLDLSYNSFSGEIPESLANCTYLNVVSLQNNKLTGAIPGQFAGLSRLTEFNVANNKLSGQIPPSLSKFSSSNFANQDLCGKPLGGHAPASSSGRPARAAGSA

SEQ ID NO: 123141 - protein, 167 aa, Triticum aestivum
  unsure (1)..(167): unsure at all Xaa locations
  Clone ID: PAT_TA_17559.pep
ARAKLVYAPEPHDVGRYLQAEVNLGGQTSVAKTAGPLDPAPGLVDYVETLVRNPETDYNVVVLQLNGIDQPADSIHVLCVGKLRMRLAQXETTVVAXESYSAPTLLAGAGRGGGAAPQPLPPPPRVGLGLPLGFDPARGPIAPPRLPRGFAIARSFILPPPGDPPPW

SEQ ID NO: 123142 - protein, 92 aa, Triticum aestivum
  Clone ID: PAT_TA_17560.pep
GPPQGCGGAAAWAGGGPPQGCGGAAAWAGGGPPQGCGGAAPRAAVAPGHRSAAVPRRAAAEARPRPRGPLVAEHPPSGAETPDGDGCGAGAL

SEQ ID NO: 123143 - protein, 208 aa, Triticum aestivum
  unsure (1)..(208): unsure at all Xaa locations
  Clone ID: PAT_TA_17561.pep
MPAPAQAPSAAAAGGAAWRHLLLLLTALPLALALLAFALQWRGGGVDDAGSRWPARLAVPAPSRLQSLHSSAASCVEVLAASAAPAFPYLRGWSFHFDAPDTHHPKVCVQTSTSAGLDQILPWLFYHKVVGVAHFLLFVEGKAAKPSVAGVLESIPGVKVVYRTKELEEQQARSRIWDETWLSXFFYKPCNYELFVKQSLNMEMAIVX

SEQ ID NO: 123144 - protein, 543 aa, Triticum aestivum
  Clone ID: PAT_TA_17562.pep
HASASPPIVGRHLLSCPDDMAFEGAYHFLQLAVGHATSSPAALLLVVVPLLLLLLASVRRSTMTGRKLRLPPSPPGSLPIIGHLHHIGAQTHISLQHLVDKYGHNGLLFLRAGAVPTVIVSSPSAAEAVMRTHDHILASRPWSMASHILRYNTTDVAFSPLGEYWQHTRKLVNTHLLSAKKVHSFANGRQEEVCLVVNKIREAATTAPSTAVDMSEFLAAYTNDVVSRSVLGATHRKKGRNTLFREMTETNVDLLVGFNLENFIPRWPLTEVLFRLVCWKVQRHLNKWDALLEEVIKEHINLKQDNSADFIHVFLSLQQEYGLTDDNVKSLLMNIFEAAIETSYLVLEYAMAELINNRHVMKKLQTEVRTFASSKGKKLDMITEEDLSSLPYLKATMKEALRLHPPGPLLLPHYSTADCSIDGYDIPAKTRILVNGWAIGRDPKAWERPEEFMPERFLQDGQEKSSNLGQDFKYLPFGSGRRICPGANFALATMEIMLVNLMYHFDWEVPNEKDGAGGKVSMAETFGLMLRRNEKLYLVPRIA

SEQ ID NO: 123145 - protein, 524 aa, Triticum aestivum
  unsure (1)..(524): unsure at all Xaa locations
  Clone ID: PAT_TA_17563.pep
MALEAAHHYLQLAVGXHGMSSPAALLLVVVPLLLLLLASVRTSASTRKLRLPPSPPGSLPIIGHLHHIGVQTHISLQHLVDKYGHNGLLFLRAGAVPTVIVSSPSAAEAVMRTHDHILASRPWSMASHILRYNTTDVAFSPLGEYWQHTRKLVNTHLLSAKKVHSFRHGRQEEVCLVVNKIHEAATNAPSTAVDMSEFLAAYTNDVVSRSVLGATHRKKGRNTLFREMTETNVDLLVGFNLENFIPRWPLTEVLFRLVCWKVQRHLNKWDALLEEVIKEHINLKQDNSADFIHVFLSLQQEYGLTDDNVKSLLMNIFEAAIETSYLVLEYAMAELINNRHVMKKLQTEVRTFASSKGKRLDMITEEDLSSLPYLKATMKEALRLHPPGPLLLPHYSTADCNIDGYDIPAKTRILVNGWAIGRDPKAWERPEDFMPERFLQDGQEKSSNLGQDFKYLPFGSGRRICPGANFALATMEIMLVNLMYHFDWEVPNEKKGTGGKVSMAETFGLMLRRNEKLYLVPKIV

SEQ ID NO: 123146 - protein, 217 aa, Triticum aestivum
  unsure (1)..(217): unsure at all Xaa locations
  Clone ID: PAT_TA_17564.pep
LHHTRRLPPPFPPPWKETGGWLPPLPRGFGGSRLRCCHALQDLSTRGAARARDQSCRKLVKPXSNYYRGLSRHSAPAKSILFSTATTSSHHDEGGDDKEKISVTFVNKDGTEKTISVPVGMSMLEAAHENDIELEGACEGSLACSTCHVIVMDVKDYNKLEDPTDEENDMLDLAFGLTETSRLGCQVIAKPELDGVRLALPAATRNFAVDGFVPKPH

SEQ ID NO: 123147 - protein, 261 aa, Triticum aestivum
  unsure (1)..(261): unsure at all Xaa locations
  Clone ID: PAT_TA_17565.pep
MRGENTLSIMDGNERDLRSEIPKLFVPEKEVKFKIPXSEITEKCLDCDGRGKVPCPTCNAGQQHGFYKANQMTRCSVCDGRGLLAQQDGSDTVCGMCNGQGMLPCIACASRGLVTCQTCNGCGSLLAQSTAHVRWKTLTARKVSATTGAASVPDEVFHRAQGVQLCNIQAYQCTPAFFADSYPLNQFSSEIVASRLPVPPSARVISERHIISVVPVTRVTMSHRKRSFSFYVVGDGRDVFIRDYSSKFCWGLGRCFEWLGN

SEQ ID NO: 123148 - protein, 327 aa, Triticum aestivum
  Clone ID: PAT_TA_17566.pep
MRAVAIASPGGPEALQVREVDDLPAPGEGEVLVAVAAAGVNRADTVQRQGRYPPPPGASPYPGLECSGTILALGANVPPRWAVGDQVCALLTGGGYAERVVVPAGQLLPVPEGVSLTDAAGLPEVACTVWSTVFMTSHLSPGESFLIHGGSSGIGTFAIQIAKHLGVKVFVTAGSEEKLAACKGLGADVCINYKTEDFVARVKKKTKGKGVDVILDNIGASYLQRNLNSLAVDGRLFIIGFMGGTTTEVNLQAMLARRLTIQAAGLRNRSLANKAQIVSEVEKNVWPAVVSGKVKPVIYKTFPLSEAAESHKLMETSSHIGKILLIP

SEQ ID NO: 123149 - protein, 169 aa, Triticum aestivum
  Clone ID: PAT_TA_17567.pep
RPVGRQILNQNVYRPGALHISSDLIWEIVRDNNCFSAKSKKNGGVQFSRDPLNLTNKSSRKHAGFVNDKAVGIAAGEKGAVVVTTKKAQPNKPAQNITTTSYSGSKSNRKTYQAVANQVAKNSYRADLRSAAVERASAIKKSHKPVKSEPEQKLRGNKAKKAAAAAEEN

SEQ ID NO: 123150 - protein, 152 aa, Triticum aestivum
  Clone ID: PAT_TA_17568.pep
LNNFASTQERESSRMFRRSGGGGVRGKTAAASTSTGTELPVDGAVRVTKVDKIQAYNLVSRPSVHHAIVPATSGPAESLAVSVVRVVDVVDEAVRVTKVDRIQAYNLVSRPSVHHAISPATSGPAESLAVRVVRFGDVVDEESDGLISVTIT

SEQ ID NO: 123151 - protein, 285 aa, Triticum aestivum
  Clone ID: PAT_TA_17569.pep
NTGYDLKHLFVGSEGSLGIAARGSILTPAKLPSTNVAFLSCNDYMSCQKLLLVPSTNVAFLSCNDYMSCQLGGAWAMTHLEGVHNPLPVSPYKFYVLIETTGSDESYDKAKLEAFLLRSMEDGLVADGVIAQDISQASNFWRIREGISEASVKVGAVYKYDLSIPVEKLYDIVEEMRSRVGDTAEVLGYGHLGDGNLHLNILSSKYSDNILAQIEPFVYEWTAGHRGSISAEHGLGLMKAEKIHYSKSPEAVQLMASIKKLMDPNSILNPYKVLPRSALSPEQGN

SEQ ID NO: 123152 - protein, 197 aa, Triticum aestivum
  unsure (1)..(197): unsure at all Xaa locations
  Clone ID: PAT_TA_17570.pep
PPGLLVLLPQIAKKESRSGGEGAAVSAVMAVMDLEVEEPRLSPGPGFRSHATDEEVVTHYPQPKAVNNAFSCLVIADVDLNKTEPWDLPGKAKMGEKEWYFFVHKDRKYPTGTRTNRATEKGYWKATGKDKEVFRGKGRDAVLVGMKKTLVFYTGRAPRADKTPYVMHEYLLDGQLAHPXXPPVRNDWAVCRVFDKD

SEQ ID NO: 123153 - protein, 150 aa, Triticum aestivum
  unsure (1)..(150): unsure at all Xaa locations
  Clone ID: PAT_TA_17571.pep
SVLLXXXRRLLVADVPSSWDVSWPRLLFETAPCLESFHIHIASCMEEPSPSEEISWCPTKFRQHRLKEFVMAGFEATERQIYLVKFVMAVCTALRHVSMFKNGHVQDKGHWEWEMVTQQHSWTEEDKDDTLKQIMGTASSTAAPVQLVLG

SEQ ID NO: 123154 - protein, 146 aa, Triticum aestivum
  Clone ID: PAT_TA_17572.pep
LRGAPCSVAILVDRGLGGHSQVAAKNVEFSVAMLFFGGADDCEALAYATRMSEHPGVAVTVTRFRPSRPSSGDAADEAAIEAFKGKVEAVKDGSAMYEDVEASAKEEVLQAINSLSKSNMFVVGRMPPTEPLVERPQELGPRGSYL

SEQ ID NO: 123155 - protein, 339 aa, Triticum aestivum
  unsure (1)..(339): unsure at all Xaa locations
  Clone ID: PAT_TA_17573.pep
CQAEQELVGQHVTDCSNAARTMLMNLKALDWDKPTLEALGIPAGILLDDAHRKKRGESVASGVCYTLLRGKIGSVCASPCLSTNKWYVVHYFGGIFLWLYIGXELEHKCPCISISTGASGXSERSAMGSKKIQWLRDXSLGIISSASEIEGLAESVQDSGGIYFVPAFNGLFAPWWRDDARGICIGITRFTNKGHIARAVLESMCFQVNDVLNSMHKDAGESGEVKSAEGEFLLRVDGGATINNLLMQIQADLLGSPVVRPADIETTALGAAYAAGLAAGVWTKEEIFAGLHKENTTVFRPKLDDAXTGRREETPGTRRFQGHLILPIFLCRLSHLVAR

SEQ ID NO: 123156 - protein, 80 aa, Triticum aestivum
  Clone ID: PAT_TA_17574.pep
LEQEANIIFLNLISAPQGVHVVSKRFPRVKIVTSEIELGLNDDFRVIPGMGEFGDRYFGTDDYQPSTPFFADDKNRVGLL

SEQ ID NO: 123157 - protein, 323 aa, Triticum aestivum
  Clone ID: PAT_TA_17575.pep
MSSALDQLKATGTTVVSDSGDFASIGKYKPQDATTNPSLILAASKKEEYAKLIDVAIDYAKQKGGSVDQQVDDALDRLLVEFGKEILKIIPGKVSTEVDARYSFDTEASVNKALHLIELYGEQGISKDRILIKIAATWEGIKAAEILQRDHGINTNLTLMFSLVQAIGAAEAGAYLISPFVGRILDWFKASTKKEYTKEEDPGVLSVKQIFNYYKKFGYNTIVMGASFRNTGEITELAGCDYLTISPNLLEDLLNSSDSVPKKLDASQASSLDIEKKSYIKDEALFRFDFNEDQMAVEKLREGISKFAADAVTLKGILKEKLS

SEQ ID NO: 123158 - protein, 178 aa, Triticum aestivum
  Clone ID: PAT_TA_17576.pep
PQNADLQVNGIQVRVVPRPSTQLLGINGRDDGPVITTFCREGQNKIVLSSDDARPFCFGIRIAKRRTVDQVLNLVPKEADGESFEDSLARVCRCLRGGNTADDADSDSDLEVVADFFPVSLRCPVSGSRLRSAGPLVPCAPLGSCVLRTFAVLDQRPRQWPWPSWPLDSALVRATLAR

SEQ ID NO: 123159 - protein, 260 aa, Triticum aestivum
  Clone ID: PAT_TA_17577.pep
MEQNGGSFLAVRRLSGHHHPSPADVVSGSTAWIGRGFSCVCVQRRDSDTRISFDLTPIQEECLQRLQNRIEVPYDSQNGEHQEALKALWHASFPGTELLGLVSDQWKEMGWQGKDPSTDFRGGGFISLENLLYFAKNYPKSFEELLCKQNGDRALWEYPFAVAGVNITFMLIQMLDLQAAKPRSLIGAVFLNLLIENDRAFDILYCITFKLMDRKWLEMHATYMDFNTVIKSTRRQLERELLLEDIQQIEDMPSYSFLAR

SEQ ID NO: 123160 - protein, 177 aa, Triticum aestivum
  unsure (1)..(177): unsure at all Xaa locations
  Clone ID: PAT_TA_17578.pep
SSGSLELPANVHPSLPAGCPSERLPGWLFHQTRLVTYLNHKNRCCEEDVCTEARLYDELQKHRHEKDCCSCTADFNELQKHTQQKHPDFRPSEIDPARQVDWDNFQQSSDIVDVLSTIHAQVPNGIVLGDYVIEYGDDDTGDDYEVLRRVRXEWWSFICCKAFVDIQEPKKRERKGQ

SEQ ID NO: 123161 - protein, 160 aa, Triticum aestivum
  Clone ID: PAT_TA_17579.pep
MRTYEDTFSGARIYPGKGKLYVRGDSKIFRFQNGKSESLFLQRKNPRRIAWTVLYRRQHRKGISEEVAKKRTRRTVKAQRGIVGASLDVIKEKRNIRPEARSAARAQAIKESKEKKQAEAATKKSEKAKLAAQASKGQAVRQVSKQGAKGSAPKVQAKTR

SEQ ID NO: 123162 - protein, 160 aa, Triticum aestivum; identical to SEQ ID NO: 123161
  Clone ID: PAT_TA_17580.pep

SEQ ID NO: 123163 - protein, 425 aa, Triticum aestivum
  unsure (1)..(425): unsure at all Xaa locations
  Clone ID: PAT_TA_17581.pep
MESLTLRASPSSTASPLLRLPGRRRAASVRVSASGAGAGAAEPDLSVTVNGLKMPNPFVIGSGPPGTNYTVMKRAFDEGWGGVIAKTVSLDAGKVINVTPRYARLRADPNGSTKSPIIGXWKNIELISDRPLETMLNEFKQTXEATEYPDRIXIGSIMEEYNRSCMGDELIERXRNHGVDALEMNFACPQCSPGRKSGGALGLDRVMLXSVCPDPITTPSIFPIRPYTTPNTRXETKQKELLLPLLHQVKAAMNTIRSVMGIDLKTLRPEXPCVEGYSTPGGYSARAVHPIALAKVMQIARLIKEEFPEGRSLSAIGGVETGNDAAEFILLGADTVQVCTGVMMHGYGLVKKLCTELQDFMRMHDFSSIEDFRGASLPYFTTHTDLVQRQKEAIKQRKAIRMGLQSDKDWTGDGFVKETESMVSN

SEQ ID NO: 123164 - protein, 105 aa, Triticum aestivum
  Clone ID: PAT_TA_17582.pep
MAAMSGLVAAAAEAVEAALACLVAAEAAQRCEHACVDAALLLVALLHVLRVGHLLPRRSVIHLRKGWVGLLWKKKKRCPRVVLCSALLSCGLGRVGSGPPPERRT

SEQ ID NO: 123165 - protein, 101 aa, Triticum aestivum
  Clone ID: PAT_TA_17583.pep
PERGEEPGLPAARCITTLRRRKACPTTSTRRSGTRRRAASTHACSRRCAASAATRRASAASTASAAAATRPGCRARHGRRPQGAAETHRPPPSPFIISICV

SEQ ID NO: 123166 - protein, 116 aa, Triticum aestivum
  Clone ID: PAT_TA_17584.pep
MLIMKGGGGGRSTSAAPCGLRPWRPGLVAAAAEAVEAALAGLIAAETTQRREHACVDAALLLVALLHVLRVGHLLPRRSVVHLGKGWSGLLWKKKILSKDSALLSRGRLGKIRIPP

SEQ ID NO: 123167 - protein, 136 aa, Triticum aestivum
  Clone ID: PAT_TA_17585.pep
KAGGGPVDLLLAPIADRPRPWRPCAGLVAAAAEAVEAALARLVAAEAAQRCEHACVDAALLLVAPLHVLRVGHLLPRRSVIASSQRVGWGYYGRRRRGVQGLCSALLSSHGLCSACSPVAPRDVVSKGCALLSCGS

SEQ ID NO: 123168 - protein, 198 aa, Triticum aestivum
  Clone ID: PAT_TA_17586.pep
KMLHYLSALVAALAASTVQASADIVSGATWTATNTGEHVQAHGHGLIEVDGTYYMIGEDKTDGTFFQNVNCYSSTDLVEWTYRGALLSRTSEAGDLGPNRIVERPKVIYNDDTKKYVLYLHIDSSDYKDARVGVATGDSVCGKYTYHRSFRPLGKQSRDMGLFKDDDGSAYLMTEDREYGTRIMALSDDYLNVTEITY

SEQ ID NO: 123169 - protein, 385 aa, Triticum aestivum
  Clone ID: PAT_TA_17587.pep
MIPAVKLSPAAFSVTNQRSKSAFVPSVSILNMKKFASCSLRPLYLTRLDDPHTSELKPRRQLLDFRCAASAADDKESKAEVLPASSEAAQKLKISIYFATWWALNVIFNIYNKKVLNAFPYPWLTSTLSLACGSAMMLFSWVTCLVEAPKTDLDFWKALFPVAVAHTIGHVAATVSMSKVAVSFTHIIKSAEPAFSVLVSRFILGESFPMPVYLSLLPIIGGCGLAAATELNFNMIGFMGAMISNLAFVFRNIFSKRGMKGKSVSGMNYYACLSIMSLVILTPFAIAMEGPQMWAAGWQKALADVGPNVLWWIGAQSVFYHLYNQVSYMSLDQISPLTFSIGNTMKRISVIVSSIIIFRTPVRPVNALGAAIAIFGTFLYSQAKQ

SEQ ID NO: 123170 - protein, 403 aa, Triticum aestivum
  Clone ID: PAT_TA_17588.pep
MGAPLFGAVLLCLVLAAAAVPEQQPTLPSSSAANSSTGVNSNSVLVALLDSHYTELAELVEKALLLQSLEDAVGRGNVTIFAPRNEALERDLDPEFRAFLLEPRNLRSLQRLLLFHVLPSRLHSHSAWPASTARMTLSGEHLQLSADGQKMLVGTAEVTRPDAVVRPDGVIHGIERLLVPRSVQEDFNRRRSLAAISAVLPTGAPEVDPRTHRLKKPAPPVPLGAPPVLPVWDAMAPGPSIAPAPAPGPGSGKHHFDGHSQVKDFIQTLVLYGGYNELADILVNLTSLATEMGRLVSEGYVLTVLAPNDEAMARLTTDQLSEPGSPENILYYHMVPEYQTEESMYNAVRRFGTVRYDTLRLPQKVTAREADGSVKFGHGEGSAYLFDPDIYTDGRISVQGIDA

SEQ ID NO: 123171 - protein, 353 aa, Triticum aestivum
  unsure (1)..(353): unsure at all Xaa locations
  Clone ID: PAT_TA_17589.pep
RNEALERDLDPEFKRFLLEPRNLKSLQTLLLFHVLPARHPAGSWPAASHPTLSGEDVELAAGANGSMRVAHAAAPAPHPEPATTRRRARAALRRRPPRPRTXRQRCASPHCPPRQRPTAPCGRTPTRGPVATPAAGSARKKNCLKHNFDGHSQVKDFIQTLVLYGGYNELADILVNLTSLATEMGRLVSEGYVLTVLAPNDEAMARLTTDQLSEPGSPENILYYHMIPEYQTEESMYNAVRRFGTVRYDTLRLPQKVTAREADGSVKFGHGEGSAYLFDPDIYTDGRISVQGIDAVLFPPVEDTAKSAGASPVRKAPAVTGTAKPKLRRGKLLEGACHVAAVFGGRSHFTSCQ

SEQ ID NO: 123172 - protein, 270 aa, Triticum aestivum
  unsure (1)..(270): unsure at all Xaa locations
  Clone ID: PAT_TA_17590.pep
SLHRRRRCDVRRRRRRRGLKSVSRAAFSWKPTGRAQQTLAAAVSRSGVGLHSGARATARLLPARAGEGRYFVVEEARVAAEAGNAEPQSPLCTTLRSGSGGARVRTVEHLLSAMEAFGVDNCRVEVSGGDEIPLLDGSAQEWVEAIRGAGLCAAEDIGGQKLEKLAPKIDEPVYLCKDDCFVAAFPSSQIHITYGIDFPKAPAIGCQWFNTFLDADIYSSKIAPARTFCIFEEVEKMRDAXAIKGGSLENAMVCSMSGGWLNPPLRFDDE

SEQ ID NO: 123173 - protein, 205 aa, Triticum aestivum
  unsure (1)..(205): unsure at all Xaa locations
  Clone ID: PAT_TA_17591.pep
ANSARGEEEGVVEAPAPPQAAAGVCAVCFRPTTFRCKQCKAVKYCSFKCQISHWRKXHKDECHPPGANAKPDDGAAISVAKEGNVEHRRASEENVVAGVQPVAEISVPVASESETSGTNHVVKSSNDKRKDTPFEGVSATTEIPEKGNSDNVVKLGQITPQVASFDSKRAESNTKSTNFVGNSYVKDLDDILVHKSQVSAPKMSG

SEQ ID NO: 123174 - protein, 95 aa, Triticum aestivum
  Clone ID: PAT_TA_17592.pep
HSHLGPPTWGCLEPHPAWASPFRRRAILTGGRGRFAAFQWCQLPSRPWSVHATSGASVAELSPGARFPKVKFVRVVSNIVYKVGYSWICSCIVFT

SEQ ID NO: 123175 - protein, 76 aa, Triticum aestivum
  Clone ID: PAT_TA_17593.pep
MGFCSGRSDVQVLPKNTSSASSPSSSSAAKDSGHSEKNKKQQGVKNEERKEKKRSNLDRAALTTPHFPFHSRPGLL

SEQ ID NO: 123176 - protein, 76 aa, Triticum aestivum
  Clone ID: PAT_TA_17594.pep
MGFCSGSSDVQVLPNNTSSSSPSSWSAAAKDSGHSGKNKKQHVVKKEERKEKKRSNLDRAALTTPHFPFHSRPGLL

SEQ ID NO: 123177 - protein, 107 aa, Triticum aestivum
  Clone ID: PAT_TA_17595.pep
LFATDSCKLVHIQLRRRRGTEVSSCCRTTLETRNRACRQCASVSLCHFWRRVRLVKVGMKHSKVLDRSRGKIFRSGRVISWIAFVHSGSTLFFPSSQFSWTEQSVQL

SEQ ID NO: 123178 - protein, 70 aa, Triticum aestivum
  Clone ID: PAT_TA_17596.pep
VVVFADENGILRTELFDLDYEYDAPRWFDLAQDEAPAEAAAAELWFATAPSYPPSRLCILGQLKPLVSCT

SEQ ID NO: 123179 - protein, 315 aa, Triticum aestivum
  Clone ID: PAT_TA_17597.pep
MEIARVDLRGLEPGGPGWAEARDAVTASVVAHGFVVVAHDALGLELRQALFGRVMPEIFALPPEAKQRNVSEVGPFRGYISNVPGTNWESVRLSEPTDAGRVRDFADLLWPQGNPAFCDTIASAVKNVWELQRTVETMILEGLGVGEEHIGAHLDTLAHSVRLSRYGPPPDAETNMSLQAHRDDSIMTAIVQHGVEGLEVQVQDGIWLAVPPEPDLFTFVAGELFTVVTNGRVPGCFHRVRTPSNRERLSALFGCPGKDGVLLSAMDELVDDEHPLLYRPCTNDGYTTFRHSDEGRKAGDPLKAFCGVEKDDHRS

SEQ ID NO: 123180 - protein, 95 aa, Triticum aestivum
  unsure (1)..(95): unsure at all Xaa locations
  Clone ID: PAT_TA_17598.pep
MMQEDNTHCENKLIELESISEDNNIIPERTSISEGREELLDCISSMSKSAEGLRLGLDSLSKRVGDFFQIVLTGRDALLCNLXRMSDAASKGHRG

SEQ ID NO: 123181 - protein, 62 aa, Triticum aestivum
  unsure (1)..(62): unsure at all Xaa locations
  Clone ID: PAT_TA_17599.pep
AAKAWARTPRSWVAVKXKEAEEDLVFRMHRLVGNRWELIAGRIPGRTAEEVEMFWAKRHQDQ

SEQ ID NO: 123182 - protein, 76 aa, Triticum aestivum
  Clone ID: PAT_TA_17600.pep
MSSESLGKNSKIMGGRERKEVNSTAKHFVDFTEAEEDLVFRMHRLVGNRWELIAGRIPGRTAEEVEMFWAKRHQDQ

SEQ ID NO: 123183 - protein, 172 aa, Triticum aestivum
  Clone ID: PAT_TA_17601.pep
HPVPLAAALLEVSTGTCVVAPAARCPRLLLVMAGGPYGVAGTGESPASQRVGRSPGSRRGTGGSTLLTRPAGHNTGRHRWVRLRKARPASLVDMPADEMASDARKLENRQIKEKALFDCERASAPKASTDQFKCGRCGQRKTTYYQLQTRSADEPMTTFVTCVNCNNHWKFC

SEQ ID NO: 123184 - protein, 199 aa, Triticum aestivum
  Clone ID: PAT_TA_17602.pep
METPFTVKAQPGTDVWKQPPSTDVFTAPFRPHSIAPLKHFISATITFRTTYVHQYDQACLLLTFTKPGAPRKWIKTGIELYNEHPRYSTVTCDSWADWSVEAVGPNDEAGVMSGEKSVTIKAMKVEDALGVCLWVYRVDENGEKTPLRQTNWVYGDEGGEGWELEVSAAVARPDPHKNIKDDLEATFDKLDVEWEKPTA

SEQ ID NO: 123185 - protein, 88 aa, Triticum aestivum
  Clone ID: PAT_TA_17603.pep
YGANRQIRLGNAKDTRGTAYVVYEDIYDAKNAVDHLSGFNVANRYLIVLYSQLNRMSKKTDIKKKEDEITRLQEKYGVGSKTPSANDA

SEQ ID NO: 123186 - protein, 129 aa, Triticum aestivum
  Clone ID: PAT_TA_17604.pep
MAAASLRKGNARLPPEVNRALFVRNLPFNISSEEMYDIFGKYGAIRQIRLGNAKDTRGTAYVVYEDIYDAKNAVDHLSGFNVANRYLIVLYSQLNRMSKKTDIKKKEDEITRLQEKYGVGSKTPSANDA

SEQ ID NO: 123187 - protein, 70 aa, Triticum aestivum
  Clone ID: PAT_TA_17605.pep
MASLKAVKPTGLDGKAKEPTKVSATKGPAKLSATATKPAAAKGGIKKAESKPREPKKRQVKSTKPAAAKN

SEQ ID NO: 123188 - protein, 222 aa, Triticum aestivum
  Clone ID: PAT_TA_17606.pep
QDSPGRPTSAAGRPADLGVAAASGPSRRLLRGRGAVVRAPVPVTPRPAGQRHTAASPPARLGKRQQQCAPPAATDRKKRTSEERRESTVKKSKQEASTASPPKQPVPAGSLGAQAAARPPAVSPFGKTDTASVLFETIKYIKFLHEQVQLLSEPYTNASRSKGNCNNLLPWGDRAEASKGEGEHDLRERGLCLVPVSWTPEVYRDGNAMDYWTPAYRGCLYR

SEQ ID NO: 123189 - protein, 129 aa, Triticum aestivum
  Clone ID: PAT_TA_17607.pep
TLPAPGNLPQHTTQHSTAQCLRRAALAPTQHAALASLQQSGRTPTVPAQREWRLWWRPLRPGWWRWRAGGAASWSGACTGACARGSGGCSRSGAGGAAAAAGGSASTSTTTRSATPSTSTTAAAPPTSS

SEQ ID NO: 123190 - protein, 241 aa, Triticum aestivum
  unsure (1)..(241): unsure at all Xaa locations
  Clone ID: PAT_TA_17608.pep
MAVEAVLEAAAMVPSPPSKEMEASSSTSEEASALLGQAEGWSKRKRSRRPRALAPSEEEYLALCLLMLAHGHRDSAPAAASEQQHGCSVCGKVFASYQALGGHKASHRKPTAAPAGAEDLKPQAAVAAAAASSSGSGEAAVGAGGGKLHECNVCRKTFPTGQALGGHKRCHYDGTIGSAAAGPAHKLAAKATAASATAASRGFDLNLPALPDIPGAVRXTENGEEVLSPVSLKKPRLMLTA

SEQ ID NO: 123191 - protein, 143 aa, Triticum aestivum
  Clone ID: PAT_TA_17609.pep
MGKDGKGKGKQAAGSSDDAGGAKGGKGKGKGGKGGDDLGTCTFVKARHVLCEKQGKINEAYKKLQEGWLDNGDKVPPAEFAKVAQEFSECPSGKKGGDLGWFPRGKMAGPFQEVAFNTPVGATSAPFKSTHGYHFILCEGRKN

SEQ ID NO: 123192 - protein, 148 aa, Triticum aestivum
  Clone ID: PAT_TA_17610.pep
MGKDGKGKEAKGKGKQAAGSSDDAGGAKGGKGKGKGGKGGDDLGTCTFVKARHVLCEKQGKINEAYKKLQEGWLDNGDKVPPAEFAKVAQEFSECPSGKKGGDLGWFPRGKMAGPFQEVAFNTPVGATSAPFKSTHGYHFILCEGRKN

SEQ ID NO: 123193 - protein, 113 aa, Triticum aestivum
  Clone ID: PAT_TA_17611.pep
WPTLLWQLTLASIKMGRPELARRAIAVAEEKLSADKWPEYYDTRSGRFIGKQSRSYQTWTIAGFLTSKMLLENPELASILTCDEDLELLEGCACCLSKRSRCSRRAAKSDITG

SEQ ID NO: 123194 - protein, 86 aa, Triticum aestivum
  Clone ID: PAT_TA_17612.pep
VSFKVILTSDPKLPFKVFSVPEAAPFTAVLKFAAEEFKVPPQTSAIITNDGVAINPQQSAGNVFLKHGSELRLIPRDRVGAPVASF

SEQ ID NO: 123195 - protein, 99 aa, Triticum aestivum
  Clone ID: PAT_TA_17613.pep
MAAEGGGGGGGGKVSFKVILTSDPKLPFKVFSVPEAAPFTAVLKFAAEEFKVPPQTSAIITNDGVGINPQQSAGNVFLKHGSELRLIPRDRVGATAASF

SEQ ID NO: 123196 - protein, 99 aa, Triticum aestivum
  Clone ID: PAT_TA_17614.pep
MAAEGGGGGGGGKVSFKVILTSDPKLPFKVFSVPEAAPFTAVLKFAAEEFKVPPQTSAIITNDGVGINPQQSAGNVFLKHGSELRLIPRDRVGAPVASF

SEQ ID NO: 123197 - protein, 100 aa, Triticum aestivum
  Clone ID: PAT_TA_17615.pep
MAAAEGGGGGGGGKVSFKVILTSDPKLPFKVFSVPEAAPFTAVLKFAAEEFKVPPQTSAIITNDGVGINPQQSAGNVFLKHGSELRLIPRDRVGATVPSF

SEQ ID NO: 123198 - protein, 528 aa, Triticum aestivum
  Clone ID: PAT_TA_17616.pep
MAHVHVDEMLHEAAAAAPRSLLIATAVLFSLVVLPLLLRIIAKQGAASDAKLLSLLPSPPTRLPIIGHLHLMGDLPYVSLAGLAAKYGPELMLVHLGAVPTAVVSSPRTAEAVLRTHDHIFASRPRSMVFDIIMYGQTDSCFSPYGEHFRKARKLVTVHMLNARKIRSQRPAREEEVRQVIGKIAKAAAAREAVDMSELLHSYVNDLVCRAVSGKFSQEEGRNKLFRELTDINAALLGGFNILDYFPSLGRFELVCKVACAKARRVRKRWDLLLDKLIDDHAARMVSREGEAQPEQEEDKDFIDVSLSLQQEYGLTRDHIKAILIDMFEAGTDTSYMTLEFAMAELIRKPHLMKKLQEEVRRNVPNGQEMAAEDDLPNMTYLKAVIKETLRLHPPVPLMIPHFSLDACTVDGYTIPANTRVVINAWALGRHSGYWENENEFQPERFMNGAGVDLKPNEFHYLPFGFGRRMCPGVHSASATVETMLANLMYRFDWKLPPGLKEENIDMTEVFGITVSRKEKLILVPVTA

SEQ ID NO: 123199 - protein, 173 aa, Triticum aestivum
  Clone ID: PAT_TA_17617.pep
MLPRIQKSIFHLGEEGGDGHRGADDHHGDNIVDIQRRLGGHTHGRRLRRGGRDVVVGLQILVQHHPQPCHVVLKQMVSSPPARRRLSGSFSGACSLCRRELSPDKDVYMYRGDQGFCSEECRRQQILSDEAREHEAMVSKERRGLAHRRHHPGPWPAPPVAIRGAPRRLLAVA

SEQ ID NO: 123200 - protein, 298 aa, Triticum aestivum
  unsure (1)..(298): unsure at all Xaa locations
  Clone ID: PAT_TA_17618.pep
GFAVSGTAGXDVVACLNAAMERQGLDMSVSALVNDTVGALAGAHYWDEDVMVAVILGTGTNACYIERTKSIPKLQHLGLGTGNTIINTEWGAFSDGLPLTEFDRDMDAESINPGEQIFEKTISGMYLGEIVRRVVAKMAQESDLFGHSLADKLAEPFVLRTPHLCAMQQDNSDNLGQVESILRDTIGVSQSSVAARRFIVEVSDCVVKRGGRLAGAGIAGILQKMENDSKGLILGRRTVVAMDGGLYENYPQYRSYMVEAMAELLGPRDMEHIIVEHTKDXRAVRTFGANQNISNSLS

SEQ ID NO: 123201 - protein, 323 aa, Triticum aestivum
  unsure (1)..(323): unsure at all Xaa locations
  Clone ID: PAT_TA_17619.pep
MARSPAQIAIRLIALLLLLPVAWSATFTMTNNCGYTVWPGLLSGAGTAPLSTTGFALAQGASATVTAPASWSGRMWARTLCASFERRQFTCATGDCGSGALQSKAHVAARLASLLLFAPSGLVGIXFLXASIVRGTQLPMLVVPQGAAAATAAASSTGGPKCMATGCLVDLNAACPAALNVTSAGAASSAVGGSAMACRSACEAFGSPEYCCSGAYGSPSTCRPSAYSQFFKSACPRAYSYAYDDSTSTFTCAAGTNYAITFCPSTTSGKYTDENPQAAGVPPANGTMVYRGGEQFSTSGGASTAAHASQLLLAAAVAVALLL

SEQ ID NO: 123202 - protein, 153 aa, Triticum aestivum
  unsure (1)..(153): unsure at all Xaa locations
  Clone ID: PAT_TA_17620.pep
MGRGVLXVHLVEXGLFGSDFLGKIDPYVIVQYRSQERKSSTSRDEGRNPSWNEVFRFQINSSAANGQHKLFLRIMDHDNFSSDDFLGQATINVTDLISTGMESGASQLNAAKYSVVSADNSYHGEIRVGLTFTATKVEEDGGQVGGWTHSSRE

SEQ ID NO: 123203 - protein, 163 aa, Triticum aestivum
  Clone ID: PAT_TA_17621.pep
MARGLLEVHLVHAKGLSGTDFLGKIDPYVVVQYRCQERKSSTARDAGRNPSWNEVLRFQINSSAANVQDKLFLRIMDHDNFSSDDFLGQATINVTDLISMGMESGTSRLNPAKYRVVTADNSYHGEIKIGITFTAAKVDSHCQVEEDGAQVGGWVHSFREQKV

SEQ ID NO: 123204 - protein, 98 aa, Triticum aestivum
  Clone ID: PAT_TA_17622.pep
PLLLPQPTFPIPLSRVPHYCRVKERRQCSPTSAATPMEQSISVGFPSPAASPTLPHPTSSSMHLKAHAIDQFTLMAPLSHGCRYPRLCWFTRSSWFLQ

SEQ ID NO: 123205 - protein, 174 aa, Triticum aestivum
  Clone ID: PAT_TA_17623.pep
PQAARCCADLLRRRRLGAPARSEAMEFLMQPINRTLLVEVNDNDITMGAVRVPLDAPAYVELAAPAASSADGQIWREEGGAEAGSADKAQCSEHSIEQLDPKTPGWTQRVHVGAAALGRAPCAGQGDSPGEDNPGICSSTWKHCHCANIGTSFNTLGEAYNFYNLQEWVCGFGV

SEQ ID NO: 123206 - protein, 126 aa, Triticum aestivum
  Clone ID: PAT_TA_17624.pep
LMAHCGGGPGPAAPREASSVESHFQGLLDDDDKYRALCGAFGYLQQQEWPDLSGACYAAFGAPPPPGTSNGAGNSFSCSGSASSGGGSTKRKPDAYVDAKDDCKRPRGKQQLCDPDEAGAAAKGRP

SEQ ID NO: 123207 - protein, 181 aa, Triticum aestivum
  Clone ID: PAT_TA_17625.pep
MIPAGAAAAAGGAAGMMRIREVARAHIVLGWATALLAVLALNLPPQLQGTCRTTEDEVAHMRVDALLLLLSSAAQAAAATVAAFALEDWRTGVPWSFAVFAHGMGVATFYRLDNVVFLVARVTVGSCPSSHVLVHGNPLVAHFILLAVPLGLFLLFSVSKLISALSKPELIISYAMTSAIL

SEQ ID NO: 123208 - protein, 443 aa, Triticum aestivum
  Clone ID: PAT_TA_17626.pep
VVGAESFLLAHPACLRLPIAPRGPRAGRPCDAPPRAHAPAWPSAPYLPPTTTPAFPAYSVRPTLRNRRGVRPSARTSVESHPSSASCSTRWGSRARDDAHPRGGTGAHRPRVGHRPPRRPRPQPPATPAGPLGHPRCGAGAHATPRPPPAAVPPLPFPGALPARRRVAGPARGSAHASAHASRDVNCSVTFHAWCAHQRGLLQSDPEGEHNEYIGFYGRCLNHATNRVNPEKCLRSNEWTCARTEGFKGRKGEGCSGSNYKKPQVKSSECSVSQEQINAWLRINGSKPCIRRQSKGWKHLVVYKSGIHGLGLYTSEFIPRGSMVIEYVGEIVGQRVADKREIEYHSGKRQQYKSVCYFFKIDKEHIIDATRKGGIARFINHSCMPNCVAKIISVKNEKKVVFFSERHIDPGEEITYDYHFNQEDEGERIPCFCRSFSCRQYLN

SEQ ID NO: 123209 - protein, 135 aa, Triticum aestivum
  Clone ID: PAT_TA_17627.pep
LAKKSFWPIIRPCKEVYQTPKGTISSTHSGDIKTENLNLSKVLYSPKATRNLISVPLLEKEGYRLTCYRGKCGIVFKGALRQCGSGAEDPRDNLYYLVEFRLARKIFLTQRGEGKSKMIRRRTSISGDTCAEMGL

SEQ ID NO: 123210 - protein, 115 aa, Triticum aestivum
  unsure (1)..(115): unsure at all Xaa locations
  Clone ID: PAT_TA_17628.pep
YAYTQREIESEMATPTPAVRFSDVPENLPRCFALSTNTNRPMKATVDDLFAEIHKDDGGILTNPHARFYFEPSRKHGGRLLHIRCGYNNKYWMAKQQQRQPDDGAAAAXIXITGT

SEQ ID NO: 123211 - protein, 118 aa, Triticum aestivum
  Clone ID: PAT_TA_17629.pep
MGQLDNDNWLYPGDGLTSENGSAEFKIEGDGRMSIYWDGEVIWQNTDEGREDIKGIHLQEDGNLVLYTHDDEAVWASNTEDHGDEVYLRVQDDGNIVLYKGEDDDAEAVWASNTVHED

SEQ ID NO: 123212 - protein, 310 aa, Triticum aestivum
  Clone ID: PAT_TA_17630.pep
MEFWGLEVKPNQSLKVSPDDDHFLHLSQGALGEVKKDDKATMFVKIGDQKLAIGTLSTDKFPQIQFDLVFEKEFELSHNSKTSSVFFSGYKVFQPADGDEMDFDSEDESEEEQDTIIPALTKENGKPEAKEQKKQVKIDTAAPSKSKPAAKDGGKSNKDDDSDDDDDSDEDDSQDDSGDDGALIPMEDDSDDSEDGDDSSDDSEDSSDEEEEETPKKQETGKKRVAGSVLKTPVTDKKAKIATPSGQKTGDKKGAVHVATPHPAKKAGKTPATSEKSPKSGGSVACKSCSKTFNSEGALASHSKAKHEAK

SEQ ID NO: 123213 - protein, 340 aa, Triticum aestivum
  unsure (1)..(340): unsure at all Xaa locations
  Clone ID: PAT_TA_17631.pep
NLVAPPPTAAASHGQFWGLEVKPNQIRQXHLADEHFLHLSLAGCPLGGQKDDKATMFVKIFGDKKLAIGTLSTDKFPQNHVXLVFEKEFXELSHNSQTSMXVFFLAKRFSSPADGDERDVFXDRRESEGGRKNMNIMPRPHXNGKNLQTRRRRKKQIKINTAPHSNMMTADDDNDSDESDSEDDXGDDGASLTHXDDYYDSGDGDDSSYDNDDSSDEEEEETTKKQEXGRRGRLEGVLKTPVTDKXKAKIATPXSGQKTGDKKGAVHVATPHPAKKGRQAPATREKSPKSGGVGRVQSRAARKFNSEGALASHSKAKARGQVKEERKLLAGWLAPIYLLF

SEQ ID NO: 123214 - protein, 267 aa, Triticum aestivum
  Clone ID: PAT_TA_17632.pep
MKGLGLACLLLALVPQVVLGTHDVYIVTMEGDPVVSYAGGVEGFPATAADLDQEMDVTSEAVTSYSLHLRRHHEKLLDSLFVAGTYEKLYSYHHLINGFAVHMSSLQADFLRKAPGVKYVERDTKIQKLTTHTPQFLGLTTAVWPTGGGFDRAGEDVVIGFVDSGIYPEHPSFSTHRTDPYGPVPRYKGKCEIDPVTQRSFCNGKIVGAQHFAKAAIAAGAFNPDVEFASPLDGEGHGSHIAAIAAGNNGIPVRMHGYEFGKASGMA

SEQ ID NO: 123215 - protein, 190 aa, Triticum aestivum
  Clone ID: PAT_TA_17633.pep
LRGLQPWNSGWSPCSCNYGSDGARVSQTAAVSRKDSWFIPTKLATNLSSSLSDSAASKEGIVVVETNFRLYAYSASKLHCEILRLFSRVEYQLPNLIVGAITKESLYGAFDNGITAEQIISFLQQNAHPRVIDKIPIVPENVTDQIRLWENDRNRVEMVLSHVYEHFPSKYMFEQCCDHGSINGYLLFRY

SEQ ID NO: 123216 - protein, 167 aa, Triticum aestivum
  unsure (1)..(167): unsure at all Xaa locations
  Clone ID: PAT_TA_17634.pep
MALWTGLGQAATVAQLVGADVGGLISMIVQSALTARQNRSECEQLARRALMIAQLLPHVQEPEAAQPLAGLGDTLRDAHELVLSCQGRGAAYQFVMASRTAXKVREVQAKIDSYLILFPVISYIGITRRIERIYNVLVPDDSTRVEPSTLLQLQESTEDGQGVPLHG

SEQ ID NO: 123217 - protein, 171 aa, Triticum aestivum
  unsure (1)..(171): unsure at all Xaa locations
  Clone ID: PAT_TA_17635.pep
MVRKREGMMSSAPWRTLSSEAGGEGEGMGDEEESRVSRDRKETPTSNTPHSHTTDLARGKRPFQEHAVDAEERYSFDPQLQVSLQSFNGCLHWAFTLHTFFXPLPPVMAYSVSRNVNFFLKFFTQFWDEEAIGNPRRCLGLGSEHSCWRFRLIAELLWKKVAGPGSWGRCI

SEQ ID NO: 123218 - protein, 118 aa, Triticum aestivum
  Clone ID: PAT_TA_17636.pep
HAPLRQRPGPHPPHAPPIAAKLHCSAPPLRLPPKPLVSDRSRRPGAATRSAARLGRQAADGVRAHHIPAAPHPDPHHRRRPLHRLPLATCRLVSARSAVTVVAPYVVLINPILHHDSA

SEQ ID NO: 123219 - protein, 426 aa, Triticum aestivum
  Clone ID: PAT_TA_17637.pep
MLTGNNDMKPPIPKRPRRMAMSPESAPLASGSSSFIPDDIIFFQILVLLPVKSLVRFQTVCKSWRTTLTSISFVRWHLELSKRTRSTMVLVPRKYQEDRRKACSRLLSIFSFQPGESKCAELIFRKEFHPYGIPVFSIPLHCDGLILIPCIMGKIFICNPATREFVELPPGSPSVLFEHRVAFGFDPWSGTYKVARHFIRSYRDTLQIDGEGGTTREYSSGHEILTFGGDSKEEAWVWKATVDPPYPIKARTPICLPGVFFWSALKSMAHGKVISNVILRFSLLDETFTVHPNPPCSDHLGKNDALSALGGKLCYIHSPTPWEIAIWLAEDGPNLTWSLCRRVSLPIPRNLLAFACASTDPDKIFLSIDARYLLRCDLHDESLEEIINMRDMLYDLRNGRKFTIGSLLVAHYMVPFVESLLRIRSS

SEQ ID NO: 123220 - protein, 148 aa, Triticum aestivum
  Clone ID: PAT_TA_17638.pep
TQLCSACYMTHMSSISRQNILPTKKKHGNSSWPNQALQKEPKFTRASEVQTQHSVAHAPREQASVALIRSQALPGPAHRTTHPCITRRHLAGAPPLASISFAGAIPHLSSMRHRWWHNLKRRRIGGAPRALRRITRPPPVRFLWPHWP

SEQ ID NO: 123221 - protein, 244 aa, Triticum aestivum
  Clone ID: PAT_TA_17639.pep
MRPLRGDPGAGADLAVLCCCFLLLSFLSRGADMPLGSSLSPAANSTSWSSPNSTYSLRFVPSPTSPSLFVAAVTYAGGVPVWSAGAGAAVDSRGSLRLSSSGDLHLVNGSGAVLWSSGTAGRGVAAASLHESGNLVLNNSRGRVVWQSFHHPTDTVVMSQSFTSGMNLTSGPYVFAVDRATGNLTLNWASAGAAPVTYLSKGYNYTFTANTTLSSPKLTMQTNGIVSITDGSLDSPIIVAYSSN

SEQ ID NO: 123222 - protein, 136 aa, Triticum aestivum; identical to SEQ ID NO: 117722
  Clone ID: PAT_TA_17640.pep

SEQ ID NO: 123223 - protein, 91 aa, Triticum aestivum
  Clone ID: PAT_TA_17641.pep
RHGRWNISRVHFISSFPRLMLRFGYLFTSTANDLGDAVLAKVLIEGDINLSLSGTRGHLCFELILKCNKLFPVMRSRPGRSSICHLTRPGR

SEQ ID NO: 123224 - protein, 86 aa, Triticum aestivum
  Clone ID: PAT_TA_17642.pep
NQFETKMSSCTTKAKIDISLDEDFGEHSVSQIIGRRGEKIAKAKHQPWKAAYKVDPTDVPSTMSLHDKPWYKSEHLDAAYEDHSGA

SEQ ID NO: 123225 - protein, 86 aa, Triticum aestivum; identical to SEQ ID NO: 123224
  Clone ID: PAT_TA_17643.pep

SEQ ID NO: 123226 - protein, 128 aa, Triticum aestivum
  unsure (1)..(128): unsure at all Xaa locations
  Clone ID: PAT_TA_17644.pep
AAVIGLLYDIGSXXDFXHKLEPYXRRMADMKEKXXKVGVVDPWVARGDGEAYYRYMGSLTTPACDERVIWTVIKRVATVSSDQLKLLTDAVHDGFEMNARPLQKVNGRDIGLFCPDDDHERYYAAADH

SEQ ID NO: 123227 - protein, 102 aa, Triticum aestivum
  Clone ID: PAT_TA_17645.pep
IRQSINCRMFYYTIKSDFSEEARNKYRADSRGKLLFKTAVSFSPVVAKLVILVQELKLFLHLLWCSRTTLPCQHPATPCRCSAFLSRCLRRRTRHACRTPSR

SEQ ID NO: 123228 - protein, 316 aa, Triticum aestivum
  Clone ID: PAT_TA_17646.pep
PTRPPTRPLLSYVSNYALAGLPVHLSWRVMYAIGVLPPVLLAAGVLAMPESPRWLAMRGREADARAVLVGTSDTAAEAELRFEEIKRVVEAPREADSGVWRELIFRPSAMVRRILVFVVGLNFLQQALGVDAILLYSPLMFKKAGMSSNSAILGATVAIGVVKTCFILVVSLFSDRFGRRPLLLASAGGVAASLTGLALTLCIGETSPASTAACVAFTLATVAAFSVGWGSLPSTYTAEITPLRLRAQGSSLGMAVNRLTCGLVSMSFISLAGWITMPGCFFLYAAMAATACVFVFLRLPETKGRTLEEMDVLFSK

SEQ ID NO: 123229 - protein, 177 aa, Triticum aestivum
  Clone ID: PAT_TA_17647.pep
MINITKPQNWTRGDYLVSTDPALLQVDAINAALSSDMVWWAGDLPADALWDALRSSICFGLYRKRSSEMNGTGPTVEYKIEEWEQVGLVRMITDGVTFGYLTDVYILPEHQGGGRGRWMLQILNEALQGWPHLRRVMLLTTDKMHLFGKNLGMKDYREFDGMKGVSIAMVEGPGAQH

SEQ ID NO: 123230 - protein, 195 aa, Triticum aestivum
  unsure (1)..(195): unsure at all Xaa locations
  Clone ID: PAT_TA_17648.pep
GLTCAGFKDLSCRLKLQXEVLVSDTERLSMTHSNVKKLQRHFQADTYPWIQRLKHQELVIERRLLRIMRIVEALENRGFRVPLMKEEADLYERLVAIIKQIKGTGGDLSKRAYNLLSTSRVLASAGCASGPIYIPSSTKVDKQNVTELLEALQQQTEAVAKLGNVLKRDTRDVEIVLSEDTDMEEDSSGRRAFKM

SEQ ID NO: 123231 - protein, 155 aa, Triticum aestivum
  Clone ID: PAT_TA_17649.pep
MATSLSPTVMVMALLLAMLVALSLAHKEHQHAPTQAPSPAHHHGHLAPAPSHHRHHGPASAPAPAHGGHHHHHHAPAHSPVHHHHHHAPAHSPGHHHHHQAPAPSPIHHHHHHSPAPSPVHHHHHHAPAPSPVHHHRHHAPAPSPVHLDAKELYT

SEQ ID NO: 123232 - protein, 106 aa, Triticum aestivum
  Clone ID: PAT_TA_17650.pep
GYEFKWWCGVNAPQGDRAKEGGVVFDYLAFIAYTIDDCMEACGNMNQKDDDNHNGVRCRNIVFSKSMAAQLDGGENGNCWLKNATKSEGGDWGFKDTNIAYAELDD

SEQ ID NO: 123233 - protein, 155 aa, Triticum aestivum
  Clone ID: PAT_TA_17651.pep
MDASATVATGKGKKGAAGRKAGGPRKKSVSRSVKAGLQFPVSRIGRFLKKGRYAQRVGSGAPVYLAAVLEYLAAELLELAGNAAKDNKKSRIIPRHLLLAIRNDEELGKLLAGITIAHGGVIPNINPVLLPKKTAEKSPKEPKSPKKTAKSPKKA

SEQ ID NO: 123234 - protein, 336 aa, Triticum aestivum
  unsure (1)..(336): unsure at all Xaa locations
  Clone ID: PAT_TA_17652.pep
MANAGDPASLPPSASPSSSTRALESVPFSSGNPRIEETRGVVLLHPDPPAAAAAASSSHLPAERKPQVFVPSEPTPGPDADFCRFCGSFVPHMLEMRIVRIDGAEDQYXSVLIKFDTLSSTDSFYKHFNGKQFSSLEXDVSRVRFVEDVHYTQLIEHAHSSITSSAEQATCPVCLERLDQDPGGILTTICNHSFHCSCISKWTGSSCPVCRYCQQQPEKSMCSVCGTSENLWICVICGNVGCGRYKGGHAIEHWKETESCYSLELETQKVWDYAGDNYVHRLIQSKTDGKLVEYNCYGGHEADGICSICSGDAGMXQALLNSKVEADIAEDKDNEQ

SEQ ID NO: 123235 - protein, 236 aa, Triticum aestivum
  Clone ID: PAT_TA_17653.pep
RRATGLGRRRLRLPPTPRPRYLLGLEPCRVPRSGLGLPLLSPWPALRPWTTNEDRRATDLGFRAFPRAPLPPSASRSAESRAMERSFQLNPHATPFVPTSKSPFAESLKGKKDPEKQVDETEKNETADKSAGYLLPESLSFDDYAESLGKINISTESSSKGEAAEASHAGNHLAVVESLSLMFPDVSADFILEALKANEFDAVLTIDMLSDLCEADDNGHSAEVSEKPEHHGPSST

SEQ ID NO: 123236 - protein, 242 aa, Triticum aestivum
  Clone ID: PAT_TA_17654.pep
MASRLARSAVGAPLLRPVLARRAAPAFSVAAARYNSNVPAEDPKKKAQSIIDALPGNSLLSKSAILSSAAALSVYAISSEYYVMNEETIIAISLLSVWGALIKYGGPAYKEWAEAQNNKIKNILNSARADHTEAVKGRIEDVKQMGSVVEITKNLFQVSKETAKLESEAFELEQKTALAAEAKAVLESWVRYEGQVKQRQQKELAQSIIAKVQKELENPKVLQQILQQSVADVEKIVASKAQ

SEQ ID NO: 123237 - protein, 112 aa, Triticum aestivum
  unsure (1)..(112): unsure at all Xaa locations
  Clone ID: PAT_TA_17655.pep
ANRXXSFELPLRYLPTGFLVMRPLIPIWWRWYYWANPVSWTIYGVIGSQFGDNTSPVSVTGGSLAVVKQFLEDGMGIKHDFLGYVVLAHFAYVIGFFSVFAYSIKVLNFQKR

SEQ ID NO: 123238 - protein, 212 aa, Triticum aestivum
  unsure (1)..(212): unsure at all Xaa locations
  Clone ID: PAT_TA_17656.pep
RGRGRGIGQVERTVFYREKAAGMYSPLSYALAQTCVEMIYNVVQGFQYTGIIYAMIGFXCKAANCFNLLFFTMTSSIHFPWFGVMLVALTASSILANISMAFILPLRNLFAGFLVATQFIPISWWWYCWAKPVSWTIYGVYRDRSFGXNDRVLLVCPPYVGDRPGRXKQFLEDNLGIKHDFLGYVVLAHFAYVIAFFLVFGYSIKVLNFQKR

SEQ ID NO: 123239 - protein, 231 aa, Triticum aestivum
  Clone ID: PAT_TA_17657.pep
MHFSTFATILAAVPAALACKGYTGGLPKHTGTKTLSTPQYIARGQTFDAGWVKYDRGVKCTGQSEGGEKDTVFVLEEGAKLRNVIIGANQKEGVYCKGSCTLEFVWFEDVCEDAISIKGGGTANIIGGGAYKAADKIIQHNGCGHVNIINFYANDYGKVYRSCGNCSGNCRRSVHMEGTTAVNGGELMGINLNYGDKATYSNNCFPKVQCQGYNGCDKKNGACEPQKVGTC

SEQ ID NO: 123240 - protein, 237 aa, Triticum aestivum
  Clone ID: PAT_TA_17658.pep
MAAEGDLKLLGLSVSPFVVRVRMALHMKGLSYEYIEQDLFNKSELLLKSNPVETKVPVLIHDGKTILDSSAIVQYIDEVWAAMGPSILPVDPNERATARFWAAYVDDKLFSAYVGINKATTEVEREEKVSEMLAVLEQLEEAFAKNSNGKAFFAGDSIGYLDLAVGCHLLWLKAQHKMFGVVFLDAGKTPLLEAWAKRFAETDAAKEVVPDTGMVMEYAKKRQAYRAAVAAAAATAK

SEQ ID NO: 123241 - protein, 102 aa, Triticum aestivum
  Clone ID: PAT_TA_17659.pep
GAALLSLAGAPNASPLPAPAFISSPGGGSPSLLRMAKVVMHRRCARRPRPRRESDGGGASMREEELRPHPHVVPGAVVGSPAVVQAREPVLLTSSPSSPPRL

SEQ ID NO: 123242 - protein, 152 aa, Triticum aestivum
  Clone ID: PAT_TA_17660.pep
MAPKAEKKPAAKKPAEEEPTTEKAEKAPAAKKPKAEKRLPAGKTASKEGGEKRGRKKGKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 123243 - protein, 194 aa, Triticum aestivum
  Clone ID: PAT_TA_17661.pep
YLLVFSATCPAPAAAVSWSAPGRTPAAVPSCPAPAAAPSWLATTPASPSPTASSSGSTILAPTPNRRRRLTYEGEGDHGRNLPGRARTGPPEPDPLRSRAAPPAVAMALTSLPSPDFAPPPSAPPAMAPVRWTPPRRLFIWTGCHRFGVRGGGPGLEVGPTVIGMVGGEDRGGEEEDGELRAVISAWSDARRGP

SEQ ID NO: 123244 - protein, 103 aa, Triticum aestivum
  Clone ID: PAT_TA_17662.pep
CCHGPDFDEFVRADDRFEVVVPRNFALVCFRIKASGAMTEKDADEANRVLMENLNKTGKAYLAHTVVGDKFVLRFAVGSSLQEERHVRSAWDLIKKTTGSIMD

SEQ ID NO: 123245 - protein, 248 aa, Triticum aestivum
  Clone ID: PAT_TA_17663.pep
MPQAQARAVLPVVLLGCGGVGRHLLRHIVSCRSLHANQGVAIRVVGVADSSSLLVADDVRASGLDDALLNDLCSAKSAGSPLSSLLARGHCQVFNKPEAMGKVIDAATMLGRTTGLVIVDCSATYDTVGVLKDAVDHGCCVVLANKKPLTCAYEDFKKLTSHFRQIRFESTVGAGLPVIASVTRIIASGDPVSRIVGSLSGTLGYVMSELEDGKFFSEVVKTAKALGYTEPDPRDDLSGMDVARKALI

SEQ ID NO: 123246 - protein, 509 aa, Triticum aestivum
  Clone ID: PAT_TA_17664.pep
EASLAPAKVANLDFEARVPVPFSIFPSTYRESESHTQTVTETKTHEEVEIKPQQPEAGREGEISSVSVTAEKVPPPRSESEYIEEEVHITREEEHYHRPGVHKYEHDEEHFTVREDSRRPQPPSQYQPSQYHQPSHHQPPPKFQSSHTHVEIDTHRHPYYSTPIDLAEREYRQRYRPAQAFSTEDPSSHSHPHYKPQDNFKANNYTVEGRPAPQFYSSEKTDINNFTVDDRSSRPQYNHTEKTEINNFTVDSRSSRPQYNTCEKTEINNFTVDTRSSQPRYRDSKTTQVNTYSVDKPVSRPSYKKDVRFTEKTVESSKSDNKSKMGYYDDEGSFRNGGIHKLGDKSREIEIDIRETSGPASSPNTVSIPCHHIRLGDFLMLQGRPCQVIRISTSSATGQYRYLGVDLFTKQLHEESSFISNPAPSVVVQSMLGPVFKQYRVLDMQEGQIVAMTETGDVKQGLPVIDQSNLYSRLHNAFESGRGSVRVLVLNDGGRELAVDMKVIHGSRL

SEQ ID NO: 123247 - protein, 314 aa, Triticum aestivum
  Clone ID: PAT_TA_17665.pep
MNHRRGETSLSSVPRSDPLTTDYGTIDDLCDLCLGYGAMSVLEDTILAITQSTTYHDTTVIQYMNTVLTRICNYCEMHRHYNYLYNFLVLKGDHVASGLCCIQLFMNSMSQEESLKHLGHAKTHFEEALSVRDRTIEATKLVSRTARNKSASEKLTREMIMKFSTRVSYQMDVVKALNSVDGPQWKTSLFGNPTDPETLRRRCMVVETLAEKHFDLAFRMLHEFDLPVVDVYAGVAASLAERKKGGQLTEFLKNIRGTIEDDEWDQVLGAAINVYANKHKERPDRLIDMLISNHRKVLACVVCGRLKSAFQIAS

SEQ ID NO: 123248 - protein, 96 aa, Triticum aestivum
  Clone ID: PAT_TA_17666.pep
MATALNRGLRSGIRLLATGAEASKPASRGFHATGVKRMSGHGHDEPYYLHAKHMYNLHRMKHQKLTAWTSVLGAVSIGVGVPVFAVVFQQKKTSSG

SEQ ID NO: 123249 - protein, 270 aa, Triticum aestivum
  unsure (1)..(270): unsure at all Xaa locations
  Clone ID: PAT_TA_17667.pep
IVEFDDVYGAVLTYFYEDSSXKFFDLKNYTLLYSISDKNVHEIKISPGLMLLXIYTRTTSSICVKILNIEDGTVLKFFNHLLHRNKKVDFIEQFNEKLLVKQDGENLQILDVRNFQLTEVSSTEFMTPSAFIFLYELQLFLTFRNRSVAVWNFRGELVTSFEDHLLWHPDCNTNNIYITSDQDLIISYCKADSTDSSSEENAGSINISNILTGKCLAKIKAGNFNEQKKTWKFQNTITEALEDITALYYDEERDEIYTGNRHGLVHVWAN

SEQ ID NO: 123250 - protein, 278 aa, Triticum aestivum
  unsure (1)..(278): unsure at all Xaa locations
  Clone ID: PAT_TA_17668.pep
MQGAGAEGRSRGSPSAMDKADESAKKARLELPHGHLVKQELVAHDAAAGGGAIVAVAEHSPRAELAVKIDMCVLHCPLCALPFKPPVFQCKGGHLACGGCAAQQPSGRCGACADGCGFFDPCPALDAVVSSTRVECPNAGCHSYVTYHEADEHRSACAHAPCRCAEPGCAFVGAAPDLXAHLSAAHAVPVRAIHYGKVSRLQVPVSTPRLLLVNEDDGRVFVLTVGALGAAATAVSVVCARGSAANKPRFTCKMWVNLAAANGGKADIVLVEMQVRSN

SEQ ID NO: 123251 - protein, 232 aa, Triticum aestivum
  unsure (1)..(232): unsure at all Xaa locations
  Clone ID: PAT_TA_17669.pep
LSFGLILVNCCVGCEAVGYYXAGTVEFIVDTLSGEFYFMEMNTRLQVEHPVTEMIVGQDLVEWQIRVANGERLPLSQEQVPLNGHAFEARIYAENVPRGFLPATGTLHHYRPVLSSPTVRVETGVEEGDAVSMHYDPMIAKLVVWGESRNAALVKLKNCLSNFQVSLLLTIVAFLPQLSSPNAFEYPILSSVCGSMRFFEVHLPWPLAKHCLLKDSGVVLLIIRPYHGVVNE

SEQ ID NO: 123252 - protein, 258 aa, Triticum aestivum
  Clone ID: PAT_TA_17670.pep
MVKSTLLLGALAAFSSYAQAKEMKVNEDKAQRLYDTGVIHNKLMASKQAVWEKQEAAGAFASEQYPKLGYTKCVRGFAEAIKGDAKNTFACHNADLYSFLSHADLGSTGGRGSSSWGWTSSDGREFVAIGQYDGTAFAEITKKGQLVYLGRLPQYSVPSQWREIRAYKNYVIIGSEAVGHGIQIFDFTKLLKIDPKKPVTFDAKKDLTSHFSALLPVGRAHNVVVNEELKYAVADGAQPRDDKNCASGLNFFDLTDPS

SEQ ID NO: 123253 - protein, 199 aa, Triticum aestivum
  Clone ID: PAT_TA_17671.pep
MPNLAGYRPGPPVLVREKLGGHHGPLSASRDHEHAMDKRALDELGAERKDGVLPKYAQSEADTKRAKQQYAQRSRVRKLQYIAELEGKVQSLQSEGIEVSAEMEFLTQQNIMLDLENKALKQRLESIAQEQVIKRVQQEMFEREIGRLRSLYQQQQQPPQPPTLARSNSRDLDSQFASMSLKHKDPNSGRDAVSGPLRT

SEQ ID NO: 123254 - protein, 189 aa, Triticum aestivum
  Clone ID: PAT_TA_17672.pep
MMSSKKLAQLSKKWQGISAIGRRRVTTTDKDVHPSCSSVAGKGHFVVYSSDGRRFEIPIACLRTMIFEELLRMSQEEFGFTSEGRITLPCDTTMMEYVMCLLRREASEDVERALLSSIITTCHHPSRMMQAATGLHQQFSVRSSSRVNISRFFFLFSCSIFFPGCTFGAHLLCNVFPRVPYCGCTDGCM

SEQ ID NO: 123255 - protein, 130 aa, Triticum aestivum
  unsure (1)..(130): unsure at all Xaa locations
  Clone ID: PAT_TA_17673.pep
CAALEAAGFVICSRRPPPPPSPSPIPPRRPPPSPGDLPPPPXPPPCPSPASPPAASLPRPLPPSASHASPSPPPPPTRVRVPHRRDPARSRACLSIHSYSMSEKPSDDTTGQVRPEGDVSDVKVETGNQA

SEQ ID NO: 123256 - protein, 100 aa, Triticum aestivum
  Clone ID: PAT_TA_17674.pep
MPDCLIKAFGSRGSMAMERFFTALVFCEAPLDGYGTSVLTAGTVKRLVSGGGHATKPAVANKPDSEKAQGYFTGKPTAQRRPGFELAFDGLNCFDTIVMH

SEQ ID NO: 123257 - protein, 116 aa, Triticum aestivum
  Clone ID: PAT_TA_17675.pep
TTRISPFVPQSSSKESLVPDCPIESSVRGSMAMERFFTALVFCEAPLDGYGTSVLTAGAMDRPVSAGGSATKPAVANKTDSQKEQGLFNGKPTAQRRPAFELAFDGVNCFDTVVMH

SEQ ID NO: 123258 - protein, 132 aa, Triticum aestivum
  Clone ID: PAT_TA_17676.pep
SNLKERPPGAGTTKNLLLRSRSSSSKESFFPDCLIQASVSRGSMAMERFFSRGAALVFCEAPLDGYGTSVLTAGTVKRLVSGGGHATKPAVANKPDSEKAQGYFTGKPTAQRRPGFELAFDGLNCFDTIVMH

SEQ ID NO: 123259 - protein, 236 aa, Triticum aestivum
  Clone ID: PAT_TA_17677.pep
MAGGGDELKLLGTFASPFVMRAKLALSFKGLSFEDVEEDLANKSQLLLESNPAEKKVPVLIHNGKPVCDSRVIVQYIDEAFSGNGAPLLPADPYERAVARFWAAYVDDKLLASWLQAARGKTEEEKAEGLKQTLVAVETMEAAFKTCSKGKPFFGGDRVGYLDVTLGGLVVWVHAGAALYGMRLFDDAKSPFLAAWVERFGALDAAKAVLPAVERVVEFAKMRQAQAAAPATAGGN

SEQ ID NO: 123260 - protein, 197 aa, Triticum aestivum
  Clone ID: PAT_TA_17678.pep
MTDIKNYSLGNFTLQNSSVLPRAWISYKTFGDPSLPAVLYPSWFSGAISDNEWLIGNDKTLSPEKYFIIITALFGNGQSTSPSNSDITPFPDVSFYDNVKAQHQLMTHLGIKHLRAVLGWSMGAAQSFQWATQYPDFMDICVPFCGSARTSLHNQVFLEGVKSALLAAKGATSAGSIKGRVESPSYSERNWTDEKTS

SEQ ID NO: 123261 - protein, 65 aa, Triticum aestivum
  Clone ID: PAT_TA_17679.pep
MAKSKNSSQHNQSRKAHRNGIKKPKTSRYPSLKGTDPKFRRNHRHALHGNMKALKEAKEGKREVV

SEQ ID NO: 123262 - protein, 65 aa, Triticum aestivum
  Clone ID: PAT_TA_17680.pep
MAKSKNSSQHNQSRKAHRNGIKKPKTSRYPPLKGTDPKFRRNHRHALHGNMKALKEAKEGKREVV

SEQ ID NO: 123263 - protein, 65 aa, Triticum aestivum; identical to SEQ ID NO: 123261
  Clone ID: PAT_TA_17681.pep

SEQ ID NO: 123264 - protein, 195 aa, Triticum aestivum
  unsure (1)..(195): unsure at all Xaa locations
  Clone ID: PAT_TA_17682.pep
RSSTXRLPKXLSHIRGLKDMIPIHLHPKPNAADQEVRFQCPVTGFEFNGKSQFLVLRGCGHVLSVKALKEVKSSSCLVCHKEFDEMDKMPINGTEEEVEVLRQRMEEERGKLKEKKDKKLANGLSGSKHAAAAVADTEKLENGKKGEAAPAKRFKAADHAPAHANKKVYASIFTSSNKSDFRETYSCRSLPLGRN

SEQ ID NO: 123265 - protein, 150 aa, Triticum aestivum
  Clone ID: PAT_TA_17683.pep
MNFLRRFTPLRSFSRTFTTTRAIMSKLYVGNLSWNTTDETLRQTFSEFGEVTDSIIMRDRDTGRARGFGFVTFSTEEQATAAVDALNEQELDGRRIRVNVANARPAGGNGGGFGGGRGGGYGGGRGGYGGGDRSYGGGDRSYGGGDRGGY

SEQ ID NO: 123266 - protein, 307 aa, Triticum aestivum
  unsure (1)..(307): unsure at all Xaa locations
  Clone ID: PAT_TA_17684.pep
SDRFEDDELRHNQRELQLKYEENGDEHQSTKMKVEDVQLSMDDLEMIQVIGKGSGGVVQLVRHKWVGTXYALKGIQMNIQESVRKQIVQELKINQATQSPHIVLCHQSFYHKXVIXYLVLEYMARLALAGMLDXDRLILDPHVTVLFHRDIKRSNLLVNXKGEVQIADNGVSAVLAKPIEVATYNYIAPLGNSGSSYYYKSDIWSLGLVILECAIGRFPYTPPEGEGWLSFYELLEAIVDQPPPSAPADQFSPEFCSFISSCIQKDPAERMSASELLNHAFIKKFEDKDLDLGILVESLEQPMNVPE

SEQ ID NO: 123267 - protein, 213 aa, Triticum aestivum
  Clone ID: PAT_TA_17685.pep
MVNTTAAMVSGGVLPLASLNHISIVCRSVEESLDFYMNVLGFTPIRRPGSFDFDGAWLFNYGIGIHLLQSEHPESLPAKKEINPKDNHISFQCESMVAVERRLKELGIPYIQRCVEEGGIYVDQIFFHDPDGFMIEICNCDKLPVVPLAGQNFAMAACKRVASVKQQQLPMPVAQVAQATPAPAAAAASQCVPAPNPALQRVGGEEAAHISCA

SEQ ID NO: 123268 - protein, 323 aa, Triticum aestivum
  unsure (1)..(323): unsure at all Xaa locations
  Clone ID: PAT_TA_17686.pep
GNLAFMVCDPMKLAPSTPTGYASASSTALLASKMDVPTQFGIPIPAVCEWLKQHWSGSLEDVSKPMMPPARLISSAGQRXEPSSLSHLHXLXPLXREGGALSSSQMPAXPTRQHGSCSSASAKISYGEXDSVNSHSFQGQRXSASQMPRPKEQPGSVMDSFPPGHPRSIFLPLPLKQMMPVDNKIKPNCSVSDESRVANARINCDAMHNVAYQENCWNEAQSSSSPPAISEQGDKRDGFSSGEETMYSAETMESRNIPSPKDKRPQIVGRSQSFANHSKWDSPKSVESSKGPPSRSHTFIPLRKPHLQAASISQKSQVYFSPT

SEQ ID NO: 123269 - protein, 116 aa, Triticum aestivum
  Clone ID: PAT_TA_17687.pep
AVAVKTETAEASASREDAAGVERAVSESPVVVVGRRACCLTHVVKRLLQGLGVNPAVHEVADEAALAGVVPDGGEAAALPAVFVGGKLLGGLDRLMAVHISGELVPILKKAGALWL

SEQ ID NO: 123270 - protein, 138 aa, Triticum aestivum
  Clone ID: PAT_TA_17688.pep
MYQAIPYSSTRPWARPSPAAEPAVAVKAETAEAAASREDAAGVERAVSESPVVVVGRRACCLTHVVKRLLQGLGVNPAVHEVADEAALAGVVPDGGEAAALPAVFVGGKLLGGLDRLMAVHISGELVPILKKAGALWL

SEQ ID NO: 123271 - protein, 253 aa, Triticum aestivum
  unsure (1)..(253): unsure at all Xaa locations
  Clone ID: PAT_TA_17689.pep
MERMVMRLVRNKQSLRQLQGAAAGGLASSSSASSTAGAAASSFSTLQQQQEDHPGVLNIRDTAAHLIGRTPLVYLNKVTEGCGARVAAKLEFLQPSFSVKDRPAISMIEDAEKKGLITPGKTTLIEPTSGNMGIGLAFMAALKGYELVLTMPSYTSLXERRVVMKAFGAQLGLADPGQRHRRDRNADLTQPYQNLPARPSCATQFENPANVQVHYETTGPGGFGGDTLGQGPTSSSWGIGNRGGPVTGRSGKP

SEQ ID NO: 123272 - protein, 259 aa, Triticum aestivum
  unsure (1)..(259): unsure at all Xaa locations
  Clone ID: PAT_TA_17690.pep
CTXTLAWGVNPPARRRVGKGTEYYDGKTKRYVDYVITDILQMMGRAGRPQYDQHGKAVILVHEPKKSFYKKFLYEPFPVESNLREHLHDHINAEIVSSTIGNKEEAIIYLTWTYLYRRLVVNPSYYGLEDTETYTLNAYLSRLVETTLEDLEDSGCIKVDDHSVQSLILGKIASQYYLSYLTVSMFGSNIGPNTQWGPCAARPGACSRLRPLPGSPSSSHRPSVPLRKGPYPVYNTPLIPIGITLPRTSPKQFHHTRNT

SEQ ID NO: 123273 - protein, 184 aa, Triticum aestivum
  Clone ID: PAT_TA_17691.pep
MKYSVAFVALAAVAAQAQSLADVPKCAIPCLDKAIASETSCDKTDLACVCKGFSAVRSKATSCVIDECGTDVAINEVLPATENLCKNPPKESEAKSTAEEEKPTTTAAATSTLVVVTTSAEVVETTAAATTTVAPIIPTTAAEEPATSTPAAATPTKGPEQANGAAGLKGLGALAMAAFAALAL

SEQ ID NO: 123274 - protein, 329 aa, Triticum aestivum
  unsure (1)..(329): unsure at all Xaa locations
  Clone ID: PAT_TA_17692.pep
MSSRMAGSVLLRRAGAGAGRLFATTASPAARTALGGGEGAWVRMMSTSAASQVKDEAAKGVKAEAAKXCDGEKKEVAISSYWGIEQSKKLVREDGTEWKWSCFRPWETYTADTSIDLTKHHVPNTMLDKIAYYTVKSLRFPTDIFFQRRYGCRAMMLETVAAVPGMVGGMLLHLRSLRRFEQSGGWIRALLEEAENERMHLMTFMEVAQPRWYERALVIAVQGVFFNAYFFGYLISPKFAHRVVGYLEEEAVHSYTEFLKDLDDGKIDNVPAPAIAIDYWRLPANATLKDVVTVVRADEAHHRDVNHFASDVYYQGMQLKATPAPIGYH

SEQ ID NO: 123275 - protein, 286 aa, Triticum aestivum
  Clone ID: PAT_TA_17693.pep
WWRRGSGRSGSARRASAHEAAASDGAAVLVWRQPMLDWWCSPSSSAVWTAWRRALGAGCTLLFFSSSPPIRPGPWRPLVAGSTVDGAAGGVVADREKSLAGFPATTTATPPGVVFLLGGAVEVRLPPSLPLSCPGENSSLFRLGGSGVSCVVIFLKVPPWVSWGCAGAMGVVSSVWRLCRRSWRHGLLVGAMLCYLVVRCLSCGCLFAGSQCHGMDRVKIGFFPRWQQQGMEGLNLVLIPAGAVLLSALAALAPLLASSSSTSLNSSFSSLGVDYCVLKRLFVWCS

SEQ ID NO: 123276 - protein, 73 aa, Triticum aestivum
  Clone ID: PAT_TA_17694.pep
GVPLEFHAPHPLQDLSKTHARRQGGREKKKKKNKHRTVPCSGSRACRRSTLLVLVILSVCKVNFHTPICAKGV

SEQ ID NO: 123277 - protein, 255 aa, Triticum aestivum
  Clone ID: PAT_TA_17695.pep
SKLRTDSQHTIKAICIVHNETATGVTNDLHAVRKLLDAYRHPALLLVDGVSSICALDFRMDEWGVDVALTGSQKALSLPTGLGIVCASPKALEAAKTAKSVRVFFDWKDYLKFYKMGTYWPYTPSIQLLYGLRAGLDLLFEEGLDNVIKRHTRLGTATRLAVAAWGLKNCTAKEENFSDTVTAVVVPPYIDSSEIVKHAWKRYNLSLGLGLNKVAGKVFRIGHLGHLNELQLLGCLGGVEMVLKDIGYPVKLGSG

SEQ ID NO: 123278 - protein, 350 aa, Triticum aestivum
  unsure (1)..(350): unsure at all Xaa locations
  Clone ID: PAT_TA_17696.pep
QWAAPRGSSPGHRREKARWTTCDGPGRNHLXFVPGPVNIPDQVIRAMSRQNEDYRSPAIPALTKTLLEDVKKIFKTTTGTPFLFPTTGTGAWESALTNTLSPGDRIVSFSLGQFSLLWIDQQXQRLGFSVDVVESDWGYGADPRRSSKSKLRTDSQHTIKAHLASSTNETATGXVTNDLHAVRKAPRCVPASRRCCWWTRVVHLLPGLPPGRGVRRAGGLDGVIKRHTRLGTATRLAVAAWGLKNCTAKEENFSDTVTAVVVPPYIDSSEIVKHAWKRYNLSLGLGLNKVAGKVFRIGHLGHLNELQLLGCLSGVEMVLKDIGYPVKLGSGVAAAAXYLSNSTPLIPSRI

SEQ ID NO: 123279 - protein, 609 aa, Triticum aestivum
  unsure (1)..(609): unsure at all Xaa locations
  Clone ID: PAT_TA_17697.pep
ARRPDAAGAAPAVGSGASFRRVLGQVLSHHLRPTAEPNPLRRWYRRASYFLEDNWRRCWVILLWLSICGGLFTWKFMQYRERAVCKVMGYCVCVAKGGAETLKFNMALILLPVCRNTITWLRNRTAAGRFVPFDDNINFHKVIAAGISVGAGLHIISHLACDFPRLLHATEEEYEPMKPFFGDVKPPNYWWFVKGTEGWTGLVMLALMAVAFTLATPWFRRGRVRLPGPLSRLTGFNAFWYTHHLFIIVYALLIVHGHFLYLTKKWQKKSTWMYLAVPMVMYACERLTRALRSSVRPVKILKVAVYPGNVLSLHLSKPQGFRYKSGQYIFVNCAAVSPFQWHPFSITSAPQDDYVSVHIRTLGDWTRELKNVFSKVCRPPTEGKSGLLRAEYDRDVGAMSNPSFPKVLIDGPYGAPAQDYKQYDIVLLVGLGIGATPMISIIKDIINNMKRFEGDVESGNPGXREHVGSSFRTRRAYFYWVTREQGSFEWFRGVMDEIAESDKKSVIELHNYCTSVYEDGDARSALIAMLQSLNHAKNGVDIVSGTRVKTHFARPNWRNVYKRIALNHREQRVGVFYCGAPVLTKELRDLAQDFSRKTNTKFEFHKENF

SEQ ID NO: 123280 - protein, 185 aa, Triticum aestivum
  Clone ID: PAT_TA_17698.pep
MSPTLSEEPVGHENEKIVTTDDMVTSYQLPPDGYNQYKQSGLDTLQRTPCRSRYMGVQVSQTEEPSDAKLDKTTTSSVAKRGSHLRRSIQSSIGKLIHGSERRNTPHSAQATPAKITTNANNDGASPITTNARLRRRQSLTGLPPPSTTMSRRSSLGGKSDSSSSDRKAKTPPLMNSAAKAKRWL

SEQ ID NO: 123281 - protein, 284 aa, Triticum aestivum
  Clone ID: PAT_TA_17699.pep
MAAAALTLLLLVLLPAGRALATAAGDAHPGYAGAEADTCEPAPGGAPPYGGGAAGRRHGPALEEYGGGHIVDITHAYRPSMPAFAPGATVGPLVRLKASMEDGSEYNLSELRMECHMGTHVDAPGHMNQAHFAAGLDVDTLDLDVLNGPALLVDVPRHTNITAESMKSLNIPKGVRRVLFRTLNTDRGLMWKAAGDMSYVGFTEDGAQWLVDNTDIKLVGIDYISVAAFDHLISAHVAFFKNADIILVEALKLDNVKTGLYMLHCLPLRLVGSEGSPIRCILIK

SEQ ID NO: 123282 - protein, 161 aa, Triticum aestivum
  Clone ID: PAT_TA_17700.pep
MDRIKEKMNQLRLEADEAAGKVEELQTKVKVLEQENLSKEQEITSLQHKNNLLEGEVEKLENTVKDFKKAADEGQQHGTQNETLQRRLQLLEEEAEDADKTLREANEKLRQTDVKAGHFERKVQALESERDQWETKYEEMSQKYTSLQKELEELQAEIGNI

SEQ ID NO: 123283 - protein, 89 aa, Triticum aestivum
  Clone ID: PAT_TA_17701.pep
YDLACTIILSFDLIERLFFFFFFILFFFFFSSKHNHHNYYLITSKIQGVRYGINLTTRFRPKTTASSSKPSSTSSLRTRDDRYNSLANI

SEQ ID NO: 123284 - protein, 118 aa, Triticum aestivum
  Clone ID: PAT_TA_17702.pep
SWSGALPQSWNGIMPFRSVDDVKNEFKSLSLKITHAHGTSNLDIPPENYLIVTKDGNACLAILDGSSDRVLRHLILIGDAMMQDLFVIYDNEVNRIGWVRAQCDRMQDLESGIIDSRL

SEQ ID NO: 123285 - protein, 323 aa, Triticum aestivum
  unsure (1)..(323): unsure at all Xaa locations
  Clone ID: PAT_TA_17703.pep
MAAATPHSPPPQQLSSPFLEYITAPGGLDKVVLRGRRSCAVEIRLLEGQVTSWKDXHHEELLXVRSKAITHPEWXRGGLPICLPLFGTQRNGKQDVFSRNCLRGYDDNPLALLEILAIRGFNDNVLRPSEVDLXMWPHSFSFRSSIVLCSGGYLSLTPQIRKTIIDGKLFAYTFAYHTYFSVSDISEVRVEGLETMDYLDNMKGKERFTEQGDAIVFESEVDKVYLAAPSKVAIIDHDMRRTFVVTKEGLPDAVVWNPWDKKAKAMQDFGDSEYKHMLCVEPAAVEKPITLKPGEEWKGRLGLSAVPSSYCSGQLDPLKVLHG

SEQ ID NO: 123286 - protein, 137 aa, Triticum aestivum
  Clone ID: PAT_TA_17704.pep
HGGARLLRPTISRPSPACRRHPCAMKPKARPLTSSSVPPRHAAALPSTRAAGGAASMHAAYEEEDERVLQHAGEEELACHCRLRPRGGGAHGGCHGGSRSRARRARKPGADAESTFETLNATWILQSEGAIWVNPLM

SEQ ID NO: 123287 - protein, 166 aa, Triticum aestivum
  Clone ID: PAT_TA_17705.pep
LSCIYNDCLNGKNSVSIAIELDLLPHASKVSGCHCQVLNTRLLASLSLANTARSALVTAPCAVQWGVLSIAAAITNGARTTLADTFSASGFKTATQECMWHFANNGLAVAFNNLDTHRQGVRTGNGSCSHGGEKDGQESGSLHLDVVVCVAFFPGRRRSRVFLTGR

SEQ ID NO: 123288 - protein, 491 aa, Triticum aestivum
  Clone ID: PAT_TA_17706.pep
RPTRPNEASSLLELCTSKLKIVQVTASMSDKDIKLALSGPPNILVTTPACVAACISKGIVQGSSIKESLSMMILDEADLLLSYRCEDDLKALVPHIPRSCQSILMSATSSPDIDKLTKLLLHNPFVLTLTEVGHAKDDVVPRNVQQFWISCSAKDKMLYILSLLKLELIQKKVLIFVNSIDNAFRLRLFLEKFAIRSAVLNAELPQNSRLHIIEAFNARLFDYLIATDDNKTKEAKQTNKESKKDSKGSRKHLQQTLDAEFGVVRGIDFKNVFTVVNFDMPPYPAGYIHRIGRTGRANKTGASISLVSPEEDNVFEEIEHMLQDVEKKDTNCILPFPLLTKNAVESLRYRAHDVARSVTSRDIQEARRQDVKNEILNSEKLKAHFEENPTDLDLLKHDKLLTNKSIPAHLRDVPEYLIDPTTKEASNAVKLSRAAMGLDNPRRKKRMGFRSGSGKSSDPLRTFSAEGKSRKRRGKEREGDDRRKRRKKAEI

SEQ ID NO: 123289 - protein, 109 aa, Triticum aestivum
  Clone ID: PAT_TA_17707.pep
MPSEAGHRLYVKGRHLSYQRSRHTTRPATSLIKIEGVDDTNAANFYLGKKVAFVYRAQKEIRGTKIRVIWGKVTRPHGNSGVVRAKFTSPLPTKSFGASVRVMLYPSSI

SEQ ID NO: 123290 - protein, 109 aa, Triticum aestivum; identical to SEQ ID NO: 123289
  Clone ID: PAT_TA_17708.pep

SEQ ID NO: 123291 - protein, 279 aa, Triticum aestivum
  Clone ID: PAT_TA_17709.pep
MSAVVCGKRSSIFADELIPSSPPSPPHHHPSKRARCSPTRAFDDAAAAHRREALLHHLRSLFPHMDPQLLERALEASGDDLDFAIRSLNDLRLESAEAIFSAAVSEPENGLSTALKLSAEGNGQLDAISGNPPATDNCQTNHHSSEWVELFVREMMSASDINDARARASRALEVIEKSIMERTGAEAVQNLHKENTMLKEQLAIALRENAVLKRGVAIQHERQKEFDDKTQEVHNLKQLILQYQEQLKTLEINNYALRMHLQQAQQNSSMPGRFHPDVC

SEQ ID NO: 123292 - protein, 67 aa, Triticum aestivum
  Clone ID: PAT_TA_17710.pep
TSFLSFQWATLMISRISPQQMCAIKATNQNVLIRIEFIPCDLCPSLSKYISNGRERRAEITRIEFIP

SEQ ID NO: 123293 - protein, 317 aa, Triticum aestivum
  unsure (1)..(317): unsure at all Xaa locations
  Clone ID: PAT_TA_17711.pep
VVLHHPGILQXTLSTKRFGPEERRFDHLAFLNFAQNVVCFVWSFIMIKLWSGGSSPAGRAPLLKYWGVSITNTIGPTMGIEALKYISYPAQVLAKSSKMIPVMLMGTLLYGVKYTIPEYFCTFLVAGGVSSFALLKTSSKTIKKLANPNAPLGYGLCFLNLAFDGYTNAPQDXHNSDNHILICSFDCTRSWXEMSGRSLAVSRSRSPLLFSNWPYANGFEAVSFCRENPEVAWDILMFCLCGAVGQNFIFLTISRFGSLTNTTITTTRKFMSIVISSVISGNPLSMEQWGSVVMVFSGLSLQIYLKWKRKKGRDHKE

SEQ ID NO: 123294 - protein, 425 aa, Triticum aestivum
  unsure (1)..(425): unsure at all Xaa locations
  Clone ID: PAT_TA_17712.pep
PQSFYRARSNTTIGTPTFFPPVAVRTPEAHPVNIRHETALINSRQAETPRGESNIADELDLFXEDREGVAPNSRRAKEVEEDLKERRKLGKKQLAAVGARVSLEAGLSSRKGAELRGREAAITAAIEYNDGRNGEVSTIKHQLDSAKEGVGAVMDQQKESESETKALRSITQRMILTQFQIEEVVLKRCWLARYWGLAVQYGVYPEIAVSKHEHWSSLAPLPLEVVLSAGQKAIKEEPRKQGVIQAGEDDAQRRNRLVRDMSDVMGEGNIESMLSVEMGLRELSSLKVEDAVVVALGQHRRPSIVRQFTSDYKSPGEPKFLEAFDLSNEEAEDVSFKHAWLIYFWRRAKTHGIEEDIADERLQFWIARNAVAPNSHDAIDVERGLTELRKLGIEQQLWEGTRADIDEACLSSDGGRIGRARVMSS

SEQ ID NO: 123295 - protein, 129 aa, Triticum aestivum
  Clone ID: PAT_TA_17713.pep
TTSFKIPSVLLSRSLVISARMGSDLALRMQTKRRHVDGELCAPDARSDRHSKLTLHPLIDNQLLSHWRSNRSPPLACLISQLVKNDANVITTNESIGLRTVTVTTFELLNEAVTEEVNRTGYCSCLFTK

SEQ ID NO: 123296 - protein, 141 aa, Triticum aestivum
  unsure (1)..(141): unsure at all Xaa locations
  Clone ID: PAT_TA_17714.pep
EPPFPPPFSRPARLPPRQRRKGALRLPPPKLPTPLPPVLASPSLPRGLVPSAVAGPDREVETAAVDVLAHQRAPRDYYQGKTSRPTGVHTRKAGHVMVGYKVTKVXVIPDLTDFKFKPYVSQCARAMSRSLLNRTQELISF

SEQ ID NO: 123297 - protein, 197 aa, Triticum aestivum
  Clone ID: PAT_TA_17715.pep
LTTDLACVRWIQFHSPAFRVHEDGRVERFFGTDTTEPGFDAATGVTSKDVVLDGATGVFSRLYLPALPDGPDRGRRLPILVYFHGGGLVLGSAASQMYHGYLNSVVSRAGVLAVSVDYRLAPEHPIPAAYEDSWMALSWAASRADPWLSEHGDAGRIFLAGDSGGANIVHNMAIMAGSADDDNGLPVGAVVEGVILL

SEQ ID NO: 123298 - protein, 128 aa, Triticum aestivum
  Clone ID: PAT_TA_17716.pep
PSQNRRTLWQNADKSFIKIPVTTPAGGRNLRAAQDENGRGSGASLWEPRSSSSSPPSPPPSPDQHLPSAWPRRLRGHLAPPLLPPLSAPRPLLPLLPAACPPATPCLRLQERRSSSCPAPYLIFPSLF

SEQ ID NO: 123299 - protein, 170 aa, Triticum aestivum
  Clone ID: PAT_TA_17717.pep
GAFFFFFFITKIHLNTFIFSTSDSERREYNSKIELLQCSSNNLALTKHANSPAECRQKLHQNCSGHASSRSLRSEQPGTRMEGKVVHHYWSPAPLLLVHLLPRSLHLIGSHLIRLADGTVHCGLLFRRRFLLLGLCSLSAEPPARRRHLACGFRGAEAVHAQHHISLAFF

SEQ ID NO: 123300 - protein, 292 aa, Triticum aestivum
  Clone ID: PAT_TA_17718.pep
RREYNSKIELLQCSSNNLALTDHGNSPGQNAGQEASPKIAVAMLSSRSLRSEQPGTRMEGKVVHHYWSPAPLLLVHLLPRSLHLIGSHLVRLNVCLFYFFSEMNIYGIILTHTPSVSTRITRRRNLGRREYKDTNSKKKLQCSSNNLALTKQANSLAECRQQLHQNCSDHTSRRLKSEQPGTRMEGKVMHHYRSPAPLLLLLFPRRLHLMINTSHLLGLADNVATRRRLFHRRLLLHGLCSLSSEPPARRRHLACGFRSAEAVHAQHHISVAFFSFSLDLCVGSASFHLPRA

SEQ ID NO: 123301 - protein, 207 aa, Triticum aestivum
  Clone ID: PAT_TA_17719.pep
QRIQWIWSRRRWRWWRCRSRCRATSTSCCTCRCSSRPSLTGLISTCTTRRPRRTSARPARACTAGTTRRSAPSTSTSSTSPRSPQLEILAHPATAAFMSHCGWNSTVESMSHGKPILAWPMHSDQPWDAQFVQKYLGAGLLVRPWEKHGEVTPAAIIQQAIETVMVGEEGLAMRRRAMALGEAVRACAAAGGSSRKDLQDFVAHLTR

SEQ ID NO: 123302 - protein, 196 aa, Triticum aestivum
  unsure (1)..(196): unsure at all Xaa locations
  Clone ID: PAT_TA_17720.pep
MASGNGRERSGMPPVPPWLTASSRTGLDDSTVTSQGVGKGPCASSCMARSVSRGGGMVANTCRALEGEFVDAFAETLAAVGQRIFAVGPLNPLLEPGQIDAKQGRHECLDWLDKQPAASVLYVSFGSTSSFRGSQVAELAAALKGSKQRFIWVLRDADRGSVSTDDADSRRHARLASEFAEQTRGTXLVITGWAPQ

SEQ ID NO: 123303 - protein, 138 aa, Triticum aestivum
  unsure (1)..(138): unsure at all Xaa locations
  Clone ID: PAT_TA_17721.pep
APSASLRSPLLALLLLLVAAAASTTSTXRPGGCSARRLRRPASRERRRGVGQQLCWEIVMXVRSCTGEIILFFLHGEAVLGPRCCRAVRPLERRCXAADDLLSLIGFSXEEGDMLKGYCAPPRQRRGAAPWGSSWRCK

SEQ ID NO: 123304 - protein, 64 aa, Triticum aestivum
  Clone ID: PAT_TA_17722.pep
EPSSLREKGLVVLPGEDAPQQPPPDVAGKMFEPPLRSWAAPRPAPAEDSDSGSGKKDPPLLLGP

SEQ ID NO: 123305 - protein, 466 aa, Triticum aestivum
  unsure (1)..(466): unsure at all Xaa locations
  Clone ID: PAT_TA_17723.pep
QQADPLSRPPPAPPHHRAEPPSKPSSGLPKGGGESQKEHHNRQGTSEQPYQHSNCAAPPGQRTPRGRWLSQRREQRLSGESREGRATHGAATGPDWTGRSVWRPGHGIDGRSTPIPPSEEDXKWFCEGVEAHRVYVVGRMKQIAQVMKTPXDDVLQSHGVIPVNIELHSXHMLDQLQEHVETIDMANDLHSIGGLDPLLGYLKNSHAGIRAKAAEVVSTVVQNNPKSQQLVMESNGLEPLLTNFRSDPSTTARTKALGAISSLIRNNQSGLAAFRLGNGHAALKDALGSDDARLQRKALHLTQYLLNNKADRNVAAEIGLPNQLIHLASSDDSGVREAALGGLLELARDKTPAASNALPDQDKLKDVLKSRIEGISAMDADDLQAAREERQLVDSLWKECYGEPSSLREKGLVVLPGEDAPQQPPPDVVGKMFEPPLRVWAVPRPAPAEDPDSGSGKKDPPLLLGP

SEQ ID NO: 123306 - protein, 164 aa, Triticum aestivum
  unsure (1)..(164): unsure at all Xaa locations
  Clone ID: PAT_TA_17724.pep
MATANLSSVVVAVDGSEESMKALRWALDSLRLCPDGALVVLHVQPPPGIAAGLNPGPIPFGGPSVAEVPAFTQAIESHXQRRITDAILEHALKICSDKNVEVKTQVVXGGIPXRRSGEVAAELKADLLVMGCRAFGPVKRMFLGSVNNYCINSVGCPVVVIKGT

SEQ ID NO: 123307 - protein, 163 aa, Triticum aestivum
  unsure (1)..(163): unsure at all Xaa locations
  Clone ID: PAT_TA_17725.pep
MATANLSSVVVAVDGSEESMKALRWALDSLRLRPDGALVVLHVQPPPGIAAGLNPGPIPFGGPSVAEVPAFTQAIEAHQRRVTDAILXHALKICSXRNVEVKTQVVVGDPKEKICEXAAELKADLLVMGCRAFGPVKXRMFLGSVSNYCINSVGCPVVVIKGT

SEQ ID NO: 123308 - protein, 126 aa, Triticum aestivum
  Clone ID: PAT_TA_17726.pep
YSSPDYLSPFLSRAARPSGQLNFVDISCRATLEASANAAAEAELGGGGGGRQAARMERRWRCLCFWLEVQGVKDEPPALHHVAEAAEPLHRCADLHLAPPLPPCPIPGPSSCSSASSSPSHHIRVQ

SEQ ID NO: 123309 - protein, 216 aa, Triticum aestivum
  Clone ID: PAT_TA_17727.pep
MDGSSAEVAKVKRAKTVLTVAAISGSLRRASANAGLIRAAAKMCEESIPGLQIDHVDISDLPLLNTDLENVDGNAFPAAVEEFRDRVRGADCFLFASPEYNYSISGPLKNALDWGSRPPNVWADRAGAIVSASGKSGGKRSAYHIRQVGVFLDIHFINKPEGFVSAHHPQSKFNGDGNLIDPETGELLRKILLSLRAFALTLIHGNDSAANSGQGS

SEQ ID NO: 123310 - protein, 327 aa, Triticum aestivum
  Clone ID: PAT_TA_17728.pep
MERRRRGSCFCLLAVTAAVVVAAASGGEAKLSPDHYRRTCPRVESIVRSAVARKVRATFVTVPATLRLFFHDCFVQGCDASVMIASSSNDAEKDAPDNQSLAGDGFDTVVRAKAAVEKACPGVVSCADILALAARDVVSMSSGPSWKVELGRLDGLVSKAGDVTGRLPGPDMQPDAITALFDGNGLAVRDMVALSGAHTVGFSHCERFAGRLYRRGAVDPSLSPSYARQLMAACPPDVDPTIAVDMDPVTPTVFDNKYYANLAAGLGLFASDQALHDGAASRPAVEGFAGNQTLFFEAFKEAMVKLGRVGVKSGGDGEIRRDCTAFN

SEQ ID NO: 123311 - protein, 188 aa, Triticum aestivum
  unsure (1)..(188): unsure at all Xaa locations
  Clone ID: PAT_TA_17729.pep
MDSPLPFLVAISSLLLLLAGLYMTRLGLLGKRRRSYPPVAGTMLQQLLNWGRLPEYMTELSRRYRTFSMLTLTRSSVHTVDPANVEYILRTNFANYGKGTMTHDTMEDLLGDGIFNVDGAKWRHQRKVASFEFSTRMLRDYSSGVFRDLAAQLAGIVAAAAAAGERXAYLRSTLDSIFTVGFGVNLGS

SEQ ID NO: 123312 - protein, 362 aa, Triticum aestivum
  unsure (1)..(362): unsure at all Xaa locations
  Clone ID: PAT_TA_17730.pep
MARPRLRLLLLVAAVLLLLHPALSSAAEGLEDPLIEQVVGGDAENELELNAEAHFATFVRRFGKSYRDADEHAHRLSLFXDSLRQSRHHHPLGLRPRLHGIPKFCRSFLKGISGSAHDAPALPTDGLPTEFDWREHGAVGPVKDQGSCGSCWSFSTSGALEGANYLATGKLEVLSEQQLVDCDHECDPSEPRACDAGCNGGLMTTAFSYLAKAGGLETEKDYPYTGRNSACKFDKSKIAAQVKNFSTVAIDEDQIAANLVKHGPLAIGINAVFMQTYIGGVSCPYICGRHLDHGVLLVGYGSAGYAPLRFKEKPYWIIKNSWGENWGESGYYKICRGPHVKNKCGVDSMVSTVTAIHTSKKE

SEQ ID NO: 123313 - protein, 94 aa, Triticum aestivum
  Clone ID: PAT_TA_17731.pep
MAPAAKKQKKKWSKGKVKDKAQHAVVLDKTTSEKLYKDVQSYRLVTIATLVDRMKINGSLARQCLADLEEKGIIKPVVTHSKMKIYTRAVGGTD

SEQ ID NO: 123314 - protein, 94 aa, Triticum aestivum; identical to SEQ ID NO: 123313
  Clone ID: PAT_TA_17732.pep

SEQ ID NO: 123315 - protein, 197 aa, Triticum aestivum
  Clone ID: PAT_TA_17733.pep
MSRMTPAMNVASVVGIQLDKVISEVKPHEKKKFISELQKEHKLVAMVGDGINDAAALALADVGIAMGGGVGAASDVSSVVLMGNRLSQLVDALELSKETMRTVKQNLWWAFLYNIVGLPVAAGALLPVTGTMLTPSIAGALMGFSSVSVMANSLLLRARMSSRHHVQSRQKPHNTISGVSDGADEVEQSYPSKWRST

SEQ ID NO: 123316 - protein, 212 aa, Triticum aestivum
  Clone ID: PAT_TA_17734.pep
MATSALATLSATAAAAGARRVLLSRGPSSLSFASRRLASAGPLRAGPLPRAATRALSATASPAATTTIAVGDRLPDATLSYFDAPDGELKTVTVRDLTAGKKVVLFAVPGAFTPTCTQKHLPGFVARAGELRAKGVDTVACVSVNDAFVMRAWKESLGVGDEVLLLSDGNGELTRAMGVELDLSDKPVGLGVRSRRYALLADDGVRLHQQQR

SEQ ID NO: 123317 - protein, 93 aa, Triticum aestivum
  Clone ID: PAT_TA_17735.pep
PRSTHRSSRSLPRDLPISPSRSLVARRPRLCSRSLGAQDHSLSIPPARCLGLCGGRATSIAESCPYKPAPLPNLHISARPRGSSQPASIPVLI

SEQ ID NO: 123318 - protein, 205 aa, Triticum aestivum
  Clone ID: PAT_TA_17736.pep
MDSVTVSTAAKPTLRVAAFCGSLRKDSWHRGLIRAAEELCEESIPGLRIDHVDISGLPMANPDLETDGGEGFPPAVEALRDRVRAADCFLFASPEYNYSVTASLKNALDWASRGNNCWADRAAAIVCAGGDFGGARASLHLRQVGIFLDLHFINKPELHIRAFAEPPKFDGEGNLIDAVTRERLKKVLLSLQAFALRLQHNNKDD

SEQ ID NO: 123319 - protein, 525 aa, Triticum aestivum
  unsure (1)..(525): unsure at all Xaa locations
  Clone ID: PAT_TA_17737.pep
EKGQVLRVAYAKSRXGPASVASQSNSLAAAAIEAASFAQQYDAVGWAPKXYNAEDNVDGNSESQKDVSAPQSGFVWDEKSGYYFDSSSGFYYDGNTGLYYDSNVGVWYSYDQKTQQYLPCNESNNNKATGDMANESQSNGGKKVVISAPAATVKQSEETSLPEAVQAAANAALAAEKKEKEKAKEIKLASKTNLLANKKKMNNVLAMWKQRNKEGQAAHVALDDKEPSRSVVDKLNNSPSAIGFSLKAKPKSDFGNSKDMNLVAGYNSLGRETGGSQILDSDIKPRPVSNSLGTTVMGVIRGSGRGAVNTFHASSDAGGSISSDITASTSGLMTNTETHTASTPFKTDLSSLGSYASPAVSGSAKRRFSEAPGQSQYRDRAAERRSLYGSTSSLPNDGLDTTGEYSSRKGSSEMGSMPFPPGVGERSVGESDNTENYEVITADRAIDENNVGNRILRNMGWQEGLGLGKDGSGIKEPVQAKPGDVRAGLGSQQKRAADPSLEARAGDSYKTIIQKKAIARFREMS

SEQ ID NO: 123320 - protein, 116 aa, Triticum aestivum
  Clone ID: PAT_TA_17738.pep
FSHGSAAPRSSARASATSSSRRSGVSKGISQRAAFQQHSTVLQEVYNVIRHGVLHVEHVISPWWDVVTELMIFFLNYKSVYSKLIITHLHAKNLFMSWIIGKVMINCLWRNFYGTP

SEQ ID NO: 123321 - protein, 177 aa, Triticum aestivum
  Clone ID: PAT_TA_17739.pep
KLHSGSDSSGQRRRDAGTGASGAGAVAGGGCGGEGAGAAAGGAAAAEVPLSCQDLLNLTDYLVSVPSLRLAFTVCSFADLRQDIFQELNKIRCARHCHIGRAAGARGDHAVRRHSAARQASTRSPPQEHQGSRTRALCGQGARPTPGSSAGASQGSPPGEHQGSVRASLQRAASQLH

SEQ ID NO: 123322 - protein, 670 aa, Triticum aestivum
  unsure (1)..(670): unsure at all Xaa locations
  Clone ID: PAT_TA_17740.pep
MEKKKRKSSTLKISKDEKNTLKDSEKTEASAEEGKVSSNKGRHTHVSPVSKQNKSKAQESSPAHADFGKEAMDTVDMTENAITQQSDSASKSKSRRKLGILKALAPESKPAEGADDSCDNVSYPVNNVTELKDKLSHCLSSXSLRRWCMSEWFYSAIDYPWFAKSEFVEYLNHVKLGHVPRLTRVEWGVIRSSLGKPRRLSKQFLQEEREKLSQYRESVRQHYAELQSGVREGLPTDLARPLAVGQRVIACHPKTRELHDGSVLTVDRSRCRVQFDRPELGVEFVMDIDCMPLHPLENFPESLRRQNIVNKYYSSFSEVKFEDRSKEYGGGGAPRFIANGDAFDSIAQAKTTANEATVAAHQAMYGQPCTPSQIQEREADIRALAELSRALAHAVALLVELRHMNEEVSGKQKDGEIIRDLEHFRKQYAMVLVQLRDSNDHVASALLCLRQRNTFHGQPTQSYPNKSTENGGAFNRTPDPSSNLFGYINQESGSQVMEIIETSRSKAKTMVDVAVQAMCKVSEGENAFAKIGEALDNLNLRGTGSGSSILGIRRIPPDSGQANSDNSASGRFDPAAATNNISSPRVLPNGSDSEAQFPSELISSCVATILMIQNCTEKQYHPAEVAHILDSALSRLQPCSSQNVPIFREIEMCMGIIKNQMLALIPTPSG

SEQ ID NO: 123323 - protein, 65 aa, Triticum aestivum
  unsure (1)..(65): unsure at all Xaa locations
  Clone ID: PAT_TA_17741.pep
MFSGTQQKCKVCTKTVYPXSYSSFEGVPYCKPHFAQLFKETGSYNKSFQSQSPAKSATEKLTPEL

SEQ ID NO: 123324 - protein, 165 aa, Triticum aestivum
  unsure (1)..(165): unsure at all Xaa locations
  Clone ID: PAT_TA_17742.pep
MFSGTQQKCKVCTKTVYPMDQLSTDGAVFHRACFKCHHCKSTLSFSSYSSFEGVPYCKPHFAQLFKETGSYNKSFQSQSPAKSATEKLTPELTRSPSKAAGMFSGTQDKCATCGKTAYPLEKVTVEEKSYHKSCFKCSHGGCALSPSNYAXLEGILYCKHPFSQL

SEQ ID NO: 123325 - protein, 200 aa, Triticum aestivum
  unsure (1)..(200): unsure at all Xaa locations
  Clone ID: PAT_TA_17743.pep
CKVCTKTVYPMAXRLSTDRAVFHRACFKCHHXARSTLSFSSYSSFXGVPYCKPHFAQLFXKETGSYNKSFQSQSPREIXTEKLTPEXPDRQSKAAGMFSGTQDKCATCGKTAYPLEKVTVEEKSYHKSCFKCSHGXGCALSPSNYAALEGILYCKHHFSQLFKEKGSYNHLIKCASVKRAAEAQTAQAAAQTAPAAAESS

SEQ ID NO: 123326 - protein, 99 aa, Triticum aestivum
  Clone ID: PAT_TA_17744.pep
TPDLFDNGYYRALVNSQGVFTSDMALIKDRTTAPIVRQFAQSKDAFFAQFAKSMAKLATAPRPGGNVGEIRRSCFSPNARRAIDTVVDAGEEEGFAASA

SEQ ID NO: 123327 - protein, 317 aa, Triticum aestivum
  unsure (1)..(317): unsure at all Xaa locations
  Clone ID: PAT_TA_17745.pep
MAMASSSGGASALVLAFVTVAVLLSPALSAPLDGAGFHSATCPQLESIVLSSVQAALQREVALAAGXGPNTTLQPRALQLVEDIRAKVHAACGATVSCADISALATRDAVVLSCGPNYTVPQGQFDSLAPASANVVDSLPSPRTXSVSTLARAFXASRGLGDVADLVALSGAHTIGRSQCGSFSDRSQRADDTFSRKLAANCSKHPGRLQNLDVITPDLFDNAYYKALGFNQGVFTSDMALVKNKTTAAIVKRFAESKDAFFGQFARSMEKLARVPKPAGNVGEIRRFSCFRSNAQRADAAVDAAGEEEEEGFSASA

SEQ ID NO: 123328 - protein, 164 aa, Triticum aestivum
  Clone ID: PAT_TA_17746.pep
MTPTACREEATSPLNSSSSFTSAPQMASSSLVVLAAMATVAALLLSPATSLPVFTGDASPGFHAASCPQLDGIVWSSVEAALRQEVAVAAGLLRLYFHDCFPQGCDAFFGQFARSMEKLARVPKPAGNVGEIRRFSCFRSNAQRADAAVDAAGEEEEEGFSASA

SEQ ID NO: 123329 - protein, 341 aa, Triticum aestivum
  Clone ID: PAT_TA_17747.pep
MAMASSSGGAGALVLAFVTVAVLLSPALSAPLDGAGFHSATCPQLESIVLSSVQAALQREVALAAGLLRIFFHDCFPQGCDASVYLKGSGTEQAMGPNTTLQPRALQLVEDIRAKVHAACGATVSCADISALATRDAVVLSGGPNYTVPQGQFDSLAPASQNAVNALPSPATASVSALARAFSAKGLRDLADLVALSGAHTVGRTGCPFFRDRAQRMDDAFSRRLAANCSAPSPRPQNLDVVTPDLFDNGYYKALVNSQGVFTSDMALIKDRTTAPIVRQFAQSKDAFFAQFAKSMAKLATAPRPGGNVGEIRRSCFSRNARRAIDTVVDAGDEEGFTASA

SEQ ID NO: 123330 - protein, 378 aa, Triticum aestivum
  unsure (1)..(378): unsure at all Xaa locations
  Clone ID: PAT_TA_17748.pep
SARAPPSPLQLASPQTRASLQAPKKWRAAQQSWPSWSPRPRCSPRPSPCPSSPADASPDFHAAXSCAQLDXIVWSSVEAALRQEVAVAAGMLRLYFHDCFPQGCDASILLNXGRPRDRARAPTSPSRPRAMHAHRRPSRARAHRLSARDAVVSCADITXLATRRPSSSSPGGPWFNVPQGNLDSLAPAAQAKVFDLPAPDTASVATLVESFGTRGLGDVADLVALSGAHTIRRAQCGSFDDRSQRADDTFSREPAANGQQAPRTGLPTVXVVTPPDLLDRVTSRPPVPTQGVFTSDMALGKERTHAALRAQFAQTQDALLRRPAQARGQPRIAPRAGRHPGPLGRPSVRRNDRPGRDPVRVRGRAEGFAGGAGRPSAG

SEQ ID NO: 123331 - protein, 124 aa, Triticum aestivum
  Clone ID: PAT_TA_17749.pep
EFTVEVYFDPAESEICPRNRRIIARRRRTPEEDEYMRGFNPWAPNVLPLESDPDAEKVDLKHQTAEDRKNAEEWMIDYALRRAVNNLGPARKKKVELLVQAFETVLPQDEKKSISPTRPAQACN

SEQ ID NO: 123332 - protein, 150 aa, Triticum aestivum
  Clone ID: PAT_TA_17750.pep
RLQKVVVKLDVNDDRHKAKALKAVSGLHGIDQLGVDMKEQKMTIVGTVDPVAVVAKLRKLFPGAQIFSVGPAKEEKKDDKKDGGGHKKAGGDKKDGDKKDGGDKKDRDEKDGGDKKPAVPVCPPYWYPMPPQPRYIVHSAEEDPNSCVIC

SEQ ID NO: 123333 - protein, 147 aa, Triticum aestivum
  unsure (1)..(147): unsure at all Xaa locations
  Clone ID: PAT_TA_17751.pep
MKKVVLKLDVHDDRHKAKALKAVSGLHGIDQLGVDIKDQKMTIVGTVDPVAVVGKLRKLFPAVQILSVGPGKEEKKDDKKDGGGDKKEGDKKDGDKKDGAXKKQQEAKPAMSVYPPYGYAHYGYPPPPPPRYVVHSAEEDPNSCVIC

SEQ ID NO: 123334 - protein, 153 aa, Triticum aestivum
  unsure (1)..(153): unsure at all Xaa locations
  Clone ID: PAT_TA_17752.pep
MKKVVLKLDVHDDRHKAKALKAVSGLHGIDQLGVDMKDQKMTIVGTVDPVAVVGKLRKLFPGVQILSVGPAKEEKKDDKKRRRPRRRQERXDKKEGGDKKDGDKKDGGDKKQQEAKPPMSVYPPYSYAHYGYPPPPRYFVRSAEEDPNSCVIC

SEQ ID NO: 123335 - protein, 259 aa, Triticum aestivum
  Clone ID: PAT_TA_17753.pep
GPLLPRPPCCYSRRRYVPLRCSCCHREPSFRFSYDHRGAVGARGLGYYAQDPIRSSESDCFSFVLHLLLLVCLTHQIIKCLIKYSTAEYSVHTVILNVLMQHLMQLAALAVLAMVTGGRGATASKAAGGSRAAEYLTAAARIAVAVLVFDAYRYAWHRLAHINRFIYRHLHSWHHRIVVPYAFGAIYGHPIEVLIADTAGASLAVLVTGLSPSSPRATAVFLTLCTVKAIDNHCGVCLLPRRLQSVLDGAAYHGVPTCR

SEQ ID NO: 123336 - protein, 174 aa, Triticum aestivum
  unsure (1)..(174): unsure at all Xaa locations
  Clone ID: PAT_TA_17754.pep
MASQVILVRICSMHRQPPRACSAGPAGEVLFHWQATIMGPPPFPYAKGVFLVNIHFPPTYPFMAPIXSFKTXVFHPNINSNGSICLDILKEQWSPALTISKVLLSICSLLTDPIRPNPLVPAPAHMYISDRPKYVTPTHIRITLNEMIWSFRQYWREVCLIPAPVNRSSRSCIT

SEQ ID NO: 123337 - protein, 200 aa, Triticum aestivum
  Clone ID: PAT_TA_17755.pep
MHAAATAPALAPPVLLPLFLPTGAGSSARPRRAARAAVRCELAASSAAPAAAPGSVAGPRWAQRTVVIPPQRRGCHIITHKIMHAIRSDLSEFKCGLAHLFLHHTSASLTLNENYDPDVQTDTETFLSRIVPEGPSAPWRHTIEGSDDMPAHIKSSMFGCALTIPITDGRLNMGTWQGIWLCEHRDYATPRTIVITLSGI

SEQ ID NO: 123338 - protein, 262 aa, Triticum aestivum
  unsure (1)..(262): unsure at all Xaa locations
  Clone ID: PAT_TA_17756.pep
WYSVPDWPLPDTDLXCEAGMASSSKWRSYIDALPRQPYSLLYWTRTEIGIXLVISXSRPRSISRIGDVIGTYNDLRDRIFSKYPDLFPEKVYNMENFRWSFGILFSRLVRLESMDGKVALVPWADMLNHSPEVDAFLDYDKSSQGIVFTTDRSYQPGEQVFISYGKKSXGELLLSYGFCNQKEGKQIQMDSSLKFLGVSLNKXDECYXEKLQALKKHGLSRXESFPXRVTGGPVELMAYASLXVSPPEMINPWGNGVRHQQG

SEQ ID NO: 123339 - protein, 374 aa, Triticum aestivum
  Clone ID: PAT_TA_17757.pep
CIDCSLCCFCAAPRPVALRAAATGGLRPAPAPLSGGGTCLAPGRPARGARCGWHPLRCGSQCPDVAPVSPAGPCGLQERLQEVDTGRSAAGFTPPHHLPKLRPEDLYHILGGGAVVAGLVMMSEGEKNDDKDGQTSEIIHDLKEKLSEVTERAENPAAETKRLLEDVANVREANKQHRFEVWMDTIRSIHEKELARLEAGSDKKDDGSGNDNKGNKSGKKDNECDKKGNESDKSGGKSDKKDEKPLAKKLLELLMAPSTVETWYKDITSNWAKWSYLFGMVPVFYALKMADYAKILKGDLSGIDPRVEVVESRACPCGIPWPQRCSRCGGGLPNFVGDSGLVSFPGIPGVKGETFTATTPTPVPRATSPRPPQP

SEQ ID NO: 123340 - protein, 263 aa, Triticum aestivum
  unsure (1)..(263): unsure at all Xaa locations
  Clone ID: PAT_TA_17758.pep
EPCTMVVRTKQWVLPDFYXAWGVDISNFYLTRFGELLIHKPAEGFLLSLLATILTPLKLMLSKFAESYYSITMKKHDMVPDHSFFEGIVGCWVELAPKDHYKNLEEGSILIKKSKTFSFCKEGVFVEGESTLVESDIVIFGTGFNGDQNIKXMFTSNYFQSILIGSTSMTVSLHRDCVHPKIPQLAVIGYSESYANLHTSELRAKWLAHFMDGGFRLPSVKAMHRDVLEWEKFMKRYFLCGTIAGLCSGRRLCPSDYIDLHPK

SEQ ID NO: 123341 - protein, 305 aa, Triticum aestivum
  unsure (1)..(305): unsure at all Xaa locations
  Clone ID: PAT_TA_17759.pep
MRKMFWRSHQVSATHISKVLSVDTSNIGVFICVKCSGVHRSVGTHISKVMSVTLDKWSDDEIDSMXEVGGNSQANAIYEAFLPEGYRKPHPDSAQEERQKFIKSKYELQEFLEPSLRIVSNHPSDAGKQASNSHSASSKSEIGMVEFIGILNVKVIGGTKLAIRDMSSSDPYVVLTLGQQKAQTSVIKGNLNPVWNEELKLSVPQKYGPLKLQVLDHDMVSKDDLMGEAEIDLQPMINAAASFGDPELLGDIQIGRWLKSGDNALTADSAVMVTGGKVKQEVTLKLQHTESGEVTVEMEWMALNI

SEQ ID NO: 123342 - protein, 72 aa, Triticum aestivum
  Clone ID: PAT_TA_17760.pep
EDRQVVQIGLLVHNGSYLKPTDISLFFLSLRVSANVHIFVIKSPHFWCLGIFIRCVDQTVRVTTHTPHVLLP

SEQ ID NO: 123343 - protein, 459 aa, Triticum aestivum
  Clone ID: PAT_TA_17761.pep
IVVSLLFYLAGLVLLTLSAAISPFRPSSCQGLSCPPASRTQFSVFFAALYLTSIGTGGVKSALLPFGAEQYDDSSPEESRRKQSFFTWFFGAINLGIFVAGTLVSWLQQNVSWALGFGVSALCLLLAAAGFLAGTPWYRVQLPAGSPLRDILRVVVASVKKRKTRLPAAAGQGDLGLHEVAEDDDLQKLAHTKGLRCLDKAAAKGGDGHEGPWNLCTVSEVEAVKILARMVPIWVTCVLYAASLGQMTTTFIQQGMTMDNKLLGKVKVPVASMVSIEVVFMLLWVLLHDAVIMPLARRWGRAGSAGLSQLQRMGVGRVLVVLAMATAALVESRRLRVAGAGRKMGIAWQVPQFVLVAGSDVFCGIAQLEFFYGEAPASMRSICSAFSFLALSLGFYVNSVVVTAVAALRPGWLTRDLNEGHLDYYFWLWAVISAGNLLLYLLLAARYTPKQVLRHSPSP

SEQ ID NO: 123344 - protein, 162 aa, Triticum aestivum
  unsure (1)..(162): unsure at all Xaa locations
  Clone ID: PAT_TA_17762.pep
ARGTVEKSRESHRGSTCRPARDDHQYAPASRFSSRSNNNGHHFSAAALSDPRPYSXRNGRARTRSRATPLSCKHNQSTIVQVASRTSRRSTLAYISSAFFAMFLVAEHAEARTSRQENKRKVMEKLEKVREEALRSKEKKEDTSKESVANLLMPPTLVDAYI

SEQ ID NO: 123345 - protein, 126 aa, Triticum aestivum
  Clone ID: PAT_TA_17763.pep
AGSRGPPPGRTREGGNHHSREEESSQASRGEGRHGCARGDAEDEGCFHPCSARGGWREPAADVSASAGAGVGVGGDDAHAAALVGGLRSFRRRWQAVVAVQRIAQADVGGHRPGRIDSARCLINYE

SEQ ID NO: 123346 - protein, 226 aa, Triticum aestivum
  Clone ID: PAT_TA_17764.pep
TTYAVTQSRVQYKPTNISSISSSSLQYKHSSHDIHHGPINLYTADRCLLFGLARPRRAAAPGPELEPPKMAQRMQPDTLGDGGSTSGATSLVRNTWGSRSSSFFWPCCSFFFCCCCFLSSPPRRSIIPTPPVLRERRISGWASSVPPSPAAFASAPSVRNRSSHTRPDEPDLLKVEDDLCNPSMCMYLSASPLRTTDKLTYLQATEKRTQEARMRRMCLLRGWSFY

SEQ ID NO: 123347 - protein, 183 aa, Triticum aestivum
  unsure (1)..(183): unsure at all Xaa locations
  Clone ID: PAT_TA_17765.pep
MEMPCEQPAVKLIGWLSPYVHRAEVALRLXGVPYDLLHDDMASKSDLLLTHNPVHKKVPVLLHGHRSIPESLVIVEYVDEAFPAGPPLLPSDPLARANARFWARFLDDKCWKALWVALWAEPGEARAAAAREANEGLALLEAQLPVWKRFFGGDAIGLLDMAASGVARWLGVFEEMAGVRLLT

SEQ ID NO: 123348 - protein, 142 aa, Triticum aestivum
  Clone ID: PAT_TA_17766.pep
VPYLVSHCGSLLIKDSCRGVVTEATTLSAQLTMMQRDSGGLATQNNELKIRLQAMEQQAQLRDALNEALTGEVQRLKLATGEITDARMSKAGLQQQMNSQLIQMQQLQIQQQQQQQSSQTQQAQQQQQQQQQQQQQQSQQSA

SEQ ID NO: 123349 - protein, 490 aa, Triticum aestivum
  Clone ID: PAT_TA_17767.pep
MVASARMLLVAAVVGFLATTACQAAQRNYATALTKSLLYFEAQRSGRLPPTQRVQWRGNSALKDGADHGVDLTGGYYDSGDNVKFGFPMAFTATMLSWSVVEHRGRLAAAGELGHALEAVRWGADYLAKAHARPDVLYVNVGDGDSDHACWERPEDMDTPRRSYLVNATHPGSDVAAETAAALAAASVAFTGPRGDSRYASTLLKHAKQVLQSASYIPARFQTRTPAAGSACTARGVHDRLLSAPVGRPIATGRHGYEAYIAGANNVGGVRHSFSWDDKFVGAQALVAKLILQGKLPNNGRHAEMRSNVESFLCNVLQHGDGRSGRLTPGGMLYLQPWSNLQDVTTAMFVLVTHADHLAAARASLQCGGVRLPPAQLVSFARSQVDYILGKNPMKMSYMVGVGKRYPLQPHHRGASLPSIRKYPGKISCGKGAEYFHRSAPNLNVIDGAIVGGPDNNDHYDDSRGNYQQGEPSTYTVAPIVGVLARLLHN

SEQ ID NO: 123350 - protein, 113 aa, Triticum aestivum
  Clone ID: PAT_TA_17768.pep
MGCAGSTPKVDESSKNLRKPKPWKHTQPITPAQLKQMRDEFWDTAPHYGGQKEIWDALRAATDADLTLAQTIVDSAGIIVSNPDLTLCYDERGAKYELPNYVLSEPTNLIRDG

SEQ ID NO: 123351 - protein, 121 aa, Triticum aestivum
  Clone ID: PAT_TA_17769.pep
GPFFFFFLVWRCILCKGAISWTLETPTESTSDEISRGVQAMLPAIAQSMTGPRISRRNIPSADSQRNQRNEQVFFFFFFFCLRVLEDVRLLLESTLRLDGQLGRHLELSFSGRYRRRDGVS

SEQ ID NO: 123352 - protein, 136 aa, Triticum aestivum
  Clone ID: PAT_TA_17770.pep
MATELTVQSERAFQKQPHIFQNSKTKTKSTRPGKGGRRWYKDVGLGFRTPKTAIEGSYIDKKCPFTGLVSIRGRILTGTVVSTKMHRTIIIRREYLHFIQKYSRYEKRHKNVAAVRSPALRVLPRTGKSVKKFSKF

SEQ ID NO: 123353 - protein, 178 aa, Triticum aestivum
  Clone ID: PAT_TA_17771.pep
MTEPLSKVDSAVQGLSSSPPKEEKKTRRQSSAAAPGVYNINDLEAEGIELELAPETQKTGWKINKSSSTVEDAAILKLHLTKPPVKRIALHFPLGLEVQARNLKGVTIKDALDAIHKAYKKRSDDELDKPYLAGFEWDKEESWTQLIVHTQAQPTATTLDGPSGGGGGKKKKNKKNEE

SEQ ID NO: 123354 - protein, 161 aa, Triticum aestivum
  Clone ID: PAT_TA_17772.pep
MATELTVQSERAFQKQPHIFQNSKTKTKSTRPGKGGRRWYKDVGLGFRTPKTAIEGSYIDKKCPFTGLVSIRGRILTGTVVSTKMHRTIIIRREYLHFIQKYSRYEKRHKNVAAHVSPAFRVQEGDQVTVGQCRPLSKTVRFNVLRVLPRTGKSVKKFSKF

SEQ ID NO: 123355 - protein, 140 aa, Triticum aestivum
  Clone ID: PAT_TA_17773.pep
LARRRDSPARHPELQGGESSEGAERCRMSCGGHTAWPHSRQLRAPIHRPMSRAEAAKGPSAAVCRATATPHVATHGNYAHACTGRRRGVSFSCPRTAATTPEFFQHAPPMVRPVEPHMHRREALLDPLHGLALRRRRPSP

SEQ ID NO: 123356 - protein, 158 aa, Triticum aestivum
  Clone ID: PAT_TA_17774.pep
SLLPSSPFSPSSSPRRAPPAAATHPTRRRCSAAPPQVPRPILTAFATPSPPSPAHPQRTRTPDPTSAPSVARRRHPVDLLRRACRRIHTRELTSPSSLPMPASCSWAISSLYSVWSCSLLPNESLLPSEAVCGWLREKQAISRSWRGSERALTLLKPD

SEQ ID NO: 123357 - protein, 134 aa, Triticum aestivum
  Clone ID: PAT_TA_17775.pep
GAPGTPTVRRDEHGIGAEESGPLAGGKGLGGTRERAGRGHAGWAARGEHDGDAQAEQVGPAMAGMYPANTQARWGDEDAQTAPPAPAYRPPISEVVQQLVRLMQRASMLRRQSGDDLGSSYRAPEREGGAWDAV

SEQ ID NO: 123358 - protein, 61 aa, Triticum aestivum
  Clone ID: PAT_TA_17776.pep
IPWRHGCRTSKRSPADLAAINQQKESSKLPKLTHTPSYQPISWPGCLGQPRRSSDGPSARP

SEQ ID NO: 123359 - protein, 373 aa, Triticum aestivum
  unsure (1)..(373): unsure at all Xaa locations
  Clone ID: PAT_TA_17777.pep
MAVHDEPLHILFFPFLASGHLIPIADMAALFAGRGVRCTILTTPVNAAIIRSAVKRANDAFAGTGCPAIDIAVVPFPDVGLPPGVENGTALSSQDDRDKFFHAATLLREPFDRFLADHRTDAVVSDSFFHWSVDAAAERGVPRIAFLGSSMFARSCSDSMLRHNPLENAPDDPDAFVALPGLPHRIELRRSQMMDPAKKAVASGSSSTAVNAADQRSFGEVFNSFLDRSVVNFRVWVIGAAAXAKDSAEWMPEGFADLIAHGDRGFLIRGWAPQMLILSHAALGGFVTHCGWNSVLEAVSAGVPMVTWPRYAGPVXNEELVVELLKVGVKHPGPKDYASRXSEAHXVXPGEVXAXSIQXADGKRRIQEEGKDG

SEQ ID NO: 123360 - protein, 216 aa, Triticum aestivum
  Clone ID: PAT_TA_17778.pep
MVSLQSALLPEASKRPPCLSFADASVVASTATSKKRKRDGEVEEEDEEHDGIELNFDAAPLPLEWQRCLDIKSGQIHYYNTRTHKRTSKDPRRHGGAAPAVEEDVANCGPQGLDLDLNLAFEPRHSSPVKELQKKAEAKPAAAGGDRHGDQAPGSASGGMEMVAAVCMRCHMLVMMCRACPACPNCKFLHPTSRPTPPPPEPAPLKLGLQLLCCRD

SEQ ID NO: 123361 - protein, 180 aa, Triticum aestivum
  Clone ID: PAT_TA_17779.pep
MEGWFGLCFIALCTPLALWLLKLAGSKYKPQKHHQLPPGPWTLPIIGSLHHVASALPHRRMMDMSRRHGPLMHLMLGEVPTVIVSSAEAAALVMRTNDPAFADRPQSVTSDIFGCSGKNIGFAPYGDHWRQMRKVCIVELLSSRQVKRIESIRAEEVGNLLRSIAALDGATVNVSEKMME

SEQ ID NO: 123362 - protein, 268 aa, Triticum aestivum
  unsure (1)..(268): unsure at all Xaa locations
  Clone ID: PAT_TA_17780.pep
ADDRASPSTQQPSARRPTVVLLLWLALAFCLAVLFIQSSFTSPSAPHARTLDSPDQPSAEASRLDLDSDQVRELSGFQSRVQQCVASRGLGLTADIVDHCKLVLKFPEGTNSTWYNAQFKFFEKLQYEXQYRRLTTCGDREYLDVRPDGWLDYAPKRIAQLGAKKCYNRTLCEELLSILLPARPPFHPRQFATCAVVGNSGDLLKTEFGQEIDAHDAVFRDNEAPVNKKYAKYVGLKRDFRLVVRGAARNMAPILKGSCNALILISSN

SEQ ID NO: 123363 - protein, 106 aa, Triticum aestivum
  unsure (1)..(106): unsure at all Xaa locations
  Clone ID: PAT_TA_17781.pep
MGIGYVIGILGGALLAHAAYATIQYRAVLKMPEEEFSGPPVDVMMQLLLGLALCMWAGVSVPXKFLSVLPHSEENRIVSLPANLDFMIFNHRGRALPSDADLKLKI

SEQ ID NO: 123364 - protein, 159 aa, Triticum aestivum
  Clone ID: PAT_TA_17782.pep
MLARPPPMSSRRVAVIGAGAAGLVAARELRREGHVPVVLERAAAIGGTWRYDAGVDAHSSVYASLRVNSSRECMGFLDFPFVAGTEGDPRRFPGHGEVLRYLEAFALRFDLHELVRLQTEVVSVRRRVHNAGVAGWSVSYCSTKLAGVGNEVEEEVFDS

SEQ ID NO: 123365 - protein, 142 aa, Triticum aestivum
  Clone ID: PAT_TA_17783.pep
MASPFRLMRPISQVARSGVVSFAARPFSSTAARFAVQDIKTTKEFKDLVSATDKAVLVDCFATWCGPCKAISPILSKLSEQPALSDNIEFVKFDVDELPDLTAELGVRAMPTFFVFKGGKKVDELVGANPQALQSMLAKHAS

SEQ ID NO: 123366 - protein, 159 aa, Triticum aestivum
  Clone ID: PAT_TA_17784.pep
HPPLPAPSHQGAQPAHRKYTYAAASPGGCKVKWTAEEKPHGAGLSSGRRSSPPPNDVSFDHKWKLEPKSKPGAASKAKTKLEEASEDDKNKPAMKCTHIEEVLAGCDAIRKDDDYLMVIPYSHIFCPHVASSKAAPAIYHHKTCLDSKSPVTITLNSSL

SEQ ID NO: 123367 - protein, 205 aa, Triticum aestivum
  Clone ID: PAT_TA_17785.pep
PAGFRYQPTLAVDMGGMQERITTTQKGSITSVQAVYVPADDLTDPAPATTFAHLDATTVLSRGISELGIYPAVDPLDSKSRMLDPRVVGQEHYDTATRVQQILQEYKSLQDIIAILGMDELSEADKLTVERARKIQRFLSQPFTVAQVFTGIEGKLVDLKETINSFKAILSGEGDNLPEGAFYMVGDFASAKAKGEKILAELEGQ

SEQ ID NO: 123368 - protein, 82 aa, Triticum aestivum
  Clone ID: PAT_TA_17786.pep
WRSWCHAGEDDDHGAPKMEIKRSKMILAISCHFLIACDVYHVYASYLLRTTVVNKMIPHNNFKKVFPLTVHHCKSSLFRSTT

SEQ ID NO: 123369 - protein, 190 aa, Triticum aestivum
  Clone ID: PAT_TA_17787.pep
MDKLINAAKEYLDDDKDKRQDQSQQSHGQQQGYGGGQQQQGYGQQQGYGQEGGYGQQQGGQYGQQQQYPPPGGIQAQGAGAFGGFHGGDVDFNNAKEEAHQKAGSSGDKDLFGSILGALGQKKNKLADEDLDEEDAIKQHKNTYDNDEPQQDSKSLGTAAAMQALKMFTQGQSQSSAGGNSQTAFLGLAL

SEQ ID NO: 123370 - protein, 122 aa, Triticum aestivum
  Clone ID: PAT_TA_17788.pep
MVSRAIVPTLLVLLLAICCTTTVVHGKEWTVGDNKGWSFGVSGWESGKHIQSGDVLVFKYNPSMHNVVQVGEGDYNSCRVSGPSRTYTSGNDHIQLAREGKTFFICSHPGHCQQGMKIAVTA

SEQ ID NO: 123371 - protein, 118 aa, Triticum aestivum
  Clone ID: PAT_TA_17789.pep
MARATMVPTPFWCLLDVCSATTVVHGKEWTVGDNKGWSFGVSGWESGKHIQSGDVLVCSNNTRLYTVVRVGEGDYNSCRVSGPSRTYTSGTDHIHTLPRQAKASPYLQPSPGHCHAKA

SEQ ID NO: 123372 - protein, 345 aa, Triticum aestivum
  Clone ID: PAT_TA_17790.pep
MAETLVGLRLGASAVPHPRGIRRRRGVRPAHHRLPQLRRGRLCARAAVTGAPEVDEDEAMSIDNLCSFFDLNVGKWNGVFYQFDAHGRVQQEISTRLSASTYGEGDLISLMQSLYIKQASSGITFADEEDPEPEWAEYKIKETNMFTVDKYQQIGFFPEQKAFALRYQTAGMLETVLRAGVLGEDDTGEESPRNLKIPSRKPSIVCENCIYSLDGNGRVRAFHIMDPNGVLDTLIDFHENQGSIVRLTHSSTDDPEKASNDRINALAGTWDPSVTIAAGCMQQRSINKLAQDARSISLADVLRVPPFPGAFCCLPYPAYRRWYLCRLQSALTPPPCSRSGPPTPP

SEQ ID NO: 123373 - protein, 134 aa, Triticum aestivum
  Clone ID: PAT_TA_17791.pep
MAGEKRMFGFEEVAKHNVAKDCWLVIAGKVYDVTPFMDEHPGGDEVLLAVTGKDATSDFEDIGHSDSAREMMEKYHIGEIDASTIPAKRTFVPPQQGSHVQAKDSDLLIKILQFLVPILILGLAFGIRHYSKSE

SEQ ID NO: 123374 - protein, 134 aa, Triticum aestivum
  Clone ID: PAT_TA_17792.pep
MAGEKKMFGFEEVAKHNVAKDCWLVIAGKVYDVTPFMDEHPGGDEVLLAVTGKDATSDFEDIGHSDSAREMMEKYHIGEIDASTIPAKRTFVPPQQGSHVQAKDSDLLIKILQFLVPILILGLAFGIRHYSKSE

SEQ ID NO: 123375 - protein, 264 aa, Triticum aestivum
  Clone ID: PAT_TA_17793.pep
MELLSTDQICNGDGNLDMIRERYSSENALQQLEDRKFSVSSGSQLSSSQNLLKQKHHSDKTSPSNITSDCYSDRNCQFSPSGSFAQRNLMVQKQVADLQPGQLINDEGQLGQQTLTRRASYPCENYEVEKKGFGKRSKDTLGTSVVVDGSFVSSLSSDNSVEESSFRQLQDAVSQLDVKTKLCIRDGLYRLARSAQNRPVFPNAMNRHEESRDVKDAQNMETSGKFVDHRSIETQTNPIDRSIALLLFHQPSDQVAGAVDNPRH

SEQ ID NO: 123376 - protein, 154 aa, Triticum aestivum
  Clone ID: PAT_TA_17794.pep
MAAHKRLHDGFEQDPDQPEKKRMERSVSFSTVIREAMVMKQVQSVFLVLEPLLRRVVQEEIQAGLVRSPRYIERSSPETPPAAERLALRLAFLNPPMLPIFTGSKIEDVNGEPLQVILVDADTGSPRGALPQFMRVELVPLFGDFPPDSREEWT

SEQ ID NO: 123377 - protein, 239 aa, Triticum aestivum
  Clone ID: PAT_TA_17795.pep
MKLNISYPANGSQKLIDIEDERKVRVFMDKRMGAEVPGDSVGDEFKGYIFRITGGNDKQGFPMKQGVMHPTRVRLLLSEGHSCYRPRRTGERKRKSVRGCIVAMDLSVLALSIVKQGDADIPGLTDVVHPKRLGPKRATKIRKFFGLTKDDDVRKYVIRREVQPKGEGKSPYTKAPRIQRLVTPQRLQHKRHRAALKRRQAEKVKDEANEYAQVLAKRIAEAKVNKADARKRRASSMRK

SEQ ID NO: 123378 - protein, 100 aa, Triticum aestivum
  Clone ID: PAT_TA_17796.pep
CQVRSVARDDDAAPAPGLRRADDEQQHDDEGGHHQRQQVEPRLVLLLAAAHLPHTRLPPSFTDGGWRDEEFLGLAWRTRRKKGRSVLSFRWAHAWADAFA

SEQ ID NO: 123379 - protein, 100 aa, Triticum aestivum
  Clone ID: PAT_TA_17797.pep
ITRVINNNKTDLQQENDFSFTVRSNSAEIEIILPPNTHQSENSDTNQTNAYHSTSHLPACSAADRGSHHPATMRSGQVSSTGRRRSACAGAAASRRRRAA

SEQ ID NO: 123380 - protein, 173 aa, Triticum aestivum
  Clone ID: PAT_TA_17798.pep
QPLACLERRRSRSRLPPPHHHHDATSVARDDDAAPAPGLRRADDEQQHDDEGGHHQRQQVEPRLLLLLAAAHLPHGRSPARFSHRQSSFLAWRNKETGRGTREGVLPSWRGGRAGETRSFLAWLGGRGGRREEVVLSWGSGLPAASILKTSLPLIRVPVGRSAFCEWWMCTGG

SEQ ID NO: 123381 - protein, 219 aa, Triticum aestivum
  Clone ID: PAT_TA_17799.pep
LGPFEEIIHFIYKDMFFNKTDPPRLLDIVVTADKFEVIGAIKHCKTLMLQSPLTLEIALLYLEFTSEKVELNEILGPVHTACADFVANTYKDLLSHEEAVLQLRLSAMISIFKSSALILPNEDYAFTFLLKWLEKEYSDKEERKDVFQRIVVSLIRFTHLSEEALLDFTSCNLVSSPVDAINIVSNAMHFKATSSRRIAYWRYEQRDYLVRPVSLSYLM

SEQ ID NO: 123382 - protein, 224 aa, Triticum aestivum
  Clone ID: PAT_TA_17800.pep
MRPSLFKPLLPRHTWFSAAGTSSSLPQLSNTIRSVRFFSATSAVMGNKVFFDISWEGPVFQNGKPTSEVKKQTGRINFNLFDDVVPKTAENFRALCTGEKGFGYEGSSFHRIIPDFMLQGGDFTRGNGTGGKSIYGEKFADENFTLKHDKPGLLSMANAGPNTNGSQFFVTTVVTSWLNGRHVVFGEVADEESLNVVKALEATGSGSGAIKYTQKPKIEKSGEL

SEQ ID NO: 123383 - protein, 341 aa, Triticum aestivum
  Clone ID: PAT_TA_17801.pep
MAAGDVATVFLEMSLGTRLAVSFPAASTTVADLKRRVSHEHAACFPNYGQIAVQSVKVEQGGSWFHLADSMAVRDAFQFHGANETWHLQVDALPHPQHLDQGMATEGHSKDSSAAHSEPSCEMLADQVKVEVGADSEPSCEMLTDQVKVEVGAEEPLAAKGERSSNGADPKGSKEAEATSTEQGACERKRLRPRTRAGKTPVTKAANSSGSSESEEMDINTVGVDAPPSQFVVMLKECHFVTKNGQYLNVPREFGVAHRYAERKKVLLRMGGESWTVNLKHVHNVRGKARTSFRYGWHQFCVDNHLRVGETCFFRALGQGGGGDRHVLKVEVRRLDGSYAS

SEQ ID NO: 123384 - protein, 97 aa, Triticum aestivum
  Clone ID: PAT_TA_17802.pep
WHKRLGHPALPVVTKILRDFNLPVSNKQDHLLVCDACQMAKSHQLPYSRSTSESAAPLELIFSDVWGPGPVSVGRQKYYVSFIDDSSKFSWIYLLKK

SEQ ID NO: 123385 - protein, 289 aa, Triticum aestivum
  Clone ID: PAT_TA_17803.pep
SIPQYQIRRRTRGRERGMAGAADAGVCGVCFNHCKYESKGSGFSMLAWEEFKNAGVVPCNERDRFNNATREKVTFVANQRAYTVKCYKGRRKSAMYGRGWRKFYEDNNLGKGQMVVFYLDEPLPTASILWFQVGNGSKPLKIQISGNEDGEASSDDSEGIVCTRGLLLNETEDAQLQGLLPLSDGFIGFAFVHRLTRTDIRLGMMKIPKKVAAATPFEEQGVVGISVDGRRFKKISYKTADDGRIVFGSKKWEDFAASRGLKVNTAVLIGFKSSERDDVHVLVILKKLG

SEQ ID NO: 123386 - protein, 81 aa, Triticum aestivum
  Clone ID: PAT_TA_17804.pep
MADIAMLVADEAFEKRLQRGAPFAGAGEEASKGRENFGAVTKVWGSWASGVKVRVALLVKADVAEPKAPVAMAAFDGLFSA

SEQ ID NO: 123387 - protein, 148 aa, Triticum aestivum
  Clone ID: PAT_TA_17805.pep
IKQMKKPCKGCPSGPGCPRGSAATSALDAAARQRTFTPPPAAAASAAPGPEVHPPAARLLVGAGDARPSLQPLLARLLRHQHRYVRLRPATEHAAAPKWQLKPNILIAMCCIGNLESKNISTQLETVALESGIWMLFALDVWIWAGHL

SEQ ID NO: 123388 - protein, 219 aa, Triticum aestivum
  unsure (1)..(219): unsure at all Xaa locations
  Clone ID: PAT_TA_17806.pep
EKASSRMCHSDGKTSCNQGQEDTSLAIPGHVAQLNSGEVMESAKAIKNKLMALPPGDGSIYRDDDELLPQWFSEAMSGPMLSSGMCTEVFQFDISPTTIVPVYSSGMHNASHNSTENLTSSQSDKVKNRRILHSMAVPLKGSTSNHTDHLKAHPKNESFAGNKPASSAVVSVLADPRVDADGRISSKSLARIFGVVLXDSVKYVTYSCVLTFKXHSPHL

SEQ ID NO: 123389 - protein, 297 aa, Triticum aestivum
  unsure (1)..(297): unsure at all Xaa locations
  Clone ID: PAT_TA_17807.pep
MSPVKVFGHPMLTNVARVLLFLEEVGAEYELVPVDFVAGEHKRPQHVQLNPFAKMPGFQDGESLHISTHIKSRAIAKYILRKYGGTAGLDLLGENSGIEELAMVDVWTEVEAQQYYPAISPVVFECIIIPFIIPGGGAAPNQTVVDESLERLRGVLGIYEARLEKSRYLAGDSISFADLNHIPFTFYFMTTPYAKVFDDYPKVKAWWEMLMERPAVQRVCKHMPTEFKLGAXTRCLCTPRGCVPCRXAGDDSIQEKRPPVCGWVIICPSSSIEYTLSVSAAREESACASVRALDSLL

SEQ ID NO: 123390 - protein, 291 aa, Triticum aestivum
  unsure (1)..(291): unsure at all Xaa locations
  Clone ID: PAT_TA_17808.pep
MSPVKVFGHPMLTNVARVLLFLEEVGAEYELVPVDFVAGEHKRPQHVQLNPFAKMPGFQDGESLHIKSRAIAKYILRKYGGTAGLDLLGENSGIEELAMVDVWTEVEAQQYYPAISPVVFECIIIPFIIPGGGAAPNQTVVDESLERLRGVLGIYEARLEKSRYLAGDSISFADLNHIPFTFYFMTTPYAKVFDDYPKVKAWWEMLMERPAVQRVCKHMPTEFKLGAXTRCXSPRECVPCRAGDDSIQEKRPPXGWVIICPSSSXSCIRFQFQQHEESACASVRASLDSLL

SEQ ID NO: 123391 - protein, 296 aa, Triticum aestivum
  unsure (1)..(296): unsure at all Xaa locations
  Clone ID: PAT_TA_17809.pep
MSPVKVFGHPMLTNVARVLLFLEEVGAEYELVPMDFVAGEHKRPQHVQLNPFAKMPGFQDGESRXFESRAIAKYILRKYGGTGRPGPPRGENSGIEELAMVDVWTEVEAQQYYPAISPVVFECIIIPFIIPGGGAAPNQTVVDESLERLRGVLGIYEARLEKSRYLAGDSISFADLNHIPFTFYFMTTPYAKVFDDYPKVKAWWEMLMARPAVQRVCKHMPTEFKLGAXTRCLCTPRGCVPCRAVPXGDDSVQEKRPPSRGWVIICPSTSSSIRFQFQQHXQESACASVRALDSLL

SEQ ID NO: 123392 - protein, 124 aa, Triticum aestivum
  Clone ID: PAT_TA_17810.pep
QLTALCQKIGGVTIMRKGKADVISDGKKVTQVSTFGSPRRCGGQGDILSGSVAVFSSWARHFLLSNKQPKETSVNPMVLGCIAGSLLLRKAAALAFEKNKRSTVTTDIIEFLGQSLEDICPAGW

SEQ ID NO: 123393 - protein, 264 aa, Triticum aestivum
  unsure (1)..(264): unsure at all Xaa locations
  Clone ID: PAT_TA_17811.pep
SRRPPHLIQSSPPPISPGNLRSKQSQGSLVLLLKMQIFVKTLTGKTITLEVESSDTIDNVKAKIQDKEGIPPDQQRLIFAGKQLEDGRTLADYNIQXKESTLHLVLRLRGGMQIFVKTLTGKTITLEVESSDTIDNVKAKIQDKEGIPPDQQRLIFAGKQLEDGRTLADYNIQKESTLHLVLRLRGGMQIFIKTLTGKTITLEVESSDTIDNVKAKIQDKEGIPPDQQRLIFAGKQLEDGRTLADYNIQKESTLHLVLRLRGGQ

SEQ ID NO: 123394 - protein, 259 aa, Triticum aestivum
  unsure (1)..(259): unsure at all Xaa locations
  Clone ID: PAT_TA_17812.pep
MSSSSSSSAVFNLDHLAPSPTEQLCYVHCNCCDTILAVGVPCSSLFKTVTVRCGHCANLLSVNLRALLLPPTAPPANQLQFGHSLLSPTSPHGLLDEVAFQTPSLLMDQASTNLSGFTGRSNSKLRQQPAGDADXLPPSLRSRKPSSRQRAPHRRTGVRTSSSCQLRRKRQRVPSAYNRFIKDEIQRIKAGNPDITHREAFSAAAKNWAHFPHIHFGLMPDQGFKRTFKAQDGAEDMLRKDGLYAAAAAAAANMSVTPL

SEQ ID NO: 123395 - protein, 342 aa, Triticum aestivum
  unsure (1)..(342): unsure at all Xaa locations
  Clone ID: PAT_TA_17813.pep
MAVIKVRVSKLREAKSVEDSRHKSASREPKEGQSSNPKRANGEAPVEPQQREVCAFCDDGGELICCDGGCLRSFHPTKEHGERSMCTSLGLNEAKWQKHKALXKKGLYFCENCKHKQHQCFACGLLGSSNLTAGPEVFQCKEQKCGHFYHPGCVAKILYPDNKAKATCFEQCVAGGLEFSCPVHKCKRCKEAENKHDKEMQFAVCRRCPTVYHRKCLPRDISLIEDEEEATPQRAWDGILPDQILIYCRKHEIQEELGTPXGDHIVFPDVRNPGAAERHRGASQGHDIPDEDELLDRLASCNPSQSPEPAETGRGRVKPIDSFAPKHLFPHPQPGSCGWLDD

SEQ ID NO: 123396 - protein, 226 aa, Triticum aestivum
  Clone ID: PAT_TA_17814.pep
MASLSPSLHLPCNSRIGFLGKSQGILLRVIPAGRVGFIRKTVECKESRIGKKPIEVPSNVTLTLEEQFVKAKGPLGELTLNYPAEVKVVKEETGKLRVFKTVETKRANQMHGLFRTLTDNIIVGVSKGFDKRLQLVGVGYRATVEGKDLVMNLGFSHPVRMAVPEGLQVKVEENTRIIVSGYDKSEIGQFAATIKKWRPPEPYKGKGIRYQDEIVRRKEGKAGKKK

SEQ ID NO: 123397 - protein, 182 aa, Triticum aestivum
  unsure (1)..(182): unsure at all Xaa locations
  Clone ID: PAT_TA_17815.pep
MAAAADHQHGHIDKEKEKELLSSVVGDIRCYSGSDPLRPWLRGIRRLEXALPPATLREKLPRFLQKCAEEFQDEPRYRDDPRYLRVWIQMMDYVKDAKPLLKKLERNRIGLKRAAFYMAYAIYYEKRRRFQEAEQMYRVGIQNLAEPIEELHKSHDQFIYRMELYQKRKDKEGMPSRVKPLP

SEQ ID NO: 123398 - protein, 134 aa, Triticum aestivum
  Clone ID: PAT_TA_17816.pep
RQQQNLQKFRDDNNSCRNFEQRSQRRKSTPCKNDNTTPVKDSAKNRKTKKQVRSRIQLSEDDVVAIFFSFDEAGKGYIAPWDLEKMANINDFIWTDFELSKMIHCFDSDKDGKISLEEFRTIVSRCNMLQEPEE

SEQ ID NO: 123399 - protein, 140 aa, Triticum aestivum
  Clone ID: PAT_TA_17817.pep
MASSSVLLGGGAGAAAFTGAAAGKALPRPCFLAARPHTASGGRLCLQTPPRATPANDAVETVRGAAGEAGDKVSEGADSVTKAASDAAGKVQEAVEGAVEGAKDLGEKAKQATEEAWDATKDAAQGVADDVTAAVEDVSK

SEQ ID NO: 123400 - protein, 140 aa, Triticum aestivum
  Clone ID: PAT_TA_17818.pep
MASSSVLLGGGAGAAAFTGAAAGKALPRPCFLAARPHTVSGGRLCLQTPPRATPANDAVENVKGAAGEAGDKVSEGADSVSKAAGDAAGKVQEAVEGAVEGAKDLGEKAKQATEEAWDATKDAAQGAADNVTAAVEDVSK

SEQ ID NO: 123401 - protein, 196 aa, Triticum aestivum
  Clone ID: PAT_TA_17819.pep
PGDVSHLLMGSGFHRLLDQFSRLEAAAPRPPASKAAVESMPSVTVAGGGGAHCAVCQEAFEPGAAAREMPCKHVYHQDCILPWLSLRNSCPICRSELPAAAVPEAEADAGLTIWRLPRGGFAVGRFAGGPREQLPVVYTELDGGFSNGVGPRRVTWPEGEGQVDGGEGRIRRVFRNLFGCFGRGGRPESSSQSRSG

SEQ ID NO: 123402 - protein, 129 aa, Triticum aestivum
  Clone ID: PAT_TA_17820.pep
MKRNQEEARGHLLAGTASRHDAADAEAPAPITKGCATFWVGAEEEGEAPRRFAVPVALLWHPLILELLGEARDKYGYAHEGAIVVPCGIERFQKAVDAARAQERHRHHHHHHFSLPHLAGCFRPSHAVA

SEQ ID NO: 123403 - protein, 143 aa, Triticum aestivum
  unsure (1)..(143): unsure at all Xaa locations
  Clone ID: PAT_TA_17821.pep
PRPRLAPIERVTPADAADTLLLLATGXGISPIRSLIEFGFAAKQRADVRLYYGARNLETMAYQERFAEWESSGLKIVPVLSRPDDGXWKGERGYVQRAFLEAKNIANPTSTGAVLCGQSQMIEEVTSALTADGVSQDKILKNF

SEQ ID NO: 123404 - protein, 102 aa, Triticum aestivum
  Clone ID: PAT_TA_17822.pep
RMQNLCSKQKESAFGCYTLILRTWQHGLEGRANLPDDPENNAPYKLILFGLHLMLMASRTDVSSLKLAPQSNGLHCLVHHYFSPRMLLQVLTSLSHSEEKTS

SEQ ID NO: 123405 - protein, 164 aa, Triticum aestivum
  Clone ID: PAT_TA_17823.pep
MSKGAIIGASTVLVVAVVAAVCVVSSREAKNEEDSTELTASVKSIKSFCQPVDYKAACEQTLGETAGNATTTTELAKAIFKATSERIEKAVEESSLLNELKHDPRTSGALKNCKEMLHYAIDDLRTTFDQLGGFEMTNFKHAMDDLKTWLTSALTYQETCLDGF

SEQ ID NO: 123406 - protein, 108 aa, Triticum aestivum
  Clone ID: PAT_TA_17824.pep
MEGDDKWKLSKKGRSRSGRNYYYGDASGSGASTSGGLSRSYSASVTATRDGSAGASGSGSSSSEQQKKEEAESRRRLSKKCVEAVKEHRARFYIVRRCVSMLVCWRDY

SEQ ID NO: 123407 - protein, 34 aa, Triticum aestivum
  Clone ID: PAT_TA_17825.pep
MEVNILAFIATALFILVPTSFLLIIYVKTVSQNN

SEQ ID NO: 123408 - protein, 155 aa, Triticum aestivum
  Clone ID: PAT_TA_17826.pep
MVRAPCCEKLGLKRGPWTAKEDMTLVAHIEKHGHSNWRALPKQAGLLRCGKSCRLRWINYLRPDIKRGNFTSEEEEAIIQLHAMLGNRWSTIAARLPGRTDNEIKNVWHTHLKKRLESSSKPSGQAAPKRKAKKPAVAGSAIEGPTSEPASSSPG

SEQ ID NO: 123409 - protein, 146 aa, Triticum aestivum
  Clone ID: PAT_TA_17827.pep
QAAGRTDNEIKNVWHTHLKKRLESSSKPSGQAALKRNAKKPVAVASTADGPASVPVLSPEQPISSSATDSSMPSSLENTDSFTSEEFQIEDSFWSETLAMTVDSSDSAMEAGVTPNSASPSSSNDEMDFWVRLFMQAGEVQSLSQI

SEQ ID NO: 123410 - protein, 260 aa, Triticum aestivum
  unsure (1)..(260): unsure at all Xaa locations
  Clone ID: PAT_TA_17828.pep
MGRTPCCEKMGRKKGPWTAEEDVTLLAHNIEQHGHSNWRALPKQAGLLRCGKSCRLRWINYLRPDIKRGNFTARRGKTPSSNLHAMLGNRXWSTIAARLPGRTDNEIKNVWHTHLKKRLESSSKPSGQAAPKRKAKKPAVAAALRAXPEGPTSEPAASSPGQSLSMSPGQSLSTSSAADYSMPSSLENTGSSSSGSEEFQIEDSFWSETLAMSVDSSGSGMETSDTFGVDSAAPSSSNDEMDFWVTLFMQAGDIQSLSQI

SEQ ID NO: 123411 - protein, 121 aa, Triticum aestivum
  Clone ID: PAT_TA_17829.pep
EDQLHGIALHELERIDVLKNTLRRGDPMAHLVKRKDTDFLLNDLGDDEKMKESGFIVPQNVPAHSWLKRGVDPPPNRYGIKPGRHWDGVDRSNGYEKDMYKLKNDKQATEQEAYLWSVADM

SEQ ID NO: 123412 - protein, 177 aa, Triticum aestivum
  Clone ID: PAT_TA_17830.pep
RPRLSRRRRSSWWSARGSGSGSDGGGRGYEVDGMDSGKYVRYTPEQVEALERVYAECPKPTSTRRQQLLRKCPILSNIEPRQIKVWFQNRRCRDKQRKESSRLQAVNRKLSAMNKLLMEENERLQKQVSQLVHENAYMKQQLQNPSLANDTSCESNVTTPPNPLRDASNPAGLLAIA

SEQ ID NO: 123413 - protein, 237 aa, Triticum aestivum
  Clone ID: PAT_TA_17831.pep
VTVEDKQAKSVLLVKYMNNYLGIGCDAKVALDIHNLREENPDKFYSQFLNKVLYAREGAKSIIDRTFADLPWQVRLEVDGAEIDIPEDSEGVLIANIPSYMGGVDLWQNEEENLDNFDPQSIHDKMLEVVSISGTWHLGTLQVGLSRAWRIAQGQLIKLRFSAPFPVQVDGEPWVQHSCTLKISHHGQAFMLKRAIESSLGHATAIVTDVLENAETSQVITASQKRALLQEMALRLA

SEQ ID NO: 123414 - protein, 337 aa, Triticum aestivum
  unsure (1)..(337): unsure at all Xaa locations
  Clone ID: PAT_TA_17832.pep
GKQCVSARRSNGGKPSRALVLYAAGHAALLAGGGGGKGHLDAFASIASCGFLSVRTPAVNEDGGDRNSDTILELAQLLDVYDALYPAKDGETARVDPQELVVPKLSERFMGLRAAMVTNCPGVSSFAANLGFHVFGTEDFAARSGSGSSSKDARIIDRAFALLGFAEWNVQDASEFDLVFVHAAMENTASKLGKLGMKTDLNRLDKLVASVMEAAPVGSAVAARIHVSVILSYGSATENKEEACLIVDSSTETDSDLKLLRPRQXSYTMKAGKTLDDVRNHHPMLLAQWQQGVTRSDLAKEFSFEEFIKRAGNFAMLAERFLHEVAFKLWKAPKYGA

SEQ ID NO: 123415 - protein, 179 aa, Triticum aestivum
  Clone ID: PAT_TA_17833.pep
MATMVALSSFAGAAVVGRSASWSPAVPRRRALLVRAQTEPDVEPTKETMTSASTSSPSPTPSPSPTPVAPKPKAKANPSVWDALAFSGPAPERINGRLAMVGFVAALSVEAARGGGLLDQVGSGAGLGWFLTTAAVFSVASLVPLLQGQSVESKSSGVWTADAELWNGRFAMLGLVALA

SEQ ID NO: 123416 - protein, 166 aa, Triticum aestivum
  unsure (1)..(166): unsure at all Xaa locations
  Clone ID: PAT_TA_17834.pep
HGTPPKETTSASDXPHPHRTSPAPTPIPDSXPKPMTKEGQPLRSGHAAGPSRGPAPGAHQAAGLGDGWDSVAALSVVGRRAGGWAPSTTAGERRWGWAGFLAXTAGVFSVXASLVPLLQGXSVGRPIPAGLWSPDXAELWNGPFAMLGLVALAATEFSTGAPFFNI

SEQ ID NO: 123417 - protein, 549 aa, Triticum aestivum
  Clone ID: PAT_TA_17835.pep
LILSCRYLIRRRLLLTGTPSQNSLQELWSLLNFILPNIFNSSGNFEEWFNAPFACDVSINDEEELLIIHRLHQVLRPFLLRRKKDEVEKYLPSKTQVILKCDFSAWQKAYYEQVASKGKVALGSGLKPKAVANLSMQLRKCCNHPYLFVEQYNMYQRGHVVRASGKFELLDRLLPKLHRAGHRVLLFSQMTRLLNILEVYLQMYNFKYMRLDGSTKTEERGKLLADFNKKDSEYFIFLLSTRAGGLGLNLQTADTVIIFDSDWNPQMDQQAEDRAHRIGQKNEVRVFVLVSVGSIEEEILDRAKQKMGIDAKVIQAGLFNNTSTAQDRKALLQEILKRGTSTLGTDIPSEREINRLAARTEEEFWLFEKMDEERRRRENYKSRLMQGPEVPEWVFDISETLAEKLLAEEAKNPVINTKRRRKEVVYSDSYVDQWMKSDEVYEDIPKMTPRAKRSAYLSDIQEVDLHDRAKRLKYSDSADGAGNSTWTPEKGRAGVSSYSKDENEDDNDEDEVTAGGLQQGGSFTWNTLRRKRSSHSTNPSSDPKGRSAF

SEQ ID NO: 123418 - protein, 167 aa, Triticum aestivum
  Clone ID: PAT_TA_17836.pep
DSARGWTLTATRGISSGGGEPEEEGPAVSLRPLGLADVDDFMAWASDERVMRHLKRPLCATREQAVAQIRDTVLGHPWFRAVCVAGRPVGQVSVWPYPDDGGHRANLGYALAHRHWGRGIASAAIRMVVGRVFEELPGLGRLEAVTDVGNARSQRALEKAGFQREGV

SEQ ID NO: 123419 - protein, 189 aa, Triticum aestivum
  Clone ID: PAT_TA_17837.pep
RKRGLGTTTRRQPAHRSQIGSRPARSRSPAGDHTAEAAPPPARTPSDQPSLRVEPTTATAVASLSRRHHPRPRTERGHHAAPRALDAPDLQSSAPPTRASLTHILVRSLASQKGRPGRALLPEHPPKQPARASQPRTEEEKGPAAAEPHGLCPATATGGGEWWKRRWVGCSRRRLGLAPEPPAGATGEL

SEQ ID NO: 123420 - protein, 430 aa, Triticum aestivum
  unsure (1)..(430): unsure at all Xaa locations
  Clone ID: PAT_TA_17838.pep
MDATTAKQLRRLRTLGRGASGAVVWLASDDASGQLLAVKSAGAGAADTLRREGSVMAGLCSPHIVPCLGSRAAPGGEYQLFLEFAPRGSLADEAARSGGSLAERAIQGYAADVARGLAYLHGNSLVHGDVKARNVMVGADGRAKLADFGCARAADSDRTIGGTPAFMAPEVARGEEQGLAADVWALGCTVIEMATGHAPWSDMDDVFAAVHRIGYTDAVPEXPASLSPQAKDFLRKCLARNPRHRSTAAQLLEHPFLASAFHDVDAEPAKQDWIMSPKSTLNADFWESDEESETEDMLTSAAERIGSLASPCSALPDWESDDGWIVVHGGRPEASETTTPTAIAGTDFGPWSEEGLEAEVDVHFAGADAGRWYDLVRNVDGAHYFGWYERDLGVSVVTDRPLCLIVSHGRKIVKFGCHCDRERTMHFGFA

SEQ ID NO: 123421 - protein, 151 aa, Triticum aestivum
  Clone ID: PAT_TA_17839.pep
ITLDRQFFTCIKSCLKTDPTNQITTTTEKKKSTRPDGYPIRQYYMKQLVDWSEGTKHTSGEMRWMDRSALDGLDLVPRLLAEVADDPDALEHRHLHLHGPLLHLPLEPSHPFSLLFSSWSERIPVGCGSLEETKKKTTAIGDLPGWVAKMS

SEQ ID NO: 123422 - protein, 112 aa, Triticum aestivum
  Clone ID: PAT_TA_17840.pep
IQASSFKIPCTRVSKVLQIQASAVVVVQACDDKHGSLVAWRHEAFCRNLDVRHLLLPDRHSHQRSAGAMAGVAAAHHHQAHQQRHDLQERHQATSSQAANSDGRTCLLLASR

SEQ ID NO: 123423 - protein, 225 aa, Triticum aestivum
  unsure (1)..(225): unsure at all Xaa locations
  Clone ID: PAT_TA_17841.pep
SQLLIDPDLSEAHTLRQWFDGGGRDASTQSISRDHTPAASRNEVRMTVAKIKDDGLXXMGDKPDWVTVKASIIFFKSDNFCYTACPTKEGDRQCNKKVTKGTSGLWVCDKCDKEFPECDYRYLLQLQIQDHSGTTWVTAFQETAQELLGCSALELVTYKENGDPRFAETMLSCLFMDYLLRLKVKEETYSDERRVKNTLVKVERFDPAAESRYLLDLLSRSVASY

SEQ ID NO: 123424 - protein, 273 aa, Triticum aestivum
  unsure (1)..(273): unsure at all Xaa locations
  Clone ID: PAT_TA_17842.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKXESTLHLGAASFEGGMQIFWEPPLXGKNHYTLEXGSPSDTIDNXQGENSRTRGGISPD

SEQ ID NO: 123425 - protein, 410 aa, Triticum aestivum
  unsure (1)..(410): unsure at all Xaa locations
  Clone ID: PAT_TA_17843.pep
MQARICMDPSLYCRMILIVKVGDLSNCSGKXESFVLDVVRGKTYLLRIVNTALFSEYYFKVAGHTFTVVGADGYYLTPYKTDMVTVAPGEAIDVLMAADAQPAHYHMVALANQPPEPDPQIPGFVSRGLVRYAGSTHNNNGLPVPTPLMPSQHNTMPSYYFHSNLTGLAHPDRHRVPMHVDERLFFTLGLGSICRGTNKTCERGRSPETIVVATMNNVSFRHPTNASLLERYYDGRTSGLYTEDLPDHPPHPYNYTDRSLIPPGPLEKALEPTFKATKLRRFRYNTSVEIIFQSTALLQSDSNPMHLHGYDFFVLATGLGNYNPKTDPKKFNYHNPQLRNTVHVPRTGWAAVRFVTDNPGMWYLHCHFEFHIIMGMATAFIVENGPTSETSLPPPPPEFKRCGANGLTQP

SEQ ID NO: 123426 - protein, 169 aa, Triticum aestivum
  unsure (1)..(169): unsure at all Xaa locations
  Clone ID: PAT_TA_17844.pep
VLQFIIAMFVMDTWQXYFMHRYMHINKFLYKHIHSKHHTLVVPYSFGALYNHPLXGLILDTIGGALSFLLSGMTPRTSIFFFSFATIKTVDDHCGLWLPGNILHALFNNNTAYHDIHHQLYGNKYNFSQPFFVLWDKILGTYMPYSLENRKGGGFESRPVKSVEQTKAD

SEQ ID NO: 123427 - protein, 113 aa, Triticum aestivum
  unsure (1)..(113): unsure at all Xaa locations
  Clone ID: PAT_TA_17845.pep
PTRPQKVASAITWQSPKDXSTYLKXKVVNFGSKAMDLNITVTGLESGIKSSGSNKTVLTSAAALDENSFEQPEKVAPVSSPVADAKQQMGVSVSPYSLTSFDLLLGPSKHSII

SEQ ID NO: 123428 - protein, 171 aa, Triticum aestivum
  Clone ID: PAT_TA_17846.pep
PNFDEHQRTTTSYKMHRVLNLHIFSYSRQFYVHKPNLYAIPKAEQSKSLIASFLHQVPKSRIQSTILMLLCSILLTMNTRRLKRGKDHTLLHVEAALALDIHEEGVGGLHEALLLVLELLELRRRVEEVDVVLQHLLRSIPNRDNRQIRSQEMRKSRIKRTSKHSDKNRRG

SEQ ID NO: 123429 - protein, 165 aa, Triticum aestivum
  Clone ID: PAT_TA_17847.pep
VKPSPESKEKEGFVEKLPGKHDNVQENVSDSPSKSLGLAGRPVAGVKKVKKIVIKKIVRRIVGKDVVFVATRRIVRPPKKGSAVQRPRTRTLTAVHDGILEDVVYPAEIVGKRVRYRLDGAKVIKIYLDPKERNNTEYKLETFSAVYRRLCGKDVVFEYPVTETA

SEQ ID NO: 123430 - protein, 176 aa, Triticum aestivum
  unsure (1)..(176): unsure at all Xaa locations
  Clone ID: PAT_TA_17848.pep
KDKGVEPSEFEDTVAQAFFDLENGNQELKSDLKDLYINTAIQMDVVGNRKAVVIHVPYRLRKPFRKIHVRLVRELEKKFSGKDVVFVATRRIVRPPKKGSAVQRPRTRTLTAVHDGILEDVVYPAEIVGKRVRYRLXDGAKVIKIYLDPKERNNTEYKLETFSAIQRKLCGKRLVL

SEQ ID NO: 123431 - protein, 173 aa, Triticum aestivum
  Clone ID: PAT_TA_17849.pep
MATSPVLFLLLAVLAAGASAATFNIKNNCGSTIWPAGIPVGGGFALGAGQTSSINVPAGTKAGRIWARTGCSFNGGSGSCQTGDCGGQLSCSLSGRPPATLAEYTIGGGSTQDFYDISVIDGFNLAMDFSCSTGDALQCRDPSCPPPQAYQHPDDRATHACNGNSNYQITFCP

SEQ ID NO: 123432 - protein, 42 aa, Triticum aestivum
  Clone ID: PAT_TA_17850.pep
SETIASVNLNSYIPLAKCNFFTFKQLQFLLQEVSGTPRPRPR

SEQ ID NO: 123433 - protein, 71 aa, Triticum aestivum
  unsure (1)..(71): unsure at all Xaa locations
  Clone ID: PAT_TA_17851.pep
MVLQNDIDLLNPPAELEKLKHKKKRLVQSPNSFFMDVKCQGCFNXCQTVLCQPTGGKARLTEGCSFRRKGD

SEQ ID NO: 123434 - protein, 99 aa, Triticum aestivum
  Clone ID: PAT_TA_17852.pep
SNLSVVSVGNRTEQVLQNDIDLLNPPAELEKLKHKKKRLVQSPNSFFMDVKCQGCFNITTVFSHSQTVVVCPGCQTVLCQPTGGKARLTEGCSFRRKGD

SEQ ID NO: 123435 - protein, 86 aa, Triticum aestivum
  Clone ID: PAT_TA_17853.pep
MVLQNDIDLLNPPAELEKLKHKKKRLVQSPNSFFMDVKCQGCFNITTVFSHSQTVVVCPGCQTVLCQPTGGKARLTEGCSFRRKGD

SEQ ID NO: 123436 - protein, 192 aa, Triticum aestivum
  Clone ID: PAT_TA_17854.pep
MYTARKKIQKEKGLEPSEFEDSVAQAFFDLENGNQELKSDLKDLYINNAIQMDVTGSRKAVVIHVPYRLRKAFRKIHVRLVRELEKKFSGKDVVIVATRRIVRPPKKGSAVLRPRTRTLTAVHDGILEDVVYPAEIVGKRVRYRLDGSKIIKIFLDPKERNNTEYKLETCTAVYRRLCGKDVVFEYPMTENA

SEQ ID NO: 123437 - protein, 291 aa, Triticum aestivum
  unsure (1)..(291): unsure at all Xaa locations
  Clone ID: PAT_TA_17855.pep
TRPDSNRRNCSVLQWNPDMSTQLILASDDDNSPSLRVWDVRKTIAPVREFVGHSKGVIGMSWCPYDSSFLLTCAKDNRTICWDTVSGEIISELPTSSNGNFDIHWYRKIPGVVAASSYDGKIGVHNLEFSSLYAAGDSTVGCLSTSKSXAPKWLKCPTGASFGFGGKLVSFHPAQGTQAGTSEVHVHNLVIEQSLVSRSTEFEAAMQNRDKSALRALCDQKSQESLSEEEKETWSFLRVMFEDGDTARTKLLVHLGFNPPQEPTVNATDELSKALADTLNIDHGTCPGGRS

SEQ ID NO: 123438 - protein, 173 aa, Triticum aestivum
  Clone ID: PAT_TA_17856.pep
MATSAVLFLLLAVFAAGASAATFNIKNNCGSTIWPAGIPVGGGFELGAGQTSSINVPAGTKAGRIWARTGCSFNGGSGSCRTGDCGGQLSCSLSGRPPATLAEYTIGGGGTQDFYDISVIDGFNLAMDFSCSTGDALQCRDPSCPPPQAYQHPNDQATHACSGNNNYQITFCP

SEQ ID NO: 123439 - protein, 232 aa, Triticum aestivum
  unsure (1)..(232): unsure at all Xaa locations
  Clone ID: PAT_TA_17857.pep
MALQISKKRKFVADGVFLAELNEMLTRELGEDGFAGVEIRVTPMRTEIIIRATRTQNVLGEKGRRIRELTSVVQKRFNFPDGGVELYAEKVLNRGXLCAVAQAESLRYKLXLGGLAVRRACYGVLRFVMESGAKGCEVIVSGKLRAQRAKSMKFKDGYMISSGHPVNQYIDGAVRHVLLRQGVLGIKVKIMLDWDPKGKQGPSTPLPDLVTIHPPKDEDEFLRPLAAEIAVA

SEQ ID NO: 123440 - protein, 149 aa, Triticum aestivum
  Clone ID: PAT_TA_17858.pep
LYINTAIQMDVVGNRKAVVIHVPYRLRKPFRKIHVRLVRELEKKFSGKDVVFVATRRIVRPPKKGSAVQRPRTRTLTAVHDGILEDVVYPAEIVGKRVRYRLDGAKVIKIYLDPKERNNTEYKLETFSAVYRRLCGKDVVFEYPVTETA

SEQ ID NO: 123441 - protein, 86 aa, Triticum aestivum; identical to SEQ ID NO: 123435
  Clone ID: PAT_TA_17859.pep

SEQ ID NO: 123442 - protein, 86 aa, Triticum aestivum; identical to SEQ ID NO: 123435
  Clone ID: PAT_TA_17860.pep

SEQ ID NO: 123443 - protein, 231 aa, Triticum aestivum
  unsure (1)..(231): unsure at all Xaa locations
  Clone ID: PAT_TA_17861.pep
MALQISKKRKFVADGVFLAELNEMLTRELGEDGFAGVEIRVTPMRTEIIIRATRTQXNVLGEKGRRIRELTSVVQKRFNFPDGGVELYAEKVLNRGLCAVAQAESLRYKLLGGLAVRRACYGVLRFVMESGAKGCEVIVSGKLRAQRAKSMKFKDGYMISSGHPVNQYIDGAVRHVLLRQGVLGIKVKIMLDWDPKGKQGPATPLPDLVTIHPPKDEDEFLRPLAAEIAVA

SEQ ID NO: 123444 - protein, 86 aa, Triticum aestivum; identical to SEQ ID NO: 123435
  Clone ID: PAT_TA_17862.pep

SEQ ID NO: 123445 - protein, 192 aa, Triticum aestivum
  Clone ID: PAT_TA_17863.pep
MYTARKKIQKDKGLEPSEFEDSVAQAFFDLENGSQELKSDVKDLYINAAFQMDVAGNRKAVVIHVPYRLRKNFRKIHVRLVRELEKKFSGKDVVIVATRRIVRPPKKGSAVVRPRTRTLTAVHDGLLEDVVYPAEIVGKRVRYRLDGSKIIKIFLYPKERNNTEYKLDTFTAVYRRLCGKDVVYEYLVAETA

SEQ ID NO: 123446 - protein, 86 aa, Triticum aestivum; identical to SEQ ID NO: 123435
  Clone ID: PAT_TA_17864.pep

SEQ ID NO: 123447 - protein, 230 aa, Triticum aestivum
  Clone ID: PAT_TA_17865.pep
MALQISKKRKFVADGVFLAELNEMLTRELGEDGFAGVEIRVTPMRTEIIIRATRTQNVLGEKGRRIRELTSVVQKRFNFPDGGVELYAEKVLNRGLCAVAQAESLRYKLLGGLAVRRACYGVLRFVMESGAKGCEVIVSGKLRAQRAKSMKFKDGYMISSGHPVNQYIDGAVRHVLLRQGVLGIKVKIMLDWDPKGKQGPATPLPDLVTIHPPKDEDEFLRPLAAEIVVA

SEQ ID NO: 123448 - protein, 175 aa, Triticum aestivum
  unsure (1)..(175): unsure at all Xaa locations
  Clone ID: PAT_TA_17866.pep
MATSPVLFLLLAVFAAGASAATFNIKNNCGFTIWPAGIPVGGGLXLGSGQTSSINVPAXGTQAGRIWARTGCSFNGXVAGSCQTGDCGGXLSCSLSRAGQQATLGRVHHPAAEHQDFYDISVIDGFNLHGLSCSTGDALQCKDPSCPPPQAYQHPNDVATHACSGNNNYQITFCP

SEQ ID NO: 123449 - protein, 86 aa, Triticum aestivum; identical to SEQ ID NO: 123435
  Clone ID: PAT_TA_17867.pep

SEQ ID NO: 123450 - protein, 192 aa, Triticum aestivum
  Clone ID: PAT_TA_17868.pep
MYTARKKIQKDKGLEPSEFEDSVAQAFFDLENGSQELKSDVKDLYINAAFQMDVTGNRKAVVIHVPYRLRKNFRKIHVRLVRELEKKFSGKDVVIVATRRIVRPPKKGSAVVRPRTRTLTAVHDGLLEDVVYPAEIVGKRVRYRLDGSKIIKIFLDPKERNNTEYKLDTFTAVYRRLCGKDVVYEYPVAETA

SEQ ID NO: 123451 - protein, 246 aa, Triticum aestivum
  Clone ID: PAT_TA_17869.pep
MYTARKKIQKDKGLEPSEFEDSVAQAFFDLENGSQELKSDVKDLYINAAFQMDVAGNRKAVVIHVPYRLRKNFRKIHVRLVRELEKKFSGKDVVIVATRRIVRPPKKGSAVVRPRTRTLTAVHDGLLEDVVYPAEIVGKRVRYRLDGSKIIKIFLDPKERNNTEYKLDTFTAVYRRLCGKDVVYEYPVARNCLKIHLNLHIGPLVHVLNLPTACLELVVARIMSSKNQNYSCDAKPKYLLVRDGNE

SEQ ID NO: 123452 - protein, 192 aa, Triticum aestivum
  Clone ID: PAT_TA_17870.pep
MYTARKKIQKDKGVEPSEFEDTVAQAFFDLENGNQELKSDLKDLYINTAIQMDVVGNRKAVVIHVPYRLRKPFRKIHVRLVRELEKKFSGKDVVFVATRRIVRPPKKGSAVQRPRTRTLTAVHDGILEDVVYPAEIVGKRVRYRLDGAKVIKIYLDPKERNNTEYKLETFSAVYRRLCGKDVVFEYPVTETA

SEQ ID NO: 123453 - protein, 173 aa, Triticum aestivum; identical to SEQ ID NO: 123438
  Clone ID: PAT_TA_17871.pep

SEQ ID NO: 123454 - protein, 173 aa, Triticum aestivum
  Clone ID: PAT_TA_17872.pep
MATSPVLFLLLAVFAAGASAATFNIKNNCGFTIWPAGIPVGGGFALGSGQTSSINVPAGTQAGRIWARTGCSFNGGSGSCQTGDCGGQLSCSLSGRPPATLAEYTIGGGSTQDFYDISVIDGFNLAMDFSCSTGDALQCRDPSCPPPQAYQHPNDVATHACSGNNNYQITFCP

SEQ ID NO: 123455 - protein, 86 aa, Triticum aestivum; identical to SEQ ID NO: 123435
  Clone ID: PAT_TA_17873.pep

SEQ ID NO: 123456 - protein, 86 aa, Triticum aestivum; identical to SEQ ID NO: 123435
  Clone ID: PAT_TA_17874.pep

SEQ ID NO: 123457 - protein, 86 aa, Triticum aestivum; identical to SEQ ID NO: 123435
  Clone ID: PAT_TA_17875.pep

SEQ ID NO: 123458 - protein, 86 aa, Triticum aestivum; identical to SEQ ID NO: 123435
  Clone ID: PAT_TA_17876.pep

SEQ ID NO: 123459 - protein, 173 aa, Triticum aestivum
  Clone ID: PAT_TA_17877.pep
MATSAVLFLLLAVFAAGASAATFNIKNNCGSTIWPAGIPVGGGFALGAGQTSSINVPAGTKAGRIWARTGCSFNGGSGSCRTGDCGGQLSCSLSGRPPATLAEYTIGGGSTQDFYDISVIDGFNLAMDFSCSTGDALRCRDPSCPPPQAYQHPNDRATHACNGNSNYQITFCP

SEQ ID NO: 123460 - protein, 192 aa, Triticum aestivum; identical to SEQ ID NO: 123452
  Clone ID: PAT_TA_17878.pep

SEQ ID NO: 123461 - protein, 192 aa, Triticum aestivum; identical to SEQ ID NO: 123452
  Clone ID: PAT_TA_17879.pep

SEQ ID NO: 123462 - protein, 406 aa, Triticum aestivum
  Clone ID: PAT_TA_17880.pep
MSLAGRTGRVPCPPPGGPPAAPFGPRVGATIGAVLPAVVAGPALALFVAHSNLFWAERLGRDHLAGMKDLWVKHCGISHTGSFKDLGMTVLVSQVNRLRRAPLSRPIAGVGCASTGDTSAALSAYCAAAGIPAIVFLPANRISLEQLIQPIANGATVLSLDTDFDGCMRLIREVTAELPIYLANSLNSLRLEGQKTAAIEILQQFDWEVPDWVIVPGGNLGNIYAFYKGFEMCRVLGLVDRLPRLVCAQAANANPLYRYYKSGWTQFQPQVAEPTFASAIQIGDPVSVDRAVVALKATNGIVAEATEEELMNAMSLADRTGMFACPHTGVALAALFKLREEGTIGANDRTVVVSTAHGLKFSQSKIDYHDQKIEDMACKYANPPVSVKADFGAVMDVLKKRLKGKL

SEQ ID NO: 123463 - protein, 233 aa, Triticum aestivum
  Clone ID: PAT_TA_17881.pep
MAATSLGSSPSKTATAKLGGISRSSPSYTQLAFCSRHAFHKIGTAAAPQRPQNELKHARPCATTDNDRAAPAEAQESTTISAGVNPVASGNGQQPQPGEPPKRVPLTARERLRAARVLGKYAEPGGGASPADKKGSSSSKPEFGSRVLDALRETDGGKKGGRKRSGLPEAPSNLLDDTKRGMPKDGWTFDWLAALPVGTDVLIVAASFGIITTVMFGTTYLVWKLGAIHFNEY

SEQ ID NO: 123464 - protein, 160 aa, Triticum aestivum
  Clone ID: PAT_TA_17882.pep
MMGRIIPKRNQMVLGVGALVAGRTPDEVGPVIPPGVAAPPGCGEPPCDRLLHPRRLRGTGPPPEFLLAAGQVELVSPAKASAPVTVQVEDDDPEEPPGFGLSDLQRSNMVVKQEQPCDDGQNHTQVKPNGGELVGAGSLGDADDEDPDVPPGFDAPPGFG

SEQ ID NO: 123465 - protein, 350 aa, Triticum aestivum
  unsure (1)..(350): unsure at all Xaa locations
  Clone ID: PAT_TA_17883.pep
CPIFFKDLSDXGALDKGPMYFRLSKVRDRVPGASPDQDAEEATCCGVLEFTAREGSAQLPPHVWNNLFQSDIPEVPLIEVLYASLPKGTYAKLKPEGVGFSDLPNHRAVLETALRNHATLSENDVVMVNYGQLQYKLKVLELKPASSVSVLETDVEVDIEGPDSVFDNEENQHVLVPLETGKVESGAVEEGKFRYYKFSVEEGVAEKVASGCANIEVKIESDTSGGDTDIYVSRHPLVFPTQHRHEWSSHEMGSKVLILKPKDATLVSGLYSVGVYGFKATAKFQLSVAIKDVIDSHRIGEQGSVSSAGNGDSVVCKNCKRHISSRTSVLHEAYCVRHNVICLHDGCGVV

SEQ ID NO: 123466 - protein, 341 aa, Triticum aestivum
  unsure (1)..(341): unsure at all Xaa locations
  Clone ID: PAT_TA_17884.pep
MDFELRSAREKLEREQRERMQRAKAKADRERRAKAEAARRRDALEASNRERRLDAARAQEEADQKMEEVMQLGKGISFSHMFEALRYDGPGDKIKLPPSSFNGFIRSTERLDKGPMYFTRCPRLGTEQATCCGVLEFTAREGCSRFPAHSENNYFQNDIREVPLIEGLMSRVVYDXVNGDSVVCKNCKRHISSRTSVLHEAYCVRHNVICMHDGCGVVLRKEAAADHVHCSKCGQAFQQREMEKHMKVFHEPLNCPCGVVLEKEEMVKHQSSTCPFRLIVCRFCGDTVQAGGQPLDVRDRLRNMCEHESICGSRTAPCDSCGRSVMLKEMDIHAIAVHQKS

SEQ ID NO: 123467 - protein, 87 aa, Triticum aestivum
  Clone ID: PAT_TA_17885.pep
MASNLQNKSPLTREFRLEFLQSITNNFSDDRIIGKGGFGVVYKGVLDNGEEIALKKLNHTGLDDKEFTNEFNNIIRAHHQNIVQFVG

SEQ ID NO: 123468 - protein, 166 aa, Triticum aestivum
  Clone ID: PAT_TA_17886.pep
GPLEGPAGPGTQTQTPHRRSTHTLTHPSSPMARTKQTARKSTGGKAPRKQLATKAARKSAPATGGVKKPHRFRPGTVALREIRKYQKSTELLIRKLPFQRLVREIAQDFKTDLRFQSSAVSALQEAAEAYLVGLFEDTNLCAIHAKRVTIMPKDIQLARRIRGERA

SEQ ID NO: 123469 - protein, 265 aa, Triticum aestivum
  Clone ID: PAT_TA_17887.pep
TGLSTQALETIHRINMGVPKITPGNDTLGRTWLPDQSFQVNTDLAQHKDAKPLTIKYDEKSALSSAYTAPAEVYATATRLSTAGETSTINVQFNISWRFDAPAGSDYLLRFHWCDIVSKAAMGMAFNVYVGGAVVLDNYEISRDTFNRLSIPVYKDFLLGAKDAKGAITVSIGSSTEDNALPDGFLNGLEIMSIVGSASAGAGAPATSPPSSKVKIGIIAGSAVCGATLVMVLGFIAFRMLRGREPEKKKPADAWSPFSASALGS

SEQ ID NO: 123470 - protein, 195 aa, Triticum aestivum
  Clone ID: PAT_TA_17888.pep
MATAVQWPVMVVVVMMAVMAARVGADMDADRSECAEQLVGLAPCLQYVQGQARSPAPDCCGGLSQVLDKSPKCLCVLVKDKDDPNLGIKINASLALALPSACGNTKANVSHCPQLLHLPPNSKDAAIFSPGGDKGTAAAPAKDNTASTANSRAQQATSAGTASSTATAGVALAALLAGYLALLLPADFLATAASF

SEQ ID NO: 123471 - protein, 127 aa, Triticum aestivum
  Clone ID: PAT_TA_17889.pep
MEDVQEGWEKQVEKKGEEGLRSKVKQMGLKYWDVLCSKDAEWPQGRTFAVVWTCRKQAKELNNCLQSSFTGMNAIARGRYRRRLTMVWAREQGEEQIIFMHGINGKPWFSNACTYTGIWQLLTGYLS

SEQ ID NO: 123472 - protein, 317 aa, Triticum aestivum
  unsure (1)..(317): unsure at all Xaa locations
  Clone ID: PAT_TA_17890.pep
MASDGSGVVTVYGSGNNGAGTQLEPKSSPFSVKVGLAQMLRGGVIMDVVNAEQARIAEEAGACAVMALERVPADIRAQGGVARMSDPGLIREIKRAVTIPVMAKARIGHFVEAQILESIGVDYVDESEVLTLADDAHHINKHNFRVPFVCGXRNLGEALRRIREGARHRSAPRVEAGTGNLIEAVRHVRSVMGDVRALRSMDDDEVFTYAKSIAAPYDLVMQTKQLGRLPVVQFAAGGVATPADAALMMQLGCDGVFVGSGVFKSGDPARRARAIVQAVTHYSDPNVLAEVSCDLGEAMVGINLSDPKVERFAARSE

SEQ ID NO: 123473 - protein, 53 aa, Triticum aestivum
  Clone ID: PAT_TA_17891.pep
MECEPCCICQEEYVEGDDLGTLHCGHDFHAGCIRQWLVVKNLCPICKNTALKT

SEQ ID NO: 123474 - protein, 241 aa, Triticum aestivum
  Clone ID: PAT_TA_17892.pep
MRHLVPELSNWNSDNPGATIPGNVSSVSRANASSTISRPAGSTSLTHQNLHRRHPRNLSEEIGRLSGALRGPQHPRLRSGFLLERQGDGVWGVPFPMRNTREGRRLMEIRNALEMIQRGENVRFESIFYGGVDIHDRHRDMRLDIDNMSYEELLALEERIGNVSTGLTENDVMKLLKQRKFSSWRLSSVEYEPCCICQEEYVDGDDLGTLHCGHDFHASCIRQWLVVKNLCPICKSTALKT

SEQ ID NO: 123475 - protein, 263 aa, Triticum aestivum
  unsure (1)..(263): unsure at all Xaa locations
  Clone ID: PAT_TA_17893.pep
IEAAKXIGIQKLLLLRYLDMQASAWPLGPAIRSCGLLRNRMLVDPAFLFKIGTEIVIDTCCATFAEVQKRGDEFWSEFELYAADMLVGVVVNVALVGMLAPYARFRGGSASAGLLGRVRHAYDALPSSVFEAERPGYSFSIQQRLGSYLLKGLLYGAVGFSCGLVGQGIANLIMTAKRSVKKSENDVPVPPLLKTSALWGVFLGVSSNTRYQVINGLERLVEASPLGKRVPAASLAFTVSVRFANNVYGGMQFVDWARMSGCQ

SEQ ID NO: 123476 - protein, 63 aa, Triticum aestivum
  Clone ID: PAT_TA_17894.pep
LKHWIVGKIEVPSPKEESSCTDSEATRDTENFETSGDDDNDRNHKHPRPLPRSCTYILSQSQH

SEQ ID NO: 123477 - protein, 177 aa, Triticum aestivum
  Clone ID: PAT_TA_17895.pep
MASLADSFLADLDELSDNEAYPEEDNAEAVGMDEDGDDDMPDLESLNYDDLDSVSKLQKTQRYSDIMQKVEGALEKDTYLSNQGFILEEDPEYQLIVDCNALSVDIENELIIIHNFIRDKYRLKFPELESLVHHPIDYARVVKKIANEVDITLVDLEGLLPSAVIMVVSVTASTTSG

SEQ ID NO: 123478 - protein, 260 aa, Triticum aestivum
  unsure (1)..(260): unsure at all Xaa locations
  Clone ID: PAT_TA_17896.pep
MAASLPSLPPPPTPSPAATTLASNLLSFPAPRPRLAATHRRAVVAAASSRPPPPPPPPPSPEGGDEEVERAMGMDGGIPGTSGELLRRVSSRAYGMRRHLMESLDSLXAYDVLETNPWXREQQPKPVYVLARRNNQLWTMKTRRNRSEVERELGMLFSKGGGSGVGTKSKYSGSKFSMVVEDLTEGVLVFEDEDDAAKYCDLLQGGGQGCEGIAELEASSVFNMCRQMKALAVLFRRGRIPPTPQSLERDLRARNRSLED

SEQ ID NO: 123479 - protein, 153 aa, Triticum aestivum
  unsure (1)..(153): unsure at all Xaa locations
  Clone ID: PAT_TA_17897.pep
YSFGVLXLEVISGESSSKSTWGEDMHVLVEWTWKLREEERLLEIVDPDVEEYPEEQVLRFIKVALLCTQATAQQRPSMKQVVHMLANETEIDLQNAVPPGVLKEPRRKMGSLGDLALDTSSSQSTRANVAGSCTTQTRDMNSCNFSTTEILPR

SEQ ID NO: 123480 - protein, 133 aa, Triticum aestivum
  Clone ID: PAT_TA_17898.pep
LNASRLRTHLRLVRRLGRDSVGGGRTCGLQIWQEVRVIDSDRPGGYSWSTRPTSVRSDSGRRPDMRVATLAGGRSRRKQPRSEIDLGKTSMTVSDRQVYIHDSYHHLNRYSELAGIDPVLVDPSYGPLAGTKL

SEQ ID NO: 123481 - protein, 159 aa, Triticum aestivum
  Clone ID: PAT_TA_17899.pep
YEVQVDQRVDRCRREDRAGGWNRRQWTILTLENGRISIGGSLFTWTMLGIFCGPSSLQNNAQSNLNSGHDSLKLLFSTLKKRFTRISGHALRKIATEYEEIFLVGINGLSCSYVRLFRGPSSLPPVAPSDLCSPPVPPLLPETAMQTMHYMHDSCTMSI

SEQ ID NO: 123482 - protein, 267 aa, Triticum aestivum
  unsure (1)..(267): unsure at all Xaa locations
  Clone ID: PAT_TA_17900.pep
MMNALAYLGLRDILATEMVCKSLHSWIRSELSWKCIHIEPVLSGKISDPDRLFLTQKIPGDLQCLNINDCINITDNGLNAVLQSNPTLTKLSIARCPRLTLDGLIANLKSFNMKAVSGIKSLRIDKNFNLPKEDYEELLSLLSIDKRQELHNRGXPRFRHXNHFLXDCNDGYALDIEMCPICQSYKLVFDCPEGECSDKRSGKCRACEVCIKRCRQCGRCLERNEKFEEKFDLVYLCYKCRGDPASPSLGVEKDLVSILSSGRIPSP

SEQ ID NO: 123483 - protein, 438 aa, Triticum aestivum
  unsure (1)..(438): unsure at all Xaa locations
  Clone ID: PAT_TA_17901.pep
MMMGLLAFENNQGLWNGGYYSQFFGIGGVMVTVAILWLSTGYFGGIGAPFAPYFWPYLGQVPKKKERQRPVRVYMDGCFDLMHYGHANALRQAKLLGDQLVVGVVSDEEIVANKGPPVLSMEERLTLVSGLKWVDEVIPNAPYEITEEFMNTLFSKYNIDYIIHGDDPCLLPDGTDAYALAKKAGRYKQIRRTEGVSSTDIVGRILQTFKHKEGVSENAGVESCDQMKTQLSNFLPTSRRIMQFSNGQAPSPGARVVYIDGAFDLFHAGHVEILRSARQLGDFLLVGVHDDQSIREKRXGXPSYHATXHERSPGGPAPRPVDEVIIGAPLEVSRDMVCYKFLHGAYNCVFYLIXITTFNISLVVHGTVVEGGSASEVDPYALPKSMGIFQVVTSPKTITSVSVATRIIDNHEAYKKRNLKKKASEDKYYTQKKFVYGD

SEQ ID NO: 123484 - protein, 117 aa, Triticum aestivum
  Clone ID: PAT_TA_17902.pep
MVKKRKNNGRNKKGRGHVKPIRCSNCSRCTPKDKAIKRFTIRNMVESAAIRDISDASVFAEYTVPKMYLKLQYCVSCAIHGKIVRVRSVVGRRNRAPPPRVRYNKDGKKIVPTAPKA

SEQ ID NO: 123485 - protein, 117 aa, Triticum aestivum; identical to SEQ ID NO: 123484
  Clone ID: PAT_TA_17903.pep

SEQ ID NO: 123486 - protein, 118 aa, Triticum aestivum
  unsure (1)..(118): unsure at all Xaa locations
  Clone ID: PAT_TA_17904.pep
ITYEFAQKQTTIRGDLLDSPSDDFVSYHRXLQILLLIHMMLYLNAFEIAIFTWVMATFGLRSCILVKSGYGTTRVVISVICQVLCGYSTLPLYAVVSHMGNSFKKTIFDENVTERLAN

SEQ ID NO: 123487 - protein, 272 aa, Triticum aestivum
  Clone ID: PAT_TA_17905.pep
SYFYQVIPNYVSKSDPEGLSNFGIEGMSPELVKTATDMIGSMKPEELQKMFEVASSLNSTSSAGPNLGPNMPEMSPDMLKMASDMIASMPPDDVQKMMSFASQMGGPGGAPRSSENINFGPSVRATTSNSARGSSSQPVLENPDELSNDHRMSQSSSSLPPSTADMQETMKNSMKDPAMRQMLTSMMKNMSPEMMANMSEQFGMKLSKEDAAKAQQAMSSLSPEDLDRMMRWMERAQKGVDVAKKTKNWLLGRRGLILAIVMLILAFILQKL

SEQ ID NO: 123488 - protein, 164 aa, Triticum aestivum
  Clone ID: PAT_TA_17906.pep
MAGKPVSLKGVALISGGAADSAVAGALHFVQDPSSGYTEVRGWVSGLAPGLHGFHIHAFGDTTNGCNSTGPHFNPHNKSHGAPVDDERHVGDLGNIQANKDGVAEIFIKDLQISLRGPHSILGRAVVVHADSDDLGKGGHELSKSTGNAGARIGCGIIGIQPAV

SEQ ID NO: 123489 - protein, 251 aa, Triticum aestivum
  Clone ID: PAT_TA_17907.pep
MAGAVKIGSWGLPSGKLCDINSYSSPQRLISITAYSNETPGGCIVGFSFTYVDQTGGAINVGTWGNTWGGVKTIYMNQGEHVNDVSGTSNSRGVTSLKIVTNQGDRGTYGCPAGDAFSVPLRQGKNEVVAFFGHSDDTLKSLGVYVPGAKECPVKIGPWGGHLGSSRDLYASNMPVQLQSIAVRSSERSRRPRLRFSYNYLGQAGSASALALGLPRQKATAQHRHERGQLLTSSALRYYGSLAQFDQPKTL

SEQ ID NO: 123490 - protein, 496 aa, Triticum aestivum
  Clone ID: PAT_TA_17908.pep
TALSVSGQRPKPRYEHGATVLQDKMYIFGGNHNGRYLSDLQVLDLKSLTWSKIDAKLQAGTSDSAKTAQVSPCAGHSLISCGNKFFSVAGHTKDPSDSITVKEFDPHTCTWSIVKTYGKPPVSRGGQSVTLVGTTLVVFGGEDAKRCLLNDLHILDLETMTWDDVDAMGAPPAPWSAHVAACRADRYLLIFGGGSHATCFNDLHVLDLQTMEWSRPKQQGPIPSPRAGHAGATVGENWYIVGGGNNKSGVSETLVLNMSTLAWSVVSTVEGRVPLASEGMTLLYSNYSGEDYLISFGGYNGRYSNEVYALKLSVKLDLQSSTKDQPTSDSTSRVLEPEVEISQDGKIREIAMDNADSKNRNDEANEQLLAALKAEKDELEATLNREGLQTVQLKEEITEAEARNAELTKELQAVRGQLAAEQSRCFKLEVDVAELRQKLQSLDALEREVELLRRQKAASEQEQAALDAKQKKQAGSGGVWGWLVGTPPDDDDSESS

SEQ ID NO: 123491 - protein, 253 aa, Triticum aestivum
  Clone ID: PAT_TA_17909.pep
MATAEQKGKRPRMEAEEGNSIDDALLLSIEKLQEIQDEIERVNEEASDKVLEVEQKYNEVRRPVYTRRNEIIKEIPDFWLTAFLSHPMLGELLTEDDQKIFKHLVSIDVDEFQDIKSGYSITLAFSSNPYFEDTKLTKTCSFSDDGKITVKATTINWKNGMDIANGKAYMENGEKRLLIDESFFTWFNDAKNKSFSDGVMDEVADVIKEELWPNPLKYFNNEAEDEFEGARDEEGFDEDDDDEDEEEEEDDEE

SEQ ID NO: 123492 - protein, 102 aa, Triticum aestivum
  Clone ID: PAT_TA_17910.pep
HLEASSTLFLAETESIIIKFILTCFTLPFSETLIMAVLDAWFACAFRNSVGFAILLANFAFRSGKQHGHHEQHQAQARHLHLVDLHVSKNEHPRREGRKLAG

SEQ ID NO: 123493 - protein, 138 aa, Triticum aestivum
  Clone ID: PAT_TA_17911.pep
MSSTGAGVAGRGKAKATKSVSRSSKAGLQFPVGRIARYLKAGKYAERVGAGAPVYLSAVLEYLAAEVLELAGNAARDNKKTRIVPRHIQLAVRNDEELSKLLGSVTIANGGVMPNINQVLLPKKAGPKGELGSASQEF

SEQ ID NO: 123494 - protein, 241 aa, Triticum aestivum
  Clone ID: PAT_TA_17912.pep
VKYVRGVAVPLGKTKSLVERFEKRESSSIDCSSPTGSCGDHTVKADSPPTSSAEASRTYERDLPTVDEMTTPIDLVRNHDEFINVVKSRLTKLEMVRHVFNLNGIKGAIAAVAKLPDIAVQADVVSTLKGKLGLFNLDIFSSLLPVLAGLLNSKTERHAIVALEMLLDLIKIFGPVIHSTLSSSSPVGVDLQAEQRLQRCTRCFNHLQKIVQALQPLMMRSGQSAQLAQELNMSLQDLVVF

SEQ ID NO: 123495 - protein, 204 aa, Triticum aestivum
  unsure (1)..(204): unsure at all Xaa locations
  Clone ID: PAT_TA_17913.pep
RTRAAGRAGTSSSLDATKSLHTESVSHWSLTFLDLSLNLEQNSSITSCLKNFSLGETMNAAXKFFCDKCCSLPSAQRRLKLKNXPNILVIHLKRFKYIEQLGRYKKLTYRVVFPLELKLMNTVDNSDLEYSLFAVLVHVGSGPNHGHYISVVKXSHNHWLFFDDETVEMTDESMVQTFFGSAQEFSGNTDNGYILFYESVAKTS

SEQ ID NO: 123496 - protein, 53 aa, Triticum aestivum
  Clone ID: PAT_TA_17914.pep
TRPEDPFLIYSSHGMKMESQVATLDTHTGVHGTHDALTLTKPNNYHQPHTHEH

SEQ ID NO: 123497 - protein, 428 aa, Triticum aestivum
  unsure (1)..(428): unsure at all Xaa locations
  Clone ID: PAT_TA_17915.pep
MPILRQIFRLLRRPGVAISHDPLRRLSSTSRPLLSFMASAPPYWSPPPLARRSFPLMMVPDLPVRRVSRFPPGSRSMTSGTTLQDMNTIAGKHDASSNIVDISGCDENGRSATNRRSALVASDAEEDDILDLGFLPKSTHRDGSLYRNTHSWKRMYNVDDCSETRLPDPTDCDIRNGECIRHQPNRVLQIFSLKLAELTLDLGPVELYGYIAVRDYLDTLRNYVVNISRDDPIIVKQGSLIDMAGPKRGIDLISSILVEYDMRIKVGEEERDDYQLIDGVXDIDDLGPWNRALKNRIQGDCGAVDLTIARVDDAVMANIEVAVSEVQSSFDLCLRCFIGGYNEGIRLFNGTVGESRHLKRSVVAVVDGSTLVLKFKAASGPSGSAERCCSFQADTHGLDTREIKTDFGLISVKVTWSTLRTRLIVGLE

SEQ ID NO: 123498 - protein, 222 aa, Triticum aestivum
  Clone ID: PAT_TA_17916.pep
MAGEKGLVLLNFWVSPFGQRCLIALAEKGLPYEYVEENLMAGKSDRLLRSNPIHKKIPVLLHDGRPVNESLIILNYLDDAFPDTPSLLPSDPYERSQARFWADYVDKKVYDCGTRLWKLKGEPHAQARAEMVEILKNLDGALGDKSFFGGDAFGFVDAAFAPFTSWFHSYEKYGEFSVAEVAPKIAAWAKRCGERESVAKSLYSPDKIYEFIGVLKKMHGVE

SEQ ID NO: 123499 - protein, 222 aa, Triticum aestivum
  Clone ID: PAT_TA_17917.pep
MAGEKGLVLLNFWVSPFGQRCLIALAEKGLPYEYVEENLMAGKSDRLLRSNPIHKKIPVLLHDGRPVNESLIILNYLDDAFPDTPSLLPSDPYERSQARFWADYVDKKVYDCGTRLWKLKGEPHAQARAEMVEILKNLDGALGDKSFFGGDAFGFVDAAFAPFTSWFHSYEKYGEFSVAEVAPKIAAWAKRCGERESVAKSLYSPDKVYDFIGLLKKKYGIE

SEQ ID NO: 123500 - protein, 265 aa, Triticum aestivum
  Clone ID: PAT_TA_17918.pep
MALATSHRHLVRPAAAAPRVPLRPLRFAAPRSLPRICCQSINSANVLGASSMTADDAVPQPVVLIDQDSDRDATIVQLSFGDRLGALLDTMKALKDLGLDVTKGSVATDSSVTQTKFHIMRLGRKVEDPDMLETIRLTIINNLLQYHPESSEKLAMGEFFGIKAPEKKVDVDVATHVIVQDDGPKRSMLYIETADRPGLLLEVIKIITDVNVDVESAEIDTEGLVAKDKFHVSYRGAKLNSSLSQVLVNCLRYYLRRPETDEDSY

SEQ ID NO: 123501 - protein, 280 aa, Triticum aestivum
  unsure (1)..(280): unsure at all Xaa locations
  Clone ID: PAT_TA_17919.pep
MAGEKGLVLLDFWVXPFGQRXVRIALAEKXGLPYDXREEDLMAGKSDRLLRANPVHKKIPVLLHDGRPVNESLIILHXTLEDAFPDAPALLPSDPYARAQARFWAXDYVDKKVYDCGSXRLWKLKGEPQAQARAESAGPPSRALDVRLAXMPCSGGEKFGLARVELARPXRALHRVLEVRPSFGLQEVGALDRGVGQAHCGERESVDKSLYSPDRVYDFIGLLKKKYWHRVGARDGRAAMHAPARRPANKSGSVWVAYSAYVSDIAYFVECSVRCVCCWW

SEQ ID NO: 123502 - protein, 209 aa, Triticum aestivum
  Clone ID: PAT_TA_17920.pep
MEFALVDGEKFSPSCSTLVMPALSIGNVGQLAVDLLIPSAKARRVAYLDEPSVLPCIGNDAFGPDAVGDLALALEEYESPSHGLAFIQQRSPVITGMMVSFAKNVANFISSIGKDHVVILSSLDSGKRRVIDASSDMLYYLSSCNEDGSDPECEKLGWKKLEEYDPSQRLWKCLASLIEGGVLSEDMADDPEEMTASDYYATLPLAALF

SEQ ID NO: 123503 - protein, 186 aa, Triticum aestivum
  Clone ID: PAT_TA_17921.pep
ACELPDVSLGPNSARVRLALVLNPELVNDCIIVTACNLYDSDCCLKNQFKSLRLASHFLQDVSSINSQDWDILKLATALKMVCYPEDDILFGNPDEMFSTDELSKLVADAHKYEDSGIIKGAILRLYNLVVYLLNCKAKYQRRLASFVKEAKESYEAEQVVRERGSLRTDAFEADIQEVGVQMVAG

SEQ ID NO: 123504 - protein, 206 aa, Triticum aestivum
  Clone ID: PAT_TA_17922.pep
VTGQMSSTLIEQGMAMDKRVGAFVVSPASLSTFDVISVLVWVPIYDAVLVPLARRVTGEDRGFTQLQRIGVGLALSAAGMAYAALIETRRLAAPATSMSIMWQAPCYFVLGAAEVFTSIGMLEFFYDQSPVSMKSLGAALALLAIAGGNYLNSVLLGAVASTTGWIADNLDQGHLDYFFWFMAALSALNLLQFVYCSTRYKSIDQH

SEQ ID NO: 123505 - protein, 198 aa, Triticum aestivum
  Clone ID: PAT_TA_17923.pep
PPPAVVRPHVVPPAFRPPSARPREASSSPRNAGEEGGHRSAPERLPRGLPGGRLHHAEAAHLQAPPPRPPVKRQPARRSGSRNNASASPRSKQPQQPRTCVRTHGAACNATCLHPLRTFFLRSMAPDWTDAVSPVDEAPSSYSMCVRLAPLYVTPVYYNVKREDVRSVPYIYMDNISPMARRSHAYTSSKKKKKKKKK

SEQ ID NO: 123506 - protein, 457 aa, Triticum aestivum
  Clone ID: PAT_TA_17924.pep
MRIPGLLAAAGTLLVLLLAVAGAAAQEAAAAGDVRPEEIAANARAQEEAVLAAELGQLRAKVAALESSIAAQTLELNSKDGGIETLTKFTGEMSQNIATLQNEITSLQSKGSIAAKEQAGKVNARAIELEKQIEKLKKDIEAQNNKKATMEARATDAEKKVQELNAKLDRLQKTSGEQKVRIQKTKNALKAAEEELMKVQLEATAKSEQLGEVHGAWLPPWLAAHAAHYMELMSSHWSEHGKPAVNNLLQKASEKTVQAKEWAEPHIETVKAKWIPVIKENWATAKKKAEPYVQMVSAKSVELYQASKDAISPHVVKAHELADPYFQEAKKLSKPYIDQVAKASKPHVDKLKTTLKPYTEKAGQEYEKLRETASLYHQQAQVTILDYMHQHELLKQFANGELVWFLAAAWLLMPVYVLYILLTEVFCITKKKKIPRSDKGKVLVNGHRRHKRRHADK

SEQ ID NO: 123507 - protein, 165 aa, Triticum aestivum
  unsure (1)..(165): unsure at all Xaa locations
  Clone ID: PAT_TA_17925.pep
MAAAMRPSSPPYPLPPPPTCSSRLPQLRCFVGLRCSAPRVQVRRQLDAVAGIGSGARGCGGRFRAPASSASQPCYSSIVIRNDNSQNADFPRNYSKREKKPFPIPVLELRRRARQRMKEAEGKPRGPPPPPXNGLLVQRLIPEAYRVYNARISLINNLKRLMKVV

SEQ ID NO: 123508 - protein, 199 aa, Triticum aestivum
  unsure (1)..(199): unsure at all Xaa locations
  Clone ID: PAT_TA_17926.pep
MAPSYDKTIATAASLAASLMLVRSLASELLPSEVRDALSAALNSLRSRMTWQHTIVIEETEGWSGNRVYGAVKAYLATRINANIDMQRLRVSSTEEDAKKMVVSMEAGEEMVDLYEGVEFRWFLVTREVKGDLNNGGGGAREIRSYEVRFHKRHKEKALKEYLPFIGATGKAIKDQERSLNIYMNEYREQWSPNVXXHP

SEQ ID NO: 123509 - protein, 192 aa, Triticum aestivum
  Clone ID: PAT_TA_17927.pep
MASDGAVATPAKVTPKKANLLDPHSIKHLLDETVAEVVKGKGYVENTRLGNWKLLIGTAVIAIALLAQFYPKKFPQNREFLLGCIALYVVMNVVLLILSYTKEKDAIIFTHPPAGSFNNTGLVISSKLPRFSDMYNLSIASADPESISAHKPVHFTKSVTKWFTKEGVLVEGLFWKDVERLIDDYNNERKSK

SEQ ID NO: 123510 - protein, 217 aa, Triticum aestivum
  unsure (1)..(217): unsure at all Xaa locations
  Clone ID: PAT_TA_17928.pep
APRRRAAPARLHPHRPISSPSDGAADGERRRGGHAGEGDPEERPTSFDPHSIKHXLDETVAEVVKGKGYVENTRLGNWKLLIGRAVIAIALLAQFYPKNVPAGTARCLVGCIARLLWSVSVGACWILRILQXSKDDIIFTYSLAGSPQXLWSLLISSKLTTFSDLYNLPIASADPRISSAXSLSIQYVFTKGLTKEGVVVEDLFWKEGERLCEDYYN

SEQ ID NO: 123511 - protein, 72 aa, Triticum aestivum
  Clone ID: PAT_TA_17929.pep
LWLCSTLKRQENNACICPSYAVSHLELGALACKAKLSPPTPRKCYIEFIHDVLAVVAFERGKERQFCFLKGR

SEQ ID NO: 123512 - protein, 133 aa, Triticum aestivum
  Clone ID: PAT_TA_17930.pep
MSLPGKKAAAGAGGIRRWLSTAVLPALALVLILVVISLSVGSPLPGASLPEYPAVRASHPKGNATADEGSKNDIATGVPLPGKELQGGQEPLVEHSAQNATLNSSEGSLNTREIHDTVPGSQFLSIAKYRPVV

SEQ ID NO: 123513 - protein, 216 aa, Triticum aestivum
  Clone ID: PAT_TA_17931.pep
MENGDETLVSPPAAATAEVEKAAPNGGVEGEEVTVADAVHPAKSYAAVAANAEIEDLRATKLDLEEQLANASQENKTLAAEAHRLEGLFSQARDDVATAEHAAATTEEEVASLRAEVERLQALVDRKKADREADERQRQELTAEVETVRQAKLKLEKEVDALKASAAATTVEDREAAPDAGVPKEQGVAWQGMAAGAAAGAAITAAVVLIYLRLKR

SEQ ID NO: 123514 - protein, 87 aa, Triticum aestivum
  unsure (1)..(87): unsure at all Xaa locations
  Clone ID: PAT_TA_17932.pep
PRPGNSRACLXDKNFFSGDEFGFLDIVIIPLSSMFRAYEQQGKFVLEVECPKLMRWEKRCKERESVKSTLPDEEEVYRMHKKWYGIE

SEQ ID NO: 123515 - protein, 344 aa, Triticum aestivum
  Clone ID: PAT_TA_17933.pep
PPVFIYLPSRPPMQAHGISRSSRMLENVLPVNHHVGSAPAVNPSILDRRTGYVGELMEAPSFHPGSAGSMGFSGSPHLHQLELTSMFPQSGGNQAMSPAHIGARSPQQRGHMFHGRGHIGPPPSSFDSPGERARSRRNESCANQSDNKRQYELDIERIVCGEDSRTTLMIKNIPNKYTSKMLLTAIDENHKGTYDFIYLPIDFKNKCNVGYAFINMISPEHIVPFYKIFHGKRWEKFNSEKVASLAYARIQGKSSLIAHFQNSSLMNEDKRCRPILFHSDGPNAGDQEPFPMGTHVRSRPGRSRVLSCEESHRDTLSSSANNWTPSNGGGHASGYSKEADPTTA

SEQ ID NO: 123516 - protein, 263 aa, Triticum aestivum
  Clone ID: PAT_TA_17934.pep
MPPLPTSPASLSSSPLRLASRLVGAALRPTPSSSSRSRRSLAPTQTAPPGTTTSGGFAAMSWLGKLGVGGGGSPRASEASAALAQGPDEDKPAPGSEFAQFGAGCFWGVELVFQRVPGVTRTEVGYSQGAFHDPTYEDVCTGATGHNEVVRVQYDPAACKYDDLLETFWARHDPTTPNRQGGDVGTQYRSGIYYYTSEQEKAALESMEKQQKVQNRKIVTEILPAKRFYKAEEYHQQYLAKGGRFGFKQSTEKGCNDPIRCYG

SEQ ID NO: 123517 - protein, 164 aa, Triticum aestivum
  Clone ID: PAT_TA_17935.pep
MADTGDELKLLGMWASPYVVRVQLALRLKGVSYEYVEEDLANKSELFLRSNPVHKTVPILIHNGKPVCESQVILQYIDEAFAGVGPPLLPADPYERAVARFWAAYVEDKLLAPWGKVFRVTTDEERAEWTRQTAAALGPLEDGLRECSKGKGFFGGDCVGYVDV

SEQ ID NO: 123518 - protein, 236 aa, Triticum aestivum
  Clone ID: PAT_TA_17936.pep
MANGGDELKLLGMWASPYVVRVQLALHLKGVSYEYVEEDLASKSELFLRSNPVHKTVPILIHNGKPVCESQVILQYIDEAFAGVGPPLLPADPYERAVARFWAAYVEDKLLAPWGKVFRVKTDEERAEWTRQTAAALGPLEDGLRECSKGKGFFGGDCVGYVDVLLGSMVPWVRATERLSGDKLIDAGKAPLLAAWMERISELDAAKAVFQDVDRVVEYAGAIQARLSAAAAASTQ

SEQ ID NO: 123519 - protein, 158 aa, Triticum aestivum
  Clone ID: PAT_TA_17937.pep
GASAPGSLHCALYAQLDSSHSPPEAESPFSRCLTNFDRRRKAAGRNPVESSSSRRGLQQCAALQLVFTVQPEEHTGSEVSTSLIFLLPAAAHFVGFVPLGTLLPGSHLVFAGGKPKMKQSSLACAAIGLLVAFGWLAAAGDCSLSLKFCVMRDCKTKG

SEQ ID NO: 123520 - protein, 202 aa, Triticum aestivum
  unsure (1)..(202): unsure at all Xaa locations
  Clone ID: PAT_TA_17938.pep
MSEHSESKAEKLMGNIMDTIADRLPKQKSDNIMSNIMDTISDKLPKQRSGRFDPGSVADVKNKMFGRQRSLHGVLGGGKSADVLLWRNKKISSSVLGLATAIWVFFEWLDYHFLTIISFALVIGMXWXQFVWSNFSRSSEIPRVKLPEDLFVNIAVAIGAQVNKFLGFLQDVSCEXNLKHFVLAIGGLXAASVXXSWFNFLT

SEQ ID NO: 123521 - protein, 259 aa, Triticum aestivum
  Clone ID: PAT_TA_17939.pep
MSEHSESTAEKLMGNIMDTIADRLPKQKSDNIMSNIMDTISDKLPKQRSGRFDPGSVADVKNKMFGRQRSLHGVLGGGKSADVLLWRNKKISSSVLGLATAIWVFFEWLDYHFLTIISFALVLGMVVQFVWSNFSRSSEIPRVKLPEDLFVNIAVAIGAQVNKFLGFLQDVSCERNLKHFVLAIVGLWSASVAGSWFNFLTVIYIGFVCAHTLPVLYEKYEDQVDDFLYSILGLLREQYQKLDSGVLSRIPSKRNKKSE

SEQ ID NO: 123522 - protein, 448 aa, Triticum aestivum
  Clone ID: PAT_TA_17940.pep
VTVAEAVTYWSLFMLDFHDLFLPYVHKFRALQRTTMYGSRTIMFLTDDGTLRLLAIELTRPASATMPQWRQVFTSSTDTTKSWLWRMAKSHVRAHDAGHHELVTHWLRTHCAVEPYILAANRQLSEMHPIYQLLRPHFRYTMRINALARSALINGGGIIELTFSPQRYAMELSSVAYDKLWRFDMEALPADLVRRGMAEEDPTAEHGLKLAIKDYPFANDGLLIWDAIKGWVQAYVSRYYPTAASVSGDAELQAFWTEVRTEGHGDKKDAPWWPKLDTPESLAHTLTTIIWVAAAHHAAVNFGQYDFGGYFPNRPSIARTNMPVEEPVDAAAFEKFLDNPDQALRECFPSQVQATLVMAVLDVLSSHSPDEEYLGGMETAPWGEDTTVRAAYLRFNEQLKAVEGIIDGRNKNRKLKNRCGAGIVPYQLMKPFSQPGVTGKGIPNSTSI

SEQ ID NO: 123523 - protein, 166 aa, Triticum aestivum
  Clone ID: PAT_TA_17941.pep
TAQNQKAKGVYRNTPTRTPYIRLSEVGELDVKEPWEKVFGDCFQKVDDEVSGKASRFSNGTREIRPEPIAADNVGSTAVVAIVCSSHVITANCGDSRVVLCRGKEPIALSVDHKPDRKDERARIEAAGGKVIDWNGYRVSGILAMSRSIGKFSAFARPSLLFGQNY

SEQ ID NO: 123524 - protein, 188 aa, Triticum aestivum
  Clone ID: PAT_TA_17942.pep
HEEAPHPVRRSIRRRAVRRPVPGSTSAHLYMGMRLEELAAKLATEDPSVVGGPGGGGGRGVGELLYLRLGIVSGPSGRWPSPARHRPPRPCGGRGGELRLRRRRWRASRACWWRHGVPCAAPRPPRQQICTLPTAESTGTTCSRGRRTSRIRWVVDTNAGRGRVHEIEGGEHRTEGGGIASVVAASGR

SEQ ID NO: 123525 - protein, 240 aa, Triticum aestivum
  Clone ID: PAT_TA_17943.pep
MLEHLAVAVSEAPTMEAGEKIAPSMLSSDFANLASEAERMVRLGADWLHMDVMDGHFVPNLTIGAPVIESLRKHTKAYLDCHLMVTNPSDYVEAFGKAGASGFTFHIEVARDNWKELTQSIKAKGMRPGVSLKPGTPVEDVFPLVEAETPVELVLVMTVEPGFGGQKFMPEMMDKVRTLRKKYPSLDIEVDGGLGPSTIDAAASAGANCIVAGSSVFGAPDPGEVISALRKSVEASQIKS

SEQ ID NO: 123526 - protein, 217 aa, Triticum aestivum
  unsure (1)..(217): unsure at all Xaa locations
  Clone ID: PAT_TA_17944.pep
DAWEGIGHAIVEELARFGARVHTCSRNTEELEECRRRWEEKNLQVTVSVCDVSIGADRERLMETVRQTFDSKLDILXESTFHLSQLAHPLLLHASIAGGGTIINMSSIGGSIGFAGYTIYATTKGAIHQLTRSLATEWGPDKIRVNAIAPSFITTDMIKGGLIGTRVHGSKENSXTPLGRSGKPVEIASAVSFLCMPAASYITGQVICIDGGRTISS

SEQ ID NO: 123527 - protein, 281 aa, Triticum aestivum
  unsure (1)..(281): unsure at all Xaa locations
  Clone ID: PAT_TA_17945.pep
MAVDYGSREERWSLAGTTALVTGGSKGIGHAIVEELAGFGARVHTCSRNGAELEECRRRWEEKNLQVNASVCDVSIRADREKLMETVRETFNGKLDILCRLWGRYRPCLXGVLMVEVNNAGQLLFKPTTECTVKEYSNLLTTNLESSFHLSQLAHPLLIHASIAGGGSIINMSSIGGSIGYAGSAIYATTKGAMNQLIRSLATEWGSXKIRVNGIAPGFVTTDMLKDIDTEYMKKEHLKTPLGRSGKPVEIATAVSFLCMPAASFITGQVICIDGGRTISS

SEQ ID NO: 123528 - protein, 264 aa, Triticum aestivum
  unsure (1)..(264): unsure at all Xaa locations
  Clone ID: PAT_TA_17946.pep
MAVDYGSREERWSLAGTTALVTGGSKGIGHVIVEECWSFGARVHTCSRNGAELXEECRRRWGEKNLQVTVSVCDVSIRADREKLMETVRETFNGKLDILVNNAGQLLFKPTTECTVEEYSNLLTTNLESSFHLSQLAHPLLIHASIAGGGSIINMSSIGGSIGYAGSAIYATTKGAMNQLTRSLATEWASDKIRVNGIAPGFVTTDMLKDIDTEYVKEEHSKTPLGRSGKPVEIASAVSFLCMPAASFITGQIICIDGGRTISA

SEQ ID NO: 123529 - protein, 332 aa, Triticum aestivum
  Clone ID: PAT_TA_17947.pep
GRVGNYVNIDDCWSYVKRGNKGQLLPDPKTFPSGIKSLADYVRGKGLKLGIYSDAGVSTCQVRPGSLHHENDDAALFASWGVDYLKYDNCYNLGIPPKERYPPMRDALNSTGRQIFYSLCEWGQDDPALWAGKVGNSWRTTDDIQDTWKSMTDIADKNNKWASYAGPGGWNDPDMLEVGNGGMTFAEYRAHFSIWALMKAPLLIGCDVRNMTSETIEILSNKEVIQVNQDPLGVQGRRILGQGKGGCREVWAGPLSGNRLAVALWNRCSETVNITMSLPAVGLDGSSAYSVRDLWKHETLSANVVGTFGAQVAVHDCKMYIFTPTVGFSASW

SEQ ID NO: 123530 - protein, 309 aa, Triticum aestivum
  unsure (1)..(309): unsure at all Xaa locations
  Clone ID: PAT_TA_17948.pep
SPQQCEAWNAYKRPPSEQGYSEDFGQIHHGLNVEPTREGLNSLTEACSRLWELDMNRLVPGKDYRIECGEGKXFITENLCHLITDXCWLGDDVLSLXALLDNARPHQGYKEVVTQQDKLVSTAFIEEIARTAPIKYLHRXYLRAEGSRHPKDYDDFKGNADSPLDLILYGMMLATRGCSSCICGCCLVGXVKWNKRQGETEVSGFHNWIQFYLEEAKGNVDYQGYIFPRRRGESPDSETQLLTVQFEWHGVLKSVSSSLSGVSPQFELALYTLCVVMGGXDNXGPYPVILKGRRVRPYEIGSVFPIAEN

SEQ ID NO: 123531 - protein, 77 aa, Triticum aestivum
  Clone ID: PAT_TA_17949.pep
PSYQDADLRLDAIRVVEDAIYRPHPFARGSIPFDAVVEVEGHLHLFFLSVPVKGRIACVVHVNPHDQTIVHQDCYPK

SEQ ID NO: 123532 - protein, 422 aa, Triticum aestivum
  Clone ID: PAT_TA_17950.pep
MDIENHGLLSCFSTSSNEEIFQLLTVLEVALKRDYLSSNFETTAELLNSNTLDFAGRNSIACSGSAAVLPWVPSTAAAVTLRLLDLDSSLSYTLDQKAGLNKEREAGDFIKGPSRYTAVKNKQEMGLVGAPGFDHHVGAQLTPSNGLRGRGRGGRGRGRGGRSLSRGGRVPRGVGSSPRIEFRDDNNVSYKETTDKQAGRGRGRGRGRGRGRGRGRGRGRGSITVSDSGSGSVRGRGRGRGRGLRTVRPRQPVELGARSIPKANLLGTFGMLSNAKPMTLHSPQSSGAEEWGLDRRAYAEDDEDNSVSQSDESEGDEENGEPMNEDYDEQLPDYSRDNSGSSPRQMMDSESEDNDEYDEEGEEDGADYDAEQPMDEDNDDAEMSEDDELGDDGDDDDGGGSQGGAGNADDDDAASYSSEYSE

SEQ ID NO: 123533 - protein, 199 aa, Triticum aestivum
  unsure (1)..(199): unsure at all Xaa locations
  Clone ID: PAT_TA_17951.pep
MPIRYNQTGSNNHFRNRWQRRVRTHSDQPGKKSCPRTARQAKAXVRCPDLSYNRRVRSGRGFTLADRSVAGIPKAFAPTIGIAVDFRRQNLSEESLAANVARLKAYQERLILLPRRSNAPKKGDTKTDVSKVEKAAQIAAAFPIAATDLAVKEISKSDMPSNIEAGAYRTLRVARANARYEGARQKRVRDAAEAESAKK

SEQ ID NO: 123534 - protein, 251 aa, Triticum aestivum
  Clone ID: PAT_TA_17952.pep
MASTHSSKQRLALAICDFLSASTNDGTLTADDKDSIDVAINCIAESFKVDPSDTSAVSAAIGSQNLLQIYSVFEKARADKPAAAPTPAPVVLTEEQKKEAEALKSKGNAAMAQKDYSAAINFYTQALAINASNAVYLSNRAAAHSANKDHASARSDAESAVSIDPAYTKAWSRLGLARFALGDARGAMEAYDRGIQHEGNGGSDAMKKGYETAKRRVQEMEAEEDSLPRASPSAGNDANAGGMPDLGSLAS

SEQ ID NO: 123535 - protein, 140 aa, Triticum aestivum
  Clone ID: PAT_TA_17953.pep
PGREWKGKRGVLSTARSRLLLFFSFPCSFFMPCCCFFFPLSPESLGEGEEEVFLGSTLTSEGPQQNPMAAARQSYCAIFAFSLFAPSSLYCSAYENLGCSLLLIRVWVSVPDPAATGDHFIGEESGSTQLAWSKFQQKMI

SEQ ID NO: 123536 - protein, 367 aa, Triticum aestivum
  unsure (1)..(367): unsure at all Xaa locations
  Clone ID: PAT_TA_17954.pep
ALGRRTPTEGRVAGSMERIGDKVISRAEITDAASATFADSTVIPDRYARPDEVRDGVVVGSDESYELPVVDMARLLHPELSEAEIAKLGSACRDWGFFQLTNHGVDETVVQDMKDNTLQFFGLPLEKKKAVAIQANGFEGFGHHYNRASSEKLDWAESLILVTQQHEQRNIQFWPANPSTFRDALDKYSVEMSNLTSRLTVFMASDLGVEQEALMGTFQGKTQSVAFHYYPPCRHPDKVIGITPHHDGLGLTLLLHVDDTPGVHVRKNGRWYPLNPLPGAFVINVGDILQILTNGTYKSAEHRVLPDVEKXRATVVMFQNACVAGMVKPLPELGEATYKAIDHVEYVKGNFSALAEGTRFVDSLKIM

SEQ ID NO: 123537 - protein, 186 aa, Triticum aestivum
  unsure (1)..(186): unsure at all Xaa locations
  Clone ID: PAT_TA_17955.pep
HNSSYSQIGSEEXPNEDATEEDEEVEISMWEAIAWLAVLTIWISVLSEYLVNAIEGASDSLHLPVAFISVILLPIVGNAAEHASAIMFAMKDKLDITIGVAIGSSTQISMFVIPFCVVVGWMMGQKMDLNFQLFETATLFITVLVVAFMLQDGIANYLKGLMLVLCYLIVAASFFVHVDPQASDDD

SEQ ID NO: 123538 - protein, 109 aa, Triticum aestivum
  Clone ID: PAT_TA_17956.pep
MAVASMVHAPSLLAVQALRGQKNAASARCSPRATAFRVRAAKLPAGVQVPRTQPKLSEPFLGFTKTAEVWNSRACMMGLIGTFIVELILNKGVLEIIGFEVGKGLDIPL

SEQ ID NO: 123539 - protein, 132 aa, Triticum aestivum
  Clone ID: PAT_TA_17957.pep
QPPPAPLPPRPHSLRGPVYSSSSNGCGLPVLHAPSLLAVQTFRGQKNAASNRSPRAAAFRVRAAKLPAGVQVPRAQPKLSEPFLGFTKTAEVWNSRACMMGLIGTFIVELILNKGVLEIIGFEVGKGLDIPL

SEQ ID NO: 123540 - protein, 587 aa, Triticum aestivum
  unsure (1)..(587): unsure at all Xaa locations
  Clone ID: PAT_TA_17958.pep
GRVECNWRNKRKILGVMMNWLARGRAQARLRLPQGMPSGLGPLWGRQRAAMLPPPVEAALQAVPVRPPPSGAPSVAMHDGATDGRPAGSEAVMRDXGGIPLLLXLARCSRVSAQSEAAKAIANLSVNAKVAKVVADEGGIAIFTNLAKSTNRLVAEEAAGGLWNLSVGEEHKAAIAAAGGIKALVDLIFRWPAGTDGVLERAAGALANLAADDKCSLEVAKAGGVHALVTLARSCKLEGVLEQAARALANLAAHGDNNNNNAAVGQEAGALEALVQLTCSQNEGVRQEAAGALWNLSFDDRNREAIAAAGGVEALVSLAQQCLNASEGLQERAAGALWGLSVSESNSIAIGQEGGVAPLLTMAQSEVEDVHETAAGALWNLAFYSSNAHRIVEEGGVPILVHLCSSSGSKMARFMSALALAYMFDGRMDEAAIVGTSSEGSSKGVNVEGARRMALKHIEIFVLTFSDPQVFSMAAASSAPAALSQVAEAVFIQEAGHLRCSGAEIGRFIAMLRNPTPVLRACAAFALLQFSIPGGRHATHHADLLQNVGAARVLRAAAAATSASIEAKVFARIVLRNLEHHQAGTST

SEQ ID NO: 123541 - protein, 209 aa, Triticum aestivum
  Clone ID: PAT_TA_17959.pep
ASATSALTATFLPGSVGTLLAQVLVEILTRLPPHDWVQTPCVGKHWASMFRGEYLWQTAIARKWPSAGFRKRWPGPIPRGSARRRFQALYVSENLVPSGGEIDELVGHTYLYLKEQLERLAVPPSSILHGTIIDQFIACGRTGEKAHELASNIWIAVIDNLEENQQTFMLLKHLAQEGDFFLPFPYSRLHIKVLQAVRKCNHTLTRLCY

SEQ ID NO: 123542 - protein, 200 aa, Triticum aestivum
  unsure (1)..(200): unsure at all Xaa locations
  Clone ID: PAT_TA_17960.pep
NFTIKRGXSTEDTVSVNYDDFISDVEAGDILLVDGGMMSLAVKSKTADTVKCVVVDGGELKSRRHLNVRGKSATLPSITEKDWEDIKFGVENGVDFYAVSFVKDAKVIHELKAYLKSANADIHVIPKIESADSIPNLQSIIAASDGAMVARGDLGAELPIEEVPLLQEEIIRTCRSMQKPVIVATNMLESMIDHPTPTRA

SEQ ID NO: 123543 - protein, 342 aa, Triticum aestivum
  Clone ID: PAT_TA_17961.pep
QDLPQWLVACAQDVPLLDNTARIEGWLDRFPMFDWVGGRTSELSAVGLLPAALQGIDVKEMLVGAALMDEETRNTVVKENPAALLALSWYWATDGIGSKDMVVLPYKDSLLLLSRYLQQLVMESLGKEFDLDGNRVNQGLTVYGNKGSTDQHAYIQQLREGVHNFFVTFIEVLRDRPPGHDWELEPGVTCGDYLFGMLQGTRSALYSNDRESISVTVEEVTPRAVGALVALYERAVGIYASLVNINAYHQPGVEAGKKAAGEVLALQKRVLTVLNEASCKDPAEPLTLEQIADRCHCPEDIEMIYKIIQHMAANDRALIAEGSCGSPRSVKVYLGECNVDDV

SEQ ID NO: 123544 - protein, 93 aa, Triticum aestivum
  Clone ID: PAT_TA_17962.pep
INPSIPSPLLSLLSSHGCSGSQVRRRHAPGRPLRGGARPGHVGTADGRASNVHRALRVCALPEREGLHRYLHSPAALRGQMPLHLFRHGLLGG

SEQ ID NO: 123545 - protein, 153 aa, Triticum aestivum
  Clone ID: PAT_TA_17963.pep
PIFSTRHCPWLLQGHAHYHQTAYIVLLTSVPYFGQCTTRVSFHHPQANPLYYGRSSRRALLHPSIPSPLLSLLSSHGCSGSQVRRRHAPGRPLRGGAGPGHVGTADGRASNVHRALRVCALPEREGLHRYLHSPAALRGQMPLHLFRHGLLGG

SEQ ID NO: 123546 - protein, 186 aa, Triticum aestivum
  Clone ID: PAT_TA_17964.pep
MEQAGQGAQPTKKPAAEVTLRLFGLADVDAMMAWASDPQVAAPCRWEPYESTETLLAFIHDAVLPHPWFRAICLAGDDDRPVGAISVSPTDDACRAELGYVLARAHWGKGVATAAVRRAVAAVFGEVEGLQRVEALVDVANVASQRVLEKAGFRREAVLRRYCVLKGAVKDMVIFSFISTDTVLVE

SEQ ID NO: 123547 - protein, 118 aa, Triticum aestivum
  Clone ID: PAT_TA_17965.pep
MARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRV

SEQ ID NO: 123548 - protein, 151 aa, Triticum aestivum
  Clone ID: PAT_TA_17966.pep
MAPKAEKKPAAKKPAEEEPAAEKAPAAKKPKGEKRLPAGKTSAGKEGGEKKGGKKKAKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 123549 - protein, 151 aa, Triticum aestivum; identical to SEQ ID NO: 123548
  Clone ID: PAT_TA_17967.pep

SEQ ID NO: 123550 - protein, 119 aa, Triticum aestivum
  Clone ID: PAT_TA_17968.pep
MEKDNHKEGEGATAWMTVPAFGDWDMKNGAMPDYSMDFSKIREMRKQNKKELSRASLGGDDDLLAHHKQQHQQHQPAAKAPQPTKLGAPAKDHGPLHGRDHSPTGRKRFLSYFQCCIKA

SEQ ID NO: 123551 - protein, 51 aa, Triticum aestivum
  Clone ID: PAT_TA_17969.pep
FQAYMFRGDNVSICNYCAIFSPFGTTLKIPKLIARGKMLYTLCVVFSKFIS

SEQ ID NO: 123552 - protein, 466 aa, Triticum aestivum
  Clone ID: PAT_TA_17970.pep
MESTGHGGGGEGASVLLLPFPGAQGHTNPLLELGRRLAHHGLRPTLVTSRHVLSSTPPPGAPFRVAAISDGFDAGGAASDYTDYFSRLEAVGSETLRELLLSEARAGRPVRVLVHDSHLPWAGRVARAAGVPAAAFFSQPCSVNLVYGELWAGRLALPVTDGLELFARGALGVELGPEDVPPFAAAPESQPLFHKTAIGQFDGLEDADDVLVNSFNAIEPKEGEFMELTWRAKTVGPTLPSFYLNDDRLPSNKSYGFNLFGSDAPCMDWLEKQSISSVVLVSYGTFSNYDAAQLEELGNGICNSGKSFIWVVRSNEAHKLSEELRKKCEKNGLIVSWCPQLEVLAHKAIGCFVTHCGWNSTLEAVVCGVPLVGIPHWADQPTIAKYVESAWGMGVRVRKSESGSLRSAEVERCIREVMDGERKDDYKRNAMKWMQKAKEAMQEGGSSDKHIVEFAAKYCQFEFTTM

SEQ ID NO: 123553 - protein, 118 aa, Triticum aestivum
  unsure (1)..(118): unsure at all Xaa locations
  Clone ID: PAT_TA_17971.pep
AIAFTFTCMQPVNAYLRPHRAENEEILSRNRIIWEYLHTYTGRTALVAAVTALFTGLQHLGHRLSEKEMAPMASRTNXVLGNPEEDDSVDLLQSGRFASKIDSSSPGSMEVQLEPLKG

SEQ ID NO: 123554 - protein, 215 aa, Triticum aestivum
  unsure (1)..(215): unsure at all Xaa locations
  Clone ID: PAT_TA_17972.pep
RNGSGKSTLTGLLDYQVTXTGTILLKGENLIDMEXPEERSLAALAGIFISRLAPIPGPGVCYFAFLLMAINARREKDGLPALXPLEFYSVVSQKAEALKMEPKILDRNVNEGFSGGERKRNEILQLSVLGADFALLDEIDSGLDVDALEDVAXPVNGLLTPQNSVLMITHYQRLLDLIKPSYVHIMESGKIVKTGDSSLASHINEGGYKSIASFV

SEQ ID NO: 123555 - protein, 156 aa, Triticum aestivum
  Clone ID: PAT_TA_17973.pep
MKFAAALAFAAGVAAHAKNVTYTTEVVTAYTTYCPGPTEIVHGDKTYTITEATTLTITDCPCTVTKPVIMTSAVVCHDCPTGEKPGKPNHPGMGHNSTMVPVYPTGKPTHGGEHPVGPGATPTAGSPSEVPTAGAGKVAALSGAGLAAVVGLAAFL

SEQ ID NO: 123556 - protein, 119 aa, Triticum aestivum
  Clone ID: PAT_TA_17974.pep
MAQDMPPKGGYEPVQYKRNLPARGLRPGILLLGMGAVMGYGWYKLIGGMREMNELGREKMWARINLIPVLQAEEDRDQVRRYLADQKREKELLGDNAKVYNSNRFVRPTFAVTPPPTTN

SEQ ID NO: 123557 - protein, 362 aa, Triticum aestivum
  Clone ID: PAT_TA_17975.pep
ALAEELARRLGKERCWRVKWPKKNETEFCKDANEVLMFLGPQALKEVIEGAELYPIRGLFNFKDFFPEIDSYYLGIHGDELGIPTGWKCMDGLYKVVPGELTIVTGVPNSGKSEWIDALLCNINNQCGWKFVLCSMENKVRDHARKLLEKHIKKPFFDARYGGSVERMSQDEFEEGKEWLNESFHLIRCEDDCLPSIDWVLNLAKAAVLRHGVRGLVIDPYNELDHQRPPNQTETEYVSQILTKIKRFAQHHSCHVWFVAHPRQLHNWTGAPPNMYDISGSAHFINKCDNGIVIHRNRDPDAGPVDVVQVCMKKVRNKVIGQIGDAFLTYDRVTGEYKEADEAIVAKVVKQQIRQKSTSYQR

SEQ ID NO: 123558 - protein, 103 aa, Triticum aestivum
  Clone ID: PAT_TA_17976.pep
MTGRGKGGKGLGKGGAKRHRKILRDNIQGITKPAIRRLARRGGVKRISAMIYEETRGVLKTFLEGVIRDAVTYTEHAKRKTVTSLDVVYALKRQGRTLYGFGG

SEQ ID NO: 123559 - protein, 103 aa, Triticum aestivum; identical to SEQ ID NO: 123558
  Clone ID: PAT_TA_17977.pep

SEQ ID NO: 123560 - protein, 324 aa, Triticum aestivum
  Clone ID: PAT_TA_17978.pep
MCAMATSATSCIYVSWFDDLTGVCQVLGSPMTAAVLCADFICVAGKISVSAALKCMKLLVKAGAGLNCTTPDTPLVIATSKDLTECVQYLLEVGADANIPSNYNGTTPIEIAADSGRRELVEILFPYTKPIQRVSNWSVDGIITHAKHLKDKGKQCDKASKVKQSDKSSKGKRKEDASARKSSSEEKVIQDKKAELKSLGAKAVEEKDYAGASEFYSEAIKVDPKDATLYSNRSLCHLRIGEAHDALVDADACIRLRPDWPKGYCRKGAALTALKDHKEACDAYMAAVKLDPSNEELHEAFWEAVAAMKAELGAGQSGSSSDSD

SEQ ID NO: 123561 - protein, 165 aa, Triticum aestivum
  Clone ID: PAT_TA_17979.pep
MNSFRIARAALRARPAAVRVPLQRRTYAEAVPDKIKLSLALPHQSIYKSHDVVQVNIPAESGEMGVLANHVPSIEQLKPGLVEVVEESAGSKQFFLSGGFATVQPNSVLSINAVEGYPLEDFSAEAIRAQIAEAQKVANGSGSEQDIAEAKIELEVLETLSAHVK

SEQ ID NO: 123562 - protein, 598 aa, Triticum aestivum
  Clone ID: PAT_TA_17980.pep
HASEMLEYYQHYRIALHFQSLLFWLVALREPSKAKSVARVSGDTSPAGNFGSVGVSSTEKEKKGVSLFITDEIYSTLLDVSFKRMLKKSANSSSSLLELWNEELEGKSDFSNYRTKLLDLIRVIASQRPVIAAANIVPRVRVVSGDANQTTKSPQDLDAMVGAQLGLETVVSAIFDGSGDYAKTDHEAKFQIHRTFEGLLQQLLSLKWTEPSLIVIHGHYLDSLGLYLRHYPDVVASVVNKPFELLTSLPITIQQQGPSNNSRQARLQICSSFIRISRAADKALLPHMKNIADTMAYLQGEGRLLRAEHDHLCEAFLIMASSSGIQQQQEVLAWLLEPLNKTWTQVEWQTAYLSDPSGLTDMFADTQFMWSIYHTVTFFEKALKRSGTKRSTTAPQAAITTTTATGYLHPMSSHLSWILPPLLRLLRCIHALWAEPFAQSLTGEIKAAKSMTISEQASLLGETSKPTKGQVAPADGLLDVQREGESKENNIRNWLRGVRDSGYNLIGLAATLGEAFFRCIDGSSVILALMENVQVMEFRHLRQLMHLAVVPLVKYCPAELWQIWTANLLQPIFVHCQQALDYSWSSLLREGRAKVPDS

SEQ ID NO: 123563 - protein, 213 aa, Triticum aestivum
  Clone ID: PAT_TA_17981.pep
KPNESIQRIQSYYIGVHDMIQLIRLGALFIYLFFNGRHEHYGGYHSISDEKELMYKRNPHIKVWLLPCARAPTYVPWNLHVRTDTAGSPAHQAGAKRSMSMHTVSSELARTALFLLLLSWICTVFTASTSSRPSPWCRRPTTSASASAAGAASRPNLANQTPTTPAMARSTLFLDSLTLGSATQTLDGEEANQAQQPSFPSSVCYANTRGRVG

SEQ ID NO: 123564 - protein, 174 aa, Triticum aestivum
  Clone ID: PAT_TA_17982.pep
FNWPHNLFILFFNGRHEHYYSTTTITRLAMKKSLCTITAQGIDSSLVPAPLRTYVPWNLHVRTDTAGSPAHQAGAKRSMSMHTVSSELARTALVLLLLSWICTPPFFTASTSSRPSPWCRRPTTSASASAAGAASRPNLANQTPTTPAMARSTLFLDSLTLGSATHTLDGKEGC

SEQ ID NO: 123565 - protein, 185 aa, Triticum aestivum
  Clone ID: PAT_TA_17983.pep
FIYYPFFNERHEHYYYDHSISDEKELMYKRNPHNHSTRHRLLPCARAPTYVPWNLHVRTDTAGSPAHQAGAKRSMSMHTVSSELARTALFLLLLSWICTVFTASTSSRPSPWCRRPTTSASASAAGAASRPNLANQTPTTPAIALTLRSATYTAHSLEKKALEVAPASWLSSLGCCCCVGGRVGR

SEQ ID NO: 123566 - protein, 194 aa, Triticum aestivum
  Clone ID: PAT_TA_17984.pep
ITVWTLDIGDGSKFKWKIHWGFNLDLLWAQDGFHALDIPRCLPQFPVVCANNPGALCCLLRKDELSRQPWMIMVDMNQEDLQPSTKYINQQPYNVACVNEKKPMEAHQIFFSNVPLLPTVFSKYLVRPTVIPRDNKLKLAASSSEEIMLITGESLSLQCEFEDLKTDDPAWNLLLVGHTKDGICPECHGMRMMG

SEQ ID NO: 123567 - protein, 215 aa, Triticum aestivum
  Clone ID: PAT_TA_17985.pep
MWGMARIDEWKPVIAMLIFDLISAVTTALIKAALEEGLDRLVLITLRQLVATVFLSPIAFFKERNTRPKLTLEILVYLFFSAALGAALSQYTFFYGLQYTTATFAITFTNLAPVLTFLIAVLLRVESLNMKNKAGAAKIIGTLMSFAGVMLLTLYKGVALTHQAEPSGQHAEAAAAAESGKKSWTLGTLALLANCLCFSFWLLLQSKLTKKYPAL

SEQ ID NO: 123568 - protein, 177 aa, Triticum aestivum
  unsure (1)..(177): unsure at all Xaa locations
  Clone ID: PAT_TA_17986.pep
CHDETVRRRFSFTVFFSGNDLQXGNLATLKXSGVIKHQNLASSPRGDSLAVIELAGDMDEETWRGLYTSAANHLTPGSKIILTSRSGKPASLGTAQSLVLKFLSQEAYWYFFKAAAFGSTLPGEHPNLAALGIGCVVHMNSIFVAANTGASLLQDNLDTHLWRELRRVTDRRARGAR

SEQ ID NO: 123569 - protein, 144 aa, Triticum aestivum
  Clone ID: PAT_TA_17987.pep
ILAGPIFEIEELRDDKNKKGGDISKTLVQAVKHEKSQVEEKLEQEKLQSFHLKKELADVENKNAELTKELQSVRDQLSDEAARASKLEDGVSEIQQRLQKMETLEKEFELLRSERGGGSDKSGSGSNKRPSSVGFRRWYGDDER

SEQ ID NO: 123570 - protein, 189 aa, Triticum aestivum
  Clone ID: PAT_TA_17988.pep
MRIAGFLSTICAAALVVAEQRTAQIYVQAVQSSPSLPQPLAEIAYDAASLISTEVVSYEAPELPETASLVRIGIYDPKSEKWIAGTTAASTENFDRGYAPTLLLSVDESGDVRSVTLKGIRVDAGQTRDFGPKAIVIADKKGSQPELNKPVILSPGGKKAEEEEPKSFLQKYWWLIAIMVVMSLAGGEK

SEQ ID NO: 123571 - protein, 131 aa, Triticum aestivum
  Clone ID: PAT_TA_17989.pep
PSTNEYGMYGSRSPGAKRGHHLYCRSVAASRDTSAEATTATAETGARLAAAPASGAGAGADEGAEEGAMTPCADAEARKTEATAMARSSTAARGAITLSFLRGDAGEESWRLGGVEEIDLLFESRPAARAA

SEQ ID NO: 123572 - protein, 135 aa, Triticum aestivum
  Clone ID: PAT_TA_17990.pep
AGRPPLEHRLLAPQNNLLDAAKPPTEPYNFPRQHLREGRKGVMAPRAAVLLLAMAVASVFFASASAQGIMAPSSAPSSAPAPAPAHRRRQLASPRSPPWPWSPPRWCPCSRRCSCSRDDGCASPWVIGFYTYRLR

SEQ ID NO: 123573 - protein, 231 aa, Triticum aestivum
  unsure (1)..(231): unsure at all Xaa locations
  Clone ID: PAT_TA_17991.pep
MGHEDAVYLAKLAEQAERYEEMVENMKIVAGEDRDLTVEERNLLSVAYKNVIGARRASWRIVTSIEQKEESKGNSSQVTLIKEYRQKIEAELAKICEDILEVLDQHLIPSAKSGESKVFYHKMKGDYHRYLAEFAIGDRRKDSADKSLEAYKAATEVAQTELPPTHPIRXLGLALNFSVFYYEILNAPDQACHLAKQAFDDAIAELDTLSEESYKDSTLIMQLLRDTLTLW

SEQ ID NO: 123574 - protein, 153 aa, Triticum aestivum
  Clone ID: PAT_TA_17992.pep
MATYPLLLPLLAAVAVAAASSAEDTPTAYEMLERYDFPRGILPEGVEGYELDRDGGFQVYFPRECEFLLAKQWLVKYDTRIAGAASAGKLAALQGIYVKVLFLWIPVAEVDRAGERLSFYISPVSTSFPLSDFASSPHCRGYHDRAAVAAAVS

SEQ ID NO: 123575 - protein, 202 aa, Triticum aestivum
  Clone ID: PAT_TA_17993.pep
CRFGTRHLSKLPSETPYSQFSNQFQEWGLEKGWGDTAEHVLEMIHLLLDILQAPDPSTLETFLGRIPMIFNVVIVSPHGYFGQANVLGMPDTGGQIVYILDQVRALEDEMVLRLKKQGLDVTPKIIIVSSIFFSHFCCPLQIIFIGYILRLLYCVVSLYYDMLLYMVTFFNKRGSPGAFASIDACNHVIAKYQSYKKHNNFL

SEQ ID NO: 123576 - protein, 173 aa, Triticum aestivum
  Clone ID: PAT_TA_17994.pep
MDAMERGQSSPRLPKSRGSKIDEESLRVPLIESKKTGSRAPAVVLGFECLESTAFNGVATNLVLYLESVLHGSGLASASNVTTWIGTSFLTPVLGAILADTFWGNYTTILVSLVVYLLGMMLITFSALLPTTDCAGWARRATHFSASTASPAHSGFARRSPGPACGHSHTTKK

SEQ ID NO: 123577 - protein, 123 aa, Triticum aestivum
  Clone ID: PAT_TA_17995.pep
GEEAGQGDRIDQRGAGQGGRAQGGRGAQGGGGGGRGRLGQEQARVSVLIDRRRAPRPAVHLAADGVLNGKSSREMMVCMYPPLTVTWRFVLRFLVLSKACLVPECCMMFLFLKIIVMFRCVYQ

SEQ ID NO: 123578 - protein, 187 aa, Triticum aestivum
  Clone ID: PAT_TA_17996.pep
AVDTCTPYSTRARKKGSSLANFFTIPEQLLPCTFRAGRGEPQEAHLLVAPGGGRSELLHVLVVGPGGPALLLLRLALPGLPALGLRGLLRADQSVHLVRPLLPCRLLVPPVENARGGDGAHVDVGRRQVHVHPPPAGVLPLVVAVTVTVVMAVLLLLPLLVLLLVVRQVQGAPLLCHGWMLSFSSSD

SEQ ID NO: 123579 - protein, 46 aa, Triticum aestivum
  Clone ID: PAT_TA_17997.pep
LTNVSCRYVTIRSVPMCEFFCRCIECIWLVGKCGISLKVASGHICS

SEQ ID NO: 123580 - protein, 115 aa, Triticum aestivum
  unsure (1)..(115): unsure at all Xaa locations
  Clone ID: PAT_TA_17998.pep
PINFAHTNYLNERTKRWIEDESSSGNTQTELRVVILDLSAVPAIDTSGIAFLIDLKKSTEKHGLELVLVNPLXRGHGENTTSEXRTQSFQAGLPXYLTTGEAIASLSGFAKMATP

SEQ ID NO: 123581 - protein, 393 aa, Triticum aestivum
  unsure (1)..(393): unsure at all Xaa locations
  Clone ID: PAT_TA_17999.pep
FLVLLLAARHVSIRWPKFFWISACAPLASVIVSTLLVFLFKAQNHGISIIGSLKCGLNRPSWDKLLFDPTYLGLTMKTGLVTGIISLTEGVAVGRTFASLKDYQVDGNKEMMAIGLMNIVGSCTSCYVTTGAFSRSAVNHNAGCKTAMSNVVMALTVMVTLLFLMPLFVYTPNVVLGAIIIAAVIGLIDLPAAYNIWXKMDKMDFLVCLCAFAGVIFISVQEGLAIAVGISIFRVLMQITRPRMMIQGNIKGTDIYRNLHQYKEAQRVPGFLILTVEAPINFANTNYLNERTKRWIEDESSSGNKQTELRVVILDLSAVPAIDTSGIAFLIDLKKSTEKHGLELVLVNPTGXGHGENTTSEXRTRSFQAGLPXYLTTGEAIASLSGFAKMATP

SEQ ID NO: 123582 - protein, 215 aa, Triticum aestivum
  Clone ID: PAT_TA_18000.pep
MRCAPPPAAGAAPWAAQGERSPSVGTASCASELAPHAHHADRRGFAAMWLFWRTRNRFSIEELRYLTDQLQKIHVVYEANKEFVVEALRSIAELMIYGDQHDPLFFEFFMEKQIMGEFARILRISKLSRVSLQLLQTMSIMIQNLRNEHSIYYIFSNEHINFLITYSFDFQIDEMLSYYISFLRAISGKLNKNTISLLVKTKNDEVISFPLYVEA

SEQ ID NO: 123583 - protein, 132 aa, Triticum aestivum
  Clone ID: PAT_TA_18001.pep
AGRVGVLIPRSFHRIGNPILLLPLFSLCIPTRPSPSLHAPFPSSSTGHLRRAPVEPRIGSDRRCRALLPQKKKKKKKKKKKKKKKKKKKLGLFCRFPRNSGMAVGLRPAGQESLPPPPARDHRPQPATQLRV

SEQ ID NO: 123584 - protein, 124 aa, Triticum aestivum
  Clone ID: PAT_TA_18002.pep
MEVEAVRCECCGFTEECTPEYIAAVRAEYMGRWVCGLCAAAVGDEIRRAGARGQRAITTAEALDRHGAFAREAPRAPGKKASEELVAAVSRLLRRCLDSPPASPAAPQGRKVAAGPRCTDADDA

SEQ ID NO: 123585 - protein, 75 aa, Triticum aestivum
  Clone ID: PAT_TA_18003.pep
TVADIQVILKKHRGQQISRPEHTPHLPRCSASIQISHQVTVTEMDSCLDCVSSGLPLDLPLHHLPEKQWGFGSCW

SEQ ID NO: 123586 - protein, 134 aa, Triticum aestivum
  Clone ID: PAT_TA_18004.pep
LQTQQKHSQAALEELDDTEFKNAFSKGYIRVKEYDGKRGRSYSRSRSPSRSRSKSRSPSKSPRARSASRSRSRSLSSRSRSASKGRSPSRSPARSKSPIASPANGVVASPGASPKKRSPSRSPSRSRSPDAKSE

SEQ ID NO: 123587 - protein, 360 aa, Triticum aestivum
  Clone ID: PAT_TA_18005.pep
AASRDHTAADDNRMGRYESMDAAHEASRVTHENKSMKPNTNAITNVALTFPSNVNLLPDGDDINRSDVSGLAEIEKIIKQKQFSRDETERLIEIMRLRTPDLHGDDQRATHSFAKETETTPFSNKLVIPAKPDERNWGTDMFAQSNVHDATSPIELARAYMEAQTSASVHESQKRKFRALSHGVEIENSASKIFPKVAMDSPVRWPGSVVRDHTNHYLTPQSNKRRALPPASSRSPYTGSVFRRSVKRTGQLDTYSNSSGRPQLSTPFSVGSKAMLEDKMTSIDGVLGVQPSTSSERVHVDAVGTDTPHTFTLERPHGKGTIESGSGTGRIPVADNISKHAAVSVHPKSSQDSSENTPAS

SEQ ID NO: 123588 - protein, 404 aa, Triticum aestivum
  unsure (1)..(404): unsure at all Xaa locations
  Clone ID: PAT_TA_18006.pep
MAAQMTPSKQAASGIENLNMESPVKKLNFGTANKENEPLNQTTDTAELKTKIVEESKKDESKTVVSKAEEDEPILQENPQRFVLFPIKYHEIWQMYKKAEASFWTAEEIDLSKDLHDWNNRLTSDEQYFISHILAFFAASDGIVNENLVERFSGEVQIPEARCFYGFQIMMENIHSETYSLLIDTYIKDPAQRTYLFNAVDTIPCIRKKADWAIRWIQDKNSTFAQRLVAFAAVEGIFFSGAFASIFWLKKRGLMPGLSFSNELISRDEGLHTDFACLLHSHLKGRASKQMIQDIITDAVSIEQEFLTEALPCALLGMNSNLMKQYIEFVADRLLVALGNEKVYKSTNPFDFMENISLGGKTNFFEKRVADYQKAGVLHSANKKDEEEAPXGENXGDFTFDDDF

SEQ ID NO: 123589 - protein, 453 aa, Triticum aestivum
  unsure (1)..(453): unsure at all Xaa locations
  Clone ID: PAT_TA_18007.pep
MSARIPAIAANRVSDAAKKQLDLVAKFVEEECIPADPVVEALAGEGDARWEGHPSIIEDLKEKARKLGLWNMFLPKGHYKESPGWTNLEYGLMAEWLGRSHVASEACNCAAPDTGNMEVLAKYGNDAQKAQWLKPLMDGKIRSAFLMTEPQVASSDATNIELSIRREXXEYVLNGTEVVGPSGAGDPRCKIYIVMGKTDPDNKDPYRQQSVILVPAETPGITINRMLKVYGFDDAPHGHGHLTFNNVRVPASNLVLGEGRGFEIIQGRLGPGRIHHAMRSIGAAERALDWMLLRVNDESKKPFGKLLREHGVIIEWIAKSRIEIDAARLIVLNAAIKMDDLGPKKALKEIAEAKVLIPQTALTVIDRAIQAYGGAGVSQDTPLAYMWAGIRTLRLADGPDEVHLQQMGRNENKRSAEATATIKMQRAKTEELLKAYGVERLQPGARIQHKAKL

SEQ ID NO: 123590 - protein, 285 aa, Triticum aestivum
  unsure (1)..(285): unsure at all Xaa locations
  Clone ID: PAT_TA_18008.pep
MEAGAGTALYPAHRCKTIYLVRHAQGIHNVEGEKDFAAYKSHALLDAQLTPLGWSQVDTLREHVTKSGLAKKIELVIVSPLLRTMQTAVGVFGGGNYTDGASASPLMVEGAGNSGRQPISSLNCPPFLAVEACREHXLGVHPCXQRSSITKYRTLFPAIDFSLIENDEDVLWEPDVRETNESVALRGMKFFDWLWTREEKEIAIVSHSGFLYHTLNMYGKECHPTIAEELGKHFANCELRSMVLVDRSNLGSDASKYNFAGKIPTGLDMPSDVADEKEAEEASKN

SEQ ID NO: 123591 - protein, 219 aa, Triticum aestivum
  unsure (1)..(219): unsure at all Xaa locations
  Clone ID: PAT_TA_18009.pep
TAAGAGPPLYPAHRRKTIYLFTPASPAYSXAGDANHCAAYKSHALLDAQLTPLGWSQVDTLRDHVTKCGLAKKIELVIVSPLLRTIQTAVGXSLGGGNYIDGASASPLMVEGAGNSERQPISSLNCPPFLAVXEACREAPGVFIPVDKRSSITKYRTLFPXAIDFSLIENDEDVLWEPDVMRTKCAFCFQVNEDHGLCMDEDRRKRYILAASVLGYIAP

SEQ ID NO: 123592 - protein, 359 aa, Triticum aestivum
  unsure (1)..(359): unsure at all Xaa locations
  Clone ID: PAT_TA_18010.pep
MPTSIASSSSPTAPLLRPRPSRIARPLVPPAPHGVGGCARPVGPPLPAAAESVLARGSLTKLGILAGGRGGLGCACLSPYFPAWDAAGQRSAGPPAMVXERFESCGSHRLHHRIIRGGGPVEDHKANVIVSQLLYLDAVEPKKEIIMYVNAVXGSVSAGMAIFDTMKHIRPDEMYAAPRIFVVIFWSFVSFGTRAKTNSLPNSCIMIHQPLGGAPXNGYLAYHTGQPWXNSMYLLAVPAYHTGQPLXDKINVDTDRDFFMSAKEAKEYGLIDGVTVNPLPSAAAASCCSCAWPTLFPLVSLHAVILHHEASQVVQNRCTTRIFIICGYIFASFQRSFGTDPLLEDSSFGGKIFHIHFFW

SEQ ID NO: 123593 - protein, 152 aa, Triticum aestivum; identical to SEQ ID NO: 123242
  Clone ID: PAT_TA_18011.pep

SEQ ID NO: 123594 - protein, 101 aa, Triticum aestivum
  Clone ID: PAT_TA_18012.pep
EEVQRSAEDKTVLVATYDGDHNHAPPPKQQGSGGRKSGDAAAVRVSPAPALVQQQQKQEASTAEQVADRKNLVEQMAATLTRDPGFKAALASALSGRIPVA

SEQ ID NO: 123595 - protein, 309 aa, Triticum aestivum
  Clone ID: PAT_TA_18013.pep
MDEQWMMGQTSLSLGLNVGRPTAPRGAPPVTKVLVEEDFMSSKKNHEVEALEAELRRVGEENRRLSDMLRALVAKYSDLQGRVSGMMAAAVAANNHQSPTTSEGGSAASPSRKRARSDSPDTAVQEARPASGGFAVSVNVGPDQAECTSVHEPCNSKRVRADECKASRVSKLYVHADDSDLSLVVKDGYQWRKYGQKVTKDNPCPRAYFRCSFAPSCQVKKKVQRSAEDKTVLVATYDGEHNHAPPPKQQGPGGRKSADVTAVRASPAPVLAKQQRKQPDGAAEPGQNRKGQMEDLQGPLTGGSGPPAS

SEQ ID NO: 123596 - protein, 129 aa, Triticum aestivum
  Clone ID: PAT_TA_18014.pep
CVQLFKIDEAAQRLEEAGAVQEQECGASHPDTLGVNSNLAAIYDAMGRVEDAIEILEHVLKVREEKLGTANPDVEDEKKRLAELLKEAGRSRNRKQKSLENLFGSGGAARGAKKDGAGGRRWTNFGFRS

SEQ ID NO: 123597 - protein, 148 aa, Triticum aestivum
  Clone ID: PAT_TA_18015.pep
KNLHSAETNQTKPKISEVRSPAEPRNLKLRNTKQGKSFLPLARSKPSVSRLHSHNSDGGDRDDIDEDGAAGGALGADAERHGRLGEDFEGGRLAQGRHRDGDGDARRPEIRLQPSHALLLIEPIKHTVFLRLEDVKMRGSLFLFASLL

SEQ ID NO: 123598 - protein, 95 aa, Triticum aestivum
  Clone ID: PAT_TA_18016.pep
FQVAEHLHHHPDAVLEPGGVALQRPRRDRRNDVEHVHQEDDQQQRLHQRRHRCRCAAADGRRTADFDLGWKGLPCFVLSSSGYELQQVLLLLRFC

SEQ ID NO: 123599 - protein, 119 aa, Triticum aestivum
  Clone ID: PAT_TA_18017.pep
PKGSWRTEISIFSRNKPSSHLDQNPAEARNLKPLSTKQGNPFLPRSKSAARLPSGATAAMAALMRMVLLVVFLVHMFSVVAPVWARTLKGDASWLRDVEGRRCSATSNQGPALPRTAAS

SEQ ID NO: 123600 - protein, 125 aa, Triticum aestivum
  Clone ID: PAT_TA_18018.pep
TSEPEATEHEASKAIVLPPRSEPAVSRLHSNNSDGGDRDDVDEDGAAGGALGADAQRHGRLGEDVEGGRLAQGRHRDGDGDARRPEIRLQPSHALLLIEPIKQTVFLRLEDVKMRGSLFLFASLL

SEQ ID NO: 123601 - protein, 324 aa, Triticum aestivum
  Clone ID: PAT_TA_18019.pep
MLPWSLPRPLAPTRPHPMAPSLLRPASPCRPLAPAPCAAGPGRSRATVSIGDSRARCVALRAAGSRRSDFSCTTKASTDHSGLTRQLLDFQHDTVDETDGGYDPFSQLKERFTDFKQRNYVENFTNYQKLAEQQTPEFMVVACADSRVCPTSILGLQPGDAFTVRNVANLVPPYEHGASETTAALEFAVNSLQVPNVLVVGHSRCGGIQALMSMKSKKDDRSSRTFIRDWVSLGKSARLSTEAAAGNLSFESQCRHCEKESINSSLLNLLTYPWIEERVKEGNLNLHGGYYNFIDCTFEKWTLVYRPGLEGGSKYAIKNRSTWS

SEQ ID NO: 123602 - protein, 137 aa, Triticum aestivum
  Clone ID: PAT_TA_18020.pep
MAPKAADKKPASKAPATASKAPEKKDAGKKTAASGDKKKRSKTRKETYSSYIYKVLKQVHPDTGISNRAMSILNSFVNDIFERVASEASKLAAYNKKSTISSREIQTSVRLILPGELAKHAVSEGTKAVTKYSSSTK

SEQ ID NO: 123603 - protein, 326 aa, Triticum aestivum
  Clone ID: PAT_TA_18021.pep
VLHQDMKVAAVNSLGSRSVTTLMPLLGGFLADAYLGRFRTVLLSTVVYLLPRVRLAVAQLAPGLRPSGVSVPRVHETLFFVGIYLVSVGTGGHKPALESFGADQFDDGHAGERLQKMSYFNWWNCALCSGVLLGVTVVVYIQERIGWGAATVLLAAVMGCSLVVYLAGWRTYRYRVPQGSPLTPLLRVVVAAVMKRRLQLPADAGELYEEDDGKKRLLSHTDQLRFLDKAAIFEHGGEVWRGAWRLATVTQVEETKLVVSMVPIWVATLPFGMAAAQVSTFFIKQGMAMDRHLGPHFVLPPASIFALAAIAMIATVALFDKCSNRA

SEQ ID NO: 123604 - protein, 156 aa, Triticum aestivum
  Clone ID: PAT_TA_18022.pep
LRQTIQQEYREVVERRFFTVTGTKPSDEVIDNLIETGSSEQIFEKAIQGIGRGQIMATVEEIQERHDVVVDIEKKLLELQQIFADMAALVDAQGEILDNIESQVQNAVNHVQTGTEALRSAKSLQKKSRKCMMIAIIMLLIIAVIIVLSVLKPWAK

SEQ ID NO: 123605 - protein, 114 aa, Triticum aestivum
  Clone ID: PAT_TA_18023.pep
KKKKKNTRCLTHHLDNILCLLSEKSPTFCHYTMEAWRKTTMCCLILFCLMATCSEVSSTENMCYHNHWNKCHPDQNGMCRDSCVKDGWDDGQCRNRFKRLMGAKCECYPKTCDH

SEQ ID NO: 123606 - protein, 357 aa, Triticum aestivum
  unsure (1)..(357): unsure at all Xaa locations
  Clone ID: PAT_TA_18024.pep
AVVSESQSDCSGSKSWLVQCGLCHGTSGSLRKTTNGQWVHAFCAEWLLENSFKRGHXNPVDGMVGLLKGKEXCLICQHNVGTCLKCSTVGCQVTFHPACARDAGLYMNTKXSGSLWQHKAYCSNHSIEQKRXDSQQYGPAEVKIMKQMRVELERLRLLCERVVKREKEKKELLVCEHDILAVKRDYVAFSMRASCYTPAPGASSESATTSVNNNSYGGKRQRSDDITARSDDVTVDSTIPRKHTIRFPVHSKDTDRNTADSSTSTISYKRKLDDVESLALKNLQERAATALRSSEDGEPASAACALRRAEDGELMPTDNALQKSEDGETKSTDNALQKSEDGETKSTDNALQKSEDR

SEQ ID NO: 123607 - protein, 141 aa, Triticum aestivum
  unsure (1)..(141): unsure at all Xaa locations
  Clone ID: PAT_TA_18025.pep
MALPAERRTEEAAVTGGCRVPAGQGGLPIGFRFRPTDEELLLHYLRRKALSCPLPADIIPVADLARLHPWDLPGAPDGERYFFHLPATACWRTHGGTGLAGASGVWRASGKEQLVVAPRCGQAIGXKRTLVFCRPSRARTG

SEQ ID NO: 123608 - protein, 232 aa, Triticum aestivum
  unsure (1)..(232): unsure at all Xaa locations
  Clone ID: PAT_TA_18026.pep
MALPAERRAEEAPGVGGCRVPAGQGGLPIGFRFRPTDEELLLHYLRRKALSCPLPADIIPVADLARLHPWDLPGEADGERYFFHLPATGCWRKGGGAGRAGGSGVWRASGKERLVVAPRCGRPIGAKRTLVFCRPGGARTGWAMHEYRLLPAGLAAYATAKSLHAAKDWVVCRVFKKATPARHGTAGRRSGXADADMTPASPSPASSCVTESRSGMEEDDDETASNSPRRED

SEQ ID NO: 123609 - protein, 150 aa, Triticum aestivum
  Clone ID: PAT_TA_18027.pep
MAGSRRGGDEEACRVGLLDGHGGAKKDDWQVVDGGEGSSKLGRRVLEESKKLWVIVAPAMFSRIVTFSMNVITQAFAGHLGDLELAAISIANTVVVGFSFGLMLGMASALETLCGQAFGAKKYHMMGIYMQRSWIVLLGCAVLLLPCTSS

SEQ ID NO: 123610 - protein, 190 aa, Triticum aestivum
  unsure (1)..(190): unsure at all Xaa locations
  Clone ID: PAT_TA_18028.pep
QTLRTLLPRLAPHPRIRRGAXXPLPRRIWRLPLLRSSLPPEXPGGLVAEDSKFVPLNAEDPMYGPPAILLIGFDKSEAVKIQEFLKELDGDFLKVIRCTEEMTKQTLWDAMHTEQPNVEAVKIMKSPQRICIFSGLTGEEMMMFINAFPETGLEQAAFAALVPNSAEKVLAEVIEEIMGDHEMLTGKNSA

SEQ ID NO: 123611 - protein, 84 aa, Triticum aestivum
  Clone ID: PAT_TA_18029.pep
GSETTEPGDDSNHPHTTPGFQIYAALTNEPWRPGDMEASGCSKKGNCKDSDKLRFLTDEFSSEWHNDGRQSKPCISYSTSARPR

SEQ ID NO: 123612 - protein, 257 aa, Triticum aestivum
  Clone ID: PAT_TA_18030.pep
EELVSCLGRASSWEGSRARIGNASCAEKSYGRCGYSEKKEFLVCLCSGGNCSSSGAAAGYPNRNPPSSESKRKYKMIIAGSVAGAAVFIALAAVAVLFIRKRPTRPVVNSSSKLLKYRYSGSGGTPTRSRGGDMESGSSQDMGNRFSYEELEEATDSFNENRELGDGGFGTVYKGYLGDGRVVAVKRLYNNSYRRVEQFVNEAARCARRSGRCWTCSGPSRMTAWVTKTVEAKARRTSPSPSLPTRCTLPGTAGTPP

SEQ ID NO: 123613 - protein, 355 aa, Triticum aestivum
  unsure (1)..(355): unsure at all Xaa locations
  Clone ID: PAT_TA_18031.pep
RGTTTRFTCGHMECVSSQDMGNRFSYEELEEATDSFXENRELGDGGFGTVYKGYLGDGRVVAVKRLYNNSYRRVEQFVNEAAILARLRHPNLVMFYGCTSKESRELLLVYEFVQNGTVADHLHGPRAAERALPWPLRLIIAVESAAALTYLHAIEPPIVHRDVKTNNILLDTDFHVKVADFGLSRLFPLDATHVSTAPQGTPGYVDPEYHQCYQLTDKSDVYSFGVVLVELISSKPAVDITRQRNEINLAGMAISKIQKCRLEELVDVELGYXSDPAARKMMTMVAELAFRCLQQNGEMRPPIREVLDVLRAIQDECLGHKDGGGKGKKDFAEPFSPNTVHAPWDSTTTTPNTSQ

SEQ ID NO: 123614 - protein, 85 aa, Triticum aestivum
  Clone ID: PAT_TA_18032.pep
RRRGAPPAPAKKEKSILDFIVSAIVKDEQEFIETNPLLNKVDGPAPSAGGTASRKAGGTTAGKKPAADSEGGGGFNLGGLFAKKG

SEQ ID NO: 123615 - protein, 119 aa, Triticum aestivum
  Clone ID: PAT_TA_18033.pep
MASVGFGSSVAAVAPASSAGRSSLRPQRTRLAVPAATRGTPAPAKKEKSILDFIVSAIVKDEQEFIETNPLLNKVDGPAPSTGGTASRKAGGTTSGKKPAAGSEGGGGFNLGGLFAKKG

SEQ ID NO: 123616 - protein, 120 aa, Triticum aestivum
  Clone ID: PAT_TA_18034.pep
MASVGFGSSVAAVAPASSTAGRTSLRPQRTRLAVPAATRGTPAPAKKEKSILDFIVSAIVKDEQEFIETNPLLNKVDGPAPSAGGTASRKAGGTTAGKKPAADSEGGGGFNLGGLFAKKG

SEQ ID NO: 123617 - protein, 195 aa, Triticum aestivum
  Clone ID: PAT_TA_18035.pep
LITWGQRLEAAVRRRMSSSEPTESEPKLTKSSSSDKRRMSSPAPLESDPHASCDGGHHGLVPPTGTKVGHQPLPLQPPLAFPSLTTSGIHGAAAAYVGHRHWPLPAGHRWNSWRCLRLGCPPMGSMAPPPSPPGLATDGIHGSTTEGTRGFAAAAMVGLPQGRSATSARMRAPAWPRDRLHLPLVVRPPGPKMGT

SEQ ID NO: 123618 - protein, 289 aa, Triticum aestivum
  unsure (1)..(289): unsure at all Xaa locations
  Clone ID: PAT_TA_18036.pep
MTNGYLFREYLGAHSTGVRFSDVPVNPGVSWGYILAFAIDYTPVASSXTPAPTNGVFSAFWDTANLSRADVAAIKTAHPNVSVMAGLGGDSVLDIVKVSFAPASVDSWVANAVASLSRLINEYGLDGVDVDYERFAAGVSVDTFVECVGRLLTRLKAAFPNITTSIAPFEDDTVQRYYRALWSRYSGVIDYVNFQFYGYGANTDVPTYVMFYDRQTGFYPGARVLASLQTGKTTEELGLLSPDQGIAAAKELLRQNKLPGFFIWSADSSKQSTYKFTYETRAQEIVANH

SEQ ID NO: 123619 - protein, 288 aa, Triticum aestivum
  unsure (1)..(288): unsure at all Xaa locations
  Clone ID: PAT_TA_18037.pep
MTNGYLFREYIGAQFTGVRFSDVPVXNTGVSFHFILAFAIDYLASQQSKPTPTNGVFKPFWDTGNLTPAAMAAAKAAHPNLSIMVSLGGDTVQNTGVNATYAPTSVDSWVANAVSSLSAMINQYGLDGVDVDYEHFGTDVDTFVEGIGRLLTQLKARFPNIRTSIAPYELPVNQKYYQALWRKYSGVIDYVNFQFYGYGANTXVQYYVQFYDEQARNYPGSGGTKLLASFKTGDVTGLLSPDQGISGAKELQRQGKLPGIFIFSADSSKMSPYGFKYETQAQQIVANH

SEQ ID NO: 123620 - protein, 126 aa, Triticum aestivum
  unsure (1)..(126): unsure at all Xaa locations
  Clone ID: PAT_TA_18038.pep
DAWATVQLPILSSRVPSLQPKQSTTQPPPEEHEEMGSGTGKVVCVTGGSGYIASWLVKFLLQRGYTVRATVRDTADPKKTLHLQALDGAKDRLHLFKASLLEEGSFDAAVXGCDCVFHTGSPFYHN

SEQ ID NO: 123621 - protein, 233 aa, Triticum aestivum
  unsure (1)..(233): unsure at all Xaa locations
  Clone ID: PAT_TA_18039.pep
MAGDGELKLLGVWTSPFVIRVRVVLNLKSLPYEYVEESLGNKSALLLGSNPVHHSVPVLLHGGRPVNESQVIVQYIDEVWSGAGPSVLPADPYERAVARFWAAYVDDKVGPAWTGMLFSCKTEEERAEAVSRAVAALETLEGAFAECSKGKAFFGGDAIGFVDVVLGGYLGWFGAIDKIIGRRLIDPARTPLLARWEERFRAADAAXGVVPDDADKMLEFLPTVLAWVAAKAK

SEQ ID NO: 123622 - protein, 111 aa, Triticum aestivum
  Clone ID: PAT_TA_18040.pep
YSNFSFGWVNVKDVALAHILAYEVPSANGRYCMVERVAHHSEIVKIIHEMYPNFPVPDKCADDAPFVPIYQVSKDKIRSLGMELIPLETSLKETIESLREKGFVTSESSHL

SEQ ID NO: 123623 - protein, 63 aa, Triticum aestivum
  Clone ID: PAT_TA_18041.pep
GRVGGRVGGRVGADDAPFAPIYQVSKDKIRSLGMELTPLETSLKETIESLKEKGFVTSESSHL

SEQ ID NO: 123624 - protein, 109 aa, Triticum aestivum
  Clone ID: PAT_TA_18042.pep
GYIKNLREAARSDGKAAVNLMKLTLFRQYYVVVICYIYFTRVVVYALVTITSYRYLWTSVVAGEIATLAFYVFTGYRFRPEVHNPYFAIDDDEEEAAAEALKLDDEFEL

SEQ ID NO: 123625 - protein, 345 aa, Triticum aestivum
  Clone ID: PAT_TA_18043.pep
SPTDPSSPSESPHLPSRRRRKEHGEMSSGMGKVVCVTGASGYIASWLVKLLLHRGYTVRATVRDTADPKKTLHLQALDGAKDRLHLFKASLLEEGSFDAAVAGCDCVFHTASPFYHNVKDPKAELLDPAVNGTLNVLRSCKKASIKRVIITSSMAAVAYNGKPRTPDVVVDETWFSSAEVCEKNEQWYVLSKTLAEEAAWKFANDNGFEIVTINPAMVIGPLLQPTLNTSAEAILKFINGSSSTYPNFSFGWINVKDVALAHILAYEVPSTNGRYCMVERVIHHSDLVKIIHEILQPLSSSRAPGRPLNHTTTRAFCNHFHQRLLRSPFVAPHISRTCQWRETAS

SEQ ID NO: 123626 - protein, 447 aa, Triticum aestivum
  unsure (1)..(447): unsure at all Xaa locations
  Clone ID: PAT_TA_18044.pep
MDVDCEVSAAAATAVTNGLGGGEQAAAAPVSVDQLDVEAYAAQYSGRTRVARLLFIAERCGVEAIQLEALRMAHDEARAREDTVLYLDAVLKINGRLGPRYRHDQAWVDSVNRRAEQRKEKLETELNGYRTNLIKESIRMGYNDIGDFFYAHGHLSEAFKSYIRTRDYCTTSKHIVQMCMHVILVSIELGQFAHVTNYVSKAEQTPDTLDAVIVAKLRAAAGLANLETKKYKLAARKFLEXTGPELGSNYSEVIAPQDVAVCGGLCALAPVDRPQLKRKLLDDLACPTDDELVSSELNAKRCLSPPPLGNSLVVLGQRVPWLLLGFRRREQLGTLYNDIRHKAIIQYTLPFISVDLNTMASAFKSSVSMLEKELAALITENKIQARIDSHNKILYARHADQRNATFQRALQTGNEFERDIKAMLLRANLIKHDFNQKNWPGQRKMNL

SEQ ID NO: 123627 - protein, 221 aa, Triticum aestivum
  Clone ID: PAT_TA_18045.pep
MGDTGANMGHWAGIYGVGGNGAAAAEGSVVTVSSPTSGGSGGGSPTRSAPGVEGGRVGKPARRRSRASRRAPVTLLNTDTTNFRAMVQQFTGIPSGPYGPAGAGGGPVISFGAGGGDYGLGGGMPVRPSPSSAVMSFDHLGHHRPSAATSSLQQQQHQQSQLFRPQQQQQYADYGGGGADMSFLHGFESSAEDRLLLQSIQAAQMLPRPASTNTPNGYNFG

SEQ ID NO: 123628 - protein, 116 aa, Triticum aestivum
  Clone ID: PAT_TA_18046.pep
KLSLWGCSAIDALYVKCPELIDLNLNTCTNLHPERLLLQCPTLKNVHAFGCQDMLIGAIKNQVLNEFAAAEPHLPCKRLADGSKRVQLSQFPQEQLPEDKIWIGFKRSECIVHLDS

SEQ ID NO: 123629 - protein, 151 aa, Triticum aestivum
  Clone ID: PAT_TA_18047.pep
MAQLMDKAKGFVAEKISGVQKPEADLSDLSVQHVGRDGATLSGRLDVRNPYSHTIPICEISYSLKSAGRDVASGTMPDPGSLVASDTTSLDIPVKVPYDFLMSLVKDAGKDWDLDYEMRVGLTVDLPIVGNFTLPLTKAGELKLPTLSDLF

SEQ ID NO: 123630 - protein, 420 aa, Triticum aestivum
  unsure (1)..(420): unsure at all Xaa locations
  Clone ID: PAT_TA_18048.pep
MTGGRAVLLLVVSALFAQIYASDPLFHESFDEGFQGSWIVSGKEEYSGVWKHEKSDGHEDYGLLVSEPARKYAIVKELDSPVTLKDGTVVLQFEVRLQNGLECGGAYLKYIRPQEAGWDAKEFDNDTPYTIMFGPDKCGSTNKVHFILKHKNPKTGKYVEHHLKSPPSVPYDKLSHVYTAILKPDNEVRILVDGVEKSKANFLSADDFEPALIPSKTIPDPDDKKPEDWDERAKIPDPVAVKPDDWDEDAPMEIVDEEATKPEGWLDDDPEEIDDPEAAKPEDWDDEEDGEWEAPKMDNPKCEVAPGCGEWKKPMKDNPAYKGKWHAPLIDNPNYKGIWKPQEISNPEYFELDKPDFDPIAAIGIEIWTMQDGILFDXILIADXEKVATSVREKTWEPQFDAEKEKQKAXEAAAGASEGL

SEQ ID NO: 123631 - protein, 319 aa, Triticum aestivum
  Clone ID: PAT_TA_18049.pep
RPGRVKTIPDPDDKKPEDWDERAKIPDPAAVKPDDWDEDAPTEILDEEATKPEGWLDDEPEEVDDPEAAKPEDWDDEEDGEWEAPKIDNPKCEEAPGCGEWKRPMKDNPAYKGKWHAPLIDNPNYKGIWKPQEIPNPEYFELDKPDFDPIAAIGIEIWTMQDGILFDNILIADNEKVATSILEKTWKPKFDVEKEKQKAEEAAAGASEGLSEFQKKIFDILYKVADIPFLEPYKTKIIDVIEKGETQPNITISILASVIVVIVTVLFRALFGGKKPVAPVKPAAETKKPSAVVPDAAAGSSGDMEDDKDAPRRRSRRDA

SEQ ID NO: 123632 - protein, 492 aa, Triticum aestivum
  unsure (1)..(492): unsure at all Xaa locations
  Clone ID: PAT_TA_18050.pep
MTTGGRAVLLLPLLVASALFAQIRGXSDPLFHESFDEGFEGSWVVSGKEXYSGVWKHEKSDGHEGLWSPSSVEPAKEICHSQRSLDSPVTLKXDGTVVLQFEVRLQNGLXCGGAYVKYIRPQEAGWDXAKEFDNDTPYTIMFGPXDKGGTTNXEHLMLKAQDLRRLAKMDXRLQSPPYKTFVNFFHEYAVFCMIEPELTFLGNVVKKKRALMLFGKGXEKPDPNISNFYLGRTSLGSPFVTRPQPVPVLRRPREPIGRPCASPLREVKEGPDADGKPRXHEGQGCGTHKRSKKRGXSHDGGTHQGQRTGDNRLWTFRRSPVLGLLLRLVSIKFGILFDNILIADDEKVATAILEKTWKPKFDVEKEKQKAEEAAAADSEDLSEFQKKIFSVLYKIADIPFLEPYKIKIIDIIEKGEKQPNITISILASVAVILVTVLFRTIFGGKKPVAPVKPVAEVKKPNATEADAAGSSGDKEEKEDDTTAPRRRSRRET

SEQ ID NO: 123633 - protein, 349 aa, Triticum aestivum
  Clone ID: PAT_TA_18051.pep
MGEDKKEKPGKADGGDQKKDAAAAAQPIVLKVDLHCAGCATKVKRAIKNAPGVESVKTDTAANKVVVTGAADAAEIKERIEARTKKPVQIVSAGAASPNKDNKEKDKDKKPDAGDKPEKEKSKAADKEKGGAGAGAEKKEKKVETADKPKEEEKKPKEPKEETVTLKIRLHCDGCIDRIKRRVNKIKGVKEVTVDAAKDLVKVTGTMDTAALPGYLRDKLSRPVEVVTPGKKDGDKKDDGEKKKDKGAGAGDGGEKKDGGGGGEDKKDKSAASVAPMPMADPSMYQMPPQYGYMPYPPAPVGYYGAAPPPPNPGFYPNAGPQYPSPYATYPAHAPQMFSDENPNACSVM

SEQ ID NO: 123634 - protein, 341 aa, Triticum aestivum
  unsure (1)..(341): unsure at all Xaa locations
  Clone ID: PAT_TA_18052.pep
MGEDKKEKPGKADGADHNKDAAAPPEPIVLKVDLHCAGCATKVKRAIKNAPGVESVKTDTAANKVVVTGAVDAAEIKQRIEARTKKPVQIVSAGAASPNKDNKEKDKDNKADAGDKPEKEKSKAADKEKGGAGAGAEKKEKKVETADKPKEEEKKPKEPKEETVTLKIRLHCDGCIDRIKRRVNKIKGVKEVTVDAAKDLVKVTGTMDAAALPGYLRDKLSRPVEVVTPGKKDGDKKDXTARAAGVDDKKRALGGRGQEGQVRGVRGADAHGGPEHVPXPPQYGYMPYPPAPVGYYGAAPPPPNPGFYPNAGPQYPPPYATYPAHAPQMFSDENPNACSVM

SEQ ID NO: 123635 - protein, 211 aa, Triticum aestivum
  Clone ID: PAT_TA_18053.pep
DEVVKYSPHARAIRDVEDEELRTFFAGMSPWQFILVVAASSVGEELFYRAAVQGALADIFLRGTELMKDARGIVSLSGMVPPFVPFAQTFAAAITAALTGSLYYIATAPKDPTYVVTPVMRSHAGRQNMKKLFSAWYERRQMRKIYSPLLEGILAFYLGFEWIQTGNILAPMITHGIYSAVVLGHGLWKIQDHRRRLRQRVQEIRRGSDGL

SEQ ID NO: 123636 - protein, 140 aa, Triticum aestivum
  Clone ID: PAT_TA_18054.pep
MSHTRMLYFQAHHPHANFQDNHASVMKKEAAVGANHVQAPQKTSQGFRTTMPILSKKDDVNTDVDSVASDFIKRKHMSWALQKSTTMYPSSLRRNLEFLSQLVLSAPCFLQYESSNKRCCLEVPWISRGCVTMVYWCSYL

SEQ ID NO: 123637 - protein, 52 aa, Triticum aestivum
  Clone ID: PAT_TA_18055.pep
EDDVQIAERAVPEAVFGELGKRAAESREESSSAQENNEQQLGALERIKRRRQ

SEQ ID NO: 123638 - protein, 345 aa, Triticum aestivum
  Clone ID: PAT_TA_18056.pep
RKSGRYRGGKGGWVTYLTKFVKRYQRSKLERARELFTEAVEKAPPHEKKALYLQYAKLEEDYGLAKRAMNVYDEAVRAVPNTEKMSMYEIYIARAAELFGVPRTRQIYEQAIESGLPDKDVMVMCMKFAELERNLGEIDRSRAIYIHASNYADPNSHPEFWKKWNDFEIQHGTDASFREMLRIKRTVAASRSQTHFILPEYLMQRDQKLNMDEAVDTLTRAGVPQDEMAALERQLASGPSPAPAAAAPSSSTTPANRMMNFVSAGVEARAESSTQQAAANNEDIELPDEESDEEDDVQIAERAVPEAVFGELGKRAAESREESSSAQENNEQQLGALERIKRRRQ

SEQ ID NO: 123639 - protein, 183 aa, Triticum aestivum
  Clone ID: PAT_TA_18057.pep
MALAAAFARAATRILHGGFPPHATSAALYTRSRLFSDLPAGNESSAPGAEEEQWEAAEAEILREVGPVVELVKDILHSRRYGDGAFLSPEDEKVVVEKVLAHHPRSEDKIGCGLDAIMVNRHPDFKSSRCLYVVRTNGDWADFSYRKCLRAYIKGAYPSHADKFINKHHLVQRRSHLGLLPPK

SEQ ID NO: 123640 - protein, 61 aa, Triticum aestivum
  Clone ID: PAT_TA_18058.pep
MSWLGVQPLKKFNAPFLKPYWPFFAAGVVIAYGVNSAQNAMMNSAEFKNDPRNPNAKTGGH

SEQ ID NO: 123641 - protein, 131 aa, Triticum aestivum
  Clone ID: PAT_TA_18059.pep
THGPSFPAFISRGDDTVNKRVLAAPDAWSGKSHMCVAVNQGPAELSVLPRRWQIVIDAAIGTGRKHLGVVTKRAKAIVTVHAANCLVIFRATALICMWSLLTPTDGAFGYWIYSVGDGSTGYLQPVWMTVM

SEQ ID NO: 123642 - protein, 247 aa, Triticum aestivum
  unsure (1)..(247): unsure at all Xaa locations
  Clone ID: PAT_TA_18060.pep
MAGEGDDVKLLGAAVSPFAVRVRMALHLKGVSYEYLEQDLFDKGELLLATNPVLKKVPVLIHAGRPVCESLAIVKYVDEVWADGASLLPADXYGRAVARFWAAYIDDKLFPAWIGILRAATEEDRAEKLEAALALFKIPPGWXXXXTLSTLYLRHCAQCSGGKDFFAGDSVGYLDLALGCNLFWFEALREMFGVTVIDAGRTPRLAAWAERFVETDAAKKAAPPMKSMVDYAGKLRSMWAAAAAAAK

SEQ ID NO: 123643 - protein, 234 aa, Triticum aestivum
  Clone ID: PAT_TA_18061.pep
MAGEGDDVKLLGSVVSPFAVRVRMALHLKGVSYEYLEQDLFHKGELLLAANPVLKKVPVLIHAGRPVCESLAIVEYVDDVWADGASLLPADSYGRAVARFWAAYVDDKLFPAWIGILRASTEEDRAERLDATLAVVGLMEDALAQCSGGKDFFAGDSVGYLDLALGCNLSWFKALREMFGVTVIDASRTPRMAAWAGRFEETETAKKAAPPIKSIVEHPGKLRAIWAAAAPAAK

SEQ ID NO: 123644 - protein, 233 aa, Triticum aestivum
  Clone ID: PAT_TA_18062.pep
MAGEGDVKLLGTVVSPFAVRVRMALHLKGVSYEYLEQDLFDKGELLLASNPVHKKVPVLIHAGRPVCESLAIVEYVDEVWADAASLLPADPYGRAVARFWAAYVDDKLFPAWIGILRAATEEDRAEKLDAALAVVGPMEDALAQCSGGKDYFAGDSVGYLDIALGCNLFWFEALREMFGVTVIDAGRTPRLAAWAERFVQTEAAKKAAPPMKSMVDYAGKLRSMWAAAAAAAK

SEQ ID NO: 123645 - protein, 126 aa, Triticum aestivum
  Clone ID: PAT_TA_18063.pep
SVYVATKRYVAEFSKSLSVEYQSACIDVQCQIPFIVETNMVSSAVKNSFFLRPWVLSPDAYARAAVRWIGHGTLCIPNFAHRLQWWFTCLFPDSFKDMNLLKRNLQHRDIFRRIKPLRETRANSRE

SEQ ID NO: 123646 - protein, 78 aa, Triticum aestivum
  Clone ID: PAT_TA_18064.pep
SLDHQSCSIPSKTSRVPVNETRNPKPKGGVWWARQPFDYKVWKVKLQKWNGCGASGAGQLGWCGGKRRGKLRSAIWRW

SEQ ID NO: 123647 - protein, 69 aa, Triticum aestivum
  unsure (1)..(69): unsure at all Xaa locations
  Clone ID: PAT_TA_18065.pep
MSDWGPXVIAGVLFVLLSPGLLLQLPGKHHFVEFGNMHTSAMAILVHAIIYFALIALFVIVIGVHITTD

SEQ ID NO: 123648 - protein, 256 aa, Triticum aestivum
  Clone ID: PAT_TA_18066.pep
FFFFFLSKHISLLIKKLHTRQQTNMITCTTTSSCKQQEQNRTEDRQESDGSDEKKKTEEGEEQLNWSWPAGVMELSRSLVSGDVHADDDDEERDEGEVDDGVDEDGHGAGVHVAELHEVVLPGELQQQPRRQQHEQHHRDHHRPPVRHPPSPSPFSDSGKLLSFSLGTNRTPAITTGRPSENLPPLPPTPASFFLSLFLASSSGKRKEGNGAEQTRSSGSRGGGWCDCGGKRREGSLSSPFPFVGTFPSSEFLSPG

SEQ ID NO: 123649 - protein, 75 aa, Triticum aestivum
  Clone ID: PAT_TA_18067.pep
NKLRPCLIMQALVSCRHNKLKHSKGQKNSKIKLQQEPSKCSALLFLGTRCLPLLCSGARTATLASYGDLRGAGVE

SEQ ID NO: 123650 - protein, 139 aa, Triticum aestivum
  Clone ID: PAT_TA_18068.pep
MEEVTEAVNNLTIGEGAAATAGAEGHKKNRIQVSNTKKPLFFYVNLAKRYMQLHEEVELSALGMAIATVVTVAEILKNNGLAVEKKIMTSTVDVKDDTRNRPIQKVKIEILIGKTEKFDELMAAAAEEREAAGAEEEQS

SEQ ID NO: 123651 - protein, 145 aa, Triticum aestivum
  Clone ID: PAT_TA_18069.pep
LQLPPPPPPPPPPPWLFWPLRPPAAAGAPARWTRARPPTGSARGGSCASSRRAAAPPASGAPAAAPAPPGRPSRTGWSRASRGGPAPAGRGTRRPWPRRSASGGAAAAPTGPAAARSCSPPPAAAPAAPAQAPAPASEAREGSRS

SEQ ID NO: 123652 - protein, 152 aa, Triticum aestivum
  Clone ID: PAT_TA_18070.pep
MAAKLTQEQADECKEVFDLFDGDEDGRIAAGELVTALRSLGQNVDEAEARGFLEDAGAGGAGAVAIDLPTFLAVAARKANAGVSAKGLAQCLDAFDDDGSGVIPAEQLRQVMLTHGDRLTEEEADELVRKADPRGEGRVQCKELVKVLMNNK

SEQ ID NO: 123653 - protein, 146 aa, Triticum aestivum
  unsure (1)..(146): unsure at all Xaa locations
  Clone ID: PAT_TA_18071.pep
TXNVLITQRKEQPHLAILMDFESARPARRAIRSQAEALQLQEWASEHCSAHFRAPELWECPPHADIDERTDVWXSPFDYELDESAGESLVTVIKSAQVKWPTETGSSYPDTLRQFVTWMLQPHPAVRPNIDDIIIHVDKLIAKHSI

SEQ ID NO: 123654 - protein, 351 aa, Triticum aestivum
  unsure (1)..(351): unsure at all Xaa locations
  Clone ID: PAT_TA_18072.pep
MGCSFSGLNALYDTVGGGGGDIWVNDYRFRVLRRLGDAGPAGSSVFLVKEVVAAAAVSDGTAGAGPGAAGLAKKKGVDPSHISADGTYALKKVFIQSDQHLELVRQEIRVSSQFSHPNLLPLLENAIIAVKGVQDGSQNHEAYLLFPVHLDGTLQDVTKSMQEKKEYLSTITILQIFRQLCAGLKHMHSFEPPYAHNGVKPDNVLITQRKEQPHLAILMDFESARPAXQQTLQLQEWAXHCSAHFRAPELWECPPHADIDERTDVWSLGCTLYAMMYGKSPFDYELDESAGESLVTVIKSAQVKWPTETGSSYPDTLRQFVTWMLQPHPAVRPNIDDIIIHVDKLIAKHST

SEQ ID NO: 123655 - protein, 86 aa, Triticum aestivum
  Clone ID: PAT_TA_18073.pep
DPCRFSLGREEDKTSGKFSDISFGAGRYSCLGQDYAFMQIKVIWSYLLRNFELELISPFPELENDKILPGPRGKVMVAYRRRSIVN

SEQ ID NO: 123656 - protein, 140 aa, Triticum aestivum
  Clone ID: PAT_TA_18074.pep
SADAWADAWAATGNNATLFNSGVMVIEPSNCTFQLLMEHINEITSYNGGDQGYLNEIFTWWHRIPKHMNFLKHFWEGDSEEAKAKKTQLFGADPPNLYVLHYLGLKPWLCFRDYDCNWNNFMMREFASDVAHSRWWKTHD

SEQ ID NO: 123657 - protein, 178 aa, Triticum aestivum
  unsure (1)..(178): unsure at all Xaa locations
  Clone ID: PAT_TA_18075.pep
LCLGPSLHKYKPSSVAVLLAAALSLGGGQQFFWVGLANKLSVYVNSLTKNTECFFSRQKKKKKKKKKKKKKKKKKKKKKKKKKKKKKKKKKNXIKKKNIFFYNKLKKKKKKKRGAPFRVPIFRRGGGEGFFFFLGPPNFFPGPGFSPRGGGKNRGVPPFIPLGNTPFLRGGGFWKRPP

SEQ ID NO: 123658 - protein, 78 aa, Triticum aestivum
  Clone ID: PAT_TA_18076.pep
CLLRSRLKAGLEWERRQAEKANFTDGHWKRNITDKRLKICFEKFCFWESMLWHWGEAPNNSTKKASTPALPAATLSSS

SEQ ID NO: 123659 - protein, 291 aa, Triticum aestivum
  unsure (1)..(291): unsure at all Xaa locations
  Clone ID: PAT_TA_18077.pep
GTRHRNSLESAGWKVRIRGGGRLPRPERDAYNEWNYSKFRLWQLTDXDKIIFVHADRLLLSNIDCLFTMPERRATGDLATLFNAGVMVIEPANCTFQLLPNLTNEITSYQAPHPGYLNEIFTWWHRIPKHMNFLKHFWEGDEEEVKAKKTQLFGGNPPILYVLHYLGRKPWLCFRDYDCNWNVPMLREFASDIAHSRWWKVHDKMPKKLQSYCLLRSRXRAGLEWERXRQAEKANFTDGHWKRNITDKRLKICFEKFCFWESMLWHWGEAPNNATKKAPTPALPAATLSSS

SEQ ID NO: 123660 - protein, 138 aa, Triticum aestivum
  Clone ID: PAT_TA_18078.pep
YLKLGSCGLAQNPSQQQPQEQVPLVQQQQFLGQQQPFPPQQPYPQPQPFPSQQPYLQLQPFPQPQLPYSQPQPFRPQQPYPQPQPQYSQPQEPISQQQQQQQQQQQILQQILQQQLIPCMDVVLQQHNIAHGRSQVLQ

SEQ ID NO: 123661 - protein, 90 aa, Triticum aestivum
  Clone ID: PAT_TA_18079.pep
MNFNSALEYLFIELYLSFSQVLLVVGILQGEVGPMISVMKIEMTRLESCSDVGGLHVPIQDIKEAVELPEGKVYIQSLEGGLAILGTEQL

SEQ ID NO: 123662 - protein, 93 aa, Triticum aestivum
  Clone ID: PAT_TA_18080.pep
MLFFSYFKELVGKEVTVELKNDLAIRGTLHSVDQYLNIKLENTRVVDQDKYPHMLSVRNCFIRGSVVRYVLLPQDGVDIDILHDATRREARGG

SEQ ID NO: 123663 - protein, 190 aa, Triticum aestivum
  unsure (1)..(190): unsure at all Xaa locations
  Clone ID: PAT_TA_18081.pep
AXQTXLLNQHPGYHARAPXXQLEGRSLHLXRARVQXGAPGRXERRSDLDLGAIAEGGGAWTLGAIAGGGGAWTLAQSPEVGAPGPWRSRRMWGRGRGHGQGWRSRARAEVELELEVEHDAGFQFKLRVLLSFCTISPGRNKVASDLHFGTEGVYIKGVFGSPPQPPTPQLSKLHRSTTIGALEADWYQDW

SEQ ID NO: 123664 - protein, 107 aa, Triticum aestivum
  Clone ID: PAT_TA_18082.pep
FGPRQVGCASVQVPDREPVPGESFCRSAAAAARSAALRSKSRIASPFPATRSPVAAPRLRRSTVKMLAGAESLMPLHSAVAGARLRSCIAADSSCWSCLSQGLIKRI

SEQ ID NO: 123665 - protein, 121 aa, Triticum aestivum
  Clone ID: PAT_TA_18083.pep
MANRRYDVYRLDLGAGTLCRVDSFGGGGHALFIGMYCSLSVPTKVFPSGSIRGDSIYLSFDIAERNKTEGYHLADRSTISSDSLSSHSALQPHNLVDCLSLCSTGRIWCHFEKHLVSHCRR

SEQ ID NO: 123666 - protein, 82 aa, Triticum aestivum
  Clone ID: PAT_TA_18084.pep
NSEVPSKSSAAECFSVHCEQKSSAEERFGTIQTRASLKPLKLQNLYWRRACRSSTSHCCCSWRSLLQYLPSVIRSKALCRSS

SEQ ID NO: 123667 - protein, 129 aa, Triticum aestivum
  Clone ID: PAT_TA_18085.pep
SNLQVHPVRCSLVPLIRVTACLLDEDEPDAYWHRSVASRDASRRPNVRHPSSKCSRAVSSGDQPAQAQIHPQVQQDPPAVNNQIQHPPQAAAAASATGTQSLAVIAVLLGATNILLTVLVLMVVVVSAN

SEQ ID NO: 123668 - protein, 152 aa, Triticum aestivum
  Clone ID: PAT_TA_18086.pep
MAPKAEKKPAAKKPAEEEPTTEKAEKAPAAKKPKAEKRLPAGKTASKEGGEKRGRKKGKKSVETYKIYIFKVLKQVHPDIGISSKAMSIMNSFINDIFEKLAGEAAKLARYNKKPTIASREIQTSVRLVLPGELAKHAVSEGTKAVTKFTSS

SEQ ID NO: 123669 - protein, 68 aa, Triticum aestivum
  Clone ID: PAT_TA_18087.pep
MEMKKIACAVLIAASATVALAADGPALAPAGALAGAPAAGASAATGAFPAVGAVLGASVLSFLSYYMQ

SEQ ID NO: 123670 - protein, 245 aa, Triticum aestivum
  Clone ID: PAT_TA_18088.pep
MMAGAQEQGLKLLVPRSGVSIYAIRVQMALAMKGLAYDYLPEDPGCKSDLLLASNPVHKTLPVLIHGGRPVCESLIIVEYLDDAFTGNGASILPTDPYHRAVARFWATYVDDKMFPSCIGILNTAKQQERADKVEETLAAFGLLEAYLAECSKEEEAPFFGGVSLGLLDVALGCYLPWFEAIGRLAGTPPFLDAVRTPKLAAWAGRFRAAEPVVALLTAVDKVEEYITSVLYPKWEVALTAPATN

SEQ ID NO: 123671 - protein, 100 aa, Triticum aestivum
  unsure (1)..(100): unsure at all Xaa locations
  Clone ID: PAT_TA_18089.pep
DLTIPLAFGTKRIAVITQGADPVVVAEDGKVKTFPVILLXPKEKLVDTXNGAGDAFVGGFLSXQLVQGKSIEDCVKAGCYAANVIIQQSGCTYPEKPDFN

SEQ ID NO: 123672 - protein, 157 aa, Triticum aestivum
  unsure (1)..(157): unsure at all Xaa locations
  Clone ID: PAT_TA_18090.pep
GLGAIAGAVLSIEVLEASRAYWCSDRLGTCSMADFIEQLLHARFVQQQLGSSAHMAYRWQLSIPDFGHDDVYDIFGDISSRGLSREALEKLPHYVVADQAQAQGKSGEDLSCAICLQDMVGGETARRLPNCSHAFHQLCVDXWLTSHGSCPVCRPHV

SEQ ID NO: 123673 - protein, 67 aa, Triticum aestivum
  Clone ID: PAT_TA_18091.pep
VKTFPVILLPKEKLVDTNGAGDAFVGGFLSQLVQGKSIEDCVKAGCYAANVIIQQSGCTYPEKPDFN

SEQ ID NO: 123674 - protein, 170 aa, Triticum aestivum
  Clone ID: PAT_TA_18092.pep
FYVEYLDDAPGLAGNDTSILPADPYSRAAAHVWAAYVNDKLFPSCTGILKTAKQEERASKVEETLSGLRHLEAALAECSKGEVEAPFFGGCSIGFLDIALGCYLPWFEAVGRLAGLGRLIDPARTPKLAAWAERFRVVEPVKALLPRVDELEQYITTVLYPKWNVAVTGN

SEQ ID NO: 123675 - protein, 247 aa, Triticum aestivum
  unsure (1)..(247): unsure at all Xaa locations
  Clone ID: PAT_TA_18093.pep
MMAGAQEQGLKLLVARSGVSIYAIRVQMALAMKGLAYDYLPEDPGCKSDLLLASNPVHKTLPVLIHAGRPVCESLIIMEYLDGAFPGDGASILPADPYRRAVARFWAAYIDDKMFPSCIGILNTAKQQERAXKVEETLAAFGLLETALVESSKEGEAEALFFGGVSLGLLDLALGCYLPWFEAIGRLAGTPPFLDAARTPKLAAWAGRFSAAEPVIALLTAVDKVEEYITKVLYPKWEVALTAPPTN

SEQ ID NO: 123676 - protein, 249 aa, Triticum aestivum
  Clone ID: PAT_TA_18094.pep
MMAGAQEQGLKLLGAASGVSPYVIRAQMALGIKGLTYDYLPEDPRCKSDLLLASNPIHKKLPVLIHGGRPVCESLIILEYLDDAFPENGASILPADPYRRVVARFWAAYVDNKLFPSCIGILKTGKPQERADKVEETLSALGLLEAALAEYSKEGDAEASFFGGGSLGLLDIALGSYLPWIEAIGHLAGMPPFLDAARTPKLATSAEWFRAAEPVRALLPAVDKVEEYITTVLYPKWKAFRALTAPATN

SEQ ID NO: 123677 - protein, 248 aa, Triticum aestivum
  unsure (1)..(248): unsure at all Xaa locations
  Clone ID: PAT_TA_18095.pep
GAQEQRLKLLGPGTGVSMYTIRVQMALCIKELSYDFLPEDPWEXSDLLLASNPVYKESSPSSSTLARPVCESLIIVQYLDDAFAGNSTSILPTDPYSRAVARFWASYIDDKLFPSCXSGILKDGQRQHERADKVKETLAGVRXLLEAALAECSKEGEAEALFFGGGSLRLLDIALGCYLPWIEAIGHLAAMPPFLDAARTPKLAAWAERFRAAEPVRALLPAADKVEEYISTVLYPKWNAALTASATN

SEQ ID NO: 123678 - protein, 248 aa, Triticum aestivum
  Clone ID: PAT_TA_18096.pep
MVGAQEQGLKLLVPRSGVSIYAIRVQMPLAMKGLAYDYLPKDPGCKSDLLLASNPVHKTLPVLIHGGRPVCESLIIMEYLDNAFPGNGASILPADPYRRAVARFWAAYIDNKMFPSCIGILSTAKQQEKADKVEETLAAFGLLETALVECSKEGEAEAEAPFFSGVSLGLLDVALGCYLPWFEAIGRLAGTPPFLDAVRTPKLAAWAGRFRAAEPVIALLTAVDKVEEYITSVLYPKWNVSLTAPPTN

SEQ ID NO: 123679 - protein, 240 aa, Triticum aestivum
  unsure (1)..(240): unsure at all Xaa locations
  Clone ID: PAT_TA_18097.pep
QRLKLLGAASGVSPYVIRAQMALGIKGLTYDYLPEDPRCKSDLLLASNPVHKKLPVLIHGSRPVCESLIILEYLDDAFPGNGVSILPTDPYHRVVARFWGXYVDNKLFPSCIGILKTRKPQERADKVEETLSSLGLLEAALAECSIEEEAEALFFGGGSLGLLDIALGCYLPWIEAIGCLASMPPFLDATRTPKLAAWAERFRAAEPIWGLLPEADKVEKYISTVLYPKWKAALTAPETN

SEQ ID NO: 123680 - protein, 225 aa, Triticum aestivum
  Clone ID: PAT_TA_18098.pep
MMAGAQEQGLKLLVPRSGVSIYAIRVQMALAMKGLAYDYLPEDPGCKSDLLLASNPVHKTLPVLIHGGRPVCESLIIMEYLDDAFPGDRASILPADPYHRAVARFWAAYVDDKVTGHGSVLMGNGASAYVHGVGTVDLKFTSGRIVQLKNVQHVPAIKKNLVSGSLLCREGFKLVFESNKLVVTKYGLFVGKGYESGGMFRLSLADFCNKVVNHIHSSINESEVW

SEQ ID NO: 123681 - protein, 251 aa, Triticum aestivum
  unsure (1)..(251): unsure at all Xaa locations
  Clone ID: PAT_TA_18099.pep
MAGGEELKLLGWWAPGVSPFVLRAQMALAVKGLSYEYLPEDRWCKSDLLMASNPVYKKVPVLIHCGRAVCESLLILXEYLDDAPGLAGNGTSILPADPXYSRAVARFWAAYVNDKLFPSCIGILKTVKQEERACKVXSETLSXGLRHLEAALAECSKGEEEXPFFGGGSIGXFLDIALGCYLPWFECSSAXAGLGPLIXDPARTPETSLHGLQRFXVAEPVKALLPGVDKLEXEYITTVCFIQNWNIAVTW

SEQ ID NO: 123682 - protein, 253 aa, Triticum aestivum
  unsure (1)..(253): unsure at all Xaa locations
  Clone ID: PAT_TA_18100.pep
MMAGAQEQGLKLLVPRSGVSIYAIRVQMALAMKGLAYDYLPEDPGCKSDLLLASNPVHKTLPVLIHAGRPVCESLIIMEYLDDAFPGDGASILPADPYRRAVARFWAAYVDDKMFPSCIGILNTVKQQERADKVEETLAAFRLLETALVESSKEGEAEALFFGGVSLGLLDLALGCYLPWFEAIGRLAGTPPFLDAARTPKLAAWAGRFRAAEPVIALLTAVDKVXEYITKVLYPKWNVALTAPPTNFRTEGV

SEQ ID NO: 123683 - protein, 177 aa, Triticum aestivum
  Clone ID: PAT_TA_18101.pep
MVGAQEQGLKLLVPRSGVSIYAIRVQMALAMKGLAYDYLPEDPRCKSDLLLASNPVHKTLPVLIHSGRPVCESLIIVEYLDDAFPGNGASILPADPYRRAVARFWAAYVDNKMFPSCIGILNTANQQERADKVEETLAAFGLLEAALAECSKEGEAEAPFFGGGSIGFLDIALGCYI

SEQ ID NO: 123684 - protein, 325 aa, Triticum aestivum
  unsure (1)..(325): unsure at all Xaa locations
  Clone ID: PAT_TA_18102.pep
MEAETAAKRARENEGAAAADGAGEQAGISAVIPGWFSEISPMWPGEAHSLKVEKVLFQGKSDYQDVLVFQSSTYGKVLVLDGVIQVTERDECAYQEMITHLPLCSIKDPKKVLVIGGGDGGVLREVSRHSSVEQIDICEIDKMVVDVSKQFFPHLALGFEDPRVSLHIGDGVAFLKNAPEGTYDAVIVDSSDPVGPAQELFEKPFFQSVSRALRPGGVVCTQAESIWLHMHIIEDIVTNCRQVFKGSVNYAWTTXVPTYPSGVIGFMLCSTEGPSVDFQHPVFSIEEDEYSTKSKGPLKFYNSEFHTASFCLPSFARRVIEAKAN

SEQ ID NO: 123685 - protein, 244 aa, Triticum aestivum
  unsure (1)..(244): unsure at all Xaa locations
  Clone ID: PAT_TA_18103.pep
MAGGEELKLLGWWAPGVSPFXLLRAQMALAVKGLSYEYLPEDRGCKSDLLIASNPVYKKVPVLIHDGRPVCESLLILEYLDDAVGLAGHGKPILPADPYSRAVARFWAAYVNDKMFPSCTGILKTVKQEERAGKVEETLSGLRHLEDVLAECSNGEVEAPFFSGDSIGFLDIALGCYLPWFEAVGRLAGVDPLIDQARTPKLAACAERFRVAEPVKALLPGVDELEEYITTVLYPNWNIAVTGN

SEQ ID NO: 123686 - protein, 268 aa, Triticum aestivum
  Clone ID: PAT_TA_18104.pep
MAGGEELKLLGWWAPGVSPYVLRAQMALAVKGLSYDYLPEDRWSTSDLLIASNPVYKKVPVLIHNGRPVCESLLILEYLDDAVGLAGNGKPILPADPYSRAVARFWAAYVNDKVSSFHTRITSRCAWSCTSQLALLPQLFPSCTGILKTTKQEERAGKMEETLSGLRHLEAVMAECSEGEAEAPFFGGDAIGFLDIALGCYLPWFEAAGRLAGLGPIIDPARTPKLAAWAERFSVAEPIKALLPGVDKLEEYITTALYPKWNIAVTGN

SEQ ID NO: 123687 - protein, 245 aa, Triticum aestivum
  Clone ID: PAT_TA_18105.pep
MAGSEELKLLGWWAPGVSPFVLRAQMALAVKGLSYEYLPEDRGCKSDLLIASNPVYKKVPVLIHDGRPVCESLLILEYLDDAPGLAGNGTSILPTDPYSRAVARFWAAYVNGKLFPSCIGILKTAKQEERAGKVEETLSGLRHLEGVLAECSKGEAEAEAPFFGGDTIGFLDIALGCYLPWFEAVGRLAGLGPLIDPARTPKLAAWAERFRVAEPVKALLPGVDELEEYITTVLYPKWNIAVTGN

SEQ ID NO: 123688 - protein, 277 aa, Triticum aestivum
  unsure (1)..(277): unsure at all Xaa locations
  Clone ID: PAT_TA_18106.pep
TRVEKVLFQGKSDYQNVLVFQSSTYGKVLVLDGVIQVTERDECAYQEMITHLPLCSIKDPKKVLVIGGGDGGVLREVSRHSSVEPESEXCEIDXMVVDVSXKQFFPRLALGFEDPRVSLHIGDGVAFLKNAPEGTYDAVIVDSSDPVGRAQELFEKPFFESVSRALRPGGVVCTQAESIWLHMHIIEDIVTNCRQVFKGSVNYAWTTVPTYPSGVIGFMLCSTEGPSVDFQHPVFSIEEDEYSTKSKGPLKFYNSEFHTASFCLPLFARRVIEAKAN

SEQ ID NO: 123689 - protein, 324 aa, Triticum aestivum
  Clone ID: PAT_TA_18107.pep
MEAETAAKRARENEGAAAADGAGEQAGISAVIPGWFSEISPMWPGEAHSLKVEKVLFQGKSDYQDVLVFQSSTYGKVLVLDGVIQVTERDECAYQEMITHLPLCSIKDPKKVLVIGGGDGGVLREVSRHSSVEQIDICEIDKMVVDVSKQFFPHLALGFEDPRVSLHIGDGVAFLKNAPEGTYDAVIVDSSDPVGPAQELFEKPFFESVSRALRPGGVVCTQAESIWLHMHIIEDIVTNCRQVFKGSVNYAWTTVPTYPSGVIGFMLCSTEGPSVDFQHPVFSIEEDEYSTKSKGPLKFYNSEFHTASFCLPSFARRVIEAKAN

SEQ ID NO: 123690 - protein, 244 aa, Triticum aestivum
  unsure (1)..(244): unsure at all Xaa locations
  Clone ID: PAT_TA_18108.pep
MAGAQELKLLGXWWAPGVSPFVLRAQMALAVKGLSYEYLPEDRGCKSDLLIASNPVYKKVPVLIHDGRPVCESLLILEYLDDAVGLVGNGKPILPTDPYSRAVARFWAAYVNDKLFPSCIGSLKTTKQEERAGKVEETLSGLRHLEGVLAECSKGEVEAPFFGGDSIGFLDIALGCYLPWFEAVGRLAGLGPLIDPARTPKLAAWAERFRVAEPVKALLPGVDELEEYITTVLYPKWNVAVTGN

SEQ ID NO: 123691 - protein, 90 aa, Triticum aestivum
  Clone ID: PAT_TA_18109.pep
MNLGHVEEEVGKLREEIQRLGQQQPDGSYKVKFGVIFNDDRCANIFEALVGTLRAAKKRKVVTYDGEMLLQGVHDNVEITLFPPSTVAAT

SEQ ID NO: 123692 - protein, 243 aa, Triticum aestivum
  Clone ID: PAT_TA_18110.pep
MAGGEELKLLGWWAPGVSPYVLRAQMALAVKGLSYEYLPEDRWCKSDLLIASNPVYKKVPVLIHNGKPICESLLIVEYLDDALGLPGNGKPILPADPYSRALARFWAAYANDKLFPSCAGILKTVKQEERAGKVEETLSGLRHLEAILAECSKGEVEAPFFGGDAIGFLDIALGCYLPWFEAVGRLAGLGPLVDPARTPKLAAWAKRFRVAEPVKALLPGVDELEEYITKVLYPKWNIAVTSN

SEQ ID NO: 123693 - protein, 324 aa, Triticum aestivum
  unsure (1)..(324): unsure at all Xaa locations
  Clone ID: PAT_TA_18111.pep
MEAETAAKRAREGEGAAAADGAGEQAGISAVIPGWFSEISPMWPGEAHSLKVEKVLFQGKSDYQNVLVFQSSTYGKVLVLDGVIQVTERDECAYQEMITHLPLCSIKDPKKVLVIGGGDGGVLREVSRHSSVEQIDICEIDKMVVDVSKQFFPHLALGFEDPRVSLHIGDGVAXLKNAPEGTYDAVIVDSSDPVGPAQELFEKPFFQSVSRALRPGGVVCTQAESIWLHMHIIEDIVTNCRQVFKGSVNYAWTTVPTYPSGVIGFMLCSTEGPSVDFQHPVFSIEEDEYSTKSKGPLKFYNSEFHTASFCLPSFARRVIEAKAN

SEQ ID NO: 123694 - protein, 90 aa, Triticum aestivum
  Clone ID: PAT_TA_18112.pep
MNLGHVEEEVGKLREEIQRLGQQQPDGSYKVKFGVIFNDDRCANIFEALVGTLRAAKKRKVVTYDGEMLLQGVHDNVEITLFPPPTVAAT

SEQ ID NO: 123695 - protein, 399 aa, Triticum aestivum
  unsure (1)..(399): unsure at all Xaa locations
  Clone ID: PAT_TA_18113.pep
MPPPSPWLMPPPSPPPFSRPPPHHWNQPLASRQRRPQISLSPPCAAIVERSKRMAASNGLEGVLLGMGNPLLDISAVVDEAFLAKYDVKLNNAILAEDKHLPMYDELSSKGNVEYIAGGATQNSIRVAQWMLQTPGATSYMGCIGKDKYGEEMKSAAKAAGVTAHYYEDEAAPTGTCAVCVVGGERSLIANLSAANCYKSEHLKKPENWAXLVEKAKYIYIAGFFLTVSPESIQLVAEHAAASNKVFLMNLSAPFICEFFRDAQEKVLPYADYIFGNETEARIFSKVRGWETENVEEIALKISQLPLASGKQKRIAVITQGADPVVVAEDGKVKTFPVILLPKEKLVDTNGAGDAFVGGFLSQLVQGKSIEDCVKAGCYAANVIIQQSGCTYPEKPDFN

SEQ ID NO: 123696 - protein, 384 aa, Triticum aestivum
  Clone ID: PAT_TA_18114.pep
WIPRAAGIRHEGLLASRQRRPQISLSPPCAAVVERSKKMAASNLEGVLLGMGNPLLDISAVVDEAFLAKYDVKPNNAILAEDKHLPMYDELSSKENVEYIAGGATQNSIRVAQWMLQTPGATSYMGCIGKDKYGEEMKSAAKAAGVTAHYYEDEAAPTGTCAVCVVGGERSLIANLSAANCYKSEHLKKPENWALVEKAKYIYIAGFFLTVSPESIQLVAEHAAANNKVKVFLMNLSAPFICEFFRDAQEKVLPYADYIFGNETEARIFSKVRGWETENVEEIALKISQLPLASGKQKRIAVITQGADPVVVAEDGKVKTFPVILLPKEKLVDTNGAGDAFVGGFLSQLVQGKSIEDCVKAGCYAANVIIQQSGCTYPEKPDFN

SEQ ID NO: 123697 - protein, 384 aa, Triticum aestivum
  Clone ID: PAT_TA_18115.pep
PTRPPTRPDHTTRTNLSPFANRPQISLSPPCAAVVESSKKMAASNLEGVLLGMGNPLLDISAVVDEAFLAKYDVKPNNAILAEDKHLPMYDELSSKDNVEYIAGGATQNSIRVAQWMLQTPGATSYMGCIGKDKYGEEMKSAAKAAGVTAHYYEDEAAPTGTCAVCVVGGERSLIANLSAANCYKSEHLKRPENWALVEKAKYIYIAGFFLTVSPESIQLVAEHAAANNKVFLMNLSAPFICEFFRDAQEKVLPYSDYIFGNETEARIFSKVRGWETENVEEVALKISQLPLASGKQKRIAVITQGADPVVVAEDGKVKTFPVILLPKEKLVDTNGAGDAFVGGFLSQLVQGKSIEDCVKAGCYAANVIIQQSGCTYPEKPDFN

SEQ ID NO: 123698 - protein, 182 aa, Triticum aestivum
  Clone ID: PAT_TA_18116.pep
SRQNPSVLVLEFTRIYRLNVTTTYSQHTHVTGRSGILQGSSMQPVNKKPTNQNEKEKPSCFCSSISVRGVDERLAVQLVVVIVAAYGAAAGVRAAQPGDVGGERAADDDADLRQVARERQPEVERPQQRRRDLEHLHETLGRHERQQVDRHRRQQELARVPDGSSLAGCGARRKCVDSEWSI

SEQ ID NO: 123699 - protein, 208 aa, Triticum aestivum
  Clone ID: PAT_TA_18117.pep
RPHSSHHTARMRPAQSLGRRAGAYHHPYKKVVPARTRGRPQPPAPPHPATGRSTPPRQRHSTILNRHISSFAAAARTPSERRSVELLASWRRRWRSTCWRSWRPRASCRCSRSRRRCCGRSTSGCPSRATCRRSASSSAARSPPTSPGCAARTPATAPEAATTTTTSSTARRSSTPPRTEMMLEQDGFSFFILMICRSLVLGLRVRSL

SEQ ID NO: 123700 - protein, 468 aa, Triticum aestivum
  unsure (1)..(468): unsure at all Xaa locations
  Clone ID: PAT_TA_18118.pep
MANSGRPLLALPPLLLCLPPPPAPPAAPAPPGRPDGTGLWGLVETRRRAQRFWGYSKSPQRVSTRCRPWPTGLSLQGGPGASGVGVGSFMVVGPLDANLKPRNSTWLQTAGPLCVDTPLGPRCRRRQHATRLVSTAWQAATDATTLLKPLAKELPTPPRAGPPCRGAGSSPGTSXARAVRSRLQRAGQRLHEAXIDEVDELLSYGVDVTVYNGQLDVICSTKGAEAXGAKAQMGRAETVKEPAAAGXWPTSSKVTRAFVRSYKNLHFYWILGAGHFVPADQPCIALSMIAGITHSRAGARRRRTRIRTSAAARXEAGSNTTNTLGGIMNGVVKEKLKIIPKDHEWHELSDPVYNALVNDFMKPRIDEVDELLSYGVDVTVYNGQLDVICSTKGAEAWVQKLKWDGLKNFLSLPRQPLSCGSSKVTKAFVRSYKNLHFYWILGAGHFVPADQPCMALSMIAGITQSPAS

SEQ ID NO: 123701 - protein, 105 aa, Triticum aestivum
  Clone ID: PAT_TA_18119.pep
FFFFFCKICLSLNELAAVCVGSEAASAEEAKGGGREGGGSRRQGGAEGRCAAGGGAGAPPGGGTAGEGLRWAQRGRRARRGGRRLHPASHEKRGAKRGPVLKNGH

SEQ ID NO: 123702 - protein, 367 aa, Triticum aestivum
  Clone ID: PAT_TA_18120.pep
MGCFSCCGADDVGKKKKRDDPYVPVPAPGGNYGYNRGPAPTHAIRTSRSQPIEVPAIPLDEIKEITKNFSSDALIGEGSYARVFLGVLKDGKKSAVKRLDSSKQPDQEFLVQVSAVSRLKHDNVIQLLGYCALGSTRILAYEYATRGSLHDVLHGKKGVKGSQPGPVLSWMQRARIAVSAARGLEFLHEKAEPPVVHRDIKSSNILLFDNDVAKIGDFDVSNQAPDMAARLHSTRVLGTFGYHAPEYAMTGQLSAKSDVYSFGVVLLELLTGRKPVDHTLPRGQQSLVTWATPRLSEDKVRQCVDPKLGVDYPPKAVAKMAAVAALCVQYEADFRPNMSIVVKTLAPLLNTRTSNRPAGSASGVAVE

SEQ ID NO: 123703 - protein, 179 aa, Triticum aestivum
  Clone ID: PAT_TA_18121.pep
AGRVGTKSGSNTFEHAIAKTKGQPPWPKRYQWAAEGTTYIRISKFFLPFSNDKWFDYVSGVMLKDTVTNKGWAVLLEVFGSTVAILKGVLSVNVAEVVGGVLSLGDAFDEKKMHEEANVRGFLTSIAQAVDVGNQARKDGKKKKPAEKPNVTNILVLVQQIDSGKYSHRDLGSRPREIE

SEQ ID NO: 123704 - protein, 218 aa, Triticum aestivum
  Clone ID: PAT_TA_18122.pep
AGRVLGILLPCSLLFTQNTLSAHASTGSTGHLVKKKRRITAHPGPPTAAPSGATWQTAKPSGARRQGAAMASSRSAAHGPASQSANGDYALSLRCGAEVGGLQRPSARDAIWRLHQARMDGTRPTAHASSGARPGLAPPRACKPSGRCTALTFSSGGGWKRKIPPTNLCTNGDEARFLNERGCFRNISISNRTGEKLGKKKKKSEYAIQLSIFLIFAC

SEQ ID NO: 123705 - protein, 236 aa, Triticum aestivum
  Clone ID: PAT_TA_18123.pep
MAHSCHGYDLVLRRYLLALHHLLDCVRFVAAVVLDRLGIVSFEGEMLPGEPWSELVDTALMERLMEAAFWQSSSPPKVNRSSSWTAPQYRRRRVAPADVEGAEDDDGCVGICAICLAALDVGGQLVTELCNCSHAFHGACIGYWIGSGEAGTCPLCRTPTLPTAWWNGWREVVPHTSLSPLIAEGLKEDRNISISSLKGRATRRDVYMYSNSYSQCFSRCFPFCVNKCFPVIFVFA

SEQ ID NO: 123706 - protein, 147 aa, Triticum aestivum
  unsure (1)..(147): unsure at all Xaa locations
  Clone ID: PAT_TA_18124.pep
MDDAGLVLAAALTGAIFVVLLVLLVVVLVRRRWXTREGVASGRGFVLFGVCCQDGTQGRFVRTTSLARSRQRAARGGEEADDEPGEGELERWKKMFGGPTRCLSTIEEATEKGTSTVATPAFCSPAASPDRRDARAVQTASAGVLKS

SEQ ID NO: 123707 - protein, 519 aa, Triticum aestivum
  unsure (1)..(519): unsure at all Xaa locations
  Clone ID: PAT_TA_18125.pep
MDKAYIAILTIAFLFLLHYILGKVSNGRRGKGAVQLPPSPPAIPFLGHLHLLEKPFHAALRRLAARLGPVFSLRLGSRRAVVVSSAECARECFTEHDVTFANRPRFPSQLLVSFDGAALATSSYGPHWRNLRRVAAVQLLSAHRVACMSGVIAGEVRAMARRLFRAAAAAPGDGAARVQLKRRLFELSLSVLMETIAQTKXTRSEADADTDMSVEAQEFKKVVDELIPYLGAANTWDYLPVLRWFDVFGVRNKILAAVSRRDAFMLRLIDNERRRLDQAGTEGDKKSMIAVLLNLQKTEPEVYADTMITALCANLFGAGTETTSTTTEWAMSLLLNHPAALKKAQAEIDAAVGTSRLVTADDVPRLAYLQCIVSETLRLYPAAPMLLPHESSADCKVGGYNVPSGTMLMVNAYAIHRDPAAWERPLEFXPASGSENGKAEGRFMIPFGMGRRRCPGXETLALRTIGMVLATLVQCFDWERVDGAEVDMXEGGGLTIPKVVPLEAVCRPRPAMRDVLQSL

SEQ ID NO: 123708 - protein, 82 aa, Triticum aestivum
  Clone ID: PAT_TA_18126.pep
VVACIADLAFKSAEQLAKDVELFAQHASRKSIRMDDVILPAHRNEHLMGQLRTFSQNLKGKEPCTGKKRKKTSKKDDNMTVI

SEQ ID NO: 123709 - protein, 520 aa, Triticum aestivum
  Clone ID: PAT_TA_18127.pep
VLAYPKIEERNLSDPPEIAQNQQEHKSDSVPLKDQDQLEEAQGLLKSAAKTGQSKEARLARVCAGLSSRLQEYKSENAQLEELLVQEREKCSSHEAHIKQLQQELSVSRVQGSRVESNMVDALAAKNTEIESLAKSLDSWKKKAAASEEMLASLQEDMDGLKRNRELTETRIIQALREELSTVERRAEEERIAHNATKMAAVDREVELEHRAVEASNALARIQRAADQSSSRAMEFEHKVAVLEVECASLHQELQEMEARNRRAQKKPSEDANQALQIQAWQEEVERARQSQREAESKILSLEAELQKMRVEMAGMRRDAEHYSRQEHVELEKRYRELTDLLYHKQTQLESMASEKGALEFQLEKSLKQFHEVQVEAERSRVSRRSASSWEEDTDINALEPLPLHHRHMATANHQLQKAAKFLDSGAVRATRFLWRHPVARVSLLFYLVFVHLSEKCSRQRPQDEAGEETGTGTRGAQANVTTPTARQPDTPPCRSPGIPRGNRSIHGPCMFLRDFGDCL

SEQ ID NO: 123710 - protein, 181 aa, Triticum aestivum
  unsure (1)..(181): unsure at all Xaa locations
  Clone ID: PAT_TA_18128.pep
MFLYLMGQAAVIAAAFGGTLPPGVTGTNDRCTLIVSNLNSDKVDADKLFNLFSIYGNIVRIKVLRNKPDHALVQMADGLQAELAIHYLKGAMLLGQKLEVNFSKYPSITPAPDAHDYSTSNLNRFNSNVAKNYRHCCASTKNIHISTLSPKKSEDTNLEHLGEHGTIVKSKLFEXSGKTQA

SEQ ID NO: 123711 - protein, 129 aa, Triticum aestivum
  Clone ID: PAT_TA_18129.pep
MDASKLKKVAGKKFGGPRKKSVTRSVKAGLQFPVGRIGRFLKKGRYAQRVGSGAPVYLAAVLEYLAAEVLELAGNAAKDNKKTRIVPRHLLLAIRNDQELGRLLSGVTIAHGGVIPKKATKSPKKATKA

SEQ ID NO: 123712 - protein, 98 aa, Triticum aestivum
  Clone ID: PAT_TA_18130.pep
LECSKQAIALDTLAWDNIIGFRSYCVGLRDQHRQALSSMRLSRMLSTYVSTLSRTLSLLLSTYSPLGHIHMTQSQVLLMMKTTVQWTPSPCHQSIHPT

SEQ ID NO: 123713 - protein, 138 aa, Triticum aestivum
  Clone ID: PAT_TA_18131.pep
MADLQTPLVRPKRKKVLVDYLVQFRWILVIFVVLPASALIYFNIYLGDMWSAMKSEKKRQKEHEDNVQKVVKRLKQRNPKKDGLVCTARKPWIAVGMRNVDYKRVRHFEVDLSAFRNILEIDAERMVAILEPAYADEA

SEQ ID NO: 123714 - protein, 144 aa, Triticum aestivum
  Clone ID: PAT_TA_18132.pep
SAPIYTQPRHLPPSKVLDADVTDSVIGEGCVIKNCKIHHSVVGLRSCISEGAIIEDTLLMGADYYETEADKKLLAEKGGIPIGIGKNSHIKRAIIDKNARIGDNVMIINVDNVQEAARETDGYFIKSGIVTVIKDALLPSGTVI

SEQ ID NO: 123715 - protein, 61 aa, Triticum aestivum
  Clone ID: PAT_TA_18133.pep
MDGSKAKKVAAKKFGGPRKKSVTKSIKAGLQFPAEKAEKAEKTATKSPKKATKSPKKATKA

SEQ ID NO: 123716 - protein, 95 aa, Triticum aestivum
  Clone ID: PAT_TA_18134.pep
LIIHKSRGSKRLPLCSRLHQGRRIQSEAATTSNQTRTISTPHYYNLRLGGFLGGLGGLLGRLGGGAGLLSLLGGLEHLRASQTCYCLKLPSPKRR

SEQ ID NO: 123717 - protein, 274 aa, Triticum aestivum
  Clone ID: PAT_TA_18135.pep
MPPKVSLLKATQGDAIRNYYHDNHVIQDMLVPLYKVGDALEFVHHEMEVYPLWLCPHRLFKLPVKTMIYPDMNKSPGAEEKFKEISAAYEVLSDKEKRSLYDRFGETGLHADYGGGDFGAHGVDPYELFNAFFGSSNKFFGDSMGPGRFHYSSNVKDNRALDICYDLLLPFEESILGGKREISISRHETCGACHGSGAKSSNSITECTQCRGQGRSMKSQRTPFGIVSQISSCLNCDGSGKIITEHCPSCDGSGKVQVERSIQVDIPGGIEDGS

SEQ ID NO: 123718 - protein, 184 aa, Triticum aestivum
  unsure (1)..(184): unsure at all Xaa locations
  Clone ID: PAT_TA_18136.pep
LNTETLGTRGLPEHHQFTGTAGSRPWWPSWGTWWSSWATWGRCVQRAGTXSTRADDSRLLGIPRXRPTIAMIYPHHDEISQDYPGLSAKAIYSLNTSVXARVRPRTSKGXHRPVIASNFRRLNGDSPSKKLAAEGWLRIASXQAEVSFVNGINQTNRSTNXERPCTTTHRIKKELSVCQSLLCL

SEQ ID NO: 123719 - protein, 115 aa, Triticum aestivum
  unsure (1)..(115): unsure at all Xaa locations
  Clone ID: PAT_TA_18137.pep
MDAGKLKKVAGKKFGGPRKKSVTRSVKAGLQFPVGRIGRFLKKGRYAXRHLLLAIRNDQELGRLLSGVTIAHGGVIPNINPVLLPKKAAEKAEKAGTAAKSPKKATKSPKKATKA

SEQ ID NO: 123720 - protein, 141 aa, Triticum aestivum
  unsure (1)..(141): unsure at all Xaa locations
  Clone ID: PAT_TA_18138.pep
MDVPLASKTLPSPLPSKREQCNVDGHKSSSKHADLNPHANDSVLGIILGGGARTRLYPLTKKRAKPAVPLGANYRLIDIPVRNCLNSNISKIYVLTQXNSASLNRHLSRAYGSNIGGYKNEGIVEVLAAQQSPDNPDWFKD

SEQ ID NO: 123721 - protein, 130 aa, Triticum aestivum
  unsure (1)..(130): unsure at all Xaa locations
  Clone ID: PAT_TA_18139.pep
RGHNHPDLRDPKLAILSLLAVFRDIIPSYRIRQLTEKELAVEVSKEVKKTRYYEYTLIRSYKAYLQKLISLEKQPYFYLVAVRCLCSLLDAAPHFNHRESLLASVVKNXSSSNDVARKLCSEAIRSLFRN

SEQ ID NO: 123722 - protein, 130 aa, Triticum aestivum
  Clone ID: PAT_TA_18140.pep
RSPQSSDPPPLPLQVHPPPPPHRGAHARTRPPPTRIQIRAAAAAQAKAKAKEGAMAGGGGAGGLSESVMRKVLLSYCYVAVWIFLSFAVIVYNKYILDPKMYNWPFPILLSMGHMSFCSLLAVGLVPVLW

SEQ ID NO: 123723 - protein, 102 aa, Triticum aestivum
  Clone ID: PAT_TA_18141.pep
MNTLPFTDTTDVEINKQVGNRIIRKRIHVRVEHVQPSRCAEEFRLRKVKNDQLKEEAKARGEVISTKRQPLGPKPGFMVEGTTIETVTPIPYDVVNDLKGGY

SEQ ID NO: 123724 - protein, 102 aa, Triticum aestivum
  Clone ID: PAT_TA_18142.pep
PAPVYLAAVLEYLAAEVLELAGNAAKDNKKTRVVPRHLLLAIRNDQELGRLLSGVTIAHGGVIPNINPVLLPKKAAEKAEKAGAAPKSPKKTTKSPKKATKA

SEQ ID NO: 123725 - protein, 70 aa, Triticum aestivum
  unsure (1)..(70): unsure at all Xaa locations
  Clone ID: PAT_TA_18143.pep
MRLIRDTVTPINLFGYGIAFLGVGYYNHIKLQALKAKEAQKKSAXADEEAGXSLLQERDSHSDRKSENQA

SEQ ID NO: 123726 - protein, 140 aa, Triticum aestivum
  unsure (1)..(140): unsure at all Xaa locations
  Clone ID: PAT_TA_18144.pep
MPAGHGLRSRTRDLFARPFRKKGYIPLTTYLRTYKVGEHVDVKVNGAVHKGMPHKFYHGRTGRVWNVTKRAIGVEINKQVGNRIIKKRIHVRVEHVQPSRCNEEFLQRKLTXXDSLKPKAKPLAKVFSTKRQPAGPRLWY

SEQ ID NO: 123727 - protein, 57 aa, Triticum aestivum
  Clone ID: PAT_TA_18145.pep
FFFFNIKGRLNQVLTDDNNDSCCYRPQAATNQRYTLDQVLLINNTQAKGGQLIQSSD

SEQ ID NO: 123728 - protein, 214 aa, Triticum aestivum
  Clone ID: PAT_TA_18146.pep
MVPLRLYRHLIPQLAAAARSPSCAPRPISRLPALAMAAYGTGACADSKLLFRQLFEKESSTYTYLLADVGDPEKPAVLIDPVDRTVDRDLNLIKELGLKLIYAMNTHVHADHVTGTGLIKTKLPGAKSVISKASGAKADHSVEHGDKIYFGKLFLEVRATPGHTAGCVTYVTSSSCPGCAPWACSSPTSSSSAPTPSAPSRSTWPSSSWARRSP

SEQ ID NO: 123729 - protein, 169 aa, Triticum aestivum
  unsure (1)..(169): unsure at all Xaa locations
  Clone ID: PAT_TA_18147.pep
MSSDGGGSQMGVAGALGLSVTSSVAIVICNKYLMSTLKFYFATTLTSWHLLVTFCTLHIAQRLRFFEPKPIDAQTVISFGFLNGISIGLLNLCLGFNSVGFYQMTKLAIIPFTMLLETIFLSKKFSQSIKASLMVLLLGVGIASVTXDLQLNLLGSIIAVLTIAATCVC

SEQ ID NO: 123730 - protein, 46 aa, Triticum aestivum
  Clone ID: PAT_TA_18148.pep
LVSWLRSRSLTELTRQIAPPTKNGHAPPPIESRKSSQSVNPCYVWT

SEQ ID NO: 123731 - protein, 171 aa, Triticum aestivum
  Clone ID: PAT_TA_18149.pep
MSTPTGNFVRPFHPDVIGNAFAQQYYRVLGSSPEHVHKFYHDESILGRPDSDGPLTSITTTYAINQHFLSTDMKGCLIQLDNVDTQPSHGGGVLILVTGSLTMLDTVKHRFVQSFFLAPQENGGYFVLNDVLRAVPEMPLAETNEALVDHVNGNTQIAPFPAEPETSVNES

SEQ ID NO: 123732 - protein, 152 aa, Triticum aestivum
  unsure (1)..(152): unsure at all Xaa locations
  Clone ID: PAT_TA_18150.pep
MDASKLKKXAGKKFGGPRKKSVTRSVKAGLQFPVGRIGRFLKKGRYAQRVGSGAPVYLAARANKLVLQVLELAGNAAKDNKKTRIVPRHLLLAIRNDQELGRLLSGVTIAHGGVIPNINPVLLPKKTAEKAEKTAAKSPKKATKSPKKATKA

SEQ ID NO: 123733 - protein, 142 aa, Triticum aestivum
  Clone ID: PAT_TA_18151.pep
MAEPSRVIHIRNVGHEISETDLLQVVQPFGAVAKLVMLRTKNQALVQMEDLSASISAIQYYTTIQPSVRGRNVYLQYSSHQELTTDQSSHGRNPDQDEPNRILLVTVHHMLYPMTVEVPLDSAFSLLVVDFQQTMLFGVWFM

SEQ ID NO: 123734 - protein, 285 aa, Triticum aestivum
  unsure (1)..(285): unsure at all Xaa locations
  Clone ID: PAT_TA_18152.pep
LASKTFPSPSPSKREQCNVDGHKSSSKHADLNPHANDSVLGIILGGGAGTRLYPLTKKRAKPAVPLGANYRLIDIPVSNCLNSNISKIYVLTQFNSASLNRHLSRAYGSNIGSYKNEGFVEVLXAAQQSPDNPDLFQGTXADAVRQYLWLFEEHNVMEYLILARDHLYRMDYEKFIQAHQETDADXILVAAVAMDEGRATXALGLMKNREKRRIIXDFAKKPKGEPVKVFYGWYHPYLAFVNARAKERPXIGCMGYFVFRQHVEGYSFSRGKFLGPKTFWREGIS

SEQ ID NO: 123735 - protein, 191 aa, Triticum aestivum
  Clone ID: PAT_TA_18153.pep
GEAQDSTLRGVALQLAAVAFEATRLVLIQILLTSKGISLNPITSLYYVAPCCLCFLLVPWIFVELPRLRAVGTFQPDFFIFGTNSLCAFALNLAVFLLVGKTSALTMNVAGVVKDWLLIAFSWSVIRDTVTPINLFGYGIAFLGVGYYNHIKLQALKAKEAQKKSAQADEEAGSLLQERDSHSDRKSENQA

SEQ ID NO: 123736 - protein, 107 aa, Triticum aestivum
  Clone ID: PAT_TA_18154.pep
MPTGLKGFLNSPVGPRTTHFWGPVSNWGFILAGMANMNKPPELISGHMTAVMCVYSGLFMRFAWVVRPRNYFLMATHASNESVQLYQLSRYARAQGYLEKKEPEAQH

SEQ ID NO: 123737 - protein, 104 aa, Triticum aestivum
  Clone ID: PAT_TA_18155.pep
IRHEVPPACIFRGEEFDGAESVKRLEQWLIENHSYQPQYAVTELNEKDFWRMFDASHYEHCRQKYGAVGTFMSVYYKSKKGRKSEKEVQEAEAAILEPAYADEA

SEQ ID NO: 123738 - protein, 85 aa, Triticum aestivum
  Clone ID: PAT_TA_18156.pep
MNVAGVVKDWLLIAFSWSVIRDTVTPINLFGYGIAFLGVGYYNHIKLQALKAKEAQKKSAQADEEAGSLLQERDSHSDRKSENQA

SEQ ID NO: 123739 - protein, 268 aa, Triticum aestivum
  Clone ID: PAT_TA_18157.pep
PRVRVDQPPLRVERVPPLPARSLIFSDGDAGRSGDGRGAWRCPMYIESRYRLRSSSAHVVYGCMPMWRAPPPRTSSGWWLTAAASQARLAGGRSLPRGVLLAHPPISSSGPLFWRLSATSLARGVAVVVKTKSRRDGEPDRVSALIRWLFGSGLGASYGVRRPAGSITSSYMLAEGRPFYFFLPAKMPKGRQLIFCTEFMAWCHGSLVVPSGNVPGDGEVTAVQKMSRTRLLFLSGYWGPLCKRQGPVCYLQLVLGPSVKCCVLHVQC

SEQ ID NO: 123740 - protein, 286 aa, Triticum aestivum
  Clone ID: PAT_TA_18158.pep
MADLQTPLVRPKRKKVLVDYLVQFRWILVIFVVLPASALIYFNIYLGDMWSAMKSEKKRQKEHEDNVQKVVKRLKQRNPKKDGLVCTARKPWIAVGMRNVDYKRVRHFEVDLSAFRNILEIDAERMVAKVEPLVNMGQISRATCPMNLSLAVVAELDDLTVGGLINGYGIEGSSHIYGLFSDTVVALEIVLADGRVVRATKDNEYSDLFYGVPWSQGTLGFLVSAEIKLIPIKEYMRLTYTPVKGPLKEVAHAYADSVAPRDGDPAKVPDFLEGMVYSATEGSMMT

SEQ ID NO: 123741 - protein, 357 aa, Triticum aestivum
  Clone ID: PAT_TA_18159.pep
MAKEAGGEGAMSESVLRKVLVSYCYVAVWIFLSFTVIVYNKYILDPKMYNWPFPISLTMVHMAFCSSLAVALVRVFRVVDLPSSPAMTTQLYTSSVLPIGALYSLSLWFSNSAYIYLSVSFIQMLKALMPVAVYSIGVLFKKETFRSSAMLNMLSISFGVAIAAYGEARFDLRGVALQLAAVAFEATRLVLIQILLTSKGISLNPITSLYYVAPCCLGFLFLPWVFVELPRLRAVGMFEPDFFVFGTNSLCAFALNLAVFLLVGKTSALTMNVAGVVKDWLLIAFSWSVIRDTVTPINLFGYGIAFLGVGYYNHVKLQALKAKEAQKKVAQADEEAGSLLQERDSHGGERKTETQSS

SEQ ID NO: 123742 - protein, 406 aa, Triticum aestivum
  Clone ID: PAT_TA_18160.pep
RRYRNPIYSSDVGGVRVLEQAVHLVDGELHGEELVEEAEGGGGAAAVARHPGLDEIYNQVDHVEPWMTGNCRGPSTAFCLLYKLFTMKLTVNQMHGLLKHPDSPYIRAIGFLYLRYAADPKTLWTWYEPYIQDDEEFSPGSNGKMTTMGVYVRDVILGQYYFDSLLPRVPLLILRQVTAHLEKMKLPTKQSGITGDSSRLGSDDTARRPPSVKASLSVSFGQRAPHRASTRDSSPVRKTLPSVRERERSHDGGHAKSPPRKHRSQSRERSRDIERDRSDRDRGRYKDREHGRHSRDNRDRDYRRSSYSDRDVERRGHERRDRDSDRNGRSSGRRSRSRSRSPSRGRTNGDSHRSSPFGKAPEPSNLAKLKDLYGDATNAKDDAGDDRARRDSGTEEVIRLGGARWR

SEQ ID NO: 123743 - protein, 297 aa, Triticum aestivum
  Clone ID: PAT_TA_18161.pep
MVPLRLYRHLIPQLAAAARSPSAPKAAASCAPRRIPPLPALAMAAYGTGVCADSKLLFRQLFEKESSTYTYLLADVGDPEKPAVLIDPVDRTVDRDLNLIKELGLKLIYAMNTHVHADHVTGTGLIKTKLPGAKSVISKASGAKADQSVEHGDKIYFGKLFLEVRATPGHTAGCVTYVTGDSPDQPSPRMAFTGDALIIRACGRTDFQGGSSDQLYESVHSQIFTLPKDTLLYPAHDYKGFTVTTVEEEVAYNARLSKDKETFKTIMENLNLSYPKMIDVAVPANMVCGFQDPPSKV

SEQ ID NO: 123744 - protein, 359 aa, Triticum aestivum
  Clone ID: PAT_TA_18162.pep
MSSDGGGSQMGVAGALGLSVTSSVAIVICNKYLMSTLEFYFATTLTSWHLLVTFCTLHIAQRLRFFEPKPIDAQTVISFGFLNGISIGLLNLCLGFNSVGFYQMTKLAIIPFTMLLETIFLSKKFSQSIKASLMVLLLGVGIASVTDLQLNLLGSIIAVLTIAATCVCQILTNQIQRRLKVSSTQLLYQSSLYQSAVLLITGPFVDKLLTKKDVFAFEYTFEVVVFILMSCGIAVSVNFSTFLVIGTTSPVTYQVLGHLKTCLILSFGYVLLKDPFTLRNLAGILIAIFGMGLYSFFSVSESRKKTEGATLPVNTQMSEKDSAPLLGTKTSPWQESNGVENFDDVPRTAKTAFSRQLNP

SEQ ID NO: 123745 - protein, 356 aa, Triticum aestivum
  unsure (1)..(356): unsure at all Xaa locations
  Clone ID: PAT_TA_18163.pep
MAKEAGGEGAMSESVLRKVLVSYCYVAVWIFLSFTVIVYNKYILDPKMYNWPFPISLTMVHMAFCSSLAVALVRVFRVVDLPSSPAMTTQLYTSSVLPIGALYSLSLWFSNSAYIYLSVSFIQMLKALMPVAVYSIGVLFKKETFRSSAMLNMLSISFGVAIAAYGEARFDLRGVALQLAAVAFEATRLVLIQILLTSKGISLNPITSLYYVAPCCLGFLFLPWVFVELPRLRAVGMFEPDFFVFGTNSLCAFALNLAVFLLVGKTSALTMNVAGVVKDWLLIAFSWSVIRDTVTPINLFGYGIAFLGVXGYYNHVKLQALKAKEAQKKVAQAXRKPGSLLQERDSHGERKTETQS

SEQ ID NO: 123746 - protein, 213 aa, Triticum aestivum
  Clone ID: PAT_TA_18164.pep
MKPAVEGDERAAEIARIKAAAAAAKKAAEEVVDVDDEGEDDEGDEEEEAVDGDDDDDDDEVDDDGEEDEDEGVEGEDKGSAAQQVVDISDEDDDGGDEEEGGDDDDDDDDDDDDEEDDDEVDEEEEPEEELGTEYLVQPLGRAEDEEHSSDFEPEENGDGAEDEEIEDDDAEDGEDPVKAQSPSKRKRSGGEDEDDDDGDDDGDDDEKPPSKR

SEQ ID NO: 123747 - protein, 329 aa, Triticum aestivum
  Clone ID: PAT_TA_18165.pep
AVRQYLWLFEEHNVMEFLILAGDHLYRMDYQKFIQAHRETDADITVAALPMDEERATAFGLMKIDDEGRIVEFSEKPKGEKLKAMMVDTTILGLDSERAKELPYIASMGIYVFSKDAMLRLLRDNFPSANDFGSEVIPGATEIGMRVQAYLYDGYWEDIGTIEAFYNANLGITKKPVPDFSFYDRSAPIYTQSRYLPPSKVLNADVTDSVIGEGCVINHCTINHSVVGLRSCISEGAVIEDSLLMGADYYETENDKQVLSESGGIPIGIGKNAHIRKAIIDKNARIGENVKIINVDDIQEASRESDGYFIKSGIVTVIKDALIPSGTVI

SEQ ID NO: 123748 - protein, 299 aa, Triticum aestivum
  Clone ID: PAT_TA_18166.pep
MVPLRIYRHLIPQLAAAARSLSAPKVAASASCAPRPISPLPALAMAAYGTGACADSKLLFRQLFEKESSTYTYLLADVGDPEKPAVLIDPVDRTVDRDLNLIKELGLKLIYAMNTHVHADHVTGTGLIKTKLPGAKSVISKASGAKADHSVEHGDKIYFGKLFLEVRATPGHTAGCVTYVTGDSPDQPSPRMAFTGDALIIRACGRTDFQGGSSDQLYQSVHSQIFSLPKDTLLYPAHDYKGFTVTTVEEEVAYNARLSRDKETFKTIMENLNLSYPKMIDVAVPANMVCGFQDPPSKV

SEQ ID NO: 123749 - protein, 452 aa, Triticum aestivum
  Clone ID: PAT_TA_18167.pep
VLKYKYTIVFLKEHAKEIYAEVRTAYIDTMNKVLSAHFRAYIQALEKLQLDIATSTDLLGVETRSTGYLFSIGKEPLKARSSVFALGERINVLKDIEQPALIPHISEAKSQKYPYEVLFRSLQKLLIDTATSEYLFSDDFFGEESLFQDIFAGPIQVVDEYFDAVLLNCYDAIGIMLMIRIIHQHQLIMFKRRIPCLDSYLDKVNMSLWPRFKMVFDLHLSSLRNANIKTLWEDDVHPHYVTRRYAEFTASLVHLNVEYGDGQLDLNLERLRMAIEDLLVKLAKMFPKPKMQTVFLINNYDLTIAILKEAGTEGGKTQLHFEEVLKSNIAIYVEEVLLEHFSDLIKFVKTRTSEDPASSSDKANIGDVEPLVKDFANRWKAAIELMHKDVITSFSNFLCGMEILKAALTQLLLYYTRLTECVKRVNCGSALNKDLVSISSILYEIKKYSRTF

SEQ ID NO: 123750 - protein, 208 aa, Triticum aestivum
  Clone ID: PAT_TA_18168.pep
MKPAVEGDERAAEIARIKAAAAAAKKAADEVVDVDDEVDEEEAVDGDDDDDDDDEVDDDGEEDEDEGVEGEEKGSAAQQVVDISDEDDDGGDEEEGGDDDDDDDDDDDDEEEEDEVDEEEEPEEELGTEYLVQPLGRAEDEEHSSDFEPEENGDGAEDEEIEDDDAEDGEDSVKPQSSSKRKRSGGEDEDDDDGDDDGDDDEKPPSKR

SEQ ID NO: 123751 - protein, 562 aa, Triticum aestivum
  unsure (1)..(562): unsure at all Xaa locations
  Clone ID: PAT_TA_18169.pep
MADLQTPLVRPKRKKVLVDYLVQFRWILVIFVVLPASALIYFNIYLGDMWSAMKSEKKRQXKEHEDNVQKVVKRLKQRNPKKDGLVCTARKPWIAVGMRNVDYKRVRHFEVDLSAFRNILEIDPERMVAKVEPLVNMGQISRATCPMNLSLAVVAELDDLTVGGLINGYGIEGSSHIYGLFSDTVVALEIVLADGRVVRATKDNEYSDLFYGVPWSQGTLGFLVSAEIKLIPIKEYMRLTYTPVKGPLKEVAQAYADAVAPRDGDPAKVPDFVEGMVYSATEGVMMTGVYASKEEAKKKGNKINSVGWWFKPWFYQHAQTALKKGEFVEYIPTREYYHRHTRCLYWEGKLILPFGDQFWFRFLFGWLMPPKVSLLKATQGDAIRNYYHDNHVIQDMLVPLYKVGEALEFVHHEMEVYPLWLCPHRLFKLPVKTMIYPEPGFEHQQRQGDTSYAQMFTDVGVYYTPACIFRGEEFDGAESVKRLEQWLIENHSYQPQYAVTELNEKDFWRMFDASHYEHCRHKYGAVGTFMSVYYKSKKGRKSEKEVQEAEAAILEPAYADEA

SEQ ID NO: 123752 - protein, 439 aa, Triticum aestivum
  unsure (1)..(439): unsure at all Xaa locations
  Clone ID: PAT_TA_18170.pep
MAEPSRVIHIRNVGHEISETDLLQVVQPFGAVAKLVMLRTKNQALVQMEDLSASISAIQYYTTIQPSVRGRNVYLQYSSHQELTTDQSSHGRNPDQDEPNRILLVTVHHMLYPMTVEVLHQVFSPYGFVEKIVTFQKTAGFQALIQFQSRQSAIQAAGALHGRNIYDGCCQLDIQYSNLSELQVHYNNDRSRDFTNPSLPTEQRPRSSQLGYNDPSLFGFQQPGAAYGQAAVIAAAFGWXLPPGVTGTNDRCTLIVSNLNSDKVDADKLFNLFSIYGNIVRIKVLRNKPDHALVQMADGLQAELAIHYLKGAMLLGQKLEVNFSKYPSITPAPDAHDYSTSNLNRFNSNVAKNYRHCCAPTKIIHISALSPEISEDTILEHLGEHGTIVKSKLFEASGKTQALVQFESEEEATEALVCKHASKLEGSTIRISFSQMQNI

SEQ ID NO: 123753 - protein, 439 aa, Triticum aestivum
  Clone ID: PAT_TA_18171.pep
MAEPSRVIHIRNVGHEISETDLLQVVQPFGAVAKLVMLRTKNQALVQMEDLSASISAIQYYTTIQPSVRGRNVYLQYSSHQELTTDQSSHGRNPDQDEPNRILLVTVHHMLYPMTVEVLHQVFSPYGFVEKIVTFQKTAGFQALIQFQSRQSAIQAAGALHGRNIYDGCCQLDIQYSNLSELQVHYNNDRSRDFTNPSLPTEQRPRSSQLGYNDPSLFGFQQPGAAYGQAAVIAAAFGGTLPPGVTGTNDRCTLIVSNLNSDKIDADKLFNLFSIYGNIVRIKVLRNKPDHALVQMADWLQAELAIHYLKGAMLLGQKLEVNFSKYPSITPAPDAHDYSTSNLNRFNSNVAKNYRHCCAPTKIIHISALSPEISEDAILEHLGEHGTIVKSKLFEASGKTQALVQFESEEEATEALVCKHASKLEGSTIRISFSQMQNI

SEQ ID NO: 123754 - protein, 93 aa, Triticum aestivum
  Clone ID: PAT_TA_18172.pep
MDASKLKKVAGKKFGGPRKKSVTRSVKAGLQFPVGRIGRYLKKGRYAQRVGSGAPVYLAAVLEYPDEHLHPPHQDKQRLHNHPLLQIEILELR

SEQ ID NO: 123755 - protein, 211 aa, Triticum aestivum
  Clone ID: PAT_TA_18173.pep
MKPAVEGDERAAEIARIKAAAAAAKKSAEEVVDVDDEGEDDEGDEEEEAVDGDDDDDEVDDDGEDDDDEGVEGEEKGSAPQQVVDISDEDDGGGDEEEGGDDDDDDDDDDDDEEDDDEVDEEEEPEEELGTEYLVQPLGRAEDEEHSSDFEPEENGDGAEDEEIEDDDAEDGEDSVKAQSSSKRKRSGAEDEDDDDGDDDGDDDEKPPSKR

SEQ ID NO: 123756 - protein, 355 aa, Triticum aestivum
  unsure (1)..(355): unsure at all Xaa locations
  Clone ID: PAT_TA_18174.pep
MDMPLASKTFPSPSPSKREQCNVDGHKSSSKHADLNPHANDSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPDWFQGTADAVRQYLWLFEEHNVMEYLILAGDHLYRMDYEKFIQAHRETDADITVAALPMDEERATAFGLMKIDEEGRIIEFAEKPKGEQLKAMMVDTTILGLDDARAKEMPYIASMGIYVISKHVMLQLLREQFPGANDFGSEVIPGATSTGMRVQAYLYDGYWEDIGTIEAFYNANLGITKKPIPRFSFYDRSASIYTXQPRHLPPLKVLDAGVKNSG

SEQ ID NO: 123757 - protein, 125 aa, Triticum aestivum
  unsure (1)..(125): unsure at all Xaa locations
  Clone ID: PAT_TA_18175.pep
ASWPGGRSRKAALRPACTGKEKTSQQSRRLAGRAATTMISILAQERLLGFALGSVSMGGFVLHQRRSIYRSLADADAASGGASFSYQTSATHRXEEFQPEMAHVWNKAVDETLGRLVVYLSSRGW

SEQ ID NO: 123758 - protein, 141 aa, Triticum aestivum
  unsure (1)..(141): unsure at all Xaa locations
  Clone ID: PAT_TA_18176.pep
MAPRHRLRAEDELPPFRHLGREEEVERPPFGQHVHEKRKLLNNLGVSPAAATTMISILAQERLXLGFALGSVSMGGFVLHQRRSIYRSLADADAASGGASFSYQTSATTGRGVSAEMAHVWNKAVDETLGRLVVYLSSRGW

SEQ ID NO: 123759 - protein, 83 aa, Triticum aestivum
  Clone ID: PAT_TA_18177.pep
TVNRELSVNDVEEEEEEEVWSTLLLPGRALSSVNFQKHACRAFFRVHRRPACEQGCFSDAEEKRQVLLAREGYAFLPGLPLSI

SEQ ID NO: 123760 - protein, 355 aa, Triticum aestivum
  unsure (1)..(355): unsure at all Xaa locations
  Clone ID: PAT_TA_18178.pep
MAGGGGAGGLSESVMRKVLLSYCYVAVWIFLSFAVIVYNKYILDPKMYNWPFPISLTMVHMSFCSSLAVGLVRVLRVVEPPSSPPMTPQLYTSSVVPIGALYAMSLWFSNSAYIYLSVSFIQMLKALMPVAVYSIGVLFKKETFRSSSMLNMLSISFGVAIAAYGEARFDLRGVALQLAAVAFEATRXLVLIQILLTSKGISLNPITSLYYVAPCCLCFLLVPWIFVELPRLRAVGTFQPDFFIFGTNSLCAFALNLAVFLLVGKTSALTMNVAGVVKDWLLIAFSWSVIRDTVTPINLFGYGIAFLGVGYYNHIKLQALKAKEAQKKSAQADEEAGSLLQERDSHSDRKSENQA

SEQ ID NO: 123761 - protein, 152 aa, Triticum aestivum
  Clone ID: PAT_TA_18179.pep
MDASKLKKVAGKKFGGPRKKSVTRSVKAGLQFPVGRIGRFLKKGRYAQRVGSGAPVYLAAVLEYLAAEVLELAGNAAKDNKKTRIVPRHLLLAIRNDQELGRLLSGVTIAHGGVIPNINPVLLPKKTAEKAEKTAAKSPKKATKSPKKATKA

SEQ ID NO: 123762 - protein, 87 aa, Triticum aestivum
  Clone ID: PAT_TA_18180.pep
ICVWRRGLRLVHPPVYCVLVSCDHYHALVSCLTCMVSFLNFQLHIMVGCVSEWECVHVSVCVSTVTVSQLAKRSVMCGFSEGVTVTE

SEQ ID NO: 123763 - protein, 83 aa, Triticum aestivum
  Clone ID: PAT_TA_18181.pep
TESSLSVNDVEEEEEEEEVWSTLLLPGHALSSVNSQKHACRAFFRVHRRLACEQGCFSDAEEKRQVLSAREGYAFLPGLPLSI

SEQ ID NO: 123764 - protein, 154 aa, Triticum aestivum
  Clone ID: PAT_TA_18182.pep
MDAGKLKKVAGKKFGGPRKKSVTRSVKAGLQFPVGRIGRFLKKGRYAQRVGSGAPVYLAAVLEYLAAEVLELAGNAAKDNKKSRIVPRHLLLAIRNDQELGRLLSGVTIAHGGVIPNINPVLLPKKAAEKAEKAGTAAKSPKKATKSPKKATKA

SEQ ID NO: 123765 - protein, 561 aa, Triticum aestivum
  unsure (1)..(561): unsure at all Xaa locations
  Clone ID: PAT_TA_18183.pep
MADLQTPLVRPKRKKVLVDYLVQFRWILVIFVVLPASALIYFNIYLGDMWSAMKSEKKRQKEHEENVQKVVKRLKQRNPKKDGLVCTARKPWIAVGMRNVDYKRARHFEVDLSAFRNILEIDPERMVAKVEPLVNMGQISRATCPMNLSLAVVAELDDLTVGGLINGYGIEGSSHIYGLFSDTVVALEIVLADGRVVRATKDNEYSDLFYGVPWSQGTLGFLVSAEIKLIPIKEYMRLTYTPVKGPLKEVAQAYADAVAPRDGDPAKVPDFVEGMVYSATEGVMMTGVYASKEEAKKKGNKINSVGWWFKPWFYQHAQTALKKGEFVEYIPTREYYHRHTRCLYWEGKLILPFGDQFWFRFLFGWLMPPKVSLLKATQGDAIRNYYHDNHVIQDMLVPLYKVGDALEFVHHEMEVYPLWLCPHRLFKLPVKTMIYPEPGFEHHQRQGDTSYAQMFTDVGVYYTPACIFRGEEFDGAXPVKRLEQWLIENHSYQPQYAVTELNEKDFWRMFDASHYEHCRQKYGAVGTFMSVYYKSKKGRKSEKEVQEAEAAILEPAYADEA

SEQ ID NO: 123766 - protein, 473 aa, Triticum aestivum
  Clone ID: PAT_TA_18184.pep
MDVPLASKTFPSPSPSKREQCNIDGHKSSSKHADLNPHVDDSVLGIILGGGAGTRLYPLTKKRAKPAVPLGANYRLIDIPVSNCLNSNISKIYVRTQFNSASLNRHLSRAYGSNIGGYKNEGFVEVLAAQQSPDNPDWFQGTADAVRQYLWLFEEHNVMEYLILAGDHLYRMDYEKFIQAHRETDADITVAALPMDEERATAFGLMKIDEEGRIIEFAEKPKGEQLKAMMVDTTILGLDDARAKEMPYIASMGIYVISKHVMLQLLREQFPGANDFGSEVIPGATSTGMRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDTLLMGADYYETEADKKLLAEKGGIPIGIGKNSHIKRAIIDKNARIGDNVMIINVDNVQEAARETDGYFIKSGIVTVIKDALLPSGTVI

SEQ ID NO: 123767 - protein, 564 aa, Triticum aestivum
  unsure (1)..(564): unsure at all Xaa locations
  Clone ID: PAT_TA_18185.pep
MADLQTPLVRPKRKKVLVDYLVQFRWILVIFVVLPASALIYFNIYLGDMWSAMKSEKKRQKEHEDNVQKVVKRLKQRNPKKDGLVCTARKPWIAVGMRNVDYKRVRHFEVDLSAFRNILEIDPERMVAKVEPLVNMGQISRAXTCPMNLSLAVVXAELDDLTVGGPHQRATGIEGSSHIYGLFSDTVVALEIVLADGRVVRATKDNEYSDLFYGVPWSQGTLGFLVSAEIKLIPIKEYMRLTYTPVKGPLKEVAQAYADAVAPRDGDPAKVPDFVEGMVYSATEGVMMTGVYASKEEAKKKGNKINSVGWWFKPWFYQHAQTALKKGEFVEYIPTREYYHRHTRCLYWEGKLILPFGDQFWFRFLFGWLMPPKVSLLKATQGDAIRNYYHDNHVIQDMLVPLYKVGDALEFVHHEMEVYPLWLCPHRLFKLPVKTMIYPEPGFEHQQRQGDTSYAQMFTDVGVYYTPGXIFRGEEFDGAESVKRLEQWLIENHSYQPQYAVTELNEKDFWRMFDASHYEHCRHKYGAVGTFMSVYYKSKKGRKSEKEVQEAEAAILEPAYADEA

SEQ ID NO: 123768 - protein, 193 aa, Triticum aestivum
  Clone ID: PAT_TA_18186.pep
MATNIYCSRSDVHPQRITYCTEPPNPPLAGVPARSKQATMDGSKLKKVAGKKFGGPRKKSVTKSIKAGLQFPVGRIGRYLKKGRYAQRVGSGAPVYLAAVLEYLAAEVLELAGNAAKDNKKTRIVPRHLLLAIRNDQELGRLLSGVTIAHGGVIPNINPVLLPKKAAEKAEKAGTAAKSPKKATKSPKKATKA

SEQ ID NO: 123769 - protein, 154 aa, Triticum aestivum
  Clone ID: PAT_TA_18187.pep
MDGSKAKKVAAKKFGGPRKKSVTKSIKAGLQFPVGRIGRYLKKGRYAQRVGSGAPVYLAAVLEYLAAEVLELAGNAAKDNKKTRIVPRHLLLAIRNDQELGRLLSGVTIAHGGVIPNINPVLLPKKAAEKAEKAGAAPKSPKKTTKSPKKATKA

SEQ ID NO: 123770 - protein, 514 aa, Triticum aestivum
  Clone ID: PAT_TA_18188.pep
MAMAAAASPSKILIPPHRASAATAAASTSCDSLRLLCAPRGRRQRPRGLVARPAPRRPFFFSPRAVSDSKSSQTCLDPDASTSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPDWFQGTADAVRQYLWLFEEHNVMEYLILAGDHLYRMDYEKFIQAHRETDADITVAALPMDEERATAFGLMKIDEEGRIIEFAEKPKGEQLKAMMVDTTILGLDDARAKEMPYIASMGIYVISKHVMLQLLREQFPGANDFGSEVIPGATSTGMRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDTLLMGADYYETEADKKLLAEKGGIPIGIGKNSHIKRAIIDKNARIGDNVMIINVDNVQEAARETDGYFIKSGIVTVIKDALLPSGTVI

SEQ ID NO: 123771 - protein, 308 aa, Triticum aestivum
  Clone ID: PAT_TA_18189.pep
MAAAAGEAPRALSQKEQDIQMMLAADVHLGTKNCDFQMERYAYKRRSDGIYIINLGKTWEKLQLAARVIVAIENPQDIIVQSARPYGQRAVLKFAQHTGANAIAGRHTPGTFTNQMQTSFSEPRLLILTDPRTDHQPIKESALGNIPTIAFCDTDSPMRYVDIGIPANNKGRNSIGCLYWLLARMVLQMRGTILPGHKWDVMVDLFFYRDPEEAKEQEDEAAGAPEYAAITDYGAAAGQWGGDQWTSDAPAPPPVTGGEWPMAEAPVAGGDGWDAAGAPVAVEGAVPAPVVAATGWDAAVQPPAQGWE

SEQ ID NO: 123772 - protein, 155 aa, Triticum aestivum
  Clone ID: PAT_TA_18190.pep
MDGSKAKKVAAKKFGGPRKKSVTKSIKAGLQFPVGRIGRYLKKGRYAQRVGSGAPVYLAAVLEYLAAEVLELAGNAAKDNKKSRIVPRHLLLAIRNDQELGRLLSGVTIAHGGVIPNINPVLLPKKAAEKAEKAEKTATKSPKKATKSPKKATKA

SEQ ID NO: 123773 - protein, 164 aa, Triticum aestivum
  Clone ID: PAT_TA_18191.pep
MPAGHGLRSRTRDLFARPFRKKGYIPLTTYLRTYKVGEYVDVKVNGAVHKGMPHKFYHGRTGRVWNVTKRAIGVEINKQVGNRIIRKRIHVRVEHVQPSRCAEEFRLRKVKNDQLKAEAKARGEVISTKRQPLGPKPGFMVEGTTIETVTPIPYDVVNDLKGGY

SEQ ID NO: 123774 - protein, 473 aa, Triticum aestivum
  Clone ID: PAT_TA_18192.pep
MDVPLASKTFPSPSPSKREQCNVDGHKSSSKHADLNPHANDSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPDWFQGTADAVRQYLWLFEEHNVMEYLILAGDHLYRMDYEKFIQAHRETDADITVAALPMDEERATAFGLMKIDEEGRIIEFAEKPKGEQLKAMMVDTTILGLDDARAKEMPYIASMGIYVISKHVMLQLLREQFPGANDFGSEVIPGATSTGMRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDTLLMGADYYETEADKKLLAEKGGIPIGIGKNSHIKRAIIDKNARIGDNVMIINVDNVQEAARETDGYFIKSGIVTVIKDALLPSGTVI

SEQ ID NO: 123775 - protein, 154 aa, Triticum aestivum
  Clone ID: PAT_TA_18193.pep
MDGSKAKKVAAKKFGGPRKKSVTKSIKAGLQFPVGRIGRYLKKGRYAQRVGSGAPVYLAAVLEYLAAEVLELAGNAAKDNKKTRIVPRHLLLAIRNDQELGRLLSGVTIAHGGVIPNINPVLLPKKAAEKAEKAGTAAKSPKKATKSPKKATKA

SEQ ID NO: 123776 - protein, 308 aa, Triticum aestivum
  Clone ID: PAT_TA_18194.pep
MAAAAGEAPRALPQKEQDIQMMLAADVHLGTKNCDFQMERYAYKRRSDGIYIINLGKTWEKLQLAARVIVAIENPQDIIVQSARPYGQRAVLKFAQHTGANAIAGRHTPGTFTNQMQTSFSEPRLLILTDPRTDHQPIKESALGNIPTIAFCDTDSPMRYVDIGIPANNKGRNSIGCLYWLLARMVLQMRGTILPGHKWDVMVDLFFYRDPEEAKEQEDEAAGAPEYAAITDYGAAAGQWGGDQWTSDAPAPPPVTGGEWPMAEAPVAGGDGWDAAGAPVAVEGAVPAPVVAATGWDAAVQPPAQGWE

SEQ ID NO: 123777 - protein, 308 aa, Triticum aestivum; identical to SEQ ID NO: 123771
  Clone ID: PAT_TA_18195.pep

SEQ ID NO: 123778 - protein, 164 aa, Triticum aestivum
  Clone ID: PAT_TA_18196.pep
MPAGHGLRSRTRDLFARPFRKKGYIPLTTYLRTYKVGEHVDVKVNGAVHKGMPHKFYHGRTGRVWNVTKRAIGVEINKQVGNRIIKKRIHVRVEHVQPSRCNEEFLQRKLNNDKLKAEAKVRGEVISTKRQPAGPKPGFMVEGTTIETVTPIPYDVVNDLKGGY

SEQ ID NO: 123779 - protein, 164 aa, Triticum aestivum; identical to SEQ ID NO: 123773
  Clone ID: PAT_TA_18197.pep

SEQ ID NO: 123780 - protein, 164 aa, Triticum aestivum
  Clone ID: PAT_TA_18198.pep
MPAGHGLRSRTRDLFARPFRKKGYIPLTTYLRTYKVGEYVDVKVNGAVHKGMPHKFYHGRTGRVWNVTKRAIGVEINKQVGNRIIRKRIHVRVEHVQPSRCAEEFRLRKVKNDQLKEEAKARGEVISTKRQPLGPKPGFMVEGTTIETVTPIPYDVVNDLKGGY

SEQ ID NO: 123781 - protein, 276 aa, Triticum aestivum
  Clone ID: PAT_TA_18199.pep
CATVRCFPHVVRVDQPPLRVERVPPLPARSLIFSDGLAGRSGDGRGAWRCPMYIESRYRLRSSSAHVAYGCMPMWRAPPPRTSSGWWLTVAASQARLAGGQSLPRGVLLAHPPISSSGPLFWRLSATSLARGVAVVVKTKSRRDGEPDRVSALIRWLFGSGLGASYGVRRPAGSITSSYMLAEGRPFYFFLPAKMPKGRQLIFCTESMAWCHGSLVVPSGNVPGDGEVTAVQKMSRTRLLFLSGCWGPLCKRQGPVCYLQLVLGPSVKCCVLHVQC

SEQ ID NO: 123782 - protein, 164 aa, Triticum aestivum
  Clone ID: PAT_TA_18200.pep
MPAGHGLRSRTRDLFARPFRKKGYIPLTTYLRTYKVGEHVDVKVNGAVHKGMPHKFYHGRTGRVWNVTKRAIGVEINKQVGNRIIKKRIHVRVEHVQPSRCNEEFLQRKLNNDKLKAEAKARGEVISTKRQPAGPKPGFMVEGTTIETVTPIPYDVVNDLKGGY

SEQ ID NO: 123783 - protein, 164 aa, Triticum aestivum
  Clone ID: PAT_TA_18201.pep
MPAGHGLRSRTRDLFARPFRKKGYIPLTTYLRTYKVGEHVDVKVNGAVHKGMPHKFYHGRTGRVCNVTKRAIGVEINKQVGNRIIKKRIHVRVEHVQPSRCNEEFLQRKLNNDKLKAEAKARGEVISTKRQPAGPKPGFMVEGTTIETVTPIPYDVVNDLKGGY

SEQ ID NO: 123784 - protein, 229 aa, Triticum aestivum
  Clone ID: PAT_TA_18202.pep
MEPSRHRVPAAAVLLVLVAAAAVVGRCGAQLPIPVRTDGFVYGGHAAAPAWGDAVVVEAFFDPVCPDSRDAWPPLQRAAAHYGARRVAVVVHLFPLPYHSSAFMACRSIHTVHKLNASAVYPLLENFFKYQEGYYNMPTYTKTRAAVVAEIANNLVAPVIGEANLAAYRAGFNDSQSDQATRISFKFGCARGVTGTPYYFVNGIPLSDSGSPMDYNKWISTLDPLVGKM

SEQ ID NO: 123785 - protein, 124 aa, Triticum aestivum
  unsure (1)..(124): unsure at all Xaa locations
  Clone ID: PAT_TA_18203.pep
MEPSRHRVPAAAALLVLVAVAAVVGRCGAQLPIPVRTDGFLYGGKSAAPAWGDAVVVEAFFDPVCPDSRDAWPPLQRAAAHYGXARVAVVVHLFPLPYQSNAFDGLPGRSTPVHKLKCVSRVIP

SEQ ID NO: 123786 - protein, 236 aa, Triticum aestivum
  Clone ID: PAT_TA_18204.pep
MDGLVGLLKVRVVRGINLAYRDARGSDPYVVLRLGKQKLQTSVKQRSVKPILHEKQPNSIAYLILHCVSIGSSTDMVSLVGLLKERVVRGIDLADGDASGSDPYVVLRLGKQQLKTSVKKRSVNPIWHEELTLSITNPNAPIKLAVFDKDTFSKDDPMGNADIEVLPFTEVLELDTEGIRNGTVVRSVAPSSGNCLAEESRVCWKNGKFVQDMILRLRNVESGEIMLKLEWVNMKK

SEQ ID NO: 123787 - protein, 302 aa, Triticum aestivum
  Clone ID: PAT_TA_18205.pep
AVGPGSIKDQTTRASSHKANDLDRSGHQQRTMARVLALGAAAAFLLLAVASTMAAAQNCGCAASQCCSRWGFCGATSEYCGTGCRSGPCTVPVTNNVSVPAIVTPAFFGPLVAQAADDCAAKGFYTRDAFLTALGGYPAFGRTGSDDDSKREIAAFFAHVNHETIKFCYIDEINGPSKNYCDPTNAEWPCAAGKGYYGRGPLQISWNYNYGAAGQSLGFDGLNDPDAVARSPVLAFQAALWYWMNSVHDVIVSGQGFGATIRAINGALECNGKNPSAVNDRVAFYKQFCQQFGVDPGTSLTC

SEQ ID NO: 123788 - protein, 232 aa, Triticum aestivum
  Clone ID: PAT_TA_18206.pep
MALNRLVAEDFLESLGKELGLEVPPEKPAQPPNVLFRSEILPTADASVSRNGQTSTFREIKENEGSLGLMEAANGNGDGPSSNVEKLDLKYEHNADIGRSHSSHRQIRNGSPESDTSIERHRSRKRRSHHRNRSPTPDSGSSDERRSGKKRKSHSRHRAGRSRTPDADLSSDSQKNKRKRREKRSHRTRMSDSDSSDHEYKEKYTSSSRRSSDKDRSRKHSKHRRHRRKDSA

SEQ ID NO: 123789 - protein, 357 aa, Triticum aestivum
  unsure (1)..(357): unsure at all Xaa locations
  Clone ID: PAT_TA_18207.pep
MLKHLAKMATASSHTYAPLLLLFLLACSCRASSGHAVDPACPPAKASALAVEISDCGGPRCQPPAPHVPVPVFPYDIDPMQFALNLEYTEAEFFLHAAFGVGLDQIAPNLTLGGPPPVGAMKANLDEVTWRIAAEFGLQEVGHIRAIQNTVGGFPRPKIDLSASNFARVMDQAFGYHLDPPFDPYMDSRNFLMACYVIPYLGINGXPAPTPSSTATRLKHLLAGLLGVEAGQDAAFRALLFERKSETVPPYKGITVAEFTDRISAARNQLAKCGVKDEGLTVPPELGAEGRICTNVLSADRDSLSYARTPAELLRILYLTGDEHVPGGFFPEGANGKIAREFLRKPFAAGGNRVPAN

SEQ ID NO: 123790 - protein, 270 aa, Triticum aestivum
  unsure (1)..(270): unsure at all Xaa locations
  Clone ID: PAT_TA_18208.pep
PSPAKALLYRTPPASHRHRRTCRRGRDEAEEAKLLIWSTAPPPRPNPSTPSPPPRTPARPNLTSPPKTSGRXYADGPSIPSEKTSSRWSEPRKNKTPTXTQPPTKRRPRENAPKLQPPPTTEPAGQSSARTKTYSRAAPPSPPEPEPRTTPASAQPDRALDSEHTQAADLKPPPGTGRRDHAAPETHQIADVSATHAARPEPSATPRSSPRQQKPSYSHQTKLYVQPTRGSGPPSPHDADEGDGSEGARRDRRQELRRRGRQTSLLSDLL

SEQ ID NO: 123791 - protein, 457 aa, Triticum aestivum
  Clone ID: PAT_TA_18209.pep
MSSPRRFSWVVLRKHVPVFDAEEKEQEDKIMAKASKDWGNIENGSWILDQFSLDAHLVEPPELSTLSVRAKIETQERGFGCVLDSVVENYLVMTLVFGDRWYGLVYDAAKNSLSLLPATMDSFAGYDFASRVDSVPFFFLRPPAVLPRDDGSYDLFNLGFRFATRDRVLQGSSGIIFRWSSHAAGKKWTKQEARFSPHTQVPRQPADKVDAAFTFKGKVFWADLMLGAIVCDMPSTGTTTREDLDHVELDFIHLPEECQGRDFSRSYPKDRRTMGPVGDSIKLISIVTISGDNPRDNTPPADVVLRSWTLSPDLRSWTRDQDMELPLPLLWQSEVYKRERLPQAMPQCPVLKADEDGVLYLLLGDYYLDWERRARLCREIECVISIDMRTKSLLSCSHRPIKDGLPAPAPWEEVQPSKDFHPDIPSLVAAKFCANHTGWSHCLLHKEKKNRLIYCRW

SEQ ID NO: 123792 - protein, 169 aa, Triticum aestivum
  Clone ID: PAT_TA_18210.pep
GSRRCGPSPSPPPSSRPGTSCRPAAPSPPSARPPSSLPPPVSPPSSCPRPALPPSARPPSSPPRPVPPPSARPLPSPPRPVPPPSARPPSSQGWPVPPPTMLVSFSWGGGAFAHLLAELHRPARPPASPPRLVSPPFARPPSSPPWPVPTPTWSSRSRGEEVPSITNTC

SEQ ID NO: 123793 - protein, 711 aa, Triticum aestivum
  unsure (1)..(711): unsure at all Xaa locations
  Clone ID: PAT_TA_18211.pep
QLAELVAXHGAVVPLVGLLFGKNFMLHEADARALVKIGKDRPACKLEMVKAGVIESILDILHDAPXFLCTALAEMLRILTNNASIAKGPSAAKVVQPLFSLLSKADTGPEGQYSTLQVLVNILEHPECRADYNLTPRQTIEPVITLLNSSPPAVQQLAAELLSHLLLEEHLQKDTVAEQSIPALIQILSSGLPNLQQRAIKALANLALAWPNTIAKEGGVFELSKVLRGGDPPLPHVVWESAAAVLSSILQYSTEFFLEVPVAVLVQLLRSGTESTVVGALNALLVLESDDSTSAEAMAESGAVEALLDLLRSHQCEEAAARLIEALLNNIRIREAKAAKNAIAPLSMYLLDPQTQSQQGRLLAALALGDLFQNEGLARSTDAVAACRALVNLLEDQPTEEMKVVAICALQNLVMYSRANKRAVAESGGVQVLLDLISSSNPDTSVQAAMFVKLLFNNHTIQEYATSETVRVITASIEKDIWASGSANEEYLKALNALLSNFPRLRVTEPATICIPHLVTSLKTGSEATQEAALDSLYLLRQAWTACPAEVFKAQSVAASEAIPLLQYLIQSGPPRFQEKAELLLQCLPGTLTVTIKRGNNLRESVGNASAFCKXTLGNNPARLTKIVSTGESPEWDEAFAWAFDSPPKGQKLHISCKNNSKFGKKSFGKVTIQIDRVVMLGSVAGEYTLLPESKSGPNRNLEIEFQWSNK

SEQ ID NO: 123794 - protein, 235 aa, Triticum aestivum
  Clone ID: PAT_TA_18212.pep
MLRMQQQVEGVVGGGIMAEAEEAAVYERVARMASGNAVVVFSASGCCMCHVVKRLLLGLGVGPTVYELDQMGGAGREIQAALAQLLPPGPGAGHHQQPPVPVVFVGGRLLGGVEKVMACHINGTLVPLLKDAGALWLCAASCIALLSRRPAGTDGGGDQRRRLLCVLVVFSFLVPCLWLWLCVAWCVERWWLVGCLYSCEGKLNFSCQFFGRVFAGAARGRWMGRDTSAQIRPTM

SEQ ID NO: 123795 - protein, 116 aa, Triticum aestivum
  unsure (1)..(116): unsure at all Xaa locations
  Clone ID: PAT_TA_18213.pep
MLSEAKLACGSVAGLLDYXLTFPLAHVIQQIQVQALSSSNPFKGQQPLGTLARLVKYQGWKQLFSGPFINYLEVVPSAALGFTVYDSMRDWLNVPSKEQAPVLSEDGSDTAPVHSS

SEQ ID NO: 123796 - protein, 100 aa, Triticum aestivum
  Clone ID: PAT_TA_18214.pep
SRPAGGVTKPQQSAKLSFASVFAQFRTQVLNNIVGEVHVMMEYKSAQSFSWPAALASWLASFCCGSEGGGHGELVAGDGPTRQMAAAARHLNGPHKIRFS

SEQ ID NO: 123797 - protein, 174 aa, Triticum aestivum
  Clone ID: PAT_TA_18215.pep
VPRLNVRLQPLMNPTTLSSKSNPGFQIRDPYPKTHSTILLLLFPLAGGGTPERMPRVGSAARGGEQDGDLTLLLPRPRLLSSAGGLLPGTDGRMGVSGRRGGGRRWRWWGSTYTERIVVGSFGDWGHGRWAAREAVRAWHSLPPWPAEGPTGSWCGVRHVSGRAPDAWADAWAD

SEQ ID NO: 123798 - protein, 218 aa, Triticum aestivum
  Clone ID: PAT_TA_18216.pep
MVLWVFGYGSLIWNPGFDFDDKILGFIKGYKRTFNLACIDHRGTPQHPARTCTLESEDGAICWGIAYCVKGGLEKEREAMQYLERRECEYDQKISVDFYKDGNSLEPAVTDVLVFVSTPDPVGNKYYLGPAALEDMARQIATASGPNGYNRDYLFSMEKALSNISHEDDTIIELADEVRKVLSRSTEKKVTGSDIPLKSHTPVVHISALPEGTVAVST

SEQ ID NO: 123799 - protein, 128 aa, Triticum aestivum
  unsure (1)..(128): unsure at all Xaa locations
  Clone ID: PAT_TA_18217.pep
GELFDRLLLGGLEKEWQEILCLERRVCGSTCKNCVDSFTYRNSLEPVVTYFLVIVXTPDPVGNKXYLGPAAFQHMAKQTATASAPNGYNXRDWLFSMEKALSNVSHEEDSIIVLAXDARKVLSRTSEK

SEQ ID NO: 123800 - protein, 68 aa, Triticum aestivum
  Clone ID: PAT_TA_18218.pep
MSYPPPGTAYPPPGQEAYPPPGYGAPPPVAANYQQQAPPQDSQDRGGDGFWKGCCAAICCCCLLDMCF

SEQ ID NO: 123801 - protein, 68 aa, Triticum aestivum; identical to SEQ ID NO: 123800
  Clone ID: PAT_TA_18219.pep

SEQ ID NO: 123802 - protein, 191 aa, Triticum aestivum
  unsure (1)..(191): unsure at all Xaa locations
  Clone ID: PAT_TA_18220.pep
SATYEAVRTNKILKVQKXDKGLDGKACKLAAHTLSSSSSPAKDLFHAVQTSGVLGCSVDAGVYDDVASRLKAVIKDTNSLLEFYYSVRGLLSLKEQGHSVVLSDADSTFHAIKALSQSDGRWRYDTNSAESSTFAAGIALEALAGVVSLSDAEVDPSMIGVVKNDIVKLFGTIKSYDDGTFYFDEKYVDGS

SEQ ID NO: 123803 - protein, 245 aa, Triticum aestivum
  Clone ID: PAT_TA_18221.pep
MDAASSLMGPSSADAPTDGEHRMGTTIVGVCYAGGVVLAADSRTSTGMYVANRASDKISQLTDNVYVCRSGSAADTQVISDYVRYFLHQHTIQLGQPATVKVASNLVRLLAYQNKSMLQAGMIVGGWDKYEGGQIYSVPLGGTILRQPFAIGGSGSSYLYGLMDHEWKEGMTQEEAEKFVVKVVSLAIARDGASGGVVRTVTINEAGVKRSFHPGDKLPLWHEEMEPQNSLLDILAAGSFDAMVQ

SEQ ID NO: 123804 - protein, 246 aa, Triticum aestivum
  Clone ID: PAT_TA_18222.pep
MDAASSLMGGPSSADAPTDGEHRMGTTIVGVCYAGGVVLAADSRTSTGMYVANRASDKISQLTDNVYVCRSGSAADTQIISDYVRYFLHQHTIQLGQPATVKVASNLVRLLAYQNKSMLQAGMIVGGWDKYEGGQIYSVPLGGTILRQPFAIGGSGSSYLYGLMDHEWKEGMTQEEAEKFVVKVVSLAIARDGASGGVDRTLTINGEGVKRSFHPGDNLPLWHEEMEPQNSLLDILAAGSSDAMVQ

SEQ ID NO: 123805 - protein, 339 aa, Triticum aestivum
  Clone ID: PAT_TA_18223.pep
PTRPRPRPRTRGKELQFDLDNNVHYLDITPLKIDVGKYSLVFEITLQDSEHETVYTTGGRNTESVVVTGLIKVDKAEIGISENDAGSAESVEKLDLLKDTKVSLSANHLQKLRLSFQLSTPLGRTFKPHQVFLKLKHESKVEHLFVVPGSARQFKIVLDFLGLVEKFYYLSGTYDLELSVGDASMENSFLRALGQLELDLPEAPEKAPRPPAQAVDPLAKFRPQKEIEHIFRVPEKRPPQEVSLAFTGLTLLPFIGFLIGLMRLGVNLKNFPSLPGPAAFASLFHAGIGAVLLLYVLFWVKLDLFTTLKYLSFLGVFLVFVGHRTLSHLSNTAAKQKTA

SEQ ID NO: 123806 - protein, 264 aa, Triticum aestivum
  Clone ID: PAT_TA_18224.pep
MAMVVKALLVAVVAVAALAQLTVAVDHQVGGSGATWATSGGYDSWSGKQKFSPGDSLVFSYSPAHDVVEVSKADYDACTASKVVARYTGGKTTVKLTTAGKRYFICSITGHCDAGMKLQVNVAAATAAPTKPRGQRSVAPVAAPAPAPEGSATDEQLPTVSSPTGTPTPSSPSGSGAASIGASAAVALAMGMAVALATDPWVPRLNHVGTFADLFLLFLAGSGMHIAFPACSFLPTVLIGFSVLLCHLFVVFVCRRINTIHIRV

SEQ ID NO: 123807 - protein, 156 aa, Triticum aestivum
  Clone ID: PAT_TA_18225.pep
MAFPVSDELLGTFVPIAVYWLYSGLYIVLDALGTADRYRLHPKEDEETRNIPSKRTVLKGVLLQQAVQVAVSLIVFKITGDGSRDTREQPPAPVIALQFVVAMFAMDTWQYFVHRYLHTNKFLYKHVHAQHHTILVPYAFGALYSHPLEGLLMDTA

SEQ ID NO: 123808 - protein, 1160 aa, Triticum aestivum
  Clone ID: PAT_TA_18226.pep
TQIRNAERALPGKNEDTSNEQPSASSPVRYNGKYSRGTVLFAEHSTDTTPPQEPLKFSARSSTDEFVKASTLFPELGSDQTLLQECPKKLSSECPSNQYVQANSVFEAFDVQTPSQDPLKRIFSGPFHGADTPLPEYRSYPIPLQHPSKNLSSGSSSGEYLRAVTPLGLDSNDTPTAKHSKKLFSGSSDHSYIKATNLFPEFDSNGTPLQNHSNKFSVSMNGKHIGAAATLFPELDSVLLKPETPVTRAVAPRGKRVQQDQRMTANNSQSPLWGSNKKVKSAHCSPPGKMVHDEMAESARSKFEWLNPLNIRDANKRRPDDPLYDKRTLFIPPDALRKMSTSQKQYWSIKCKYMDVLLFFKVGKFYELYEVDAEIGQKELDWKMTISGVGKCRQVGISESGIDDAVEKLLARGYKVGRIEQMESAAQAKSRGPNSVIERKLAHVSTPSTAADSNIGPDAVHLLALKEVTLASNGSRLYGFAFLDYAALKIWVGSLQDDDSSAALGALLVQVSPREIIYESSGLSRESRKSMIKYASAGSVKMQLTPLPGTDFSDASQIQMLVHSKGYFKASTDSWLSALDYSVNRDAVIFALGGLIGHLTRLMLDDALKNGEVLPYNVYQTCLRMDGQTLVNLEIFGNNFDGGSSGTLYKHLNHCITASGKRLLRRWICHPLKDVDAINRRLDVVEGFIQHCGVGSITLYYLRKIPDLERLLGRIRSTVGLTSAVLLPFVGEKILKRRIKTFGMLIKGLRVAIDLLSALHREDHGIPALSKSVDIPTLSSLDELVHQFEEDIHIDFEQYQDHDIKDGDATTLANLVELFVGKATEWSLVINAISTVDVLRSFAAMALSSFGTMCRPCILLKDKSPILRMKGLWHPYAFAESGTGLVPNDLSLGQDLSGHNRFALLLTGPNMGGKSTIMRATCLAIVLAQLGCYVPCISCELTLADSIFTRLGATDRIMSGESTFLVECSETASVLQNATEDSLVLLDELGRGTSTFDGYAIAYAVFRHLVEQVRCRLLFATHYHPLTKEFASHPHVSLQHMACMLRPRSGGNGEMELTFLYRLVSGASPESYGLQVATMAGIPKSIVEKAAVAGEMMKSRIAGNFRSSEGRAEFSTLHEDWLQTILAIGGVKDAHLDEDTMDTMFCVAQELKSHFRKGGS

SEQ ID NO: 123809 - protein, 367 aa, Triticum aestivum
  Clone ID: PAT_TA_18227.pep
MDMCPVGGCDRREPRRLCAVTGGRGFMASHLVTALLGSGDWSVRITDLGPQAALSPAESDGLLGAALRDGRAAYVSVDVCELAQLTKALEGVDTVFHTAAADHTNNNFQLHYKVNVEGTRNVIEACNTCKVKTLIYTSSSGVVFDGVHGLFGVDESTPYPDKFPDAYTETKAEAEKMVIKSNGRNELVTCCIRPGSIFGPGDTIVPILVSYGGMMIIVGDGKNCDDFVYVENVAHGHVCAEKTLSTIDGAKRSGGKAYFITNMEPVNMWDFVYMILEELGYKSRFRLRIPSYFLKPITYLVDWSYHNIFSHYGMRQPGMLTSASIKYATLNRTFNCNNAAQQLGYKPIVSLKEGVKMTTDFYRRLRA

SEQ ID NO: 123810 - protein, 470 aa, Triticum aestivum
  unsure (1)..(470): unsure at all Xaa locations
  Clone ID: PAT_TA_18228.pep
MYHKMVFIYLGLCSYYQLVSYKDGMTRLSKSWRTWNTPELTLVTPIAVVGGRKTSLVLKPRLLAFPGTLTHCTXRGKYISKEVLCSAYPGTIYDDSRSXRPLTYREEPSLTLGRCFIEVXRTGXRGNSFPVIFANKSICXRSLRNLEDELEDPRXLNVSPDDQVHDARPLKPRDQVLHFPNELGWPFQAPAPSSPSTFPDVSDSELIQFSTARFRHLLLFSNERDWCSLTKTLLEILSKRSMVSEELSHETLEMLSEIHLLNRAVKRKSSHMVHLLVHFVVICPDNSKLYPFLPNYPGPGGLTPLHLAASIDDAEDIVDALTDDPQQIGLSCWHSVLDDEGLSPELYAKFRNNGSYNELVTRKLVDRKNSQVTIVLNKGEIHMDQPGNVGANNASGIQALEIRSCNQCAILESGLLRRPMRSRGLLARPYIHSMLAIAAVCVCVCVFMRALLRFNSGRSFKWERLDFGPT

SEQ ID NO: 123811 - protein, 170 aa, Triticum aestivum
  Clone ID: PAT_TA_18229.pep
HSSQAAPNQRVRRRPTAVGRRDARRREATGRRAPGPRERLQLPLWLEAEGRGSLHRSTDTPPSARSSPSPRSPPSEASVPELTILDADGVRPRRAASPPPHTFASVATARPFLGDSIAPRLGAHLGRVFSEHGVHGRRDPPPRIIWLIGRRGTRALRVHPETTVPSCVGG

SEQ ID NO: 123812 - protein, 139 aa, Triticum aestivum
  Clone ID: PAT_TA_18230.pep
ETCKVASKQETIRAQALSSSIGAAAGPKQPNASCNSTGGCGSPSTISVFTWSRRASASAGSSPVCWCRWTLCLQTPEPNLLHQMPRPSVAFLDKYHPQQFAVHPFDSEHDNLLVLNALCLHLSVTISQGFWHELSRHEK

SEQ ID NO: 123813 - protein, 235 aa, Triticum aestivum
  unsure (1)..(235): unsure at all Xaa locations
  Clone ID: PAT_TA_18231.pep
HQLNKLHLGLFHGGGFNRLDALTPSSRISKGFVLSSAPAHDSVSCLLTIGTPQSTEDSVDRKTPHIMSSALPLPSGQPGTPSGACQSLSSSLISCTLVCSTAARLHGSSICIGFSSQGHEASDLGLEAGHCKXVFMESEDVGRTIDLSVFGSXDELYGRLADMFGIEKEEIISHLRVRVTAGAVMHTGGLPLSDFMKVARRLTIISGEKGGLAKPLIECMVRPVGFRDVHGFDFL

SEQ ID NO: 123814 - protein, 260 aa, Triticum aestivum
  Clone ID: PAT_TA_18232.pep
KPRVPRLLDEQFDLLALEEYGASDDDDGAVRDGEHELPTEVIDELKLFHNQNVCVDEEYRTPADFVRGKLDSTTAEEVDESANVIQKCAEYAERYLNETAEDEDVLLVSESSDESEVWDCETIVSTYSNLDNHPGKIQTPGNPKNRLPKVFPGETATTKDIIKLHGKEKLPVDYLPQRKRKVEKEKKAKPTEASDAEYYFEKVVVQKETKDEKKARKSAVKEEKREARKAKKELKELYKFETQKAQKVAAVTGPSSIRLI

SEQ ID NO: 123815 - protein, 488 aa, Triticum aestivum
  unsure (1)..(488): unsure at all Xaa locations
  Clone ID: PAT_TA_18233.pep
MARGGGNGEVELXVGGGGGRGGAPGRPGPTRPGHHASARLILAGMVAGGXVQYGLGAPALPSAQPTSIWDSRNFQYALTSFHVGLCGPIAGLVGHXERCSVRSQKRDLYMVGADRALLMCVFLFWLADWSLNTLXGNSAGLVGRFXAQHGPSAANSIFCSWIGLGNDLWYASGSTNNWHKWFPFLRTRACCEACANLKGAFLVAVLFLAFCLVITVIFAKEIPYKAIAPLPTKANGQVEVEPTGPLAVFKGFKNLPPGMPSVLLVTGLTWLSWFPFILYDTDWMGREIYHGDPKGTPDEANAFQAGVRAGAFGLLLNSVVLGFSSFLIEPLCKRLGPRVVWVSSNFLVCLSMAAICIISWWATQDLHGYIQHAITASKEIKIVSLALFAFLGIPLAILYSVPFAVTAQLAAKRGGGQGLCTGVLNIAIVIPQVIIAVGAGPWDELFGKGNIPAFGMASAFALIGGIVGIFLLPKISRRQFRAVSGGGH

SEQ ID NO: 123816 - protein, 111 aa, Triticum aestivum
  Clone ID: PAT_TA_18234.pep
DPGAGRATWAIGPGSSGPFGPGWRDKPGPMCLAPGPPPLVPVGGMNRDQRTPISPSSYHQPGLKCWSSLRPEFSPTSPTEGGSHRFISPSLSALLSSSQNENRCPYTGNLT

SEQ ID NO: 123817 - protein, 103 aa, Triticum aestivum
  Clone ID: PAT_TA_18235.pep
GIPSDNLPSCEAHTPPCPSHRARPAFQPTPMAWRQPTVRLLPPPSAVRWLLLVAPASPSPCTALSDDDNRFTRYSTTAGHTGHSGHATSSAIPYPQETSPSYS

SEQ ID NO: 123818 - protein, 193 aa, Triticum aestivum
  Clone ID: PAT_TA_18236.pep
MSYMRGDLLTKTRKLVKGLAKPAPAWLKASPQAPPVTFPRTDGKIEKIELPEDVYVKRFFRRHPDSLYHDAIKISGFDPPPARVFAWRVLELKEQGVNEDDAMAVADMEYGAEKKAKKLAYKELKQIARREGKPPPPNPYPSAIKEIQAEENKYVRDRFHNPKVLEIVNKMKEASQMFLQDRAPASGGSGEGQ

SEQ ID NO: 123819 - protein, 177 aa, Triticum aestivum
  Clone ID: PAT_TA_18237.pep
MSSDYSSSWARALVHISPYTFSAIGIAVSIGVSVLGAAWGIFITGSSLIGAAIKAPRITSKNLISVIFCEAVAIYGVIVAIILQTKLESVPTSRMHDPESMRAGYAIFASGLIVGFANLVCGVCVGIIGSSCALSDAQNSTLFVKILVIEIFGSALGLFGVIVGIIMSAQATWPTKV

SEQ ID NO: 123820 - protein, 174 aa, Triticum aestivum
  unsure (1)..(174): unsure at all Xaa locations
  Clone ID: PAT_TA_18238.pep
MSSDYSSSWARALVHISPYTFSAIGIAVSIGRSLSVGAAWGIFIXGGRSLIGAAIKAPRITSKNLXSGVIFCEAVAIYGCNRGELVLQTKSWMSVANYSRTGYAFFASXLAGYANLVSWVCFGRIGSSCALCDAENSTLFAKSLTSLVFEIFCSLFGVIVGILXTAQAIWLAKL

SEQ ID NO: 123821 - protein, 130 aa, Triticum aestivum
  Clone ID: PAT_TA_18239.pep
GLGDEDLGNSIVEAKSEHNEFAKKKKELEMQEKKYHEELKMEIEGTTFSNLSNKKADSAADVADEDEAQAAIDQAEKDADDIAKSVVSRRKRGLIEAMQISNDRKKSKVELLKQRKKAAESSASAKAKRR

SEQ ID NO: 123822 - protein, 602 aa, Triticum aestivum
  unsure (1)..(602): unsure at all Xaa locations
  Clone ID: PAT_TA_18240.pep
MPKHYRPAGKKKEGNAAKYITRTKAVKYLQISLAVFRKLCILKGVFPREPKKKVEGNHKTYYHMKDIAFLAHDPLIEKFREIKVHXRKKVKKAMAKKNRDLADRLLNRPPTYKLDRLIIERYPSFVDALSDLDDCLTMVHLFAALPAIEGERVQVQRIHNCRRLSHEWQAYISRTNSLRKSIHIXVKGIYYQAEVQGQKITWLTPHALQQVLTDDVDFNVMLTFLEFYETLLGFVNFKLYHSINVNYPPILDPRLEALAAELYALSRYMSSGRLPGNPESNGLIEDKETENNKESSKTDESELRLAQLQHQLPANEPGALMHLVEESTADDTEEESVKECRTLFKDLKFYLSREVPRESLLFIIPAFGGTVSWEGEGAPFDETDQDITHQIVDRPTQSHVFLSRHYVQPQWIFDCVNILKVIPTDDYIVGRVPPPHISPFVDNDKEGHIPDYAVTLEGYKSAGQNQVMPLPGLGDEDLGNSIVEAKSEHNEFAKKKKELEMQEKKYHEELKMEIEGTTFSNLSNKKADSAADVTDEDDETQAAMEQAEKDADDIAKSVVSRKKRGLMEAMKISNDRKKSKVELLKQRKKAAESSASAKAKRR

SEQ ID NO: 123823 - protein, 188 aa, Triticum aestivum
  Clone ID: PAT_TA_18241.pep
MQAFARLSSPAASRKVISGVSGAVARPCYRTWRWKAHAAPLSAPGPPKGKKREYISKNERKARMKEFIEGYQASNDGRFPTMQMIRQSVGGGHYTIRDVLSEVKYNQIKFPFDKSKAAQLQETAEGAEQSRPEEDSGNSSFNSQSFNGNQDEDDTLLSQKDSPAGNTIMENTEASISLDAKEAKLPAI

SEQ ID NO: 123824 - protein, 196 aa, Triticum aestivum
  unsure (1)..(196): unsure at all Xaa locations
  Clone ID: PAT_TA_18242.pep
NLSWRTSTVTGRSVSGPLSPLAPEVTNIPNPTTGRSGQLLPALMNMSGPLMGVRSSAGHLRSRHVSRDSGDYYFDTPNSNDEFLHQGGSGIHGINAIELQSALQGHQHLLSRADIALILLAEIAYENDEDFRENLPLLFHVTCVSMDSSEDIVLEHCQDLLVNLLYSLAGRHLELYEVXSSEWENNQYVVSLIKYI

SEQ ID NO: 123825 - protein, 94 aa, Triticum aestivum
  Clone ID: PAT_TA_18243.pep
PQVLQLGRECVDPSHRPPMMAREKSGKEKRMLLSWSSERLAVDAVTHWMPSTASRGRAPRRLRKIWMHGILVLTLQCVLFRCCDLYTLWKKPPV

SEQ ID NO: 123826 - protein, 131 aa, Triticum aestivum
  Clone ID: PAT_TA_18244.pep
TRHSPSPFLSCRPRNRCCSPRRACSPPPHPIPVALPPPFLLPSYHSPPPGLEIEEEAEPLPAVGPQTVLIDQAQGRGARRIRARQLAPPALLLWISSSSSSRRSSSSVRLSSHRRHLLRPANRRRTARGGM

SEQ ID NO: 123827 - protein, 273 aa, Triticum aestivum
  unsure (1)..(273): unsure at all Xaa locations
  Clone ID: PAT_TA_18245.pep
MAACRGFFECLLRLLNFFLTVAGLAMVGYGIYLLVEWMRPRRLSXLTFGRPMLTVVALGEGGSFFDKLPKAWFIYLFIGVGAVIFVVSLFGCIGAGTRNTCCLCCYSFLVILLILAEAGGAAFIFFDHSWKDVIPVDKTQNFDAMYDFLNENWKIARWVALGVVVFEVLLFLLALAVRAMNKPAEYDSDDEIIGTARSTSIRQPLIHSQNAPATGVPVPTLDQRASRNDAWSQRMREKYGLDTSQFTYNPSDATRYQQNGAPPAEERSRCTVM

SEQ ID NO: 123828 - protein, 552 aa, Triticum aestivum
  Clone ID: PAT_TA_18246.pep
KLKRSSLPAALQVDKSSCPYFTELCYKILELIDRESDTSVKIAAISSLETLAKEYPSENPAYSKCLATIISHISSGDSVTSSGLINTAGSLINVLGSKALPQLPLIMKNMLQRAHLVSCCPSGKYVHGSPRTDASLSNQSISMLLSVLATIQVIVQKLGEFVSPYLEEILDLVILHPECATQIDGKLDVKAADVRGLLTETVPVRLILPPLLNLYSSATKCGDASLSLSFQMLANVVGTMDRLAVGTYHTKIYEHCLEALDLRRQNLDSLKNINLVEQSITHTIITLTMKLTESTFRPLFLRTLEWAESEVDQSTSKRSMDRAIVFYKLVNKLAEQHRSLFTPYFKYLLEGSVQYLSEDGVLISSKRKKKAKLGDDIVKYKDSLSGQKLWNLRALILKSLHKCFLYDNDQKILDSSNFQTLLKPIVSQFVAEAPESLDSVPDAPSVEEVDEILVSCLGQMAVTARSDVLWKPLNHEVLMQTRSDNVRPKMLGLKVVRYMVQHLKEEYVALVPETIPFLGELLEDVELPVKTLSQEILKEMETLSGESLREYL

SEQ ID NO: 123829 - protein, 153 aa, Triticum aestivum
  unsure (1)..(153): unsure at all Xaa locations
  Clone ID: PAT_TA_18247.pep
MCTTSEWYCDPVLKVMLLDNNEPTSYGEAMVGPYSDKWLEAMKSEIGYMYQNKAWTLVDLXDDRQAIEXKWIFKKKTDVDGNVTVYEALTCGRXRLFSQVQGVDYDEVFSSVAMLKVRRNHVSISCIYGIGQEDVKTSFLTNFCMESLYVIQS

SEQ ID NO: 123830 - protein, 101 aa, Triticum aestivum
  Clone ID: PAT_TA_18248.pep
MAAGGVWVFKNGVMELEQEAASRKALVYMPANETMRSLEALERRLGSLGWERYYEDRAIVQLHKRGGVDLISIPRDFSRLRSIHMYDVVVKNRDHFKVVDL

SEQ ID NO: 123831 - protein, 282 aa, Triticum aestivum
  unsure (1)..(282): unsure at all Xaa locations
  Clone ID: PAT_TA_18249.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTXLADYNIQKESTLHLVXXLRGGMQXFVKTLTGKTITLEVGXLGHHCNGKARSRTRXGIPPDQTPLFCAGLWVAPS

SEQ ID NO: 123832 - protein, 503 aa, Triticum aestivum
  Clone ID: PAT_TA_18250.pep
MRYLVSTDAGSFITAQAKPNVTGKLDFDLNELGDEGNHSEPVTSPVICTSGIHVPGLSPFVSPVLIGWPAPITVAAPAKGPFVPPENLLRVKPEAGWKGSAATSAFRPAEPRKDVGTSLTAPDIVGSDAAGKRSRPAFDIDLNVADDQILEDDISQSSAQTVGSESGNSRSRDGPVRSAGIELDLNRADEVAENNQFISNSSNRVEVTLLPARSLPGGLPSTSMNGSKNFFDLNNASADAWASTEPAQRSLSSKGASSIPFLPQVAGLRMNGTEINNMSPWFASANPYAPVAMQSFLPARGEQPYPIETASGTQRMIVSAADSCQFGSDSGRAPVVSTPPTMVFHPPPAYQYAGFPFTPSVHLQTAGFPIGSTSYANSAPAGVPYFPTIAPSLVGSTGALPPQHVRQYAINRPEGSSSDGLDGNWKWKRPGGFDLNSGPASIDLEGKDERILSSVRQNLMTPQQAFAEEQTRMYQLPGVGIKRKEPEGSWDPDRSSYKQLSWQ

SEQ ID NO: 123833 - protein, 179 aa, Triticum aestivum
  Clone ID: PAT_TA_18251.pep
MEDIEDVLGPAGFSGGGAPPGLRLPLSTVAVKPKRRSSKLVQTQPQPDARIPGTQTIYVKTFGCSHNQSDSEYMSGQLSAFGYAITEEPEGADLWLINTCTVKNPSQSAMSTLISKCKTANKPLVVAGCVPQGSRDLKELEGISIIGVQQIDRVVEVVEETLKGHEVRLLSRKTLPSLD

SEQ ID NO: 123834 - protein, 204 aa, Triticum aestivum
  unsure (1)..(204): unsure at all Xaa locations
  Clone ID: PAT_TA_18252.pep
MASLAAASASTALLFPSTSSSKPRLPLSTSLGFSAPARSRRATAVAGSSGRRPGLLVVRAARGKFERNKPHVNIGTIGHVDHGKTTLTAALTMVLASVGGMRAXKYDELDAAPEERARWYQPSTPPPSSTRRETRHYAHVDCPGHADYVKNMITGAAHMDGAILVVSGPDGPMPLPKEHILLAKQVGPTLVVFKRSPQQDCSGV

SEQ ID NO: 123835 - protein, 276 aa, Triticum aestivum
  unsure (1)..(276): unsure at all Xaa locations
  Clone ID: PAT_TA_18253.pep
GDQRCLHPRCRPNAGRAPGLQSNSKRTLTAAREANPELLPSLLTLALNDAMTYEQGXPKTGGPNGSCRLRSQITRPRNSGLSAGMGLLVEAKKEIDTYSKGGPNSFADLIQMGASPAXKKTFLDAAIAKTGGNEEKGRTLYSAYGSSGQWGFFDKMFGRHDAQEPDPEGRVPQWSTASVQEMKDKFISVGLGPRQVAVMSAFFGPDQAATEEKLIADPDCRPWVEKYQRSRETVSRTDYEVDLITAVTKLSYLGQKINYEAYTYPKQKINLGKLKL

SEQ ID NO: 123836 - protein, 205 aa, Triticum aestivum
  unsure (1)..(205): unsure at all Xaa locations
  Clone ID: PAT_TA_18254.pep
MASLLRLQALFSLKLATPRRLPSHLRCAAAVASPLPRRLPAAASNGSPEQRASETDLESGLYLVATPIGNLEDITLRALRVLKCAHVILSEDTRHSGKLLQHYNIKTPLLSFHKFNEREREPIILKRLHEGEAIAVISDAGTPGISDPGMELARLCATEKIPVIPIPGPSAAIAALSASGFXTEEFTFGGFLTKSWPIKNPVIIL

SEQ ID NO: 123837 - protein, 319 aa, Triticum aestivum
  unsure (1)..(319): unsure at all Xaa locations
  Clone ID: PAT_TA_18255.pep
PFAVPAEYHRFPLPPSSSAPAAASRGSAGGDVEEGIVITTPLKRKAPCERKRPXESTEWMITSPGFTEGVSSPHMTPISGKAARTYKSKAKGSKDGLQTPISNAGSPGTPLTPGSSRAEHSLGELTKKFISLLKQAEDGILDLNNVAEILVVKKRRIYDITNVLEGIGLLEKKLKNRIRWRGLDDSGANLDNEISILETELENLKLQEKALDNRISEMHEKVRELTEEENNQRWLYLTEDDIKGLPCFQNETLIAIKAPHGTTLEVPDPDEAGDYVQRRYTIVIRSTMGSIDLYLVSKFEENMEELVGVTTPPRHANVA

SEQ ID NO: 123838 - protein, 217 aa, Triticum aestivum
  Clone ID: PAT_TA_18256.pep
MASGDPKPDENYSSDGGDTTDAESSDESPHQPRRPPRANPILTRLSVSRNPSPLSAATAAPGVCLLRFAWESAAGSLVGAVVGYGKGLVTTKGFKGSFADAASSAKIFAVLAGVQSLVSCSLRKLRGKDDVINAGVAGCCTGLALSFPGAPQTLIQSCLAFGTFSYIIEKLNRQQPALALPSAAGLTCRTMRWKASLCFTPFFQSSEKAEGPGGMIL

SEQ ID NO: 123839 - protein, 164 aa, Triticum aestivum
  Clone ID: PAT_TA_18257.pep
MAREASSSSAPGPSELPPAARGSGSGSGSGGDTPRVPRRRARGDPLLIVCGCFSVVTAATALLCVAVNVLSAVQSFRRNGGYIFGGIFRCYAVVISLFVAVLETEWGFIIKFCKILEYWPARGMLQIFVAVMTKAYPNVERSDLILLQDIASYLLLACGLIYVI

SEQ ID NO: 123840 - protein, 167 aa, Triticum aestivum
  unsure (1)..(167): unsure at all Xaa locations
  Clone ID: PAT_TA_18258.pep
MWRRLQTLAPALHRAAAAAGAAPSPASARAAPLSTAVAAFRRTGPLLSADKPAAAGTSVEDVMPIATGLEREELEAELQGKKRFDMDPPVGPFGTKEAPAVIESYFDKRIVGCPGDEGEDEHDVIWFWLKKDEPHECPVCSQYFVLKXLVYGGNPDGHDDDDDGHHH

SEQ ID NO: 123841 - protein, 378 aa, Triticum aestivum
  Clone ID: PAT_TA_18259.pep
EFGTSRSWRRSRRSSTRSQQSAGMLDISNSIPFDDETEDGKSHELKVLSLDRIKAATGSFSESNKLGEGGFGPVYMGTLPGAARVAVKRLCKNSGQGHEEFKNEVILIAKLQHRNLVRLLACCIQGEEKILVYEYMPNKSLDAFIFNPEKRGLLDWRTRFDIIEGIARGLLYLHRDSRLRIVHRDLKASNILLDTDMNPKISDFGMARIFGGDENQFNTNRVVRTFGYMSPEYAVEGIFSVKSDVYSFGVLILEIITGKRAVSFHGQQESLNIAGYAWQQWNEDKGEEMIDPLIKPSCSIRQVLRCIHIALLCVQDHAQERPDVPAVILMLSSDSSSLPMPRAPTLMLRGRALESSKSSENERSHSIGTVSMTQLHGR

SEQ ID NO: 123842 - protein, 159 aa, Triticum aestivum
  Clone ID: PAT_TA_18260.pep
ARGFRRAVSSHVLTQARYQRQHSTRLHARPVRREDRRRRRSRRTSGTRSGGARREEERLRDVALRRAGAGRPGRRHGPGQAAAAAQAPRAGGGAAGRGRAQDHYCSRGRDRPTRSGRGTRRGRTRRGSEGSTARTTLCSTLGPKCTQTILTMTSRRDRR

SEQ ID NO: 123843 - protein, 439 aa, Triticum aestivum
  Clone ID: PAT_TA_18261.pep
MTFSLDLNASPLPEEEDEQPYEEPPGEADYAHEEEHVESAVATLRREREERRRKLKREHQDEGSMQHPQQIRNDYAPPIKVGRGRIKEAPEGWLDCPAFGEPIDKIIPSKVPLDETFNESVPPGKRYSSKQVVNKQRKAGREIGLVIDLTNTSRYYSPAEWTKQGTKHIKIPCKGRDAVPDNESVNTFVYEVMMYLERQKHTKTPKYILVHCTHGHNRTGFMIIHYLMRTRISCVAEAIRIFAQRRPPGIYKRDYIEALYSFYHEVPENIIVTCPSTPEWKRPSDLDLNGEAKPDDDDDNGDVSPVHNDVEEKVITNDDVLGDAVPFDQQEALRIVCYRLLELPPARGHAQFPGSHPVSLDSDNLQLLRQRYYYATWKADGTRYMMLIMRDGCFLIDRNFCFRRVQMRFPHRNLNEGPHDMTLIDGEMIIDTVPDSRLR

SEQ ID NO: 123844 - protein, 215 aa, Triticum aestivum
  Clone ID: PAT_TA_18262.pep
CLQVPLCLPKGCLFRPGEVRGTHYLPVSAARSGRAASVAEAEKTGLSLDSFKTTVVKRDEEKIHLRIELPGKETQKVFDAALTSLAKDAPPVPGFRRSKGGKTSNIPSSILLSMLGKSRVTKFILQEILSVTVGDFVKKENLKVNPEIATTQSEGDLESSFAPGSSFGFNVILELEKEPDTDDAIDVELSDSMDAPDVLQSDSEEPSEEEPASSS

SEQ ID NO: 123845 - protein, 138 aa, Triticum aestivum
  Clone ID: PAT_TA_18263.pep
RPGGRSHSPSPFPFTHSISPASPRALLGDGEIDFTGSAGGAHGGRRSEVGGKGDQDPGHYLRVDPAGSRVEGGRSGGGGGKRSRDASCGGQVCRGLSFEGRGRAEDFGEEDLRRSLCGGETKDAFLPSLPVSRFHPVG

SEQ ID NO: 123846 - protein, 234 aa, Triticum aestivum
  Clone ID: PAT_TA_18264.pep
MAPTRVLHLIALVLAAAVAADAATITVVNRCSYTVWPGALPGGGARLDPGKSWQLNMPAGTAGARVWPRTGCTFDGSGRGRCITGDCGGALACRVSGQQPTTLAEYTLGQGGNKDFFDLSVIDGFNVPVSFEPVGGSCRAARCSTDITKECLKELQVPGGCASACGKFGGDTYCCRGQFEHNCPPTNYSKFFKGKCPDAYSYAKDDQTSTFTCPAGTNYQIVLCPARNDLHMDQ

SEQ ID NO: 123847 - protein, 225 aa, Triticum aestivum
  Clone ID: PAT_TA_18265.pep
MASSRVLHLIALVLAVATAADAATITVVNRCSYTVWPGALPGGGARLDPGKSWQLNMPAGTAGARVWPRTGCTFDGSGRGRCITGDCGGALACSVSGQQPTTLAEYTLGQGGNKDFFDLSVIDGFNVPMSFEPVGASCRAARCATDITKECLKELQVPGGCASACGKFGGDTYCCRGQFEHNCPPTNYSKFFKGKCPDAYSYAKDDQTSTFTCPAGTNYQIVLCP

SEQ ID NO: 123848 - protein, 625 aa, Triticum aestivum
  unsure (1)..(625): unsure at all Xaa locations
  Clone ID: PAT_TA_18266.pep
MAPPLSSWPWASLGIYKYFLLGPLVWKVAQEWAEQGGAPLGAPWVPLLQLFAVRGVTYQFRVSYSSMLFLTRRRRVVPDLVDFRQVDHEWDWDNFLVLQTLIGAALXVNGPLPLPSGSNDLRVWDPRGLGIALLLHVGFSEPVFYWAHRALHGAPLFGQYHAGHHSTPVTQPLTAGFGTPLEALLLTLTTGVPLAGAFLMGAGSLGLVYVHLLTXSLSSEHGVQQCRGHLSQXFEALPPLRYLIYTPTYLSLHHREKDSNFCLFMPLFDLLGGTLNSKSWELQKEIYQGKNDRVPEFVFLVHVVDIMSSMHVPFVLRSISSVPFENHLILLPFWPVALVYGLLMWCCSKTFLVSFYYLRGRLHQTWSVPRHGFQYFIPAAKAGINRQIELAILRADRMGVKVLSLAALNKNEALNGGGTLFVDKHPDLRVRVVHGNTLTAAVILNEIPSNTKEVFLTGATSKLGRAIALYLCRKKIRVVMLTMSSERFLKIQREAPAEFQQYLVQVTKYQAAQNCKTWLVGKWLSPREQRWAPPGTHFHQFVVPPIIGFRRDCTYGKLAAMRLPKDVQGLGSCEYSMERGVVHACHAGGVVHFLEGWEHHEVGALDVDRIDVVWKAALKHGLTPV

SEQ ID NO: 123849 - protein, 221 aa, Triticum aestivum
  Clone ID: PAT_TA_18267.pep
MPLLAPAAKTLFPSRLPPSPRLHLRRATATAAGGRGDGAAAVSAASGTSARDRRLARVREERRRREYDREHTYPGWARVLENACRDDEEMRAILGDSIGNPELMKQRIQERVRAKGREGFNRPKTGSVAAFKVSFRDFNPLNAFIWFELFGEPTDRDVDLLGGVIQAWYVMGRLGAFNSSNLQLANSMLDFDPSYDSEEASAVMPSSFHDISDVEFQDSWG

SEQ ID NO: 123850 - protein, 250 aa, Triticum aestivum
  Clone ID: PAT_TA_18268.pep
MLPCARSVLRRRGLALLRGFAEGECGRGEALANARCAATLAGLGGARGRVGRWADPPARGEPRRLGAGWPAGAQTRSFLGCGDGEEGSVLSKVYEERRVMGYSPEQMYAVVAAVDLYEDFVPWCQRSRVIRRYDNGSFDAELEIGFKFFVESYVSHVEMEKPKYIKTTASQSGLFDHLINVWEFKPGPVPGTCDLYFLVDFKFQSPLYRQVASMFFKEVVSKLVGSFSDRCFRIYGPAVPVLEKSYRHGR

SEQ ID NO: 123851 - protein, 77 aa, Triticum aestivum
  Clone ID: PAT_TA_18269.pep
MGYLWRVRLSSFAAGASTASAVGFLLLYKDHLLARAAIARQVEDVKRISEKHYEALNHQISALENRKESGTNKEASD

SEQ ID NO: 123852 - protein, 131 aa, Triticum aestivum
  Clone ID: PAT_TA_18270.pep
MLLGAKVVPRDKAVPQGGGDGSGSDGSAGKTRTKRSSSKRRDKEEKRRRRHRRRSRRRSDSSEEGSDDSVDEEEEKELSRSKRRRKQRRGGRRDFSDEDESSGESDKGRGSGKGKRGGAASDDDEDEDEDE

SEQ ID NO: 123853 - protein, 135 aa, Triticum aestivum
  Clone ID: PAT_TA_18271.pep
MEALLELEKVQRVLSLMGSRGLSDSDGSGGGDRFLAHFLLFLAQPFDSLAIEKKVVLISELLREVNSDTLKEVQRLASLEGTNREDEVRLFPLYLPTKKFKTDAEKLTIQDAPMIGFDAMMRANSTLEDFCRSYF

SEQ ID NO: 123854 - protein, 106 aa, Triticum aestivum
  unsure (1)..(106): unsure at all Xaa locations
  Clone ID: PAT_TA_18272.pep
RPAGVEVALVQEVPGTVPGRSYRLSFSIGDARNGCVGSLGVDVYAAREKLRVSYESRGTGGHKCAKLEFTAIANKTRVVFQSSNHHTVNATLCGPXVDDVWLVRIK

SEQ ID NO: 123855 - protein, 538 aa, Triticum aestivum
  unsure (1)..(538): unsure at all Xaa locations
  Clone ID: PAT_TA_18273.pep
ARVRGRVGGRVGTYISIADQFNNLGTPAWLRATNTYPANNIPDVGSVNVTVNCSCGDPGISTAYGLFLTYPLRDRETLASVAANHSFSSPEQMDLLRKYNPGMDGVTGSGIVYIPAKDPNGSYLPLKSQGQNWSSRELIIARCXGKKSSAGAIAGGVVAGVLALVLGVVLFLFYRRRKAKQDALLPSSEESTRLASAVSMQKVTPSSSQADGASPAAGITVDKSVEFSYEELFNATEGFNIIHKIGQGGFGAVYYAELRGEKAAIKKMDMQATQEFLAELKVLTHVHHLNLVRLIGYCTESSLFLAFDFCDFATLRHHLRRPGYEPLSWVERVQIALDSARGLEYIHEHTVPVYIHRDIKSANILIDKNTRAKVADFGLTKLTEVGGGTSLQTRVVGTFGYMPPEYARYGDVSPKVDVYAFGVVLYELISAKDAIVRSTESASDSKGLVYLFEEALNAPDPKEGLKRLIDPKLGDDYPIDAILKMTHLANACTQEDPKLRPTMRSVVVALMTLSSTSEFWDMNALYENPGLVNLMSGR

SEQ ID NO: 123856 - protein, 267 aa, Triticum aestivum
  Clone ID: PAT_TA_18274.pep
GTRPPTRPPTRPSKRSRTRESRSPFPSPSPRFHPAEEAPPPDPVPMPQKRRRRPRRRSPREGSSRRLRGEDGASLSGSLVESDGSSSSSSPSSGSPSLDDPSDTRSSRRYESRYHEILASRLAQLPLPACADDDGPDLPSDETVEALVRSSFYDDELRAALVEYQAHNFFLGGPDVQGRDGDSGEFDSSSVIHDVTQEDLLADNERLRSHIHDEIDTESQLDLEELDRLYHKYARYRLKACMLLKGMPIDDAALGMPVHPRVALDYL

SEQ ID NO: 123857 - protein, 340 aa, Triticum aestivum
  Clone ID: PAT_TA_18275.pep
RPATYNFLTMVGHSRSGNGSRKLLGSGDQGGAVAFGSGSDPSKRFHVALTATDALYSQWQSRIMYYWYKQMRVRPGSDMGGFTRILHSGKPDGLMDEIPTLVVDPLPEGADRGYIVLNRPWAFVQWLQKANIKEDYILMAEPDHIFVKPLPNLAHGEEPAAFPFFYIKPTDNEKILRKFFPEEKGPVSNIDPIGNSPVIIQKAQLEMAARPPNVSLKMKGAVESDRAFGWVLEMYAYAVASALHGVHHSLQRDVMMQPPWDAKSDNTFIIHYTYGCHYSSKGELTYCNIGKWRFGIRSYLRSPPPRNLSLPPPGVPESVATLVKMVNEATANIVGWDDEI

SEQ ID NO: 123858 - protein, 113 aa, Triticum aestivum
  Clone ID: PAT_TA_18276.pep
SQQKFASNVIEKCLSFGNPVERQILIGEMLGSTEESEHLEVVRKDQFANYVVQKVLETCDDQQREAILTRIKAHLNTLKKYTYGKHIVARVEKLVAAGEKRLGLQPSRVLPED

SEQ ID NO: 123859 - protein, 158 aa, Triticum aestivum
  Clone ID: PAT_TA_18277.pep
NQSPPEGPNHTGISGSDPLEATLPFLPLLIMPPWLPQLEMTTQLGGLASKPGTWPRMKPCEKITSQPCLCHPMEPKWINQQRHGPCRRIESGCPEIEGRFDPTAGNQPARGDSAAQSLRAISAGLSTSTSAGPSPLLRSPLAALLRSPLSLAAPMVGI

SEQ ID NO: 123860 - protein, 193 aa, Triticum aestivum
  unsure (1)..(193): unsure at all Xaa locations
  Clone ID: PAT_TA_18278.pep
MRDPAEIRSLPIDIAFARLQEWLVDRKRVPQDWRKRLAAIRARLAAAFSSLPRDLHPYLQTLELEEIGYLEAKKIYSILLESNTDSRNIFGRLTGSAGEWYSIVKAYEKDHVFLGEAAQIMVQNVNYDIPYQRKQMQKTQQQLAELDRREADIKRLAALSATRYAEACQELGLQGIDVRQELXESAKTLPSTF

SEQ ID NO: 123861 - protein, 203 aa, Triticum aestivum
  unsure (1)..(203): unsure at all Xaa locations
  Clone ID: PAT_TA_18279.pep
ALLDDRANAXFALLSQXCVPLHSFPCLYEALFPPKAAHHHRLPSYIEVLAGEPQMPARYVARGDDAMLPEVPFDRFRIGSQFFTLARRHAVLVVRERRLWRKFREPCLPESQDSCYPEEHYFPTLLDMADPAGCTRYTLTRVNWTDSFEGHPHTYAAPEVSPRLVAELRQSNSSTYEHMFARKFAPDCLGPLMAIADTVIFKD

SEQ ID NO: 123862 - protein, 279 aa, Triticum aestivum
  Clone ID: PAT_TA_18280.pep
SVVAAEVLLNKQIVGEGASSADSTQAPVVLPPPPPPPRLPPNSNEMQATDDTAMDTPVVKEDAKIPRFLPPPPPHPSQLLPLPPRPPMMPPVPPRAPAPGMVRFPPPPSQPDSRPPFMAPGVAARPPPPPPALPPAQMPMSPFGVLPGPSAMLRPPFFPGPEFAAFGPRPQLPQQPSYVKSAASTVVKRPLAQHTPELTAMVPASVRVKRESALPKPKPKAQQQQQQQSSAPSYSALKPSVTPIKSAAQPSPSASKPQSIDDSYMAFLEDMKQLGALDE

SEQ ID NO: 123863 - protein, 190 aa, Triticum aestivum
  unsure (1)..(190): unsure at all Xaa locations
  Clone ID: PAT_TA_18281.pep
MAAEVSSIARMLRGEAGKRRAGAAGKAPEMVTMDLLGGCGGDAGGQDEVVDLEVKVPAGWERRLDLLSGKTFLTPHRHQAAQDGQPDLNLPPTATTAPAAAVTTCAAVCTLDMVRDALQRAAAARSARSPDTSSSSSASTPRRAPPWESPPRSXKHXSPRQXGIRSXPSANSQCHPGPLKSQNRRTYGKN

SEQ ID NO: 123864 - protein, 320 aa, Triticum aestivum
  unsure (1)..(320): unsure at all Xaa locations
  Clone ID: PAT_TA_18282.pep
TIGQCWRHERRPAGRRREHYQWNMDIFGMPKVRAEAELIQAIVLXDEGLGITSSDVGIRLSSRIGLQDLLDMYSVPQYLFTQVWLILDKLGKLSREEIEFKLISTGLSSEAVQGIIEVLSRESLSKLEYXLGSGVXDVADLRIVFSLAEQYGYTDWICLSMHPELFMALHTTHGIVFEAFDREGELRAICGGGRYDRLLSTFGTEDVPACGFGFGDAVIVELLKEKGLLPDLPRQIDDIVFPLDEELEGPASSVASSLRKKGRSVDLVEDKRLKWVFKHAERINASRLILVGKSEWERGMVRVKILSTREEFEVKAGELQ

SEQ ID NO: 123865 - protein, 451 aa, Triticum aestivum
  unsure (1)..(451): unsure at all Xaa locations
  Clone ID: PAT_TA_18283.pep
MDFLFNSLAAPDPASPPPEPEAAAGSSSSSPPADSGDGGGWGGFGGLLKTLTSQSETVLDAYRRDLAEFSTGLRRETDALREAAAQAARDLPSSALALDGLADIVAQGKGAIAQVAATAAASAASPPAPSDAGGPDSDPGPASGHLRYYSRFEAQLRALQSDPATFTADPEDAEDFAAWGAGFSLQERQDEIDALCYESDAVEGMVDRLVPDAVEGEVFWARYFYRVHKLKQQEDARAKLVKRVIAQEEEEDLSWEVDDEVEEEEPAKEEGIKQAPIKEEPKPEVQERENEKLEVAGRVNAVEEAGALDKEQKNADSPQPEVFGSSMVVVDKEEKEDASKLNVEESSDNKTAAEEPHSSTGDAEVKEGTKNETSDSSKDSDYSMVSRQRTATEEDLEWDEIEDLGEHEEKKGSAHGSSSAPKEELRKRLSVVEDXGEDLSWDIEDDDDDKA

SEQ ID NO: 123866 - protein, 145 aa, Triticum aestivum
  unsure (1)..(145): unsure at all Xaa locations
  Clone ID: PAT_TA_18284.pep
SVTWSTRSPAEEVASPXPGLAEGESDAIHPARREIPVPPLRAGPCTGGAVVRPRLRAACQCNKGRTRKKNRMQEAAAASSGEHLHASPLLSWARPCAATASMASLSLCFCIYRKVTSQTLLLSVSAWHRRRGFACLPACLPASAE

SEQ ID NO: 123867 - protein, 320 aa, Triticum aestivum
  Clone ID: PAT_TA_18285.pep
MGILSLITGKPGASGFGSGSTAEQVTEGISAAGLTVLVTGGSSGIGLETSRVFALRGAHVIIAARNTEAASEARKRIMEIHPVARVDVLKLDLSSLKSVRAFADQFNSMNLPLNILINNAGVMFCPFQLSEDEVEMQFATNHLGHFLLTNLLLDNMKTTAKSTGIEGRIVNLSSVAHLHTYPKGILFDQLNDKKIYNDKMAYGQSKLANILHAKELSRRLKEEGANITVNCVHPGLIMTNLMRHSFALMKAIQVVTYLFWKNVPQGAATTCYVGLNPQLKGVTGKYFADCNEEKTSAHAKSDVLAKQLWEFSEELIRSAK

SEQ ID NO: 123868 - protein, 145 aa, Triticum aestivum
  Clone ID: PAT_TA_18286.pep
SAPPSLLASLHVAAGGAGVEPPCARPLPSSPHQTPPRLPHSMPLLMQIAPSSCGGSVLHLEMMRPWWRRGRLPGLEPPDAGGGHGSSSIQWLRHTRVLLLEWLVANLRGTRTCPSCRMMHRPHRFQLVLLKLSTRAISSPTQFLL

SEQ ID NO: 123869 - protein, 77 aa, Triticum aestivum
  Clone ID: PAT_TA_18287.pep
QQINQKTQCMYVSHLSQPSRDSTSTSHLTRPDSLVGLGGEAEPEGKQRVVVLVADALFGDYGFSGKLVVVLVAAHAS

SEQ ID NO: 123870 - protein, 214 aa, Triticum aestivum
  unsure (1)..(214): unsure at all Xaa locations
  Clone ID: PAT_TA_18288.pep
CCXKNGKSASAPLLPLPKKAGKILVAGSHADDLGNQCGGWTITWQGQTGNDKTAGTTILSAIKSIVDPSTEVVFSENPDSAAVDSGKYDYAIVVVGEPPYAETFGDNLNLTIPAPGPSVIQSVCKSVRCVVVLISGRPLVVEPYIGAMDAFVAAWLPGSEGQGVTDVLFGDYGFSGKLARTWFKSVDQLPMNVGDKHYDPLFPFGFGLTTEASK

SEQ ID NO: 123871 - protein, 336 aa, Triticum aestivum
  Clone ID: PAT_TA_18289.pep
IQGFVISDWMGIDKLTTPYGADYPYSVKASILAGLDMIMVPKNYTQFISILTGYVNSGVVPMSRIDDAVTRILRVKFAMGLFENPYADPAMAEQLGKQEHRDLAREAVRKSLVLLKNGKTSDAPMLPLSKKAPKILVAGSHADNLGYQCGGWTIEWQGDSGRITVGITILDAVRAAVDPSTTVVFAENPDAEFVKKGGFSYAIVAVGEHPYTETAGDNLNLTIPEPGQSTVQAVCGAVRCATVLISGRPMVAQPLLAASDALVAAWLPGSEGQGVTDALFGDYGFTGRLARTWFKSVDQLPMNVGDAHYDPLFPLGFGLTTEGTSQGDGVALHSSM

SEQ ID NO: 123872 - protein, 624 aa, Triticum aestivum
  Clone ID: PAT_TA_18290.pep
MGSLHKTTFVLLMFCLAALGSADYLKYKDPKQPLGVRIKDLLGRMTLAEKIGQMTQIERENATAEAMSKYFIGSVLSGGGSVPSPQASAAAWQSMVNEMQKGALSTRLGIPMIYGIDAVHGHNNVYKATIFPHNVGLGATRDPMLIKRIGEATALEVRATGIPYAFAPCIAVCRDPRWGRCYESYSEDPKVVQSMTTLISGLQGDVPAGSEGRPYVGGSKKVAACAKHYVGDGGTFMGINENDTIIDAHGLMTIHMPAYYNSIIRGVSTVMTSYSSWNGKKMHANHFLVTDFLKNKLKFRGFVISDWQGIDRITSPPGVNYSYSVEAGVGAGIDMIMVPYAYTEFIDDLTYQVKNNIIPMSRIDDAVYRILRVKFTMGLFESPYADPSLVGELGKQEHRDLAREAVRKSLVLLKNGKSASSPLLPLPKKAGKILVAGSHADDLGLQCGGWTITWQGQTGNDKTAGTTILSAIKSTVDPSTEVVFSENPDSAAVDSGKYDYAIVVVGEQPYAETFGDNLNLTIPAPGPSVIQSVCKSANCVVVLISGRPLVVEPYIGAMDAFVVAWLPGSEGQGVADALFGDYGFSGKLARTWFKSVDQLPMNVGDKHYDPLFPFGFGLTTEANK

SEQ ID NO: 123873 - protein, 253 aa, Triticum aestivum
  Clone ID: PAT_TA_18291.pep
MGSLRKATFVLLMFCLAALGGADYLKYKDPKQPLGVRIKDLLGRMTLAEKIGQMTQIERENATAEAMSKYFIGSVLSGGGSVPSPQASAAAWQSMVNEMQKGALSTRLGIPMIYGIDAVHGHNNVYKATIFPHNVGLGATRDPMLIKRIGEATALEVRATGIPYAFAPCIAVCRDPRWGRCYESYSEDPKVVQSMTTLISGLQGDVPAGSEGRPYVGGSKKVAACAKHYVGDGGTFMGINENNTVIDAHGLMT

SEQ ID NO: 123874 - protein, 583 aa, Triticum aestivum
  unsure (1)..(583): unsure at all Xaa locations
  Clone ID: PAT_TA_18292.pep
DEGERRRARPCGLDIKGRVLCGGGAVTSPIGSGVAGQSVVDEIEHAVDSPRLGIAMGYGMYAGSGXHSNKXKHLTSPPSVGREDARYGAMKDRIGEETGREVSAKGIRSASAPCAAVCGDRRGGRRYEGYRQHHQVLRALKTLKSVMPVDDRSGSVGSPYVVRHMQLGAXPRHPADRAARSSRPRRIVSASSPGIGGLLRSWVHEPVSSCLPRLGCPISLPCTSRSCSIIXPTIHLSYFLGPYLLKYKLQIRGSVISDWQGIDRITSPPGVNYSYSVEAGVGAGIDMIMVPYAYTEFIDDLTYQVKNNIIPMSRIDDAVYRILRVKFTMGLFESPYADPSLVGELGKQEHRDLAREAVRKSLVLLKNGKSASSPLLPLPKTAGKTLVTGKRRXSHADHLGNQCGGWTITWQGQTGNDKTAGTTILSAIKSIVDPSTEVVFSENPDSAAVDSGKYDYAIVVVGEPPYAETFGDNLNLTIPCPRVPRSIRXVCKSVRCVVVLISGRPLVVEPXYIGAMDAFVACVASPAAEGQGVADVLFGDYGFSGKLARTWFKSVDQLPMNVGDKHYDPLFPFGFGLTTEANK

SEQ ID NO: 123875 - protein, 266 aa, Triticum aestivum
  unsure (1)..(266): unsure at all Xaa locations
  Clone ID: PAT_TA_18293.pep
MSGAAYRDRGFGGAAEMDRKRIKEALEKHTERPSPSTSRGASREKELLAAGKITTQIGKVPKVSDVEEFETDSEDSDVSGSEGEDTSWISWFCSLRGNEFFCEIDDDYIQDDFNLCGLSSQVPYYDYALDLILDIESSNGDVFTEEQNELIESSAEMLYGLIHARYILTSKGLAAMLEKFKNYDFGRCPLXAGQSDILRSSTVKVFCPKCEDLHYPRSKYQGNIDGAYFGTTFPHLFLMTYPHLKPQKPSQQYVPRVFGFKLHKQS

SEQ ID NO: 123876 - protein, 285 aa, Triticum aestivum
  Clone ID: PAT_TA_18294.pep
MEGNKDEALRSVKLAQTALASGDRQQADKFIRIAQRLDPSLPIVDLLTSTKKFDPLNLNGTACQDKTRRGHENLKTPKEFVGPSNVDKGYTEENVRVIRDIRKNKDYYAILGVERTCSLEEIRKAYRRLSLKIHPDKNKAPGAEDGFKMLSKAFMCLGNDQSRKTYDQTGTLEGHEFNDQYSNVMGQRTAWRRRQTRNGFYNYEEDLDPDEIFRSFFYGTRDNSFRGHNVYRTREAGRQEQQRREHPVQGGSFINLTVLMHLSVVLLFVLFAFIPVQQPQYALHK

SEQ ID NO: 123877 - protein, 155 aa, Triticum aestivum
  Clone ID: PAT_TA_18295.pep
ALADLIGLVLPRRPRHAGGRAVAVAVAVAGPAAVLGQLLLQVVVAAVARLLHHLVAPNQPNARLLPSPRAPHGTREVTTPPNVWDRITDPWSGRERARPTEAQRNDRRGEIRPAGDARVAGGVATQGGRGLALARRGGRSTVRAAYRIKTHASAD

SEQ ID NO: 123878 - protein, 222 aa, Triticum aestivum
  unsure (1)..(222): unsure at all Xaa locations
  Clone ID: PAT_TA_18296.pep
MSTKLLNSLSLRRLLGQQRNPIDLYTASRAWSSSTSFSGAHEKNGMGVEADGDLADSWKDADFRGVYRAIICGSVGQVPVQKKLRNGHTXVTVFTVGTGGMFAQRRAGAENLPMPAQWHRIAVHNEQLGTYAVLLWVKLAPVSAVGASVTRAYTDISSVRGKIVPEICVRFDGKIPAVHSGGCGGGYSWGDLRDGLLQVRPAGRCAAGGAALPERLFQAPWP

SEQ ID NO: 123879 - protein, 298 aa, Triticum aestivum
  Clone ID: PAT_TA_18297.pep
ACRYRSGIPGSTHASGEVDMKDLGDPVNFFGRNRMFDSILYNKLVGRPKSKDGREINPYLAKIIKMNPRMVSEIFAYALRSLAVITVENHRMGVPLGAAVKLSNLRISYSHGKFVLLNILPKSPGYKGLTLQQRCNDWIAIRDLVKQLVEEVCGSGVQYPVDFAHWLEKLGEPQPPIFLILYHTVFLRSNARFYYHVSLDQFCRKEPRGKFNMIMNDSDLRELLREIGDLRDLLNLAELNEFLKCCIAGDDGTQAAAAKYPKGGQPSNGTGQQGQAPPATGQQGQPPAATGQQGQPPA

SEQ ID NO: 123880 - protein, 171 aa, Triticum aestivum
  Clone ID: PAT_TA_18298.pep
ARRLLCVGGGRLLVSFLCCRHGDGWSEDEKQRTGSHGLGKSSFSMAYVSGLRRQLSGRLPALISPLTLLAEGRPSIFLPAWSLEGRQFISGLESPASSNGSGWSGCGDPGAPSGSVPGGDGIGSVPELIRTRLSFLFPVWGPPCKNQGPSGSFRLCLGPVVICFVLSPFKN

SEQ ID NO: 123881 - protein, 188 aa, Triticum aestivum
  unsure (1)..(188): unsure at all Xaa locations
  Clone ID: PAT_TA_18299.pep
MRGARLAPCLPLLLLAACWGGGADGHGVHPLSRVAIHRARVALDASAAVRASPNLLGSRGEDTAWVTVEFKIPRASDGDWIGVFSPSNFNASTCPASHGSGPGPAICSAPIKYQVCKLLRQXYNKSRTGALKFQLINXRQXFSFGFFNGGLSKSNARXVSNKXXLANPKAXLPSLAVGKNGTHVDADQ

SEQ ID NO: 123882 - protein, 349 aa, Triticum aestivum
  Clone ID: PAT_TA_18300.pep
FGPAARPRALEGAPPGDAPAPPRLGAPASRPGPRCPAAPGGDALAFAPHSLSFKRSIKDIAALYGCEASLDKVEEFRKAQGLSSISSKCFQAANISAILVDDGLAFDKMLELEAHKEFVPTVGRVLRIEWLAETIINDDSFSGSSWTLDSFTETFVAKLKSVASKIVGLKSIAAYRSGLEIDPCVSKTDAEDGLRKELTGQRPLRITNKSLIDYLFVRPRDISVQSHLPMQIHTGFGDKDLDLRKCNPLYLRAVLEDERFAKCQLVLLHASYPYSKEASYLASVYSQVYLDFGLAIPKLSVQGMVSSLKELLELAPINKVMFSSDGYAFPETYYLGSRKARDVVYRVLS

SEQ ID NO: 123883 - protein, 113 aa, Triticum aestivum
  Clone ID: PAT_TA_18301.pep
LATFDHFTVPCTYLKNPPSSRIGHRSEKQSDVPKQSRIMLNVVFSMLDFFCLLPNIREPSPLPRSFFLSFKSMCSTQRHFFRINIGIYSPDRLALYLSLTYLLALKSLHTAVE

SEQ ID NO: 123884 - protein, 240 aa, Triticum aestivum
  Clone ID: PAT_TA_18302.pep
MDRGDGLSWGGAQRTGNRYATLATPGSEGRRAEVRGGSSAEAERTAVGGRQGKIKRRNTQGITYFGLVWKKNKSDMNAINADDVILGSKDGVGSSMKPICCLCRKRYSPDLMYIRCERCRNWFHGDALRLEEAKIAEVISYRCCRCRRRAIPGCPHSDDYYYKRPEPEPVIQESAANIPSSEEAIGAADENTSSASFGIFEQTVEDIHADSSVHMETFVLGSNQEMNFVDGSYNSAHPFH

SEQ ID NO: 123885 - protein, 76 aa, Triticum aestivum
  unsure (1)..(76): unsure at all Xaa locations
  Clone ID: PAT_TA_18303.pep
KXIVHMSTTKLMSNNHGHGYDYNPCSSMDARKQLDHYPKGHPRAADPADGLETTIARTPRQVCFFFYKVFLYFILV

SEQ ID NO: 123886 - protein, 84 aa, Triticum aestivum
  Clone ID: PAT_TA_18304.pep
PVRPFRVHAASGGARVRARVEEGIMTVVRRVFIGTGMVLRYYTGAPGDSHLKDTWPSCNILEVVPRSHARLDCRVVVPTSPGFR

SEQ ID NO: 123887 - protein, 180 aa, Triticum aestivum
  unsure (1)..(180): unsure at all Xaa locations
  Clone ID: PAT_TA_18305.pep
GARVRSEASRRRKIDSPHHSHGARRDDAAPPAAPPPAPAXPPPWPARPVSPPPSPSISSLATAPSRSSLSPAPMPPPPATSPCAPRAPGYSTTNPFTSPPPPPASPPTSPSLSTLSPNLTPPPSPSSXRPPRPRPRPHPPLTPSPSPSSSPPRXQPHPSPNRPRRVKRPPRPPPAASPKR

SEQ ID NO: 123888 - protein, 206 aa, Triticum aestivum
  unsure (1)..(206): unsure at all Xaa locations
  Clone ID: PAT_TA_18306.pep
MSDSASMAAATEARFVSRRVGGRGSFGDVYRGFDKELSKEVAIKVIDLEEAEDDIEDIQKEISVLSQCRCPYITDYYGSYLHQTKLWIVMEYMAGGSVADLLQAGPPLDEISIACILRDLLHAVEYLHSEGKIHRDIKAANILLTESGDVKVADFGVSAQLTKTMXSRRKTFVGTPFWMAPEVIQNSDGYNEKADIWSLGXTAIEM

SEQ ID NO: 123889 - protein, 120 aa, Triticum aestivum
  Clone ID: PAT_TA_18307.pep
WPRSPRLTHACRESSQGRAAAPPSPTVSRRSLASPHRRRRSTWGSCPSPGGSSSPPSSSSPPTKSTRPPPASLLPLRLSCPLAFFLLPAVDPSLVSSDLSPRWRYLGERVGRVRPGLWIS

SEQ ID NO: 123890 - protein, 73 aa, Triticum aestivum
  unsure (1)..(73): unsure at all Xaa locations
  Clone ID: PAT_TA_18308.pep
VQRRPLDPLEIARAAGFCLLACLLCYLFVTWSILFSSTILSAEKMEMHCFTFVTGFRVHYAGQPLXGNXXPSS

SEQ ID NO: 123891 - protein, 327 aa, Triticum aestivum
  unsure (1)..(327): unsure at all Xaa locations
  Clone ID: PAT_TA_18309.pep
LPPPPTRPPLPPSPPLPPAPLSLSPPLPPRRAPGSSATGPPSPCPPGPTTTTGTAAAPPPPPPSSPAAAACPRRPPTPRRAAPAASPRLAAPPTLLPLTVKQLMDAPQTHDDWSWYVGNGSEVCRVRHEXRMMNKAERIKYVRWNMDDGTGRIEVNRWANETSDNTEMGLVKDGDYVIVNGGLKAFQGKRHIVAYSVRLVTNYNDITHHFLYCIYVHLDLAKAKKSGTQPQVTANASTWNQAPPPNNQAPTLSASGNAGGQDLTDMVMNVFHDPVLVNLDHGVSIEQVASRLNISDALARSTVTHLIDLGNLYPTIDDNHYKSTLNG

SEQ ID NO: 123892 - protein, 295 aa, Triticum aestivum
  Clone ID: PAT_TA_18310.pep
QNDGFKCLEMEAKFIGLCERNKIKLTDTETALSHKIKQHAQDIVDGACEYAGAYAAAAALVCICKEAELMCERAMCGRYNSGNLTCMLCNQLREHAISLMLYKGSGSIAAAAGAAMVGAAKEAKLLRENLSNLSCDEEMSVSIREEACCILQDMHTEAFGANGKNNIAAAAAAGADISTRISTVGNLTCTAANNKKELGSNGCTEWNDDKENMESSNGNNIVAAAAGVGKSSRIRALGDLTCTASSGKEDNKRTLSNGCTEMNDAKENMENVNQKTGEEYMWKKKTEEEAYMETA

SEQ ID NO: 123893 - protein, 134 aa, Triticum aestivum
  Clone ID: PAT_TA_18311.pep
GVLVGIHTDQTISSTRGPHRPIMNLHERSLSVLACRYVDEVIIGAPWDISKDMITTFNISLVVQGTIAENMDFAKDESHPYAVPMDMGIFRRLESPLDITTSTIIRRIVSNHEAYQKRNEKKEASEKKYYESKN

SEQ ID NO: 123894 - protein, 618 aa, Triticum aestivum
  unsure (1)..(618): unsure at all Xaa locations
  Clone ID: PAT_TA_18312.pep
MFGRDPWGGTLEISHADSATDDDRSRDPDRGAMMRXQLDETQQSWLLAGPGDQAGKKXKKYVEQSVCNGYMVTKIFILDRTVLITRGVPLLRRRDYMTANSFRTRRPPPPPPGPLPPSPSPWALMFVNAPRXNHLLNHNSGHWRSKACLEEEILEILLNKTDLHFCYCLQACNWFNYSKGTWPMHLSLTSSMLRTXTRGVHMGGIVDLIPAAQMASVSLHSERVNIFQAGIHTEQATGLGRGTNRPIRVLHRRSSTLLTGLELGWVGVVPRWHSTKAMLTTFNISMVAGRTIAEDIDYTDDNSNQSAAXYCYGHFTINLDSXLWASPHVXFATGKTYHLTINTPHGMANPAXGRFRIXSPIYGVFTWDAKHGGSHVLLWRMQLFLSPGNPYKXEYSDTLHNHTDNVICTNLPXVFNSFNFTKGRIRYNSNXGGPQSIFSTSVNARFPLPLCMLHYLDITDTSKXYCRPNFYTTDVLXKFAKSQLDYILGKEPTKDDXLVGFGKKYPKRVHHRGASIPHNGVKYGCKGGFKWRESKKANPNILVRAMVAGPDKHDGFKDIRTNYNYTEPTLAANAGLVAALISLADIDTGRYSIDKNTIFSAVPPMFPTPPPPPSAWKP

SEQ ID NO: 123895 - protein, 173 aa, Triticum aestivum
  Clone ID: PAT_TA_18313.pep
CTGEGLEGGCSHWALRPNLELGQGRWDEAAHAAGRRVHGAGERAVNVGLTRPLALVLLDAEEADRGARRGRLQTMQGSGGAHMRSRMDGFMAGREIQRGSSLAAPGFRGGRAEGLGAAAEKLQGGGLATPAKRRGKKTVAWTPDAQPSRSHGDLGPRFLSMASGQGSLVPAEA

SEQ ID NO: 123896 - protein, 100 aa, Triticum aestivum
  unsure (1)..(100): unsure at all Xaa locations
  Clone ID: PAT_TA_18314.pep
ERRESTSLWGRFCNWITSTENRLYIGWFGVLMIPTLLTATSIFIFAFIAAPPVYIYGIRGPFSWFLFXGNRICLGVVIPSSAVFGLCFYHFSGCSCWGIK

SEQ ID NO: 123897 - protein, 216 aa, Triticum aestivum
  Clone ID: PAT_TA_18315.pep
PRVPARRRAALRSTRPRPPPATPLAPPAASCPAPPLTTRRRPSPASQSHLAAFFAVHRSPPPTGRDLVGGRGWEGAALASDSRSSRSSRGPICASATSREAWRGVLRSRRAGSSKGIGGWRRRDRGRGWSGRVPARSRPGMERAVGELAAEDGRGGTNSLLPAPHHVPSFLLSDRTESVLQRDPATRGELPPVTLPEKLARVLQKCAEGVPERAPV

SEQ ID NO: 123898 - protein, 344 aa, Triticum aestivum
  Clone ID: PAT_TA_18316.pep
MAYNDPDNESFSRILEKVNHRRRERYAHLLEPGEVADKQLLEDAKRDRITDGYGTSGQPPSTLEGAKFTAKNLLMYHPADRGEAPLTDEELAVRLKGLTKEIDKSNTRLHGKALAEDGRPKEEEAAAILYALVAGSTPGGMAYNDPDKGKKYDLEDLRKTPNPFYIESGKKADNGYSFVKTPSPAPGVDESPFMTWGEIDGTPLRLDPDETPGGSERSHFKIPPPPVRDVKAHLLSRDAAKKIKARTHMFHKPPLPSPVRGGSASPRNLSPAAQKFVRNAIAKSTRTIDESLRASYRGSTPSAGTPKTWFSAHPGLGPRPPSARPASAPPWPFRYPAMLDISIS

SEQ ID NO: 123899 - protein, 42 aa, Triticum aestivum
  Clone ID: PAT_TA_18317.pep
SKTSSKLPSETRPICLSFCPFNQEQCLELTWLSKFSSVKEEY

SEQ ID NO: 123900 - protein, 129 aa, Triticum aestivum
  Clone ID: PAT_TA_18318.pep
MVAVDLIASCQDSIRQIGDEIADALVYLDAGTLEAFQFIGAFPLLLELGARAVCSLESTSPLDAAAEWNSSFAHPARKIVVITSRLLSDAHRYIIRCLGNHGTVSHCTVLTAISEGHSAYVDSPLGAFR

SEQ ID NO: 123901 - protein, 213 aa, Triticum aestivum
  unsure (1)..(213): unsure at all Xaa locations
  Clone ID: PAT_TA_18319.pep
MAASAAHVAALAAILLFIPSLLATVAAQQGKAKAFCISQFAIASQACSILPPSPPEDDHHHHHDDDDDDDDDDDDDDDDDEHHGGDGDRRLRGRHGHAAVINISSLGLMAANNDSSEVHVARNGTGHHGGNHTRRGRGRGRLRGTGRGRRGRVRDGDEDPDHDDDHEEDPDHDDDHEEDSDHDDDHDDEPDDDXDDDDDDHEHNDDDHEHHHD

SEQ ID NO: 123902 - protein, 137 aa, Triticum aestivum
  Clone ID: PAT_TA_18320.pep
LARGEQSILSIYLREQEGASMAALLRFAARKVCGHAGLERPLQGSFMAARSIAVVKEEEPRKLPWTIFHGRLSSLQWFSSTPESPYDPLTNNHKHFPVSLGTRGLEEKRQELLRLLREMDDLQAERCTMEIKKNTKL

SEQ ID NO: 123903 - protein, 222 aa, Triticum aestivum
  Clone ID: PAT_TA_18321.pep
MAVDLQRLRHMLLATGGGHHQLANRPGASAAAMPASGPCYGAAVTGQPYADLFTPPPTMSAADQYSELLALAAVDLARKGDGAQEMTSGNKRRRVDEGSSSVLGEVLAAHAQQQAVAVDHILHRHARKMWAALAEQRRSHLRLIVSTVEARAAKPLKAKDDEVQRSRGMNWAREDPLGRLFRAARPWPDAAPPPVSPPTVLRADLQRVLDAQAVRGGGGGGG

SEQ ID NO: 123904 - protein, 75 aa, Triticum aestivum
  unsure (1)..(75): unsure at all Xaa locations
  Clone ID: PAT_TA_18322.pep
VINNFAAYPAVIELQTVTAQPYXAALDNCFEIDAWGPIEISIMXRHFDRQGKPPYAYHAQYMSHLLSHGQLDGSG

SEQ ID NO: 123905 - protein, 95 aa, Triticum aestivum
  Clone ID: PAT_TA_18323.pep
GSTVIFMPLSGMAIAFKASTSACTAQQLWGHPTRDQCQHGFTHLNERKSRKGSAALHARAIPGNLDLDFGDPSWKQKYQEDWDRRLVCHILQMYL

SEQ ID NO: 123906 - protein, 223 aa, Triticum aestivum
  Clone ID: PAT_TA_18324.pep
MGGVFGRHDTSRQGSHGMKLESKMVESMKQRAAHGTSVKSFNTIIMKFPKIDEGLRKCKTIFEQFDEDSNGEIDKEELKHCFQKLEISFTEEIGDLFEACDINEDMGMKYNEFIVFLCLVYLLNDPTASEAKTKMGLGDLESTFETLVDAFVFLDKNKDGYVSKDEMIQAINESIPGERSAGRIAMKRFEEMDWDKNGMVTFKEFLFAFTRWVGIGENEDDDE

SEQ ID NO: 123907 - protein, 361 aa, Triticum aestivum
  unsure (1)..(361): unsure at all Xaa locations
  Clone ID: PAT_TA_18325.pep
DPLLATPRSAPTARPSAIPPPRRDQRFKMSNRATHWCYACRRPIRLRGQDIICPNCNDGFIQEISETRGALNNYGMFGPRFDDRLDGRFGMMDAMSALMRRRMAEMGSNPVFDPNAAWASTTQGRPSPIGPRLIFGSNMPAQGSDDSGVNVLVRGGRTIVADRPNFRGFLVGGPSLEALREQMXTDXHCNHQGLAPAQHFVIDSMPVVRITRIHLSDDPLCPVCTERFEIGSAGLPVAGTDPAPVTCIXTTMVGRNSCPLCPIPLPXAPSHRPXCSPSTGCGPSAGLRRRLGVDGAGPDPGPVVRNGADDGGSPFSFLWPFGSSSSGPSSYQYGGGGGEPAPAVYNDDPGQITYSEWHYDP

SEQ ID NO: 123908 - protein, 126 aa, Triticum aestivum
  unsure (1)..(126): unsure at all Xaa locations
  Clone ID: PAT_TA_18326.pep
SGFPNCHMYSTEKEFVRLTMKALXEEPIPLTEELRHELSWEAATERFVRVAEIAPATPAKQTPSTSQRFMYINPDELKKNMEEASAFFHNTISGFEAARCVFGAIPNSLQPDEQQCKELGWRPQGL

SEQ ID NO: 123909 - protein, 140 aa, Triticum aestivum
  Clone ID: PAT_TA_18327.pep
GGSLGASDMDSLSTASTPRATNDAEVGSQEGIHHEEEAPEVPQGNLPDFALDSAPEPVVAPESGGRPLRKKGKTVTPAASIQPGVPDSLLEALIGTSIKEEHRTVMSVVIQKVQLAKSGLTEACSSLLTGFEVRILIYVK

SEQ ID NO: 123910 - protein, 228 aa, Triticum aestivum
  unsure (1)..(228): unsure at all Xaa locations
  Clone ID: PAT_TA_18328.pep
MVLGKIAIVIGSGIIGTMVTGGDGSKLPDLRDVLSFSFKFMKQDKKEGSSNASPQNDLLLSQVNYLRDQLQALSREAQCPQIINVNGGPGAGAYGLTFIAVGAIGYLYIRWKGWKISDMMFVTKRGLADACNVVGKQLDQVSESVHASKKHLAGRIDRVDCSLDECHEIIEATGKEVTVIHGDLSAFQEEIXSVHHVVRTLETSLAPCXTQDPQHEEXMSYVRSLKMG

SEQ ID NO: 123911 - protein, 99 aa, Triticum aestivum
  Clone ID: PAT_TA_18329.pep
MQPLLGLALLALLLLASPAPALCRHRAPAAVAATETLDVEASLSRARAAVSTDALPLHQSLAATDTDTNVLVKDEPSGGPSGRLALRLHSRDFLPEEQG

SEQ ID NO: 123912 - protein, 225 aa, Triticum aestivum
  Clone ID: PAT_TA_18330.pep
SADAWAPGKAFPDGPWMPPTGVQVGSTFKGVGDPTTPMWASSEGCERVSVAKAMSTDDMPGIPALPVSGRDGEEILRLVGGDVAPEDWQGGDGAPVYRLGPGPAVLNLTYTGNETIATIQNVISVIEGKEEPDRYVILGNHRDAWTFGAADPNSGTAALLELAQRLSKLQTKGWRPRRTIILCNWDAEEYGLIGSTEWVEENRAMLTSRTVAYLNVDVGVSGSGV

SEQ ID NO: 123913 - protein, 112 aa, Triticum aestivum
  Clone ID: PAT_TA_18331.pep
MVQGRQGQRVRLYVRGTILGYKRSKSNQYESTSLLQVEGVNTKEDVSYYAGKRIAYVYKAKTKSSGTAVRCIWGKVTRPHGNSGVVRAQFRSNLPATSMSKKVRVFMYPSST

SEQ ID NO: 123914 - protein, 185 aa, Triticum aestivum
  unsure (1)..(185): unsure at all Xaa locations
  Clone ID: PAT_TA_18332.pep
MTVTLKTPLEVHHIKLFLTRMPKEKTPYLCCLKKRKFIISTYSVQCSTCQKWRVVPSKLKYEQTRENIIQVPFSCKYVHGWKPQVTCHDPTDISEDNGMAWAIDIPCIPQTPLGWERNITLRNEQSTRFADVYYISPAGRKVSPLKVVERYLEDNPDFAARLQLSQFXSFRVPNPPNCPRQSDAY

SEQ ID NO: 123915 - protein, 52 aa, Triticum aestivum
  Clone ID: PAT_TA_18333.pep
PRVRAPPSSRRAAPPSQEKGSSFALVFLSFVVTQDYDDGRDITEVLKYACFA

SEQ ID NO: 123916 - protein, 62 aa, Triticum aestivum
  Clone ID: PAT_TA_18334.pep
MGKVHGSLARAGKVRGQTPKVAKQDKKKQPRGRAHKRIQYNRRFVTAVVGFGKKRGPNSSEK

SEQ ID NO: 123917 - protein, 137 aa, Triticum aestivum
  Clone ID: PAT_TA_18335.pep
PAVIRPSPSQPPPPPPPQTLAHSPSNPPPPSTWVRCTDRSPVPGRCAARRPRSRSRTRRSSPAAAPTRGSSTTAASSPPSSASARSAAPTPPRSRRAAPPSQEKGSSFALVFLSFVVTQDYDDGRDITEVLKYACFA

SEQ ID NO: 123918 - protein, 77 aa, Triticum aestivum
  unsure (1)..(77): unsure at all Xaa locations
  Clone ID: PAT_TA_18336.pep
MGKVHGSLARAGKXRGQTPNVAKQDRKKQPRGRAHKRNQYNRPLGPPPSSRFGNKRGSDSSGRVRHGRRAASQPSEK

SEQ ID NO: 123919 - protein, 348 aa, Triticum aestivum
  Clone ID: PAT_TA_18337.pep
FSFYNAPAAAPPASLAPPPRRPTSGRGPVFFGSAAAVQPFDLEDLLRASAEVLGKGAIGTTYKAVPESSATVAVKRLKDVAMAEPEFRDRIADIGELQHEFIVPLRAYYYSKDEKLLVYDFMPMGSLSAVLHGSTGSGRTPLDWTIRSSIALAAARGIEYIHSTSSSTSHGNIKSSNILLSKTYQARVSDNGLATLVGSSSSGPSRATGYRAPEVTDPRRVSQKADVFSFGVLLLELLTGKAPSQAALNDEGVDLPRWVQSVVRSEWTAEVFDMELLRNQSSEEQMIQLLQLAIDCVAQVPDARPTMSHVVVRIEEIKMSGGSTEETDQQQQSALNQGDEMVEGPSSP

SEQ ID NO: 123920 - protein, 298 aa, Triticum aestivum
  Clone ID: PAT_TA_18338.pep
MCINAFNTSRFLCYQVYLYGGQVTSWKNNSGEQQLFLSKKASFKPPKAIRGGIQICFPQLGNHGVVEQHGFARNRLWSVDESPPLPDTTSDCHIDLILKQSEEDMKTWPHSYELRLQVALSPRGDLILTSRIKNKNADGKPFQFTFAYHTYFSVSDISEVPARAAAPSGVRPCLPANLPCTVQGVAVVVESGVDRIYLSAPPKIVTIDHEKKRTFVLRKKELPDVVVWNPWDRKAKAMPDFGAEEYKCMLCVGAARIEKPITLRPGEEWQGRQEISPVPSSYSSGLLDPEMIQQMQRI

SEQ ID NO: 123921 - protein, 245 aa, Triticum aestivum
  Clone ID: PAT_TA_18339.pep
MAQRTISLCLILGLLAAAAPANATSFDFYYLVLMWPGAYCVDSEYGCCVPKYGYPAEDFFVQSFTTFDLSLNKAIVRCNSDKPFDINKLEPIENNLNHYWSNIHCPRTDGTSTWKSEWRSYGVCSGLKEVDYFRAALNLRKNADVLGALAEQGINPDYRLYSTEHIKWAVNQKLGVMPGVQCRDGPFGKKQLYQIYLCVDKNGEAFIDCPKLPKLQCPEEVLFHPFHTWMLNATSPAKIMLPTEA

SEQ ID NO: 123922 - protein, 168 aa, Triticum aestivum
  unsure (1)..(168): unsure at all Xaa locations
  Clone ID: PAT_TA_18340.pep
MGSAHPSQGLPSGMDPSMVDEYASQSKLLQEFVKIPSIGKAWVFTSKDENASRAMVSVSQSDLLANKKRSFLSKYSHLKGSSKSASFQWVSFPXLNSAGVSAXVPSTRPADMLLLVRVGRRPLRDAVEGVPPTRLGLWGPWLLGNEIHVARSVHGSLYTDGWFEGISW

SEQ ID NO: 123923 - protein, 147 aa, Triticum aestivum
  unsure (1)..(147): unsure at all Xaa locations
  Clone ID: PAT_TA_18341.pep
KNFGISRILQKNTSEGTQTSYSLTGIKGSIGYVAPGDXILLTLYFTFSLKYGMLTTNLCIIAKYGKGSVVSTAGDIYSLGILLLEMFTGRRPTEGTFRDSLDLHKFVEDALPNRTFEIADPTMWLKFTGEDGAEREASTREIQNIIE

SEQ ID NO: 123924 - protein, 457 aa, Triticum aestivum
  unsure (1)..(457): unsure at all Xaa locations
  Clone ID: PAT_TA_18342.pep
TSCSAAARCLCRRRRGQRSASTTWRVFRACTRVRIQGDPSPSPPGTASPRQRTGRILAMSLPLIATLLLIRVCVCXWRRRESAERMPLVPIPYSATNSDDVESIDTIVLRLSTLRAATDNFAESNKLGEGGFGAVYKGVLSEGEEIAVKRLSQSSTQGIEELKTELVLVAKLQHKNLVRLLGVCLEGQEKLLVYEYMPNRSLDTVLFDAEKSRDLDWGKRLKIVNGVARGLQYLHEDSQLRIVHRDLKASNVLLDSDCNPKISDFGLAKLFGWDQSQAVTSHIAGTYGYMAPEYAMRGQYSXVKSDAFSFGVLLLEIVTGRKNSSFASPDSEPSLDLLSLVWEHWTSGTVEKLVDPSLGGRSPGGQMLKLVNIGLLCVQDSPADRPTMSAVNVMLSSSTVSLQAPSRPTFCVDDMEGFSGMYSGAYPGGSQSTGDSKPQAAMSPSPNEVSLTEIEPR

SEQ ID NO: 123925 - protein, 177 aa, Triticum aestivum
  unsure (1)..(177): unsure at all Xaa locations
  Clone ID: PAT_TA_18343.pep
MMVASSKRCLGAILVASFYFSASLAFFPAHHEGEGAHPIGHSPKPGLSXPHFYRSTCPQADEIVVSVLKKAIAKEPRIAASLLRLLFHDCFAQGCEATVALDDGQAVASEKNAPANKKSVSGLEVRGEIKAALEEACPHTIXSADTIPLTTGGSTVFGRGPYWELAVRWRDAKSANR

SEQ ID NO: 123926 - protein, 298 aa, Triticum aestivum
  unsure (1)..(298): unsure at all Xaa locations
  Clone ID: PAT_TA_18344.pep
RKLLSRDDAIADLDLAGIIEGASEGKGWHLQVIAXTKVIRIQIVYVXHAKYEGHRQILTSELEAVGLRLNKRPPQIYFKRKKTGGISFNSTAPLTHIDEKLCYQILHEYKIHNAEVLFREDSTVDDLIDVIEGNRKYIKCVYVYNKIDVVGIDDVDNLARQPNSLVISCNLQLNLDRLLARMWEEMGLVRVYTKPQGQQPDFGDPVVLSSDRGGCTVEDFCNHIHRSLLKDVKYVLVWGTSARHYPQHCGLGHGLEDEDVVQIVKKKEKEEGGRGRFKSHTNAPDRISDRVKKAPLKT

SEQ ID NO: 123927 - protein, 185 aa, Triticum aestivum
  Clone ID: PAT_TA_18345.pep
SGRDRINEKMRALQELIPNCNKIDKASMLEEAIEYLKTLQLQVQMMSTMGTAGLCMPPMMAMQHMQMPPMAHFHHHHLGAMGFGMGPFDPRLVAAAGAAQFPYPMMPGAPIFGGHAMPPPPPFHQAAVAGAHMAPGPVTNDAATQRKPSTSRQGDIASPTKMLTNSRGQLVCTSKGAATKVLQGA

SEQ ID NO: 123928 - protein, 289 aa, Triticum aestivum
  unsure (1)..(289): unsure at all Xaa locations
  Clone ID: PAT_TA_18346.pep
GPRDLVSAPCLPPAGQGAGVGSPMGRCLLLDTSVMCLLYKSHSDPSVRPPMPPQXLCSGLQFAPGSSLEVLITSADSRIRVVNGDELGPNGTAPSVRSIVRSASVAPTGKYVVSPSEDSHVYVWRHDNSSHPSRSRSAVAVTNSYEHFHCRDVTVAITWPGAEARGSLGCRSSRHSDSDGAVNSVPETPIQNKEHGSSGTAHSQRYIESPVCEGGASTSTSNHPVEAASPSLPDDQLPSAKEQSWSQSSXSLHRSYGCPAPAAWGLVIVTAGQGGELRVFXNFGFPVQV

SEQ ID NO: 123929 - protein, 155 aa, Triticum aestivum
  Clone ID: PAT_TA_18347.pep
KNSEFLDRFGVKNKSKLVVSEDPASLERRYIERQRNARIQNANRAIGAIALELDKLADQVTSIEKSGAGGSKVAEVQITTLIELLMRHAVKLESIPADADTSSQKNLQAKRVQKCVEALDVLKVSNARLQTVVVTTKWETFDNSPPVTTKWEIFD

SEQ ID NO: 123930 - protein, 469 aa, Triticum aestivum
  Clone ID: PAT_TA_18348.pep
MESPPHKLNVGRDEDRISALTDDLLLAILERLDLREAVRAGALSTRWRDLPYRLSRLHLDVGHFQGQGATPLEVMDAFTGAAQRLLSVVVPLAEGEGGSAAIIPIKALILGFYMSPPHLSSIGRTVEDVVSYRKTGCLEFSISPPRGSNASLLAEFGQQFMSFPQAYPVAFRWLTRLTLKNLVFGHSDVTALINACNKLKHLTLSSCRLVDQRLALRIDTPCSGLRRLDCIRFRCERIELISVPELRTVLCCSRRYENPPVRFGDVPQLCHVNLGYLAKASQAPLMLSECLSRSSRNLSKLNLNFFSQTIWIQPEQPKRLTAIFRNLTDVYLFGIFPECDLSWTLFILEAAPALRNFKLSRTRHTCGKKLYDTAEKTNVVWEPSKDLKHLNLKLLMMLGFEEEVKVTNYIRLVMAHVVRLKRIELHGEDPCKECNAIDPRRSQVDEASRRQIKERLTLESSSSAKIIIC

SEQ ID NO: 123931 - protein, 503 aa, Triticum aestivum
  Clone ID: PAT_TA_18349.pep
MSGYPFYPYGRGGAGDDASAMSDYPFYPYGRGGAGDDAAARYSSYEIDLIAARYAGDPSPYPYPSASGGFDPHVGARRPADVLYHQSIMGSHSTIGQSDAFYSPNTMVKRPRLESSLPIYPQRPGEKECAFYMRTRTCKYEETCKFDHPQWVPEGGIPNWKEGTKAGESYPERPGEPNCPFFVKTGDCKFGSKCKFNHSKKKDDGTVAGPGDKESLFSGNSTLPVKPSEPCPESLISGNSTLPVKPSKPCPHYAKGKCKLGTNCKFIHAKDMEAPSSGGNESENTATAEAAGHHGAAHDSVSAKKSAPVALEHNSKGMPIRPGEVDCSFYIKTGSCMYGRTCRFNHPGRHIQASVVPGEMLNPAAKFPPSFDFRVTHVPIEPEPITYPQRPGETVCDFYKKTGFCKFSEKCKFHHPVDRSAPDSIAKWEPSQQPVTLTVAGFPRREDAEACAYYMKTGACKFGVQCKFDHPPLGEAIAKVSKHGEGKEGGKKKAVGLSYVLEN

SEQ ID NO: 123932 - protein, 644 aa, Triticum aestivum
  unsure (1)..(644): unsure at all Xaa locations
  Clone ID: PAT_TA_18350.pep
PRLQPRSPPARPAASHPSPPSSWPRPSPWTPPSPDSFYLPGLAPRDFLKLVVLHVTVSKLSSLKTLRLCYYFFLDYVKPDAVKNRAEKLGEVLRGDRIENSVYYFKMRRDGSCDGVCRIKLSADAVKNYRXRNVDDXLLDMILDNLPVVFPRQTREGGLQMLYHGXSGICEVMDEKYHINVHXVGLRVFATSPRLARGVXIVGFLRIPMSFQNVXSACVPNNPAVQTCNANTKITPGSHTPQEVAPDAYVVFSYDVTFESSEIIWASRWDVYLLSSDSQIHWFSIINSLMIVLFLSGMIAMIMMRTLYKDIANYNQLDNQEEAQEETGWKLVHGDAFRPPVHSGLLCVYVGTGVQFFGMTVVTMMFALLGFLSPANRGGLMTAMVLLWVFMGVLAGYTSSRLYKMFKGTEWKKITLKTAFMFPGIIFGVFFVLNALIWGEKSSGAVPFGTMFALVLLWFGISVPLVFVGSFLGFKQPAIEDPVKTNKIPRQIPEQAWYLQPAFSILAGGILPFGAVFIELFFILTSIWLNQFYYIFGFLFIVFVILLVTCAEITIVLCYFQLCSEDYHWWWRAYLTAGSSALYLFAYAIFYFFNKLEITKLVSGILYFGYMLIISYAFFVLTGTIGFYACFWFVRKIYASVKID

SEQ ID NO: 123933 - protein, 326 aa, Triticum aestivum
  Clone ID: PAT_TA_18351.pep
MDRGEPSLKPEWLVRGVATPTAAATGLRPGTSPRAGDQDRGASSRNRSSGRDRERSSQQSSSRRGSGPSVSRRHDRDGTVKSRGYASFGRSNRDRGCDKDSDFRDWESRLGLAGDPLRDGFGPFNSCRPESDRFNRIRPKLDTLNRASGVSLDNGNLSRKDAGGMSFEREFPHLSSEDNNGKHDVVRVPSPGIGSPIQSIPLVTAPDGWNSVLAEVPGLSEPSNTQTSSASSRAGSSQQLVVSNCGTALSMAETVMQTPLKISTTPQLSIDAQKIEERTMRQCILRPLTPSSNKNSVSTLSDRLKTKGARAGILIVLSNCTQLSAQ

SEQ ID NO: 123934 - protein, 417 aa, Triticum aestivum
  Clone ID: PAT_TA_18352.pep
RISAAAASTTTTRTGVASAPTVQLVPNKGPLSVPPTHNERSVPVASRPLQVPLPTKSESQKPTSLVNSSSATKVITVSRPLSAPQVPAAKQVAPAVSTVQTAPVLSRSRSAVGRLGNEPSASAPSYIPRSYRNAMMEKTSVGASGLTHQTSSSGQGVSHSQSVFASSASILSPDNSARTEKSSLEPGFTFGTVKPESLNQYQWREESSQQASCSSSSSNDHGLLNSSVGNESDKLNLNGRPRSKQLLSEISTRFTPYQPQGLVGDEFPHLDIINDLLDEELGDRRKVLQPGFVRQFSMPNNVPNNASTPDYGMFNDQYLFDQSEQYYDEELAPYYSDLNGGPQGLRDRSYSQFDLPSYSNSQFDDMVMGQWPYSRADNSMPNFGADINAYPYQSRDYQTTSANAASRYPSYHPGNGH

SEQ ID NO: 123935 - protein, 154 aa, Triticum aestivum
  Clone ID: PAT_TA_18353.pep
DADLKLAYRKLAMRWHPDRCSSSSGTKRMEEAKEKFQEIQGAYSVLSDANKRFLYDVGVYQEEEDSDDSMQGMGDFLGEMAHMMSQTRPARQESFEELQQLFVDMFQSDIVSCGARLTDVGRAARSSRRPHQARRRLDRSPDPGTLVPRLVYFV

SEQ ID NO: 123936 - protein, 289 aa, Triticum aestivum
  Clone ID: PAT_TA_18354.pep
MATGGDGCGGGEPAAPGGGDLYAVLGLSKECSDADLKLAYRKLAMRWHPDRCSSSSGTKRMEEAKEKFQEIQGAYSVLSDANKRFLYDVGVYQEEEDSDDSMQGMGDFLGEMAHMMSQTRPARQESFEELQQLFVDMFQSDIDSGFCNRPAKGHHDPFQTFSTSPSSSPSPPPPVATEAEAASCNGINKRGSSAMGSGKPPRAGEAGAGYGQPEFCFGTSDAAQAPKARGMHTTSSRSLLLRKRDAKQAPKARGGNTSRRRNGQKQKPSSKHDVSSEDEMLSPQQPRVV

SEQ ID NO: 123937 - protein, 215 aa, Triticum aestivum
  Clone ID: PAT_TA_18355.pep
MAAVTAAAVSLRAATAATSTPSSAPQHSHCSFPCAARTTAVSRRGVLTVRAQAVSTDAAPVKEKKVSKKQEEGVVTNKFRPKEPYVGKCLLNTKITADDAPGETWHMVFSTDGEVPYKEGQSIGIVADGQDKNGKPHKLRLYSIASSALGDFGDAKTVSLCVKRLVYTNDAGEVVKGVCSNFLCDLKPGADVNITGPVGKEMLMPKDPNATIIML

SEQ ID NO: 123938 - protein, 269 aa, Triticum aestivum
  Clone ID: PAT_TA_18356.pep
ALAKDVDFDKVARRTPGFTGADLQNLMNEAAILAARRDLKEISKDEISDALERIIAGPEKKNAVVSEQKRKLVAYHEAGHALVGALMPEYDPVAKISIIPRGQAGGLTFFAPSEERLESGLYSRSYLENQMAVALGGRVAEEVIFGQDNVTTGASSDFMQVSRVARQMVERFGFSKKIGQVAIGSSGGGNPFLGQQMSSQKDYSMATADIVDAEVRELVETAYSRATQIINTHIDILHRLANLLIEKETVDGEGFMSLFIDGQAELFVA

SEQ ID NO: 123939 - protein, 353 aa, Triticum aestivum
  Clone ID: PAT_TA_18357.pep
MAAVTAAAVSLRAATAASTPSSAHPVSAPQHSHCSFPCAARTAVSTDAAAAPVKEKKVSKKQEEGVVTNKFRPKEPYVGKCLLNTKITADDAPGETWHMVFSTSGEVPYKKGQSIGVVADGQDKNGKPHKLRLYSIASSALGDFGDAKTVSLCVKRLVYTNDAGEVVKGVCSNFLCDLKPGADVNITGPVGKEMLMPKDPNATIIMLATGTGIAPFRSFLWKMFFEKYEDYKFNGLAWLFLGVPTSSSLLYPEEFGKMKAKAPDNFRVDYAISREETNAAGEKMYIQTRMAEYKDELWELLKKDNTYVYMCGLKGMEKGIDEIMIPLASKEGIDWIDYRKQLKKSEQWNVEVY

SEQ ID NO: 123940 - protein, 308 aa, Triticum aestivum
  Clone ID: PAT_TA_18358.pep
RPDVLDSALLRPGRFDRQVTVDRPDVAGRVRILEVHSRGKALAKDVDFDKVARRTPGFTGADLQNLMNEAAILAARRDLKEISKDEISDALERIIAGPEKKNAVVSEQKRKLVAYHEAGHALVGALMPEYDPVAKISIIPRGQAGGLTFFAPSEERLESGLYIKSYLENQMAVALGGRVAEEVIFGQDNVTTGASSDFMQVSRVARQMVERFGFSKKIGQVAIGSSGGNPFLGQQMSSQKDYSMATADIVDAEVRELVETAYSRATQIINTHIDILHRLANLLIEKETVDGEEFMSLFIDGQAELFVA

SEQ ID NO: 123941 - protein, 410 aa, Triticum aestivum
  unsure (1)..(410): unsure at all Xaa locations
  Clone ID: PAT_TA_18359.pep
RHAGRVRRRLGGVAYGQVAGERVRAAGGSGGSDERAGADWRPPAQPANEDGQEGQDRYRAHAPKVPIGCLLVGPPGTGKTLLARAVAGEAGVPFFSCAASEFVELFVGVGASRVRDLFEKAKAKAPCIVFIDEIDAVGRQRGAGMGGGNDEREQTINQLLTEMDGFSGNSGVIVLAATNRPDVLDSALLRPGRFDRQVTVDRPDVAGRVRILEVHSRGKALAKDVDFDKVARRTPGFTGADLQNLMNEAAILAARRDLKEISKDEISDALERIIAGPEKXNAVVSARKEPAVVRAGRPGERAVGDAGGGGDADPGGADQGGAPERARVVRRRQGDLLRLLLHAVRHRVHPLPLRRDPAVAGHQEPGLRQPGPHLQELQPPAPRVRLPRQRLQPPQLRPHPREQGEGARQR

SEQ ID NO: 123942 - protein, 235 aa, Triticum aestivum
  unsure (1)..(235): unsure at all Xaa locations
  Clone ID: PAT_TA_18360.pep
MSSVSARAPVAALRPAASASSPRFLGDSGRVXGLAKSTRRDVAVXQAKGSWLPGLXSPAYLDGNFGGGDNGFDPLALAEDPEEXRWRWFLWEELELVNGRWXAMLGVAGMLIXPEVLTKGGASLNRRPAVVRRPAKETYFASSSTLFVXSEFILFHYXWEIRRWQDIKNPGYLNXDAIFKSYXAPRHDMRAHPGTRLQPPRLRPSPKTKRGTSGSARGRLAVLADRVVPGHRHRR

SEQ ID NO: 123943 - protein, 228 aa, Triticum aestivum
  unsure (1)..(228): unsure at all Xaa locations
  Clone ID: PAT_TA_18361.pep
MAPGLKRFTDVAGDGTPRLDDAAGEELVCVERAASVALGSRAPEPPGTLFITTRRVIWLSEAEKGKGYAVGFLDITLHAVSRDPEAYPSPCLYTQIEAEADSDEEDGDFDSEADGDSQLPKISEMRIILADAAQLDSLFDAFCHCAELNPDPTAEENEDDXGGGMTNGGWIHGDEDEHMVDGIDPEFFIPNPIGQNGGDDLSSSVLELQINDQRFEDAEEEEARENGH

SEQ ID NO: 123944 - protein, 284 aa, Triticum aestivum
  Clone ID: PAT_TA_18362.pep
MGYHRNRRGRGSSSSSSSSSSRRTKQEASCDDAPGTSLPRQEDNAEEESNSPKIQLAMWDFGQCDAKRCTGRKLSRFGLLKEFRVTNGVQNSWLSRAGTHSESPVDQANKPHRRTEEEGSDSESDDGLPPLEENMNHLDLSEEEESEEESETESEGITARKMMFVCPIEIRSRPLAVLLVVPKSIYRCSLYCLLWVPLYACANREHGTEIINVQTSFLSSASSVSKSPVNVADKPHRSTEEGSDSESDDGLPPLEENMNHLDLSEGEESEEESETENEGITDAK

SEQ ID NO: 123945 - protein, 332 aa, Triticum aestivum
  Clone ID: PAT_TA_18363.pep
MLFLYRTFLFLSPRVRDKKTTFPKVFRVFLALTMAAIGVSHTSTLTSDSSRARSAVSSIFAIVDRKSMIDPSDDAGVNLEPLRGDIEFRHVRFRYPTRPDIQIFEDLCLTIQSGKTVALVGESGSGKSTAIALLQRFYDPDAGHILLDGVDIQKFQVRWLRQQMGLVSQEPALFNDTIRANIAYGKEGEATESDIVSAAQLANAHKFISSLQQGYGTVVGERGAQLSGGQKQRVAIARAVAKDPRILLLDEATSALDAESERAVQDALDRVAASRTTVVVAHRLSTVRGADVIAVVKDGAIVERGTHEALIAVKGGAYASLVALHSGAAASS

SEQ ID NO: 123946 - protein, 593 aa, Triticum aestivum
  unsure (1)..(593): unsure at all Xaa locations
  Clone ID: PAT_TA_18364.pep
MCLASANFARTAGGPLQITSYDYDAPVNEYGFLRQPKWGHLKDLHTAIKLCEPALIAVDGSPQYVKLGSMREAHVYSNGKVQTNRRMTGNGLITKIILASFGTPKYASVWIFEGSCHASSTLALDTRGVCGQQLSLLLTLVHKLLFLRLNLGPQVIQVDISLVFYYLGLXGSYFSSTWWTSKEIIGTWGGESFATQGILEHLNVTKDTSDYLWYTTSVNISDEDVGFWSSKGVLPALKIDRIRDVARVFVNGELAGSQVGHWVSLKQPVQFVQGLNKLTLLSEIVGLQNYGAFLEKDGAGFRGQVKLTGLPNGDIDLTHSVWTYQVGLKGEFSMIYAPEKQACAEWSGMQIDDILSPFTWYKTMFDAPKGTDPVAIYLGSMGKGQAWVNGHLIGRYWSLVAPESGCSSSCNYPGAYSESKCQSNCGMPTQSWYHIPREWLQESDNLLVLFEETGGDPSKISLEVHYTKTICSRISESYYPPLSAWSRLTSGRVLVDTIAPELRLRCDDGHLITKITFASYGTPSGGCQNFSEGKCHALSTLALVSEACVGNNECAISVSNDVFGDPCRGVLKDLAVEAECSLSSATKEPRDEM

SEQ ID NO: 123947 - protein, 528 aa, Triticum aestivum
  Clone ID: PAT_TA_18365.pep
MQEEPSNQRTEAEEGKKEEKKPKPAAEAEAEEAAAPQEELSNKRKRDKKSKKDKKRKLAAEADEAAAEEEAKSSNNRGVATEEPDQGGGVEKSVAVTGKGFADPKYAPLKSFAAAALPTQVLDCCKGFDRPSPILALAWPYRLDGRDCIGIAATGSGKTIAFGVPALMHVRKKLSEKGAKKGLPRCLMLAPTRELAQQIADVLTEAGAPCGINSVCLYGGTSKGPQISSLKSGVEIVIGTPGRMKDLIEMGVCRLNEVSFVVLDEADRMLDMGFEPEVRAILSQTSSVRQMVMFSATWPFAVHQLAQEFMDPNPIKVVVGSEDLAANHDVMQIVEVLDDRARDSRLVALLDKYHRAQSNRVLVFVLYKKEAGRVEAMLNKRGWKAVSVHGDKAQHDRTKALSLFKEGKCPLMIATDVASRGLDIPDVEVVINYSFPLTTEDYVHRIGRTGRAGKKGVAHTFFTQADKGLAGELVNVLREADQVVPPALTKFGTHVKKKESKIYGSHFKEITADAPKSTKITFGDSDEE

SEQ ID NO: 123948 - protein, 108 aa, Triticum aestivum
  Clone ID: PAT_TA_18366.pep
PRHGSRRLSGARAAQRPNIKLGLCYRNLGLVSAIGSGPRASASIEPDWAPILEFSSVDIFQHSPLGDVLNSLKSISLSGNSRPNYIQLEREADDEELRFPPTTDVIST

SEQ ID NO: 123949 - protein, 290 aa, Triticum aestivum
  unsure (1)..(290): unsure at all Xaa locations
  Clone ID: PAT_TA_18367.pep
VRFPSLAHARRASSRCLLAVGALLVFSAVYFLLLSPSPPRPVAGPLPNPSSATTSFVASLDRFLDSPHRPAASSAAPGDLDAAIRREEEARLYGDPRGAWPXAPLRVYVYEMPRKFTYDLLRLFRDSYRDTTNLTSNGSPVHRLIEQHSIDYWLWADLIAPESQRLLKNVIRVEQQEEADIFYVPFFTTISYFLLXEKQECKALYREPLKWVTDQPAWATFKKARVHVIPGHHPWXFKSVPRFVXKKSNMAPPDMGSTGNWYNLXIYXERYLPKWDKWVQKPTKESFSGN

SEQ ID NO: 123950 - protein, 226 aa, Triticum aestivum
  unsure (1)..(226): unsure at all Xaa locations
  Clone ID: PAT_TA_18368.pep
MECVIGVVGRDFAVVAADTSAVQSILVHKTDEDKIMLLDSHKLMGASGEPGDRVQFTEFIQKNLHLYQFRNNMPLSTAATANFTRGEXLATALRKNPYSVNIILAGFDKDRXVASMYYIDYIATLHKIDKGAFGYGSYFCLSLMDKLYRPDMTVEEAVDLVDKCIKEIRLRLVVAPRNFVVKIVDKDGARDYARREIGGDSPPTATATIATAAVGGLGAVGSHLAA

SEQ ID NO: 123951 - protein, 153 aa, Triticum aestivum
  Clone ID: PAT_TA_18369.pep
HEHPARAPRRPGPRQLARPALMEKSARPSAATPEPAADKAPITSESPSRAPRNQGETSDNRRKSMADSCPRTERKSDDFELKSGGGIRGAAAWTGAPRGDGRGRRGGGNPSPRRTRSGRRGSLRRAAGGSPSRRWCGGKERKEGEGKADAWAD

SEQ ID NO: 123952 - protein, 102 aa, Triticum aestivum
  Clone ID: PAT_TA_18370.pep
VVSCRCCCLCFCTKGARKAPYPNLGLVTMAESKSFQCRNRSDSMKSADYGSHVELVLGSRHTGGLQVLRVLRWRASGFIMPARIFSLSVPTVPMCSGNPLNF

SEQ ID NO: 123953 - protein, 269 aa, Triticum aestivum
  Clone ID: PAT_TA_18371.pep
MGGCFSGDVRGGMEAVGGGARGATAAAVQGQGQGGPNEAVDHFFQGQALRLYTLLELSFSASKLRNMDALSKSDPMLVVYTKMDGRLEEIGRTEVILNSLEPLWITKAMINYQFEIVQPLVFRIYDVDTKYHNTPLKMLNLAQQDFLGEAFCNLSEIVTKFNHSLTLNLRNGSGHALQGTVTVHAEETASSRMAVDMQFHCLNLDNKDTFSKSDPFLRVSRLSESAVAIPICKTEVIKNNLHPIWRPITLTSQQYSSKDDPLLVECFDF

SEQ ID NO: 123954 - protein, 156 aa, Triticum aestivum
  unsure (1)..(156): unsure at all Xaa locations
  Clone ID: PAT_TA_18372.pep
KTTHLHQKQXRPDEHQPTTLAATNGSTPVNSKPATRKLHLHSEEEIKIDKRDPPLNLHVQQKIPHTKNASRRIQRDNQPDLANRTEKRRENGTGGEGVLANQQPQVGGGERRRACGPPQKKERHESKTREETAAKSPWRRLRLSLSPTKAPREISE

SEQ ID NO: 123955 - protein, 129 aa, Triticum aestivum
  Clone ID: PAT_TA_18373.pep
HEALRGQVEANCSPRLPRYHDLVSDLSPIHAKLSCENALAKKHPMYKCNEVQAKASWQFLNVLRTYLESLCSELRYHTITNVQSDNDRVSLLLKDSFLDSFPSHDRPFMKLFVETPDVLCSIRFSTCHI

SEQ ID NO: 123956 - protein, 212 aa, Triticum aestivum
  unsure (1)..(212): unsure at all Xaa locations
  Clone ID: PAT_TA_18374.pep
MAGQSDPHLSLFSPSEVEFVAEDEIVEIVPNIRMEALNMICGDFGPFFPQIPSKVPLCLGVALKRRVKRTIRAADWMTVDRLTRXGLVAERESPREFQPLPFHYIEISKLLFDHARDDITDAYLVRSLIEDIRDVRFHKVETGLETISGRTHAVKLKNLSAMEVNIVRPFMVRTLQAFYKHDSPQMIQQADNTGSRSTPVTDRGPRRDLRRR

SEQ ID NO: 123957 - protein, 167 aa, Triticum aestivum
  unsure (1)..(167): unsure at all Xaa locations
  Clone ID: PAT_TA_18375.pep
MEKEKANWDAHHITIFYEICKDEVDAGNRPKGCLNRRGYTHLEDKFFDRTRKRCSQNQFKNKRDMLKRQYVQFMLLKNAATGLGWDDVNKTIIADDDWWKIHLKKNPKHAKYKKKGLANLEEIHVMFANAHVTXATSSIPGEMSDNTNDDDMPDVGEESEEDGNALK

SEQ ID NO: 123958 - protein, 411 aa, Triticum aestivum
  Clone ID: PAT_TA_18376.pep
MSGHVKEAVSMGARAEKTSSENAEKIIQLLTEISVTLREVPPSSTGSFADRFMRMSKYPFEAGQVYEQFRQYLEFLGGFLLLLGVLDPKDEQLKERFFEKFLPDTTPGIYEDICRQGRDLMYKDFASDLSFQMSMQCGDGFVLTSSAKRSPMDDNVHGCQLRLRQPQLSLDFKFDTTKHVSAIVSFPGVLGCDVNPVLKVCYPFRDSSFNLDALYRQAGFRAIASMHPVRGDALVSLSGLFGSRRLNYGGLMKMNLGNEVPNFYSLGCSFNTEAFSCGIQCNSHAQVLMLLNHKLEPCSLFRDAVRRTNLGGDLYDLLARTTPSQTMVGAQAIHCLATGSSVVMVGCEYADPSTRFKLRVGSSGILSAVVKHKFFGSAWVALKSHFNLRNIRAAPRLGLSISIGEASSSSS

SEQ ID NO: 123959 - protein, 143 aa, Triticum aestivum
  Clone ID: PAT_TA_18377.pep
LNCISIYRDDFLEFKNLLELYLKEINSSIKVSSAENALAIEKCIGAHSKDMEHLLQQFEAMSGHVKEAVSMGARAEKTSSENAEKIIQLLTEISVTLREVPPSSTGSFADRFMRMSKYPFEAGQVYEQFRQASWNFLADSYCF

SEQ ID NO: 123960 - protein, 112 aa, Triticum aestivum
  Clone ID: PAT_TA_18378.pep
FMSLLAKSSWFTLNLTQKYGCWEPRHLLDEGDHFTVHLRKLAKCRDPSYNFKKIRQDKIVCRDWRARIIKSREVVHVRRTMRRELVHVCFSVYQYTDELFVMKIQAQTKTAH

SEQ ID NO: 123961 - protein, 140 aa, Triticum aestivum
  unsure (1)..(140): unsure at all Xaa locations
  Clone ID: PAT_TA_18379.pep
MAELSWLTALGFVFLTFNXAMAVYRSNGDAGSVIFVAVSYLDLVALFACLRLYERLVRHSPRRDRIKAAVWALTTLLTVMFTYKVAEVMPLAVKLLVWAMAAATNCGGFYVFFVHERQACTSMLARTRCGRRRVAGHVAN

SEQ ID NO: 123962 - protein, 215 aa, Triticum aestivum
  unsure (1)..(215): unsure at all Xaa locations
  Clone ID: PAT_TA_18380.pep
VRADRMGLHSRQYSRIIVFSKVPLPNYRSDLDDKRPQREVSIPSGLQREVDALLADYLARKRTDSGNFPNAAFSRSSSTDSFATDESFYEQQDNQTSTNVVMERIQRRKSLQLRNQQAAWQESNDGQSMMEFRRSLPAQKERQSLLEAISQNQVVVVSSETGCGKTTQLPQYILESEIEAARGATCSIICTQPRRISAXSVSEXXAAEXXEKIGX

SEQ ID NO: 123963 - protein, 113 aa, Triticum aestivum
  Clone ID: PAT_TA_18381.pep
LPPPSPPPPRAAPRCGCPRRAPPPQDCPRRATPQRPHPLLHCEHYSEEDAIHLPARSRLRPPPRLHPKASLPLLQNISLPFARSAPAGLLGTKECLNTTLVFSSLEKQHQLGM

SEQ ID NO: 123964 - protein, 88 aa, Triticum aestivum
  unsure (1)..(88): unsure at all Xaa locations
  Clone ID: PAT_TA_18382.pep
NVLAAAVAVASAVRSSAGPSRLVFHVVPDKTRYVPMHSWFALHPVAPAVVEVKGLHQFDWRDGDSIASVMRTIXEVQKSSXGLTTNFC

SEQ ID NO: 123965 - protein, 498 aa, Triticum aestivum
  unsure (1)..(498): unsure at all Xaa locations
  Clone ID: PAT_TA_18383.pep
MGGRPGCSVLIRPALGRGRSPFFRDSLSFASFGAMQMGVFIACSAGNAGPDPISLTNLSPWITTVAAGTMDRDFPATVTLGNGANIISVSLAKGRNRLFFFYFEIKVLVLWGTMHKFLESGTNRYNPXPELRFLSSLSTNQCDLVGQLLLKLEQFLXKLASDMKPWVLRTAPGLLADSHLLPAGGRWGLPKASAAKKYTRTAPKPTATLSFAGTKLGIRPSPVVAAFSSRGPNYLTLEILKPDLIAPGVNILAAWSGDASPSSLASDRRRVGFNILSGTSMSCPHVAGVAALLKASHPDWSPAQIKSALMTTAYVHDNTYHVLKDAATGDASTPFEHGAGHIHPVRALNPGLVYDIGQNEYLEFLCTQNLTRTQLKGFTKNSNMTCKGSFSSPGDLNYPAISAVFTDQPATPLTVRRTVTNVGPPSSTYHVKVTKFKGADVVVEPSTLHFSSANQKLAYKVTVRTKAAQKTPEYGALSWSDGVHVVRSPLVLTWLPPM

SEQ ID NO: 123966 - protein, 163 aa, Triticum aestivum
  Clone ID: PAT_TA_18384.pep
MDVEGKMNLEIGSKDMEVESKNLKLEDPLPSSAMDMDEPGVAESGEVDDSNGSSKECPLTPRDSMASNVPVAKEPRSVSTDFGDELDLELGSGEPEPGRQQERKLSRQDRMELSQLFQHAGSSHEWECADGLLAKADAQGLNDVLCVAVDAIWFLSDKEELYA

SEQ ID NO: 123967 - protein, 347 aa, Triticum aestivum
  unsure (1)..(347): unsure at all Xaa locations
  Clone ID: PAT_TA_18385.pep
ENCQREKRGERISSSPSRTWGAAPSPLARASRTASPGGAPRTSAAATRGPSPLPPAADADYVNQCFLEAARYGSTELVRILLPIAQRNSLDIDVDLALGFAAHYGKLETMGCLVEEGNTVAFLGPLMRAAERGCFQVVEWFVNRGCRVMELGLALTAATSSSQVEVGASVLPRVPQLVFPPLSIEIVKAAGERSTGSLQGVDFLLRSDFLNGKPATYAVAESRARCAHEAVDAKLRLFMLEQWSEEAFNKGFVSSQEHFVNITRXMQRGESPVVLRQLPLQLVIAMAYLPLYRECVGSGGRLLPQRLRGQLVEAAGRLEGRQLDRGMQQSELLAILEHHLPRFLVQT

SEQ ID NO: 123968 - protein, 243 aa, Triticum aestivum
  Clone ID: PAT_TA_18386.pep
VAGWEHAEGEVSNLKRLLDASSLKNASLEDQVSHLDGALKECVRQLRQAREEHEEKIRDAVAKKSHELESEMSELQNNIADLQQQLEASDLREKLQVAEKESKDLKIELLTLSKELKMLALERDLSNQAAETASKQHLESVKKITRVEAECRRLRHVTHRTSLANDSSRPVPNNACMESLTDSQSDSGEHMLAIDSEVKNSDLWASALIGELDQFKNGNEGTRDLVNNPAENDLMDDFLEMEK

SEQ ID NO: 123969 - protein, 113 aa, Triticum aestivum
  unsure (1)..(113): unsure at all Xaa locations
  Clone ID: PAT_TA_18387.pep
LGVPTSDTLLYKXEFEKXVEIGGENFRLDFAVSREQTNAAGEKMYIQTRMAEYKEELWELLKKDNTYVYMCGLKGMEKGIDDIMVDLAAKDGIDWIDYKKQLKKAEQWNVEVY

SEQ ID NO: 123970 - protein, 158 aa, Triticum aestivum
  Clone ID: PAT_TA_18388.pep
MPKDPNATVIMLATGTGIAPFRSFLWKMFLEEHEDYKFSGLAWLFLGVPTSDSLLYKEELEKMKEMAPDNFRLDFAVSREQTNAAGEKMYIQTRMAEYREELWELLKKDNTYVYMCGLKGMEKGIDDIMLNLAAKDGIDWMQYKKQLKKGEQWNVEVY

SEQ ID NO: 123971 - protein, 363 aa, Triticum aestivum
  Clone ID: PAT_TA_18389.pep
MPAQLTAALPSYSPAATKAAGGSSASCTASHFLAYPTRRLRNGVRAQVSTTEPTAEPAPAAPAKPVKISKKQDEGVVTNKYRPKEPYVGRCLLNTRLTGDNAPGETWHMVFSTEGEVPYREGQSIGVIADGEDKNGKPHKLRLYSIASSALGDFGDSKTVSLCVKRLVYTNDAGEVVKGVCSNFLCDLKPGSEVKITGPVGKEMLMPKDPNATIIMLATGTGIAPFRSFLWKMFFEQHEDYKFNGLAWLFLGVPTSDTLLYKEEFEKMVEIGGENFRLDFAVSREQTNAAGEKMYIQTRMAEYKEELWELLKKDNTYVYMCGLKGMEKGIDDIMVDLAAKDGIDWIDYKKQLKKAEQWNVEVY

SEQ ID NO: 123972 - protein, 269 aa, Triticum aestivum
  unsure (1)..(269): unsure at all Xaa locations
  Clone ID: PAT_TA_18390.pep
MAAQLTAALPSYSPATTKAAAGGSSPSSHFLAYPSRPRNVRNGVRAQVSTTEPTAEPAPAAPAKPVKISKKQDEGVVTNKYRPKEPYVGRCLLNTRLTGDNAPGETWHMVFSTEGEVPYREGQSIGVIADGEDKNGKPHKLRLYSIASSALGDFGDSKTVSLCVKRLVYTNDAGEVVKGVCSNFLCDLKPGSEVKITGPVGKXMLMPKDPEREPIIMLDDGNGVIVAGSAPSIWDDVLLKEDVGLKVQWVGMDFLGDFPQVTQLIYEED

SEQ ID NO: 123973 - protein, 194 aa, Triticum aestivum
  unsure (1)..(194): unsure at all Xaa locations
  Clone ID: PAT_TA_18391.pep
QPQLVFSDIRVQSVLLDKHRRSKFAPXSLIEVSYLGYALNSHTYRXYNNFTXKVEETVDVKFDDXNGSQVEQLXIDVGDKDPSEAIXDLSIGKVRPTEVKESTSSVQVEASTSRQGEPRVDTEASTSGTHQDEENEEVHQDEHQQPPSPPRQENDNANNEEGQEEGQDEEDVPPRPKQKLPRVRARVARDHAVD

SEQ ID NO: 123974 - protein, 563 aa, Triticum aestivum
  unsure (1)..(563): unsure at all Xaa locations
  Clone ID: PAT_TA_18392.pep
MLRLNPGRLPSEVLGSGMRRLEAWFATDVDIISSTDWDQEHGLTGWPWADGEWLRPCYLTLSPGFSGIASARALSNASFKVTLLESRERLGGRVHTDYSFGCPIASGASWLHGVCNEISLAPLIRLLGLRLYRSSGDHSVLYDHDWETHALFAKDGRQIPQEITTKVGEIFEQILKETVKVRDEYANDMPLVQAISMVLDRNPHLKLEGLAXYEVLQWCICRLEAWFATDVDNISLKNWDQEHVLTGGHGLMVNGYDPVIKALSRDLDVHLNHRGTKIIHRYDKVIVCMGLGKGSFADGSVITASSGVLKTKMIKXMTELLVGILLSRLEMAGGIDHSTILTLFLVVWKKELICVTVQLPDGKPSLFPSLHAGPQTNLLTNXEKQYVDSILNYFRRLAQAATAPGHFLVSRRGTDPPALGSNSAGRVAYQMDKLSHEEAVNFVMSQLRRMLPRATDPVQYLVSRWGTDPNSLGSYSCDLVRKPADLYQRFCAPVGNLFFAGEAACIDHSGSVHGAYSSGIGAAEDCRRRLSTQLGISDLFQVGKIVMREEMTEVMVPLQISRL

SEQ ID NO: 123975 - protein, 194 aa, Triticum aestivum
  unsure (1)..(194): unsure at all Xaa locations
  Clone ID: PAT_TA_18393.pep
MRKARPPQPQPQPSQQSPEIRYRGVRKRPSGRYAAEIRDPAKKTPIWLGTFDCAEDAARAYDSAARSLRGPTARTNFPXPPPRSRRRGPLPLRPRPRPPRPARAAPSSLERAAGPAPPPGPAAPPERARPRRGEEDCRSYCGSSSSVLLEEGADDAAASRSPLPFDLNMPPPQEGGLDAEGDQMTCRYDTLLRL

SEQ ID NO: 123976 - protein, 442 aa, Triticum aestivum
  unsure (1)..(442): unsure at all Xaa locations
  Clone ID: PAT_TA_18394.pep
MNVSAAQFPWAKMFKESPMPKMVDVPLSHVPEPVCKTASDWISQRSPDALGEFVLWCIDSIMSELSGPTVGPKGAKKVVQQTPKAQVAIFVVLALTLRRKPDVLINLSPKIVGNSKYLGQEKLPIIAWVINQASQGDLVSGMFSWSHSLFPTVCAKSSGNPQSRDLVLQLLERFLTTPNASKARAMLLNGAVRKGERLVPAGTLDLFMRCTFPVPNARVKATERFEAAYPIIKELALVGTPGSKAVKQASQQLLPASLQALQENIAGNARKATXSVAKESTDVFIWCLTQSPESYKLWDKLHXENIQASVAVLRKITADWQXLSPKLNSDSSQSNSELEEAEDSGEKASITGXRDKYCKAIIGRLSRGATCLKGSLLVIALAAGAGFMLPPTWTSPPDLEKLQAIGVGAPGHGVRVPAVSSEHSVYTESGEGRGERNKEGRG

SEQ ID NO: 123977 - protein, 406 aa, Triticum aestivum
  Clone ID: PAT_TA_18395.pep
AFFPAVSARTLPQALSLLSRAVTVAAVTAFGASHWMVKRLAKSAMLGSSAQRQFRDTRDMMMDNMLSTFHTLVTDDPHSPLNFREVFKDELFPMSLIQSLDVDVGSVYVKEFGSEISKDEIYQITVVDMMMCAIDVDWRDFFPYLSWMPNNSFETRVRSSESRRTAVMQALIHQQKKRIADGEAGAPGRRRGLAGHAPTAPPTSSTRCTCISRPEGGSELTSGWALYELAKSPEKQDRLYQEIREVCGDETVTEDHVPRLPYLSAVFHETLRFHSPVPLVPPRFVHETTKLAGYDVPAGTEIVINLFGCNMNKKDWEEPEDWRPERFMDGRFEAADMYKTMAFGAGRRSCAGSLQATTISCAAIARFVQDFAWRLKEGDEDKVDTVQLTSYKLHPLYVYLSPRGRK

SEQ ID NO: 123978 - protein, 141 aa, Triticum aestivum
  unsure (1)..(141): unsure at all Xaa locations
  Clone ID: PAT_TA_18396.pep
MGFAQLVIGPAGSGKSTYCSGLPPPRDTVGTRIHLVXLDPAXEHLAAPLSTDLRELVSLELVFGEVAMEVNGGLIYCMEHLEDNFDDGLDEQLENYLDDDYLVFDCPGQIELFTHVPVLRNFVEYLKRKNFTVCAVYLAQD

SEQ ID NO: 123979 - protein, 109 aa, Triticum aestivum
  Clone ID: PAT_TA_18397.pep
VRGRVGYDPGATTVIESIFNFNLSIPLNFLFDSFGGNVLVIQGMKDPLTKSESFISMLRDHCSKVQIRELNAGHAPHDEVPDEVNSLLSEWMKTNKTELKAALEKSKAI

SEQ ID NO: 123980 - protein, 376 aa, Triticum aestivum
  unsure (1)..(376): unsure at all Xaa locations
  Clone ID: PAT_TA_18398.pep
PANSRFAHTIRVIRFHAFIAAPIELGSTAKRRASPEPRPSEGHAIPPFLSPPAYSVPTEPGVGTPPRQFRCYSRCPENYHVSLEENYPLRFWRWNCYLIQYTSVGHEGPAVLLVHGFGASLQHFRDNISNIADDGRRVWAITLLGFGKSEKPNVDYSEXLWSELLRDFIVDVVREPVHLVGNSIGGYICAIAAGLWPSLANSLVLLNSAGSVVPNYSFIPLSKEGRTSWLSRLQARLLLLFLRSRAGGILKGYYPTRTERVDKPLVDEIIRASYDPGAXQLFESVFNFNLSIPLNFLFDSFGGNILVIQGIKDPLIKSESFISMLREHCSKVQIRELNAGHAPHDEVPDEVNSLLSEWMKTNKTELKPALEKSKAI

SEQ ID NO: 123981 - protein, 128 aa, Triticum aestivum
  Clone ID: PAT_TA_18399.pep
MADRWLELPNLALQVVGILPEVQRPSSMVPRCQKVAYTAISLLIYLVGSQLPVYGYGVRSPSVADSQYWVDMPDCNSVMSAGIMPLVLSEAVLHFLLWCKVLRAKNPDDRMLLSRVQKLVVNIFSCDF

SEQ ID NO: 123982 - protein, 146 aa, Triticum aestivum
  Clone ID: PAT_TA_18400.pep
IDRENPIDHTTCFLQGPGLSSSSHTATMWAKVIAIFLLLLQLALLSSSNSMVFELRGNVYPIGQFFVTMRIGEPAKPYFLHVDTGSGLTWLECDAPRQSFHKVPHEVFQTTIEQPGAMRGRALCHDAQGPGHRARLHGASKPMRLL

SEQ ID NO: 123983 - protein, 272 aa, Triticum aestivum
  Clone ID: PAT_TA_18401.pep
LLLSNGTVDCCWRAAVISDPRLLLLVSRCLLACVGSDYLLGEKEQEFFHSSPEYAHLASRMGSEYLAKLLSQQLEAVIRARIPSITSLINKTIDEPSAEMDHLGRPIGSDAGAQLYLVLELCRAFDKIFKEHLDGGRPGGDRIYWVFDNQLPAALRKLPFDRHLSLPNVKRIVSQADGYQPHLIAPEQGYRRLIESGLSYFRGPAEASVDAVHNVLKELVRKSIGETEELRRFPTLQAELAAACNKALESFRQEGRKTTVRLVDMESAYLTV

SEQ ID NO: 123984 - protein, 197 aa, Triticum aestivum
  Clone ID: PAT_TA_18402.pep
VRKVERERMQQISTLITTSVNKDIPAILEKSLKREISLLGPTIARTTTPIIEKSLSSAVSDSLQKVLGEKVANQLDKSISTKLEATVAKQIQTQFHTSAKQALQDALRSSFESSIIPAFEQSCKTMFEQVDGAFQKGMSEHGTAIQQQVAAAHSPLAQTLRETINSASSITQGLTSELLDGQRKLLALVASREPNIT

SEQ ID NO: 123985 - protein, 127 aa, Triticum aestivum
  Clone ID: PAT_TA_18403.pep
LEVRPFVRSPRLGSTNCLRIQPPSSFCHASHAYKRGSTCPGVSLEGTPTHTPVEAPCSTLADDTVQERVCPSTTGSPMVRARGRHRPRSVYAHDRVEAPRSMVVDTSPTHLLFLTLFLFFWTLICMI

SEQ ID NO: 123986 - protein, 297 aa, Triticum aestivum
  unsure (1)..(297): unsure at all Xaa locations
  Clone ID: PAT_TA_18404.pep
ARCTFVEALSKDVLARLQTQPSSSSEDLTGQLIQSVTSSTNXGARKDMQSLINGLLSKSSVYQKDLSGLNKRSLYQICCSCLNLLVELFKEDLEPKCGTGQALKIRHNKPMIETSGVSKQSENLSWLFEILVNNDMAENFVVLWAGQDDLIRMHXQASPMFRYELSRISTGXQEFILSYNHKHTTNTDITHADPRAEAGVFVALWQGKVQCPSDLRSQLFRGWFTPMLTDLGWLQRSSKGLDAIALDDSLGQALITLSVLEQYNLFEEWFQGFAFRGAECPNLNLALQVLLRKFITR

SEQ ID NO: 123987 - protein, 409 aa, Triticum aestivum
  Clone ID: PAT_TA_18405.pep
MAAAAEKTAEEIRRELQELQRQHREISERLRDPRGLRRGAPATGPGPGPGPGGPRPLRGFARQAPEPVDQPEPKRRLLSAVVKVDGPGTNGDDAAAEGREDGPNAAQGGERRGASNGGFRRDGSQWVSRRELDNQLPEPLPRPAPKEEDQSLVRRNKRMLGKLLVGTLEKFQQENKKLSNSEAFMRRSEAQQKADQKAREDSERLRQQEREQAAEKRRRDMTLRARVAAKAEEKRLELLYIQWSEHHKKLSSFLRTKAEPAIYYMPAKPIVDDPVIVEQNKEKVFEEWKSVRRTELTQFQKQVEEQYLSNVERQLERIQNARNARRGNVPANMQEMDKELDTHRAEHGPKARRIPDGGNDEDDDVDVDDMAAEDDLMDEVLGVNEAINEDPGKPSEEATDVAPVPEQAQ

SEQ ID NO: 123988 - protein, 143 aa, Triticum aestivum
  Clone ID: PAT_TA_18406.pep
HYENLSLTSAHASADAWGNLGNLYIDEQAPWSCFKQGGEIAEKAAKDLVIILETVRIIAIALSPITPSLSLRIYTQLGFTEDQFRTLRWDDTKWGALKAGQAMMEPKPIFAKIETEVEEKDQASPKEGKGGKKKARSKGLVEA

SEQ ID NO: 123989 - protein, 335 aa, Triticum aestivum
  unsure (1)..(335): unsure at all Xaa locations
  Clone ID: PAT_TA_18407.pep
KLKPQSNRNPSAMSATAGDEAAVAERLEALRRKLGKKQHFEEAVADLAATLRDRYAGASPALRESMYSTVCRVATVLQTRYTAPGFWRAGLNLFVATEKLLTNPAEKERLKTCILRAREHLDEKENEEATPTNRESDVRSHFERHLTXDKEPPPPAWLVAQNLTRGLESLAEPSGDQNGNNTRTELRPEEMTPAIMNFLNTLSGDAELESALEASLQGITAQPKVPPASKEVVANLPVVTVTEEVIARLGSETECAVCRENLVVDDKMQELPCKHLFHPPCLKPWLDENNSCPICRHELRTDDHAYESRKEREREEEEDRKGAANAVRGGEFMYI

SEQ ID NO: 123990 - protein, 503 aa, Triticum aestivum
  Clone ID: PAT_TA_18408.pep
VRGRVSGRVGESFQNERNYPNSDLHHASSNYKAAGGFVRANRREAGVANAPRQYSGRPGSQFHGPNDSYHANIQRGNFASAGPSVRRPSFIPRNTQPNHRPAVDTVTRGRSVGRPFGNQNHSRYHQGPASNQKVIQPAKEWKPKSTNKSCTNDADNSGTNATSPLDSKAENANVLDVNSSCDKSSHANVHEMEHVIIPEHLRVPEYEQTRLRFGSFTPGFDSPEHEQTRIRFGSFSPGFDSDQLPTSTSPEPEQPEHVQEPVQLVVQEDEFDTEHDEVDEQVGSQLTTISTSAAESSLPPSEDSEQMNGQEVEDDDGLGLVQSDTPLGAADDHNIQSTSGLTAFSAYGHEDPNMHPNNEAQLYGLVEPNVHQQVLASSSQGYTSVNPGADNAVQVFRMPEPSVHSQVLPSASEALSSQLASSSPIAMSTQQQHMSQQQQAAQMYPPMHVQHYPNFMPYRHPLYSPVYVPPMAMPNYSANVPYPANGNNYPLAVGVLLQAMNRS

SEQ ID NO: 123991 - protein, 125 aa, Triticum aestivum
  Clone ID: PAT_TA_18409.pep
SAHASAGNSLIVADYGQLELRILAHLANCRSMLDAFKAGGDFHSRTAMNMYQHIREAVEEKRVLLEWDPQPGQEKPPVPLLKDAFGAERRKAKMLNFSIAYGKTAAGLARDWKVHKRETYLSVNL

SEQ ID NO: 123992 - protein, 241 aa, Triticum aestivum
  unsure (1)..(241): unsure at all Xaa locations
  Clone ID: PAT_TA_18410.pep
HASASSFLSLLSLTQRHISLSLSLISVSVRRGGQERSGGGGKRGNGAGRAGLLRGALLAEEGRHGRVGVQCHGGLLLPGLRRRRRRHGLLPGAAPAHRQRAAHLHGLVRAAAPAAASASPARGGGFWGVRLPQRGLRRRPLPQCRRRRVRRDGVSRRDGXQGGGGWGRPPRLQGGAPAGGRGRRRVRVGSDGGVGPGARRRGRNXVEGMPSKNLMAERXRRSGSTTXSHAPLRRPKISKMD

SEQ ID NO: 123993 - protein, 366 aa, Triticum aestivum
  unsure (1)..(366): unsure at all Xaa locations
  Clone ID: PAT_TA_18411.pep
MDAAAMESLILELHAVEAYKFGAFVLKSGITSPIYLDLRVLVSHPRLLSRVAALLGSLPSTRPYGLLCGVPYTALPFASVLSVARSIPMILRRYHETGAGAPPAMRTQGSFRAGDTVLIVEDLVTSGASVLETVAPLRDEGLVVADAVVVVDREQGGRENLAANGVTLHSLMTLTEVLAVLVSHGKVTREKAAEVKRFLDANRKVLVPAEPKVVPARKAFAERARLAKNPVGRSLLGVAAAVPTALGLPALATTAGPLLGLPNTLGPVLSVLTPRVGRLAPFAPEXGHNFLIFEDRKFTDIXGNTVTMQYEGSEQTMLYQLGTFLTSHCPEFLTPCAFPGPVEHPHIRLGRYCHCACSPGPGIVMA

SEQ ID NO: 123994 - protein, 228 aa, Triticum aestivum
  Clone ID: PAT_TA_18412.pep
SARGQSLVLEQSRCSSSQSVETRVDNNLVHVRVRIADFVVKSSRLGLLIDPKSDSSVSKVVQQLAFVGPQLYREGKFYSRRLVDDCFSSFVNRHPPIEDGVQHPPEAYGLVQSAYFHGLNPYEELVHSICTRETIVRSSRGLTEPGTLFKSLMAILRDVVICYDGTVRNICSNSMMQLKYKEEDDTDFPSAIAPGEPVGVLAATAISNPAYKTVLDSSQSNNTSWELM

SEQ ID NO: 123995 - protein, 117 aa, Triticum aestivum
  Clone ID: PAT_TA_18413.pep
GRRALSFDEKERERCISKCKREEAKITAWENLQKAKAEAAIRKLEMKLEKKRSSSMDRILGKLRSAQKKAQGMRTTVSVSEDQCAVSEDQCAVRATKKASLRRTSKPFSCCFTYHAC

SEQ ID NO: 123996 - protein, 344 aa, Triticum aestivum
  Clone ID: PAT_TA_18414.pep
FCNCANVFLCNNCGTRQNKTLGRATGPRDESNRARARRRASEAAGMEDLSVEELASNLSTYKDQLREVRKFIKEKKDDAGISEYVDMEKELQEVITLTEELLATANPSESAQNDVGLSPPNYSAGVHSEALDDLSQSHEKFAVGTKVQAVYSEDGEWYNATIEGLTPIGYFVSYEGWGNKEEVDPANVRALDVEAADALGLAEKEAEATKMALKRKVEQAATSDYQIRSLPTKLKIDPNDPEDVKAAKRKKIHAFKSKARFEQLDFAQNKRQNAWQQFQTTKGKAKKVGFFSGRKKESIFKSPEDHRGKVGVTGSGKGLTDFQRREKHLHLKDGSSGDTLDYEE

SEQ ID NO: 123997 - protein, 315 aa, Triticum aestivum
  Clone ID: PAT_TA_18415.pep
TRPRTRGRSQTYNVSAVLKPDLELRQPLWPPVTKGILPALDAIVREASSSGKIIIGQTFYSQQQRPKISSHGAFTTEALEGTMQTLKATEQGLVLCVDYSVMEFCGDGSTVLDLVKHLVKRFDADIPFDMETTLDEKQRKFLESQLKGLCITVNYLKKSSKGKDNGTRIRKYKVQGLTAQPAQLITFQDFDSGEPLKLVEHYGKEHGVAIRYKMLPCLDLSTKHGRPNYIPIELCSLHQRQKYPKDNTLKGSNLKPRDKPPESNARKDMILDMVKPPEGPCSGSRGEQFNITLNREMTEVTGTILAPPTLTLGSS

SEQ ID NO: 123998 - protein, 407 aa, Triticum aestivum
  unsure (1)..(407): unsure at all Xaa locations
  Clone ID: PAT_TA_18416.pep
MAGDGTDAAFVDELEPKFTISEYMDGIDDEELEADLVPGRDDGNECTYGAGYLKRQAVFYCLTFLRESVAGVWTHWCLGLPGERXLLNFLTKCTIPFCSRNWKCGRDILILWPQRDAXKLLYIHSFSPCSCASLHPADQRVEMIQCXCICEDWFLADHIGLDSLEKIPRDEEGEPLYEEFICHQCSPVCYFLKLYPDTIWASSKQSSASEAVTADSNGMEGGSSGHADTEKNENGAPVDRQSIENTSVEENCTKDIAASDKSILGDNSGGNCKIGVDINTTSADSEKTMPFFMSKGWRETLCKCGTCTNFYAQRGIAHLTDKEDSIEEYEKIAKQKREKKLEQQEGAEANFINSLNHVQKIEILSGINDMKNEFQSFMESFDPSKPVTSDDVKSIFENLARKKQRLS

SEQ ID NO: 123999 - protein, 196 aa, Triticum aestivum
  Clone ID: PAT_TA_18417.pep
VRGRVGQPALCGNANTAIICNITLAQVHADETKSSLQFASRALRVTNCAEINEIVRDAALLKRQRKEIEELRAKLKNSQSEHLDEDVLHLRNTLLQSELEKERIALELEEERKAKEQREKRLLQQAKKIENLSSLVLNSERDDRAIVSSKNKRRQTWCARPLSNEFSVEVQEPASEQGSASSSVREERNNGDAPMF

SEQ ID NO: 124000 - protein, 231 aa, Triticum aestivum
  unsure (1)..(231): unsure at all Xaa locations
  Clone ID: PAT_TA_18418.pep
MEYCEXETLXLANAGMGARLCTYYQKTSPTDQTAISLRSNNDGLGTVLAIEPADKSPFLGDVRSGSQQSCLETNMYRAPAFPHKLASTDYLLVRSPKGMLSLRRIDKLYAVGQQEPHMEVFSPGTKNLQNHLLNRMLVYVYREFRLRERPGVLSQIRADEVPIQHPLTEAIVRKRLKHCADLKKGPNGHYYWTQRPDFRIPSEEELRRLVSPESVCCHESMQAGLHRLNRL

SEQ ID NO: 124001 - protein, 59 aa, Triticum aestivum
  Clone ID: PAT_TA_18419.pep
TRTKLRMHELLVNIIMQPITEEILKTLLAADSESRLSHCFGAHTAAEGHPTLLLLPVDP

SEQ ID NO: 124002 - protein, 138 aa, Triticum aestivum
  Clone ID: PAT_TA_18420.pep
WCRTRSRGRICARMILWISGSPPRCRQRVLAALEHRGRAPHGHLRSLIAEVPGPLAISRVCVGLGLNLMLILRHRRETAAAPPLVQDRALDRLQLSPATDVLRAHGKAGASQHQGLHAPRPRGGGGWVPGRSAGALPE

SEQ ID NO: 124003 - protein, 145 aa, Triticum aestivum
  Clone ID: PAT_TA_18421.pep
HLILVEHSCWTHLPGPWCHPTLVWLAKQLCLLCRSVQRLPRCPSGGRFLFGPGIDSRRDVRLLGPKSTVTLLIVDSERLSPRHANSQHHHHQRVAAVVPAPGEVGGALLHASTTRHGGMLNGALSSSTSWGEDGCGGLGASGSTT

SEQ ID NO: 124004 - protein, 130 aa, Triticum aestivum
  Clone ID: PAT_TA_18422.pep
DSRRDVRLLGPKSMVTLLIVDSERLSPRHANSQHHHHQRVAAVVPAPGEVGGALLHASTTRHGGMLNGALSSSTSWGEDECGGLGASGSTTSAARSSNRTRCSTVPALAVISMIAWSGRLCSVARLLRSC

SEQ ID NO: 124005 - protein, 102 aa, Triticum aestivum
  unsure (1)..(102): unsure at all Xaa locations
  Clone ID: PAT_TA_18423.pep
IWLGGIQCSRGRIGRPRAQRFSTRVGYQVSVPNSPYSESXYYNSLAVVLQRRDWENPGVTQLNRLAAHPPXASWRNSEEARTDRPFQQLRNLNGEWEIQFLR

SEQ ID NO: 124006 - protein, 86 aa, Triticum aestivum
  Clone ID: PAT_TA_18424.pep
MGGIHALLILLSVASLALLPGATPLQASQAWSLFKLRQLLGDPPVLGTWHNYTDFCYGGDYKTASALVECYEDSVTQLHIMGDPSS

SEQ ID NO: 124007 - protein, 372 aa, Triticum aestivum
  Clone ID: PAT_TA_18425.pep
ESGDGEECSREDNEDEEDADHDDPDAKVESEGEAEGNTEAHDADGGMSLPFSERLHNTVRPLAKHVPTALQDHGGKFSRIFYGNDSFYVLFRLHQILYERLLSAKTNSSTAEKKWRTSKDTSSPHQYSKFMGALYNLIDGSSDNTKFEDDCRSIIGTQSYVLFTLDKLIYKVVKQLQAIAADEMDNKLLQLYIYEKSRSPGRFFDLVYHENARVLLHDESIYRFERRSNPTRLSVQLMEYGHEKPEVTAVSIDPNFSSYLHDEYLSSISDSKVSEDVFLERNKRKRGSSNGPQASLAVMDGFKVANGLECKITCKSSKVSYVLDTEDFLFRMRNRRRISSGATAAAPGKADFVKAADVVKAQRFHKFLLSRS

SEQ ID NO: 124008 - protein, 97 aa, Triticum aestivum
  Clone ID: PAT_TA_18426.pep
MGDHMTVFRSLRELFPQVDPRMLKAVAIEHHKDADSAVVAVLDEVMPSMIGSVEVSSLHQEAAVSKDDFFRSLSANHDAPETGSSSAGPVGISGCPS

SEQ ID NO: 124009 - protein, 114 aa, Triticum aestivum
  Clone ID: PAT_TA_18427.pep
MINQRRVFFPPKVRMTTRYTSLMKICGQSATRHPGSSCWLRSPCVDCQLRCTASLQPVAVSPSPPVEFPPRLCAPHPRYIADGATKDVVILTTDDLHPFASPHVLQNRSGLKAT

SEQ ID NO: 124010 - protein, 344 aa, Triticum aestivum
  Clone ID: PAT_TA_18428.pep
YCNQLLEEDVFNNSAWNQRYLLVARAPTLGGLAARRGAPLPHAVEPSPVNPHPYRGDFREVMDYFRALYAAGERSPRALRLTADAIHLNPGNYTVWHFRRVVLEALDADLLLEMHFVDQIAESNPKNYQVWHHKRWLAEKIGPDAANSEHDFTRKILAMDAKNYHAWSHRQWVLQALGGWESELQYCNQLLEEDVFNNSAWNQRYLVVTRSPILGGLAAMRDSEVDYTVEAIMVNPQNESPWRYLRGLYKDDNNLLVADNRISDACLKVLNKDWTCVFALSFLLDLLRMGLQPSDDLKGTIEAMENSDPETGHADIAVAVCSILQKCDPLRINYWSWYQTTLSS

SEQ ID NO: 124011 - protein, 334 aa, Triticum aestivum
  Clone ID: PAT_TA_18429.pep
MDQFLKTAEIPLEMHERLKKAAAELKELKTLMGGFLVSIGMFFRGYGFSSPSVIPPSPVDSPPTPSPAPRPFLKLGAGPTPFHSIGKRAKEVLFGDYEETPFHGIGKAGFLICDKQLGVGVELKSDPSVETTLCYGKEYLDYKMEAKAKVVLPFGDTSKAEIDVIHRRACLSASVGLSANPVFNMSGMFGIADGICGGARLSFESCGLVREFELGLSMDTTEFGSLSTRLNREKLQVMFDTAVGRATGAAELTYFHDPVAEKRSVCLTGGLSYNYDNTLTLKGRFNSDLHVGGMIQFEERLASIVLRATGDVDLRAMGQQPRVGFQVVFDPTWK

SEQ ID NO: 124012 - protein, 253 aa, Triticum aestivum
  Clone ID: PAT_TA_18430.pep
NWHEAASASFRFLSPPAPNPHDRIHPSLLACPTRRRRLRATRCSSTPQPAPSPPLEFPLLPFQPAEVLIPSECKTLHLYEARYLALLEEALYKRQNSLVHFVLDPVLSSSSKDSFAVRYGCLVQIVRGRVGDFGALVSIRGVCRVNIKNLLQMEPYLRGDVSPMMDKSCDGTGLGLRISRLRESMCNLHSLQMKLKVPEDEPLQTNIKSSLMWSEKETFEGYDEEFIPELVERLSFAAYQSVSGDKRSFHFHP

SEQ ID NO: 124013 - protein, 89 aa, Triticum aestivum
  Clone ID: PAT_TA_18431.pep
EPSLSLDHSTSHTHTLEYPHQLAFSPSTTLLSFTAVKIFGLHAPPGTNQVPSCVSPSCLISYLSPPRFESVHKHLFTLIYLPAVAVGCG

SEQ ID NO: 124014 - protein, 141 aa, Triticum aestivum
  Clone ID: PAT_TA_18432.pep
TPPPPPTDPATHVPLPPHVQSMAPAASACPVRPSPAATPASPSFPSSPSPIPPSPFSSASRQPRRHHSILPPPDHGPLGSPPAASATTSPCLHTPPARAAARGGQPRAVGRCAASPASAGQHGSDANGVVLRHHHIVPTER

SEQ ID NO: 124015 - protein, 303 aa, Triticum aestivum
  unsure (1)..(303): unsure at all Xaa locations
  Clone ID: PAT_TA_18433.pep
MAGSTNGSSPPALKFLIYGRTGWIGGLLGKLCTAQGIPFAYGAGRLENRAQLEADIDEVAPTHVFNAAGVTGRPNVDWCETHRVETIRANVCGTLTLADVCRARGLVLINYATGCIFEYDAGHPLGSGVGFKEEDTPNFVGSFYSKTKAMVEELLKNYENVCTLRVRMPISSDLSNNRNFITKITRYDKVVDIPNSMTILDELLPISIEMAKRNLTGIWNFXTNPGEVSHNEILEMYRXDYIDPNFSWKNFNLEEQAKVIVAPRSNNELDTVKLKTEFPRTFVNQRSRLIKNVFKPNQKTSKA

SEQ ID NO: 124016 - protein, 142 aa, Triticum aestivum
  Clone ID: PAT_TA_18434.pep
RPGWRLAAGDCTRTVAKLAAGNEGSLKMANVLLAGLRGAKQLVKNLGSAYRSLSSGSSPKWVEPGYDFSRKRFGPDYGVTTSVGQYGLPKSVDWRDVPCGSNPSEKSFEQWLFLYSGIPYEYRKPSFHYKYNSHRIVCPAYP

SEQ ID NO: 124017 - protein, 391 aa, Triticum aestivum
  unsure (1)..(391): unsure at all Xaa locations
  Clone ID: PAT_TA_18435.pep
GLKVFDTSVESITTGAWRALRSAWRSGSLIVQKLETSXFPGLQALAETIRHGELPAKASEIAPTILETGKSFTAKGMEMLERVGKETMELIIEETGMEIEKGGTGEGDQQTEEEQSEEVSFDRCFYIYGGPDQLEELEACQXSLALLFNRKKTNLVLSRKXVYDGKIKEIQQLFTLSTKIEENGPDSDKGRRXEAADTDGDAQMKKLCDSSVSKAAKMAAGFATGLGGLSPSDIIKRTTDRLETIHSEGVHRLSEMCCLAVSQLLVLGKSVISAANKSNDEDESDVKIDWPEDLISKAEIIRWRAQSIAVDIEKVATSFATGISDVAEAYAAAIQNALADKQGDVPHQSVQEKAKDISSHLKSDQTSAISKLQDALQYLAYVVVCTSMPSV

SEQ ID NO: 124018 - protein, 222 aa, Triticum aestivum
  Clone ID: PAT_TA_18436.pep
MVVATEEMAVYCFDTLVAHYSGEQPPPPAFEEGVHPLFVTWKKATNGSEPRLRGCIGSFGRLFSLLRTYAWLVSGFKDYALTSALRDRRFSPIQSKELPYLECTVSILTEYETALNHLDWEVGKHGLIIEFTDPDYNVRRSGTYLPEVAAHEGWTQLETIDSLMRKAGYNGTITESLRKKIRVTRYQSTLYTMHYGEYTAYVKKNRGEINGEPIVNGFKPGQ

SEQ ID NO: 124019 - protein, 127 aa, Triticum aestivum
  Clone ID: PAT_TA_18437.pep
SRSPSIPLNIQFRRVLVGDRWETWLHLVSRLMEVQLTHQPDQLRWKLTRSGDFTVKSMYINVINSSVIPSSKHVWKVKVPLKIKVFMWFVHKQVILTKDNLIKRNWTGSTRCSFCDRDENIKHLFFD

SEQ ID NO: 124020 - protein, 118 aa, Triticum aestivum
  Clone ID: PAT_TA_18438.pep
LRCVLAQPLYVMAGQEITGRLHLVAHSAQSYTIFLLSAKMWGVGADPGGILQTSTAKLELKEPYYRLSQPQAYMPQDQQQLPLSSLQAQGSGQQMQDGLSPGITVDQERDSAAFTRQV

SEQ ID NO: 124021 - protein, 454 aa, Triticum aestivum
  Clone ID: PAT_TA_18439.pep
THASDDLSDSDDDDTSSRASDASSDFSTPPPASASKAARAATPASVVDDIDHHLRNLQLKYSEPISPNPSPAPNPGASASASAVNAVKLYLHIGGSTAAARWVNSDRLAAVSFVRSGEGASDPDEDDEPTGPWFLVVGSKIRAKVGPELQLKTFPVQRRVDFVADGVWALKFLHADGYGDFSPRVRSCLFENSYGVEATDEGRAKVFGKEFAAWARPECGDESIWEDASDAFSPGPKGSPMPARSPMLRPLMEDFREFEEPVEEGDGSIQSLALGALDNSFLVGDSGIHVVKNFEHGIHGEGVSVKISGGGTNFTTPKKALLMRAETNMLLMSPATDGKPHAKGVHQLDIETGKVVSQWKFGKDGAYINMRDITNDSKGAQMDASESTFLGLDDNRLCRWDMRDRHGIVQNLASSMESPVLEWTQGHQFSRGTNFQCFASTGDGSIVVGSLDGK

SEQ ID NO: 124022 - protein, 283 aa, Triticum aestivum
  unsure (1)..(283): unsure at all Xaa locations
  Clone ID: PAT_TA_18440.pep
MAAAVAVRSKRRLLPHLYRLLHSTAAPSPNRFLRHASPVPRAADHSPFLRLPAARVSTLPTGLRVVTQSYPAATRMASVGVWVDAGSRFELPGTNGTAHFLEHMAFXGTERRPTANALEVEIEDMGARLNAYTSREQTTFFADVQGRDVPAALDVLSDILQHPRFPQQGIQRERGVILREMEEVQGMMEEVIFDHLHTAAFRDHPLGDTILGPTENIKSISKKDLQQYISTHYTCPRMVVSASGAVDHDEVVDQVRKLFTGFSTDPTTADQLVEANPAIFTGS

SEQ ID NO: 124023 - protein, 234 aa, Triticum aestivum
  unsure (1)..(234): unsure at all Xaa locations
  Clone ID: PAT_TA_18441.pep
DAWGIRELAQLIFQAQEIESAHQLLXVDDSVGFGIVNACVGLGLLNKAHNILDEMTAQGASVGLAIYTPILKAYCKEQKTAEAAQLVAEISAAWLQLDAGSYDALIDASMTAHDFQSAFALFKDMREARLPDLKTSYLTIMTGLTENNRPELMASFLDAVVDDPRIEIATHDWXNSIIHAFCKVGRLRGCSERTYPKDAIPCLYEPKHPTYLLHFTNGXSSSQRXTFNVLHTMM

SEQ ID NO: 124024 - protein, 146 aa, Triticum aestivum
  Clone ID: PAT_TA_18442.pep
PTRPVANDSFVVQEFDEEFATGPRTRDFVAALQRWGLDPREKAMFFSTELDDNVRLSGRNIGTLKMLTPRTLNLYDILDARKHFFTPAAIDYLNSRYGTTGFDEYEGDDGDDDGEEEGVEEQEEGEEITEEAAQDETGEAEADSIS

SEQ ID NO: 124025 - protein, 305 aa, Triticum aestivum
  unsure (1)..(305): unsure at all Xaa locations
  Clone ID: PAT_TA_18443.pep
FLLPPLAPPPLPLHRRRRHHRPHIHQPAARAGTIILVLMMATAFLGYVLPYGQMSLXGATVITNLLSAIPXVGQDIVEFVXGGFSVNNATLNRFFALHFVLPFVLAALVLMHLIALHDTAGSGNPLGVSGNYDRLPFAPYFIFKDLITIFLFIIVLSIFVFFMPNVLGDSENYVMANPMQTPPAIVPEXYLLPFYAILRSIPNKLLGVIAMFSAILIIMIMPITDLGRSRGLQFRPLSKITFYIFVANFLVLMQLGAKHVESPFIEFGQISTVPRVEVVNGGRGEEMLACVEDVVQVESPWELAF

SEQ ID NO: 124026 - protein, 269 aa, Triticum aestivum
  Clone ID: PAT_TA_18444.pep
MASPYLLHRLTADEIFQTLEASSSTSSSCYDAFVPVFRPDPSSSSLSVSAADRVRSQFLSVERDLFHDALVAPRNDDLGFPEENDEEEEASIRWDCFQLDEEEEPDLPLEASVSAEEFDWEEVAFASGPLVENPEPDWEMLGDMPPSAPAGANEGFVYTSDREAYEVLVAVGDGLFLTNKPPAARSAVKALPSAILAAGEEGEGEECSVCKDGVVAGERVKMMPCSHRYHEDCILPWLEVRNSCPLCRFELPTDNPKYETWKAGRAMAT

SEQ ID NO: 124027 - protein, 169 aa, Triticum aestivum
  Clone ID: PAT_TA_18445.pep
GGAAPSLIKVMSFHEHIRCSYQLCRTIRLRTFRKGPKNYKALQQQLIMAILNYCLSILAPAPAVRGRRVLRGTGAACRRHCAPAAGVVAHPLRPLHERPSAAPPHCTSRSRRESSRHQWPGRARPRRRGPTPAETLSHSKSHLPILFPKFHPPLPPSPSHLHSLPCRSN

SEQ ID NO: 124028 - protein, 212 aa, Triticum aestivum
  unsure (1)..(212): unsure at all Xaa locations
  Clone ID: PAT_TA_18446.pep
RPPTRAVQQDSSLLDIANTSLMSDPPTVEKLKSXDEMNLRPLPTHQPAQSVSMAPKVPSVTDDDMFNDGRVYENFCVDDNDLTFENYEELFGTPHVQTEQLFDDAGIDSFFEMKEMPAADCDQQLNPVRPECSNAVSADSSLCVPARQAISTISLSFSGLTGESNAGDHQDCEVSPLLLMGEQPWLPPGSEGSSAGGSRGSALSRYLGRDHA

SEQ ID NO: 124029 - protein, 364 aa, Triticum aestivum
  Clone ID: PAT_TA_18447.pep
MASSLDAPNLDDYLTADSLPQEPPRSLTLRDLLDISPVLTEAAGAIVDDSFTRCFKSNSPEPWNWNIYLFPLWCLGVVIRYGLLFPLRFLTLILGWMAFFTAFFPVRFLMNGKNRLKSKIERKLVEMMCSVFVASWTGVIKYHGPRPSSRPYQVFVANHTSMIDFIILEHMTAFAVIMQKHPGWVGFIQKTILESVGCIWFNRNDLKDREVVGRKLRDHVQHPDNNPLLIFPEGTCVNNQYTVMFKKGAFELGCAVCPIAIKYNKIFVDAFWNSKKQSFTMHLVRLMTSWAVVCDVWFLEPQYLREGETAIEFTERVRDMIAARAGLKKVPWDGYLKHNRPSPKHTEEKQRMFAESVLRRLEEN

SEQ ID NO: 124030 - protein, 114 aa, Triticum aestivum
  Clone ID: PAT_TA_18448.pep
ISMYNSKLSHSDIRIYLLVMLWRLPGMISLPNVRRTPGRHPEACSSHIPRSGAQLQLARLMSSSCLATNARSKPAHTCPAPRTRRPVSHDTVKSTNLSTTVIIATRTLAHASAH

SEQ ID NO: 124031 - protein, 151 aa, Triticum aestivum
  Clone ID: PAT_TA_18449.pep
MSGRKKTREPKEENVTLGPAVREGEHVFGVAHIFASFNDTFIHVTDLSGRETLVRITGGMKVKADRDESSPYAAMLASQDVAVRCKELGITALHIKLRATGGNKTKTPGPGAQAALRALARSGMKIGRIEDVTPVPTDSTRRKGGRRGRRL

SEQ ID NO: 124032 - protein, 151 aa, Triticum aestivum; identical to SEQ ID NO: 124031
  Clone ID: PAT_TA_18450.pep

SEQ ID NO: 124033 - protein, 151 aa, Triticum aestivum; identical to SEQ ID NO: 124031
  Clone ID: PAT_TA_18451.pep

SEQ ID NO: 124034 - protein, 68 aa, Triticum aestivum
  Clone ID: PAT_TA_18452.pep
YGDGHLNFKKQYELNPFCKSNIRFAGTTWGSCRALHLQWVWPSSSAKHATSTSTMRELPGVQDPPQAP

SEQ ID NO: 124035 - protein, 270 aa, Triticum aestivum
  unsure (1)..(270): unsure at all Xaa locations
  Clone ID: PAT_TA_18453.pep
MAPLAPRRPAACLLALLSVVAVALSLAAPGLAAGKTGQVTVFWGRNKAEGSLREACDSGMYTMVTMSFLDVFGANGKYHLDLSGHDLSAVGADIKHCQSKGVPVSLSIGGYDARYSLPSNRSALNLFDHLWDSYFGGSKPGVPRPFGDAWLDGVDLFLEHGTPADRYDVLALELAKHNIRGGPGKPLHLTATVRCGHPPAAHVGRALATXIFERVHVRIYEESDKACNQYXAWEEAXDRWTAAYPATRFFIGLTXDDXSYQWIHPKNVYY

SEQ ID NO: 124036 - protein, 305 aa, Triticum aestivum
  unsure (1)..(305): unsure at all Xaa locations
  Clone ID: PAT_TA_18454.pep
MAPLAARRPACLLALLSVAAALFLTPTALAAXGGKTGQVTVFWGRNKAEGSLREACDSGMYTMVTMSFLDVFGANGKYHLDLSGHDLSSVGADIKHCQSKGVPVSLSIGGYGTGYSLPSNRSALDLFDHLWNSYFGGSKPSVPRPFGDAWLDGVDLFLEHGTPADRYDVLALELAKHNIRGGPGKPLHLTATVRCGYPPAAHVGRALATGIFERVHVRTYESDKWCNQNLGWEGSWDKWTAAYPATRFYVGLTADDKSHQWVHPKNVYYGVAPVAQKKDNYGGIMLWDRYFDKQTNYSSLIKYYA

SEQ ID NO: 124037 - protein, 145 aa, Triticum aestivum
  Clone ID: PAT_TA_18455.pep
VRSKHRASSLGGLLAAYDGSKSLYTAGELPFQAMDFSIKLGKPPRETEYKVKVQFAARANLYHLQQFLSGRQRDSPQDTIQALDVVLRESPSLNYVTVSRSFYSTIFGQRDIGDGLECWRRYYQSLRPTQMGLSLNIDISSMPFY

SEQ ID NO: 124038 - protein, 255 aa, Triticum aestivum
  unsure (1)..(255): unsure at all Xaa locations
  Clone ID: PAT_TA_18456.pep
MPRRALTLLLLARAVSAPFVAAAAAPPLHCPNDAAAGNATTTRRLDRRTKMFVHTARGVIGGGGDAGVEQESELGLFDAFFASLSMILVSEIGDETFIIAALMAMRHPKSTVLSGALSALVVMTVLSTGLGRIVPNLISRKHTNSAATVLYAFFGLRLLYIAWRSDSRASQNKEIEEVQEKLEAGQGKSTFRRVFSRLCTPIFLXSFVLTFLAEXGDRSQIATIALATHKNAVGVAIGATXGHTICTSFAVVRPG

SEQ ID NO: 124039 - protein, 362 aa, Triticum aestivum
  unsure (1)..(362): unsure at all Xaa locations
  Clone ID: PAT_TA_18457.pep
CTTRLRSDTKVRTPEEALVHIFGEARRTTPSILYLPQFHLWWDTAHEQLRAVLFTLLNELASTLPVFLLGTSSVAFDDPEVDCPSIFASRKLCLVDRPSDDHALRYFSILFESLLAHRGLRGAATREALLADNERRDRVDRERNQQGEQTVSSXADEGAGRGQRLFLTDAGDSAITQSSLGAFFFPVTKTRGRAVHAQPEVDLSPSYEVLKRHKNSIENEVGTSAKESTARDGMSPGDVDLSKPTSPEEAPKGPHSNGPLKEADKAPAEAPPILPGSPPDPMETDNGEDSAMPTSDDTLEQLEGLKQRFMELTVGYGVPQLERLYSRIMKGAIELTGKETNKDHRRLVVRHLLAFVENSDNF

SEQ ID NO: 124040 - protein, 261 aa, Triticum aestivum
  unsure (1)..(261): unsure at all Xaa locations
  Clone ID: PAT_TA_18458.pep
MVGLSEGEKHFIRGGIAQDLRADGRTRLQFRALTVVTGIVPQRVGSARVRMGATEVIASVKAELGKPTILHPDKGKVSIYVDCSPTAAPMFEGRGSEELSAELSVALQRCLLGGKSGAGAAIDLSSLIVVEGKACWDLYIDGLVVSSDGNLLDALAAAIKVALSDTGIPKVNVSLNNETDGEPEVDISDEEFLQFDTSGVPVIITLTKVGKHYIVHATXEEESHISSAVSVSVNSHGQICWVQEGKRKVGSNLILYTVARI

SEQ ID NO: 124041 - protein, 103 aa, Triticum aestivum
  Clone ID: PAT_TA_18459.pep
LGRVMLLISCVWYLALLCHLLSLDMLCVNATCLVSNYHICELCIAILLQDIIYVNYAMLSCCKGIIYVNYAMSCCLGKRHVCELYHTIIFLYYVLIACVDPVF

SEQ ID NO: 124042 - protein, 221 aa, Triticum aestivum
  unsure (1)..(221): unsure at all Xaa locations
  Clone ID: PAT_TA_18460.pep
XIAAIVKKYPRLLVLSDEIYEHIIYHPAKHTSFAALPGMYDRTLTVNGFSKAFAMTGWRLGYLAAPKHFVSACGKIQSQYTSGASSISQKAGLAALNLGYAGGEAVATMVKAFQERRDYLVSSFRELPGVKISEPQGAFYLFIDFSSYYGSEVEGFGTIKDSETLCMFLLEKAQVALVPGDAFGDDKGVRISYAAALSTLQSAMEKIKDAMALLKAPAAVQ

SEQ ID NO: 124043 - protein, 358 aa, Triticum aestivum
  unsure (1)..(358): unsure at all Xaa locations
  Clone ID: PAT_TA_18461.pep
MAFSSLSTPSSSSPSSSFTLPTKPSPGAGSLSFWRSSTGRFRIAAARAEAVDTTMSPRVSALRPIKTTAISDMVRGLQHVGLPXSGLGAGDSSWDTRALFAXPGKKNAQGAXTRYTPYGGDKGSLKIAMRHKLPNDTGCNCSTVKDVVTILDRHWENXESMTLAGPKPVTLPSCISNFRPIKPESLASVSTEKSRLLILCSPSNPTGSVYPKELLEEIAAIVKKYPRLLVLSDEIYEHIIYHPAKHTSFAALPGMYDRTLTVNGFSKAFAMTGWRLGYLAAPKHFVSXCGRLRSQSAAGASSGALTEPRAPWDPGVPRRRSNRILGLVKPGITCNISNRNTKLKLHCHDLPSERGHKI

SEQ ID NO: 124044 - protein, 62 aa, Triticum aestivum
  Clone ID: PAT_TA_18462.pep
SAHASGPGGDLRMYLEKLVFADDVECYVRNSPFGQPLRTHSDPHWDFYAEIAGKEYGALTCA

SEQ ID NO: 124045 - protein, 81 aa, Triticum aestivum
  Clone ID: PAT_TA_18463.pep
LLSGGSSSILQIKERLEKEVLEESPQNARVKVLASGSSMERRFSVWIGGSILASLGSFQQMWFSKAEYEEHGVSYIQRKCP

SEQ ID NO: 124046 - protein, 483 aa, Triticum aestivum
  unsure (1)..(483): unsure at all Xaa locations
  Clone ID: PAT_TA_18464.pep
VAEQPQRQAVRSTPRPGRVRTTRPRAPAPARRPLPPRTCSPVRRRRGSVYRGGRGPAIVIDVGSYSCKAGYAGDDTPKCIFPSVIDSTEQTRDTDEAKPEKEAXSDPMNGDKAKKKRKFYVGQELEFRRDHMEVISPMKDGTVTDWEVVDNIWNHAFRRRLLINPEEHPMLIAEPSINSGQQREKAAELMFEKYKVPALFLAKNAVLTSFASGRATSLVVDSGGGSTVVSAVHDGYVLQKSVATSPIGGEFLTDCMMKSLGRCXLGVMXQYSVKKKEVSPXWWHVVNLAFQRTTXSYMLYHMRAIASDIKETVCRVPDTPFDEVAYANVPTTSYELPDGQTIEVGAERFKIPDILFNPFLSQTIPGIDGFGDSTSIRGLPRMVLESVNRCDVDIRKELLSSILLSGGSSSILQLKDRLEKEVLEESPQNARVKVLASGNSTERRFSVWIGGSILASLGSFQQMWFSKAEYEEHGVSYIQRKCP

SEQ ID NO: 124047 - protein, 191 aa, Triticum aestivum
  unsure (1)..(191): unsure at all Xaa locations
  Clone ID: PAT_TA_18465.pep
MDSNANGGRSTMVGEMESSLERVRRQLSSTSTRHILQGPXLLKRSDTLRKWNERWVILDPATGKMEYKVRRSDTTVRGIIVFDSTSTATLSPTNFHGLPKYEGXCCVYIGTPQKKEYFLCAETPSAARAWVSTLHATQLVLQAHKQAVDSLGEMAETGVQTVATVVAVANATAIEASKEVEAAMKISLRAA

SEQ ID NO: 124048 - protein, 225 aa, Triticum aestivum
  unsure (1)..(225): unsure at all Xaa locations
  Clone ID: PAT_TA_18466.pep
VRPRVRADAIIFSCRKANRLTRSVGLXSYTFLKGTGCDDILVPVVDYEFDPSSRNFKRLMDRGEKHFSSNLSTLLRWSKFSTEDDLLNQFEDMGCHGTKIVVFNLWLNDVDEMELDFTTDDEDIMMSGAPKIPXERAKVKRLNHMHIANRFRYSLRVYASILYLRLPQHFKVILCGRTVEPHHIIKDLIYRECIKYRPQVGTSVQVDVITSIGFLKGAPHLDIYG

SEQ ID NO: 124049 - protein, 494 aa, Triticum aestivum
  unsure (1)..(494): unsure at all Xaa locations
  Clone ID: PAT_TA_18467.pep
AWSRPRYKSSYNXXAFPEALYHQLLLAMMHPXNNTRIGSHRVLSTIGAPSLLCPWSAIGFPVPMKXXGSQSVLLLALSAFSSEXXMDELQXXSRTXXSLQENEKPEAVNSKLMKLNNGQLXLLLSSIWSQASPEDNSXSNFEAMGHTYNVALLCSKAKTSSHVALVRCFQLAFSLRRLSLNQDNVVQPSRRRCLYTMASAMLIFSAKVADIPQITHLVKAAVPEEMVDPHLCLIDDCRLTVTSAQSSNSGMLYGSEEDESDAQVFLSAVNKDDTQLKDIVISHFKRKFENSPEKFDGIEEQLLQEFSLDDSFPLGAPLFMETPHSCSMYAEKDDHCFDEDVIPCEMDDDDDIVFEHSGSQSDRKTSGSMASSDVLNVNQLMESVHETARQVANIPVSTNPVSYDQMKSQCESLVMEKQQKMSVLMSFKHSRTDSRSSIGENGPETNESSAQSEPESHLTRKDYMRRNDSTSSDDRSFRLPPASPYDKFLKAAGR

SEQ ID NO: 124050 - protein, 377 aa, Triticum aestivum
  unsure (1)..(377): unsure at all Xaa locations
  Clone ID: PAT_TA_18468.pep
MNKDRSRISADGGGGDGLPPQPSRRSSTPPPEYDISRMPDFPTRNPGHRRAHSEILSLPDDLDLCAPGGGDGPSLSDENDEELFSMFLDVDKLNSSCGPSSDQAESSSAAAAGGGEAARAGHVMRPKHQHSQSMDESMSIKAEDLVGAPGXEGMSTVEAKKAVSAAKLAELALVDPKRAKRIWANRXSAELSNERKLLYIGELEXKVQTLQTEATTLSAQLSLLQRDTSGLTSENSELKIRLQNMEQQVHLQDALNDTLKTEVQRLKVATGQMGNGGGMLMNYGGMSQAPHQFGGSQQMFHSNPALPALRAALLLHQRRLHQQPQQHQQPMRPHHHHQQQQQPLHPLQPQQLQLPPRPLQLQRPMWGDGKSSGSGGI

SEQ ID NO: 124051 - protein, 93 aa, Triticum aestivum
  Clone ID: PAT_TA_18469.pep
RAPSSIVNLLWLCEEDATEAQQQADVKLLEAKKLASQYQKEADKCSSGMDTCEEAREKSAESLLGQRKLTALWEERARELGWKPGNVKPHRNQ

SEQ ID NO: 124052 - protein, 184 aa, Triticum aestivum
  Clone ID: PAT_TA_18470.pep
MGLWDSLLNWLRSLFFKQEMELSLVGLQNAGKTSLVNSIATGGYSEDMIPTVGFNMRKVTKGNVTIKLWDLGGQRRFRTMWERYCRGVTAILYVVDAADRDSVPIAKSELHDLLTKQSLSGIPLLILGNKIDKSEALSKPALVDQLGLESIKDREVCCYMISCKDSVNIDVVIDWLIKHSKTAN

SEQ ID NO: 124053 - protein, 87 aa, Triticum aestivum
  Clone ID: PAT_TA_18471.pep
VNRARCFDLGCGLQVYWILQKLPYILPLPLISSPAMSCPGGCHSGCSWILQSVGGTGERTLSCHPPARTGPRVRPRVRIVVGIIFLQ

SEQ ID NO: 124054 - protein, 174 aa, Triticum aestivum
  Clone ID: PAT_TA_18472.pep
LVCNDWQRERGWKTFKRPGVEAFLQHMANMYEVVVYSDQLQMYVDPVVERLDSTGQIRKLSRPATKYQDGKHYRDLSKLNRNPAQVLYVSAHALESCLQPENCVTVKPWKLETDDTELLDLIPFLEYLAIARPSDIRAVLASYQGHDVAKEFRKRSKELERHKQAKQRKSIWRR

SEQ ID NO: 124055 - protein, 312 aa, Triticum aestivum
  Clone ID: PAT_TA_18473.pep
MLSLGAHPFLLPSSSPLHTRLRSRPLCSPTSSAPTVSSSSAPPSLRFRFGFPRRGCAADRSRRATTMAAVVSPGDGGLVHDLVSSGVTAAIALGLLRFFEELAKRGVCDQKLNRKLVHITIGMVFLLFWPLFSSGRYAPFFAALAPGINIIRMLLLGLGIMKNEAMVKSMSRSGDHRELLKGPLYYATTITLATSVLWRTSPIAIALVCNLCAGDGIADVVGRRFGKEKLPYNPNKSYAGSIAMAVAGFLASIGYMHYFHSFGLMEKSWYMTLGFLVVSVAAALVESHPISTELDDNLTVPLTSFLVGSLIL

SEQ ID NO: 124056 - protein, 240 aa, Triticum aestivum
  Clone ID: PAT_TA_18474.pep
MGRGKIVIRRIDNSTSRQVTFSKRRNGIFKKAKELGILCDAEVGLVIFSSTGRLYEYASSSMKSVIDRYGRAKEEQQLVANPNSELKFWQREAASLRQQLHNLQENHRQLTGQDLSGMGVKELQTLENQLEISLRCIRTKKDQILIDEIHELNHKGSLVHQENMELYRKINLIRQENAELQKKLSETEAATEVNRDSRTPYNFAVVEDANVSVDLELNSPQQQNDVEHTAPPKLGLQLHP

SEQ ID NO: 124057 - protein, 70 aa, Triticum aestivum
  Clone ID: PAT_TA_18475.pep
RIFPDKPVTLRPTEARMGSGKGSPEYWVSVVKPGRILYEMGGVSETVARAAISIAASKMPIRSQFIRLEI

SEQ ID NO: 124058 - protein, 114 aa, Triticum aestivum
  Clone ID: PAT_TA_18476.pep
MSCLIVLLLHKDPFAEANAGDAGAAAGSKDYVHVRIQQRNGRKSLTTVQGLKKEFSYSKILKDLKKEFCCNGTVVQDTELGQVIQLQGDQRKNVSNFLVQAGIVKKEHIKIHGF

SEQ ID NO: 124059 - protein, 71 aa, Triticum aestivum
  Clone ID: PAT_TA_18477.pep
LEQSLMSCKDRLVPINYQPRTKSDVQKQKSVSLKSYCYSSTSLPTHLIKLYPIAQRFQHRFIPRADPAARG

SEQ ID NO: 124060 - protein, 106 aa, Triticum aestivum
  Clone ID: PAT_TA_18478.pep
TAFDPFAEANAGDAGAAAGSKDYVHVRIQHRNGLKSLTTVHGLKKEFSYSKILKDLKKEFCCNGTAVHDTELGQVIQLQCDQRKNVSHLLVQAGIVKKEHIKIHGF

SEQ ID NO: 124061 - protein, 63 aa, Triticum aestivum
  Clone ID: PAT_TA_18479.pep
RAPSTRGRATRRSAGPRCSCRATARRATPRSPTPASGARRCRDRTREPGRPRSSSPRRRGRPG

SEQ ID NO: 124062 - protein, 132 aa, Triticum aestivum
  unsure (1)..(132): unsure at all Xaa locations
  Clone ID: PAT_TA_18480.pep
MSDLDIQXIPTAFDPFRWRPMLGTLGAAAGSKDYVHVRIXQQRNGPKSLTTVQGLKKXFNYSKISKIQERFCCNGTMAKTXLGQAFNSKGDXRKNXSNFLVKPGFXKRTXQIKVLTTPVNTNNIATYKNRGN

SEQ ID NO: 124063 - protein, 115 aa, Triticum aestivum
  Clone ID: PAT_TA_18481.pep
MSDLDVQIPTAFDPFAEANAGDAGAAAGSKDYVHVRIQQRNGRKSLTTVQGLKKEFSYSKILKDLKKEFCCNGTVVQDTELGQVIQLQGDQRKNVSNFLVQAGIVKKEHIKIHGF

SEQ ID NO: 124064 - protein, 71 aa, Triticum aestivum
  unsure (1)..(71): unsure at all Xaa locations
  Clone ID: PAT_TA_18482.pep
YPFSALEPAWITARQIEAGXRAITXYARRGGKIWEHILTGGHGLLVDGHKQVIEALAQGLNQSCRYCRYLA

SEQ ID NO: 124065 - protein, 179 aa, Triticum aestivum
  unsure (1)..(179): unsure at all Xaa locations
  Clone ID: PAT_TA_18483.pep
MKIDKSFNIIAMLSPKRTRFRKQHRGRMKGKSCRGNRICFGRYALQALEPAWITARQIEAGRRAITRYARRGGKIWVRIFPDKPVTLRPTETRMGSGKGSPEYWVSVVKPGRILYEMGGVSETVARAAISIAAXSKMPIRSQFIPIKRYRTLKGVWKDKKKCPGFPFWETIFLQPFALK

SEQ ID NO: 124066 - protein, 135 aa, Triticum aestivum
  unsure (1)..(135): unsure at all Xaa locations
  Clone ID: PAT_TA_18484.pep
MSDLDVQIPTAFDPFAEANAGDAGAAAGSKDYVHVTHPSSVMVAKSLTTVQGLKKEFSYSKILKDLKKEFCCNGTXVVQDTELGQVIQLQGDQRKNVSNFLVQARIVKERTHQDHGSEHCSSYRAHASSIIVVRY

SEQ ID NO: 124067 - protein, 123 aa, Triticum aestivum
  Clone ID: PAT_TA_18485.pep
MIQPQTLLNVADNSGARKLMCIRVIGAAGNQRYARIGDVIVAVIKDALPQMPLERSEVIRAVIVRTCKEFKCEDGIIIRYDDNAAVIIDQKGNPKGTRVFGAIAEELRELNFTKIVSLAPEVL

SEQ ID NO: 124068 - protein, 148 aa, Triticum aestivum
  Clone ID: PAT_TA_18486.pep
MTSFKLVKYIPRIKKKKSGLRKLARKVPTDRLLKFERVFKAQKRIPMSVFKAQRVLDEIRWRYYEETVMILNLMPYRASYPILKLVYSAAANATHYRDFDKANLFITKAEVSRSTIMKKFRPRARGRSFPIKKSMCHITIVLNIVKKS

SEQ ID NO: 124069 - protein, 213 aa, Triticum aestivum
  Clone ID: PAT_TA_18487.pep
FIHMLQTHIGHRDEASLGIAGRVAGDGSIPSSRLEGLGKLQPHGALLQLLARAGEHRPNWLRRPGGVEVAPQPALDSCDDGGEVRRLRGGAAMERRRRHPGRPRLLRDEDLGRHGSRVLARHRGAPEAGVGERGVARRAVALHEHLGPALRRVARPRVDRARDPRRRGRHWNTSPELRRKCVCVWPPAWLEVDMSVIMRCCCAAHSLQINVVW

SEQ ID NO: 124070 - protein, 157 aa, Triticum aestivum
  Clone ID: PAT_TA_18488.pep
SCRIRHEVSRRSSARSQTRYPPPTTPAATRTDALAPELSSSERSNGGRADGGSVPGLPVAERRGAARGQGVHAERLRGVPLRAPLRRPPRRGGAGPGRGSQDGRDPRCRRGHGGGAAGDGDDADPVHAGPRHRRHKNPGRAAVQPLLHWDGDGAGAR

SEQ ID NO: 124071 - protein, 123 aa, Triticum aestivum
  unsure (1)..(123): unsure at all Xaa locations
  Clone ID: PAT_TA_18489.pep
MSDLDVQIPTAFDPFAXEANAGDAGAAAGSKDYVHVRIQQRNGSQRAWTTVQGLKKEFKLQARSSKDLXKKEFCCNGTSXVQGHKNLGQVIQLQGXIKRERTSQNFLVQGRIVKKGHIKIQGF

SEQ ID NO: 124072 - protein, 121 aa, Triticum aestivum
  Clone ID: PAT_TA_18490.pep
VISSGRPGRSRKLMCIRVIGAAGNQRYARIGDVIVAVIKDALPQMPLERSEVIRAVIVRTCKEFKCEDGIIIRYDDNAAVIIDQKGNPKGTRVFGRGLPEELRRLNFTKISFISSLKYYKY

SEQ ID NO: 124073 - protein, 115 aa, Triticum aestivum; identical to SEQ ID NO: 124063
  Clone ID: PAT_TA_18491.pep

SEQ ID NO: 124074 - protein, 115 aa, Triticum aestivum; identical to SEQ ID NO: 124063
  Clone ID: PAT_TA_18492.pep

SEQ ID NO: 124075 - protein, 115 aa, Triticum aestivum; identical to SEQ ID NO: 124063
  Clone ID: PAT_TA_18493.pep

SEQ ID NO: 124076 - protein, 115 aa, Triticum aestivum; identical to SEQ ID NO: 124063
  Clone ID: PAT_TA_18494.pep

SEQ ID NO: 124077 - protein, 239 aa, Triticum aestivum
  Clone ID: PAT_TA_18495.pep
MGQKINPLGFRLGTTQKHHSFWFAQPKNYSEGLQEDKKIRDCIKNYIQKNRKKGSNRKIESDSSSEVITHNRKMDSGSSSEVITHIEIQKEIDTIHVIIHIGFPNLLKKKGAIEELEKDLQKEINSVNQRFNISIEKVKEPYRQPNILAEYIAFQLKNRVSFRKAMKKAIELTKKADIRGVKVKIAGRLGGKEIARAESIKKGRLPLQTIRAKIDYCCYPIRTIYGVLGVKIWIFVDEE

SEQ ID NO: 124078 - protein, 116 aa, Triticum aestivum
  unsure (1)..(116): unsure at all Xaa locations
  Clone ID: PAT_TA_18496.pep
MSDLDVQIPTAFDPFAEANAGDSGAAAGSKDYVHVRIQQRNGRKSLTTVQGLKKEFSYSKILKDLKKEFCCNGTVVQDPELGQVIQLQGDQRKNVSNFLVQAGIXVKKEHIKIHGF

SEQ ID NO: 124079 - protein, 250 aa, Triticum aestivum
  unsure (1)..(250): unsure at all Xaa locations
  Clone ID: PAT_TA_18497.pep
MDFDGGIGDQSEMWDWQSQEFDLQKDLLPVACTSLWAEANHNEVDSWSLFDEQTPIKECTDIDLPFCDIGDIIIKDFDEGKETLQAKRRRMLQFCPDNSEIDCSLTDGLLENLQVDLDFSSDEHLLQCDGTEELPEQWLVDCSQDSENRSPPEEVKSPSAAVEVNISVLQNSLVELEEQPIMKVEKKPPQAKPTPLKAGRSVFRAXKLKVASVAYPFELIKPCGFRGDTTLRDINRKILAPPSYRIKHKI

SEQ ID NO: 124080 - protein, 211 aa, Triticum aestivum
  Clone ID: PAT_TA_18498.pep
MQPPKKTNNMKFTQITLANRTTLHIKHGCSTFSQLTSSKGQFSQNSQVVDLIDNATMHGQLKEHTLKSMRLKKAKIADVSSQLKHNVESRALTGNRGQQSTPPSKRSTIEQACEKNEAIQERCGGQESTTGPAFLKLAREKLSTAHDCADVEFMKALKLKTMHIKDSLEAIAKLFSSPGRLTLLEGFRVFVSKNHLPLYEQLVRKYTMANT

SEQ ID NO: 124081 - protein, 256 aa, Triticum aestivum
  Clone ID: PAT_TA_18499.pep
MARVYVGNLDPRATAREIEDEFRVFGVLKSVWVARKPPGFAFIDFDETRDAKDAIRELDGKNGWRVELSTKSSSGRGRERERSGGSDMKCYECGESGHFARECRLRIGSGGLGSGRRRSRSPRHRSRSPRHRSRSRSRSPRYRRSPSYGRRSYSPRDRSPRKRSYSRSPPPPRARSISRSPPPALARSISRSPPPARGRSTSRSPPPARARSISRSPPPPRAISISKSPPPARERSYSRSPAQPPQREESPYADNA

SEQ ID NO: 124082 - protein, 194 aa, Triticum aestivum
  unsure (1)..(194): unsure at all Xaa locations
  Clone ID: PAT_TA_18500.pep
MARVYVGNLDPRATAREIEDEFRVFGVLKSVWVARKPPGFAFIDFDETRDAKDAIRELDGKNGWRVELSTKSGSGRGRERERSGGSDMKCYEVVVERWPLCHQRPVRLRIGSGRPGXGRRRSRSPTPRTRSRSLSNPRRPTYGRRIYSPRPRRSPPPPRARSISKSPPPARERSYSRSPAQPPQREESPYADNA

SEQ ID NO: 124083 - protein, 219 aa, Triticum aestivum
  unsure (1)..(219): unsure at all Xaa locations
  Clone ID: PAT_TA_18501.pep
MATAAPTDTVPAWARTSSTPPPPPAPPAAADPARPSTPAPSAAVFIARLRLPPGAAAVHPRVPACAADRVGEPAPGQPAAVCSAALPLYFSINIGALVASSVLVYVQTHVGXGWGFGIPAVVMAIAVGSFFVGTPLYRHQRPGGSPLTRIAQVLVAATRKLGVPVDGSALYETADRESGIEGSRKLEHTGQSSSLTRAGVQATAASTASPGVARNQGGL

SEQ ID NO: 124084 - protein, 146 aa, Triticum aestivum
  unsure (1)..(146): unsure at all Xaa locations
  Clone ID: PAT_TA_18502.pep
MAAPTSSAASTLAPFSHPKTLAAATAAGGSSSVAFSPAASHPACALSVSGARRRAVAAMVAAPAKVGAAMPSLDFDTAVFNKEKVSLAGHEEYIVRGGRNLFPLLPEAFKGVKQIGXIGWGSQGPAQAQNLRDSLVEAKSDIGVKI

SEQ ID NO: 124085 - protein, 235 aa, Triticum aestivum
  Clone ID: PAT_TA_18503.pep
FPPFLQGMLEVYNSLSEEGKKEFNKAYSASFYPCIDILYECYEDVASGSEIRSVVLAGRRFYDKEGLPAFPMGKIDQTRMWKVGEKVRSTRPDGDLGPLHPFTAGVYVALMMAQIEVLRKKGHSYSEIINESVIESVDSLNPFMHARGVAFMVDNCSTTARLGSRKWAPRFDYILTQQAFVTVDKDEPINQDLISNFMSDPVHGAIEVCAELRPTVDISVTADADFVRPELRQSS

SEQ ID NO: 124086 - protein, 325 aa, Triticum aestivum
  unsure (1)..(325): unsure at all Xaa locations
  Clone ID: PAT_TA_18504.pep
GINASFAVXQDVDGRATDVALGWSVALGSPFTFATTLEQEYKSDIFGERGILLGAVHGIVEALFRRYTEQGMDEELAYKSTVEGITGIISKTISKKGMLEVYNSLSEEGKKEFNKAYSASFYPCMDILYECYEDVASGSEIRSVVLAGRRFYDKEGLPAFPMGKIDQTRMWKVGEKVRSTRPDGDLGPLHPFTAGVYVALMMAQIEVLRKKGHSYSEIINESVIESVDSLNPFMHARGVAFMVDNCSTTARLGSRKWAPRFDYILTQQAFVTVDKDEPVNQDLISNFMSDPVHGAIEVCAELRPTVDISVTADADFVRPELRQSA

SEQ ID NO: 124087 - protein, 243 aa, Triticum aestivum
  unsure (1)..(243): unsure at all Xaa locations
  Clone ID: PAT_TA_18505.pep
RAGRQPLPAAARPCLQWAVKPTAVIGWGSQGPAQAKNLRDARVEANPDIGVRIGVSKDSESFGEARGAGSTXENGTLADLWESLSGXSHLVPAXILDSAQADKYCEDYSLTWEPNRIHGLSHGFLLGHLQSHGLDFPKNISVVAVCPKGMGPSVRRLYVQGKEVNGAGINASFAVHQDVDGRATDVALGWSVALGSPFTFATTLEQEYTSDIFGERGIFLGGVHGIVGIPVHLCYDSRTGVQE

SEQ ID NO: 124088 - protein, 266 aa, Triticum aestivum
  unsure (1)..(266): unsure at all Xaa locations
  Clone ID: PAT_TA_18506.pep
VREISVFPSKEFYEGILEDGEGLNKKRPWHSYSCFGPFCFFDVDGVESQLSGSGSTVNEDEVEFITLLYYQLAMRYPELKSSSQVAVISPYRGQVKLLXDHFRSTFGDQSKEVIDVNTVDGFQGREKELVIFSCVRCNKEQNIGFVSDFRRMNVAITRARSAVLVIGSASTLKKDKHWTNLVESAKERNRYFKVPKPFTAFFTEDSFKSMKVERPVPDARISQAVEAINEVVARQEVMDADDAGDHQADGDDYDAMEADDGGGGDD

SEQ ID NO: 124089 - protein, 134 aa, Triticum aestivum
  Clone ID: PAT_TA_18507.pep
MEGGDARNGLTGTSQTTGSGVESPAKPLPPCCVKARAAAPESEAKCHATVVSGWFTETRSRCGKASKLQYYNNPMWPGETHSLKVDKILYQGKSPYQEVLIFESLTYGKVLVLDGIVQLTDKDECAYQEMITHL

SEQ ID NO: 124090 - protein, 290 aa, Triticum aestivum
  unsure (1)..(290): unsure at all Xaa locations
  Clone ID: PAT_TA_18508.pep
MSAVVCGKRSSSIFADDLLLQQASSSPPSPRHSPAPKRSRYAHHHHRRDGRDALLQHLRAAFPAMDPQLLERALEASGDDLDDAIKSLKELHLMESNQANLPATGSTFENGPTAVQPSVEGIVTSGGVDTATEHQPAADGQQPSNSGPEWVDLFVREMSNASDMDDARARASRALEALTKSILEGAGAEAAQSLHQENMMLKEQMTALNVMLSQNAVLKRAVAIQHVRNEEFDERRQEEEVLKQLVLQHQEPLRTLXTNNYINQTTALQMHLKQAQQSSSMPGRYNPDVF

SEQ ID NO: 124091 - protein, 318 aa, Triticum aestivum
  unsure (1)..(318): unsure at all Xaa locations
  Clone ID: PAT_TA_18509.pep
MNMYFEGYGYRGSTFEQTYRCYPASFIDKPQLESGDKIIMPPSALDRLASLHIEYPMLFEVRNTAAERTSHCGVLEFIAEEGMIYMPYWMMQNLLLQEGDMVFIKKANLPKGTYVKLQPHTTXDFLDISNPKAILEKTLRNYSCLTXGDSIMVAYNNQKYYIDIVETKPSSAISKSLPVREVDFAPPLDYKEPERPKPTAPPSADPAAEAQDEEEPKFSPFTGPGRRLDGKPAKDLDASSSSPAKRQANATNSVQPSAASTPQITAPRKTTGKLVFGSGGSQSSKGTEKVPDKDAKEDPKKEEPKFSAFTGKKYSLKG

SEQ ID NO: 124092 - protein, 385 aa, Triticum aestivum
  unsure (1)..(385): unsure at all Xaa locations
  Clone ID: PAT_TA_18510.pep
QSGGSPAXHQNLDGTNSAFLNYGLSGYPLNPGFNSMMMNNMGSGSMPPLFESGAAASAIASLGSDSRNLGSNISSPPALSLSDLHNLGRSNNQTATGLQSPLSDPFYVQYLKTAPSAPASAAEYSDAYLERGFMGSSYADLTPVQKAYVEALLQQKQYGMPLGKSVSSNHGYYSNLGYGMGMAYPGSPLGSPVASPSGPGSPIRLGERNLRFPSNTRSLTGWNVDPSGYMNGNFPSSLLDEFKSNKARSFDLAEIAGNVVEFSADQYGSRFIQQKLETATVEEKNMVFEEIMPHALSLTTDVFGNYVVQKFFEHGSSTQRRELAXELFGTCTKLLSIQDVMVVRVYPKSHIGVDLDQEDKXGTELGWHIMRCVXXQNGNHLSRNV

SEQ ID NO: 124093 - protein, 283 aa, Triticum aestivum
  unsure (1)..(283): unsure at all Xaa locations
  Clone ID: PAT_TA_18511.pep
MRVAVVGGGVSGLAAAHELLAASGGDGVRVTLYEEEDRLGGRASTVAVDDGAGRVHLDLGFLIFNQVTYSHMMEWLEGLGVEMERSDMSFSVSTQSDGGSRGCEWGNGNGISSLLAQKANILKTSFWRMVREILKVKNDALTYLEYHEHNPDVDCNETLGQFIQSHGRPLLFQEAYLIPVCAGLWSSSSEGVLSLSAFFVLSFFRNHDLLQLFRYPQLPTVKARSQSFVDKVKGALESMGCRIKTSCRVKSVSSFGGAGYRVLENDGSEETXDSVILGIHAPN

SEQ ID NO: 124094 - protein, 346 aa, Triticum aestivum
  unsure (1)..(346): unsure at all Xaa locations
  Clone ID: PAT_TA_18512.pep
ACSATAQLQKILKSGFSIARGSLPNRVLCSSHHLHCPKRSTQHAGFPGGGGEERRRRRPMDPGGAAAAAAKRAVWCWMWGMHDNSDDAGDGHKQFHLVASADFSHDTRMPGEFGNHLTNITPESDLVKLVAHDEPISDSNRCEANGGSASDTDMQLEVTLSTLAIQFFCRFYENVHMRGLTWQDDEYMQWVSGYHHIERTNGLSARFMNELIGVGCYSYFPFGPFGPGSTVITIPESAWAEISVGLQSMLITRLDSFLQPKHSNAMGLNNSACTLPPESVCVLADAAVSSSVLADVAVSDTSMFEAAVPEFATVSEGVLAAAVLPIPQSXXXGRXTXQTRQSXRXL

SEQ ID NO: 124095 - protein, 210 aa, Triticum aestivum
  Clone ID: PAT_TA_18513.pep
VRFNPKSAAELEELIKAHGEKSDVTVHVPKKIAVLLEGKQMLDLLEDKMETNGWVVSRYDKLKKVVHIHNALLKTDGLLSEAISLTDAAKIKPARYARHHVGSPVRVGKFSPTGRHHRRRTRRRHKLPRIVPAKIAGDLVDTGNVLQRFPLLQVQHLGRSVAAAGMGLLRQKEDMSVLHAQLLKVEEDSVMCGSVSSSLMSCRIPLGGIV

SEQ ID NO: 124096 - protein, 347 aa, Triticum aestivum
  Clone ID: PAT_TA_18514.pep
MPESSSDPGNGKGKRSLPSWMGSGDGGGGGGSPGKKKHAEAARERAPTGPDFSKLLDGVVFVLSGFVNPERGRLRSQALDMGAVYRPDWSSDCTLLVCAFTRTPKFRQVQSENGTIVAKEWISESHSQRKLVDIEPYLMHAGNPWRKNKVPVDSSQDQKKPRKEHEKQPEKTHAKTPPSAATKAGRSDAINKQFSPSKIKQWAMDDFAKTISWLESQEEKPEPNELKAIAAEGVITCLQDAIESLEQGNDISGVAEQWSFVPHVVDELVRLDGEGSSLSKEQLAQLATKCKKIYQAEFAQMDSGGKKGNERPGKTGADDAQYDSDDTIEMTEEEIDLACRQFSGISS

SEQ ID NO: 124097 - protein, 178 aa, Triticum aestivum
  unsure (1)..(178): unsure at all Xaa locations
  Clone ID: PAT_TA_18515.pep
NKSLTHNDTEDDLKQRRNGIYPDISMSKYEYWSSFAPLPLEYVTSAGLRAKDGGSNDLEETDMLVHDLTARAGEGNIETMLAVDKGLKELAFLKVDDAVLIALAXQHRPNVAELSDPDFKSSRDEKFTEASDLSKEEEEGVWCKQAGLMYFGRRAKIHHLGEDSRQGRVRCRICLLRP

SEQ ID NO: 124098 - protein, 161 aa, Triticum aestivum
  Clone ID: PAT_TA_18516.pep
LKVKELESQLDSKMHSQITSEKSQLSGKLKEKEEACTALQHKIVELERKLGQQQQSDSEVAALKQTIEEVELKLKEQEEQRSAAESKAMEMGQELLEAQKTESMLQSKLLDLEKKLQEMTKLKDASTMPDPKPQDASSTMMPEPKPQGTSSTTMPEPSNNN

SEQ ID NO: 124099 - protein, 89 aa, Triticum aestivum
  Clone ID: PAT_TA_18517.pep
IPVLSEMHLLDAKYEHCRLWRAAEGRRGGRRHHRHQAGPHPRAARCHQVTGTTLHAQVVQHFLLLLVQSHLECLFPILLCFHGKMLGWI

SEQ ID NO: 124100 - protein, 94 aa, Triticum aestivum
  Clone ID: PAT_TA_18518.pep
SFGAKATNLQIQPNILTCKHGKMGKKYSKCDAPKAKDLATPSSVWMWTSLMTVVAAPPRRPSAARQSLQCSYFASSKPISLRTGMSIAFGMLCL

SEQ ID NO: 124101 - protein, 247 aa, Triticum aestivum
  unsure (1)..(247): unsure at all Xaa locations
  Clone ID: PAT_TA_18519.pep
GGRRLAGGEGDILVRFGSHAGISLLSAFLLVSNFDAWICCLGQXEWEETGRMRKETSRRKRKSCSPYGTRINRSTRPPTRPQTTELVTSTCDVRGSENQQVQCTNMVVDQPTWAGNLVSNSGDVSTFLRKLIDQGKVSVGDIQSELSLSSESLEAALEKIGGAGSRGAWRIPLRPCTVPGRGVAAPLPAPLPSLAQALEDSHRGGGAPGAEVATASSRLTILGHALPPTVTGRWRWYPGGECCVKGL

SEQ ID NO: 124102 - protein, 126 aa, Triticum aestivum
  Clone ID: PAT_TA_18520.pep
ADGHAPPARLPWASASPEPRSGARGRAGVPTRLVALEAGLGGPRRRGGGRQGGRRALLGRRVAALRLQQMTAESQVWLCVANSHEVIGAGHRARLDQLLQPPCAVAVAVAQKARVPPRYRRLGVVL

SEQ ID NO: 124103 - protein, 112 aa, Triticum aestivum
  Clone ID: PAT_TA_18521.pep
SLHHSHFVSLLTICSKKFLAVASMVRASNKGSCSAYPFQVAQVLKRDQKCQLLKQKKGPDTHCNHGLLIYLMHFFMMVDFLSPDLTCLIMCARNQKLIEIFSSYLQMFCYSE

SEQ ID NO: 124104 - protein, 130 aa, Triticum aestivum
  Clone ID: PAT_TA_18522.pep
PGPTTATPLPRNIQPVVNDSTFLNLNNHGGKGRSFFSVGIRSWSRGWGRGWGRIPLDKVTTRRAVAPVVAAPPCTPVLGAGSPCTLSIGTWDSAGTSDGLLEPTWLAGSHPHLSCHLYLDYYYDCCCLAE

SEQ ID NO: 124105 - protein, 378 aa, Triticum aestivum
  unsure (1)..(378): unsure at all Xaa locations
  Clone ID: PAT_TA_18523.pep
SRYRXXXXSPVTSXXQIFNSEDDSVSGADKAEKHLTILETTVVELHLQIVDIKNLPSSIPEKSVYVWFTKTKPDAFIRDGGRLDIFTKTGKSIGAGFQCEPTGDLILTVMIDQAYFGASSSSKKPEPCARVSISLQELTRHDSKLSFERWFELKTGGAYAGSPPVSLRVAASCTVPRNAPHVLGMVNVKPCSLKACLLPHSIRDQNMSSWTRFVYDCGTELIRVQIRERKAKSGMALIRELVGVTKSSKQPFQLAEFTENKWSFNNSNSSITLDLKPSKDGCINELKYDNKLIKLYRGRRLAYELKCCSQHAEDTAAVTAVKFSAEHPYGKAVALVDTESEFISVDEDWFLLPWIAISFLFLNSIGNIGFEGQSMGHG

SEQ ID NO: 124106 - protein, 62 aa, Triticum aestivum
  Clone ID: PAT_TA_18524.pep
SIVYFWAIWPLCLNIKSHASRHPLYDSIASPPIYKRIKRCTTSFSLPQSNSEHSQLRTVQCL

SEQ ID NO: 124107 - protein, 42 aa, Triticum aestivum
  Clone ID: PAT_TA_18525.pep
GPSFFVGESMHDDGGVVFAYYKEGAADPTFLYFAHGLKEVKC

SEQ ID NO: 124108 - protein, 364 aa, Triticum aestivum
  Clone ID: PAT_TA_18526.pep
MERPWRRWLRCLSSAPGVVSPAAASGREEAHLVPAVYVFGDSTVDVGNNQYLPGNAALQLPYGIDFPQSRPTGRFSNGFNVADSISRLLGFKRSPPAYLSLTPETSRQIVRGYRGVNYASGGSGILDTTGNTLTLTKQVEYFAATKSKMTEKSSGIDALLSKSLFLISDGGNDFFAFLRQNLTASDAPSFYADMLSNYTKHVQTLYQLGARRFGIVDVPPIGCVPAVRVTSPDGETACVEAANALARGFNDALGRAMAKLAAALPGMRYSVGSSYNLITFITVHPQAAGFKDVASACCGGGRLGAQTWCGAPNATYCADRNDNVYWDEVHGTQATSSKGAKAIFAAPVKLGFAAPINFKQLVSS

SEQ ID NO: 124109 - protein, 168 aa, Triticum aestivum
  Clone ID: PAT_TA_18527.pep
MLVYQDKLSGDELLSDSFPYRELENGVLWEVDGHWVVQGAVDVDIGANPSAEGGGDDEGVDDQAVKVVDIVDTFRLQEQPAFDKKQFISHMKRYIKNLSAKLEGDDLDVFKKNVESATKYLLSKLKDLQFFVGESMHDDGGVVFAYYKEGAADPTFLYFAHGLKEVKC

SEQ ID NO: 124110 - protein, 168 aa, Triticum aestivum
  Clone ID: PAT_TA_18528.pep
MLVYQDKLSGDELLSDSFPYRELENGVLWEVDGHWVVQGAVDVDIGANPSAEGGGDDEGVDDQAVKVVDIVDTFRLQEQPAFDKKQFISHMKRYIKNLSAKLEGDDLDAFKKNVESATKYLLSKLKDLQFFVGESMHDDGGVVFAYYKEGAADPTFLYFAHGLKEVKC

SEQ ID NO: 124111 - protein, 168 aa, Triticum aestivum; identical to SEQ ID NO: 124109
  Clone ID: PAT_TA_18529.pep

SEQ ID NO: 124112 - protein, 54 aa, Triticum aestivum
  unsure (1)..(54): unsure at all Xaa locations
  Clone ID: PAT_TA_18530.pep
GPLGPDVQGKHAEVFERLVQTELTARSKRIHXHSWPMLGGGMYEPELDMNVRDR

SEQ ID NO: 124113 - protein, 197 aa, Triticum aestivum
  unsure (1)..(197): unsure at all Xaa locations
  Clone ID: PAT_TA_18531.pep
VTGATLSRGFNRGLGTLTAGGLALAIAESAKNLGEMEEVIIIISTFTVGFCTTLAKLHPTMKPYEYGFRVFLLTFVYVMVSGYNTGKFTDTAVSRFVLIALGAAVSXGINIGIHPIWXLGEDLHNLIAKNFAGVAXLXXCVXGYLKCMEYERXPSKICIQAXDDPLYMGQGNCRXSAQEETARFXIWEPPMVRKNRN

SEQ ID NO: 124114 - protein, 263 aa, Triticum aestivum
  unsure (1)..(263): unsure at all Xaa locations
  Clone ID: PAT_TA_18532.pep
VRKVDVRFAKEAPVLGIFGMNVYHKNRXIMPFWKVLQEGSSRGRSVVGVLEANFIEPAHDKQDFERTPLFIRLETKLRQIIIEYWKNNCHLIGYQPMNSQLKTQYKAAKGSGGPGHEFQQKSSTAQRIGAHSSSTAQRIGAHSSNLLPETYDDAAVFGLRTNGAGSGLQFFGQAQENGTNSAGLEEDLVNIASDGELDPNFLEKLSDENISLFTRREELKQRDTQLKQTILELEHELEETKRKCSQLSTELQVRKSQQQLPYM

SEQ ID NO: 124115 - protein, 135 aa, Triticum aestivum
  Clone ID: PAT_TA_18533.pep
EGREGFRGEVYMPSQGSCTTPRRRLCNCLQRGSANQLRIYLIRKRAEEIPACVWRSPAFPLYDKEGSSAPTSHVIKFLKANGLLGQYRDYYNIVMLSDKVFMERFIRPHKKAAPRLAKDYATACKGEVPANFRFT

SEQ ID NO: 124116 - protein, 120 aa, Triticum aestivum
  unsure (1)..(120): unsure at all Xaa locations
  Clone ID: PAT_TA_18534.pep
ACVRPRVRRSELENLEKKIKTCLRNXQSAQADITNGLEFKFELCQAACQEGIQHLCETTAYKVTFFDLGHILWDTLYIGDIASSRVDLLLRELDPILETISGTCPGGVSNRVITVLMKAT

SEQ ID NO: 124117 - protein, 249 aa, Triticum aestivum
  unsure (1)..(249): unsure at all Xaa locations
  Clone ID: PAT_TA_18535.pep
MQWPRNTQTMHSSIVLPSLATSLRRLVTLPALARDLRSAENALVNSKVTANLAAVVAEAGITGCDKSVGNLLYAVATKYPNNALVHRPALINYIXVSTKVKNPAQLDAALSFLTNTGPESLDIGKFEEACGVGVVVSIEEIQSTVAEVLKENMEAILEQRYHINVGGLCGQVMKRHPWGDAKATKEEIEKKLAEILGPKTEADNVKPVEKKXEKPAKGEGKKCAGTTGAPPSEGGLDAYTIFSQAGGNN

SEQ ID NO: 124118 - protein, 235 aa, Triticum aestivum
  Clone ID: PAT_TA_18536.pep
MASLDTVRGDLGLVVLYLSKAEARDKICRAIQYGSKFLSNGQPGPAQNVDKSTSLARKVFRLFKFVNDLQALISPPAKGTPLPLILLGKSKNAMLSTFLFLDQIVWAGRTGVYKNKERAEFLGRIAFYCFLGSNTCTTIIELAELQRLSKSMKKLEKDLKHQELYKNEQYRMKLKKSNERLLALIKSSLDIVVAVGLLQLAPKKVTPRVTGAFGFASSRLLIACYQLLPAPAKSK

SEQ ID NO: 124119 - protein, 189 aa, Triticum aestivum
  Clone ID: PAT_TA_18537.pep
DHFINRMTMRARGTGTYFPDPTLCKDRPPAGRGERGRHSFHPNHYHRAHRYPRMDMPADMVLSEEWRQVPVPPLQIYIPGASDHGIPSPLNIPLSSPSPRAPRDGIHRNGFIHPQDNKLEFGTLGALPLEVKGTSQDHPNKASSAANSQPSAPVSPVSSALNPGKGSNRMRNGGPYHLKDNGDFPPLSS

SEQ ID NO: 124120 - protein, 524 aa, Triticum aestivum
  Clone ID: PAT_TA_18538.pep
MLLRTRRCLPAALSRAAVHPRVSPALPSPGAPRQHGPVAVANQRSALEPRSGPIDWVRSSTMARANPATLFPASTGGHYRVGMQARWFSSAGLPPHMVIGMPALSPTMNQGNITKWRKQEGDKIEVGDVICEIETDKATLEFETLEEGYLAKILVPEGPKDVQVGQPIYVTVEESDDIEKIPADTSFGGDVGEDESSGSAAQTVEVDAAEQSPVMSRISPAAKMLIKEHGLNASLLKASGPRGTLLKGDVLAALKSGTALSSAKEKTAPAAPSPQPARDSQVHSQTTSPKSDTFEDITNTQIRKVIAKRLLESKQTTPHLYLSKDVILDPLLAFRNELKEQHGVKVSVNDIVIKAVALALRNVPEANAYWDNSKEEAQKCDSVDISIAVATEKGLMTPIIRNADQKTISAISSEVKQLAEKARAGKLAPNEFQGGTFSISNLGMYPVDHFCAIINPPQAGILAVGRGNKVVEPVMDNDGTEKAAVVTKMMLTLSADHRIFDGQVGGKFFTELALNFSDIRRLLL

SEQ ID NO: 124121 - protein, 217 aa, Triticum aestivum
  unsure (1)..(217): unsure at all Xaa locations
  Clone ID: PAT_TA_18539.pep
MPISADGHIWAVSAIQLSVSSFHLVMQRLFTQEEEDAAGGRWELVGRPFKDDCKFDRSLPTWDGSFLQGYVVLPGHGLDGGTLILLFLQNGLFFTFDCSATPEIQWTXVTHTSDEYYLPINGRGLYAQESNAIYMLWNNVVYEYKLTVVDEEEERGLSRLKLHPPARIDSVCPFITLKGDGFLTHLGWGVMCSVWISLDLSCGCDYLHAIVTTFQIG

SEQ ID NO: 124122 - protein, 96 aa, Triticum aestivum
  unsure (1)..(96): unsure at all Xaa locations
  Clone ID: PAT_TA_18540.pep
AATESGNLEVTYTHKEENGALALTGMXDAQSKPVLVCSLNDNTVRLYDLPSFSDRGRIFSKQEIRAIQTGPGGLFFTGDGTGELKVWQWIIDASQT

SEQ ID NO: 124123 - protein, 194 aa, Triticum aestivum
  unsure (1)..(194): unsure at all Xaa locations
  Clone ID: PAT_TA_18541.pep
XXRKIFFFYQITKFYFYQKEEIHNKKLGITDFFPDLAYYFCPKLFCSHHIKRRRPFAGCQSEFIAIVFLARIWQTSLKQCKIKRHHWRRLSEAFAAAARVGRCRCGGVSCRRGSGRPAVALDPASGMTSSRWPTTQARRGGRNGALASGSNRIPTNRRAAVGGAGGGPSRRRQRPAAASTGVAXGAADAGQGLV

SEQ ID NO: 124124 - protein, 534 aa, Triticum aestivum
  unsure (1)..(534): unsure at all Xaa locations
  Clone ID: PAT_TA_18542.pep
VRGRVGSPNHTTHTPTRGHVPGGGAAISRSSSSALRRQLARGGGGEQRQWARGYAAKEVTFGVGARAAMLRGVNDLADAVKVTMGPKGRNVVIERPNRSPKVTKDGVTVAKSIEFEDSAKNVGASLVKQVPDATNKAAGDGTTCPTVLTQAILTEGCXKAVAAGVNVXXLRKGINKAISAVTAHLKSKAWMIDSPDEINQVATISANGEKEIGDLISKAMGIVGKDGVITIADGKTLDNELEAVQGMKLTRGYISPYFVTDHKTQKCELKDPLILIHDKKISNMNSLLPAVQISIQNRRPLLIFAEDVDGEALSMLVLNKHRAGLKICAVKAPGFGENRRANLDDMAVLTGGQVISEDQGLDLDKVELQMLGTAKKVTVSLDDTIILDGGGERQQIEERCQQLRESLENSTSMFDKEKAQERLSKLSGGVAILKIGGASEAEVGEKKDRVTDALNAARAAVEEGIVPGGGVALLYATKELDNISTSHEDEKIGVQIIKNALKAPLMTIAANAGVDGAIVIGKLLEQDNLSLGYD

SEQ ID NO: 124125 - protein, 226 aa, Triticum aestivum
  Clone ID: PAT_TA_18543.pep
PFISVSPPAYHVALPGRPPRLAAFSSLASTVAPSTGFFAAVASLPSASAVALSTGFLAAVAFLPRVLTPTPSAVFPVVAISASAASAAVSPWVDIPASASTATLSSGESPVASPTPTSPPSDSAASVFSISSPGASPSVPAVALSSTVSSTGATASDSTAPSNTTSVIVISSAVFLSTLVCPPDASVYIFHLTGLLGTAVWPRDALSSSGFQALLFQPRTWSGPIC

SEQ ID NO: 124126 - protein, 185 aa, Triticum aestivum
  unsure (1)..(185): unsure at all Xaa locations
  Clone ID: PAT_TA_18544.pep
VEMGRGRRRGMRAVPLFLVLLVLVFMAVARVAAAEGSDVAEGVDVGGGEGEDKAFEKRFLKLWTDGGGGDGEDHLRCYGDDEDDYGDIYDDEKVKEMTEEEEEGEDGIMLGATRCPNPNKKKKKKKXNVVKVDSFGAVGXXCADDTXXRSFLNSRSCQRRDIYMIRTYLPTXXGVXXXXXXXXXX

SEQ ID NO: 124127 - protein, 109 aa, Triticum aestivum
  unsure (1)..(109): unsure at all Xaa locations
  Clone ID: PAT_TA_18545.pep
MANTNITGILEKMTGKDKDYRYMATSDLLSELNKESFKADQDLESKLTNIVLQQLEDASGDVSGLAVKCLAPLVKKVNEERVVEMTDKLCDKLLNGKDXHRDTASIALK

SEQ ID NO: 124128 - protein, 332 aa, Triticum aestivum
  unsure (1)..(332): unsure at all Xaa locations
  Clone ID: PAT_TA_18546.pep
INPADFFYPTGSPVPKQGSAFVPPDEIQLPPATIAFDWPSRQGQPCSMDFMAFXANRDKIVAVDSIGCSYLYDAPVRSISTNMPMMPTRMLQPMSIAVGDNGLLVMSKADHQFVALNDGCDPNSKIFITKCLAXYWQSLKPPPFPSRSYHQNEKGSHHPFEVSSYTVVGNSQFWVSTVGAGTFSFDMNSGAWMKAGNWELPFRGRAEYVPEHNLWFGMFGKDDQLCASDLIAVSAVSSPVPHILWKELVWPKDWKLRSTHLLPLGSSRLCIARFFLTSDDDKEENMSDYKRSTTNNFGVLTGVEVVSDEGGLRIIHHKSIRFDFGLSIASVL

SEQ ID NO: 124129 - protein, 117 aa, Triticum aestivum
  unsure (1)..(117): unsure at all Xaa locations
  Clone ID: PAT_TA_18547.pep
YSPQXVHARDPSIWLASXVIGPSRVRVAGGPLGEIVDPLYPGGSFXPLXLADDXEAFAELKVKEIKNAASPCSPMFGFFVQAIVTGKAPFGDLADHLADPVNNNAWAFXATNFVPGK

SEQ ID NO: 124130 - protein, 190 aa, Triticum aestivum
  Clone ID: PAT_TA_18548.pep
SSPGSGRDNSSFKKPGQSSTVFVRGFDSSLGEDEIRSSLQDHFSSCGDIRRVSIPKDYDTGASKGIAYIEFDDISSLSKALELNGSNIGEGLSLFVDEAKPRADNRDGADSGNRSGGRFNGGGGRGGRFDGGGGRRGGRFDGSSGRRGGGRFGWGDRGGRSDRGRGRGGAPPRQSAGTPSAGKKITFGDD

SEQ ID NO: 124131 - protein, 114 aa, Triticum aestivum
  Clone ID: PAT_TA_18549.pep
VYTRLLVALRLCQRCRCCVVDSDVCDSSSGCGLGRSLPFGYTNSFEASWMVSVDWSSWSTMVVFSCSLPFARTMEDDGIPVLFFFPSIVSGVIYFLSSLYSSVISRLCRFLLNE

SEQ ID NO: 124132 - protein, 134 aa, Triticum aestivum
  Clone ID: PAT_TA_18550.pep
MGNLCCCVQVDQSTVAIREQFGKFDSVLEPGCHCLPWIFGKRVVGHLTLRLQQLDVRCETKTKDNVFVTVVASIQYRPLAGKESDAYYKLTNTRSQIQAYVFDVIRASVPKLNLDDAFVQIRDGLLQGQSASDN

SEQ ID NO: 124133 - protein, 114 aa, Triticum aestivum
  Clone ID: PAT_TA_18551.pep
RFCWFFGRIAWGWDHVIKKNESRLGWNVRRENQQRTGGRLDEGFDDVRRETERCVSFRYYYYYIILIIIIGELEMRLEIICFLKIYYLFPNINCINERDFVDLAKVGKNLLFVC

SEQ ID NO: 124134 - protein, 94 aa, Triticum aestivum
  Clone ID: PAT_TA_18552.pep
MAASMITSPIVAPTSVPSLSRRGSSFAVVCSGGKKIKVDKPLGLGGDLTVDIDANGRKVGKKGVYLPGAARAARAGTLFWLWLQFSSAGQAIAR

SEQ ID NO: 124135 - protein, 100 aa, Triticum aestivum
  Clone ID: PAT_TA_18553.pep
CNNRHDIIVQGFKHYRRHHGTRKICQTHTNNDRGHLVSLFYYMELQAGNGETNVTHPRGQRESGGKLRQSWNNDTRTKNNSSAQHTNGGRRTCPGGRSKS

SEQ ID NO: 124136 - protein, 121 aa, Triticum aestivum
  Clone ID: PAT_TA_18554.pep
RWPAPFDHDASDAGAPAWLLLPHARPTHPPLLLQTKHEDHTREALLWRRPVPDQESRYVVAPDRERRRRCPVDGVEEDGGFRAVVRPAVEKLIEVHPHTACCVDGHNLGCLPPPSHRPFEG

SEQ ID NO: 124137 - protein, 67 aa, Triticum aestivum
  Clone ID: PAT_TA_18555.pep
IFTCLIGERERESLLKLTSVCWHRICGVQCGLLSQTLSYLNRSEIILRWHRICEALNLYSQTLCMLK

SEQ ID NO: 124138 - protein, 72 aa, Triticum aestivum
  unsure (1)..(72): unsure at all Xaa locations
  Clone ID: PAT_TA_18556.pep
RPGGSRRXTCRPTSPRPARSTRRTPGSGPTPRRASPRHGARRPSRLXRWPEPWPCDRSTHRSRHAKVHARVA

SEQ ID NO: 124139 - protein, 98 aa, Triticum aestivum
  Clone ID: PAT_TA_18557.pep
GAEREGRRGGRKRELGECTGLFKIERTIGKAEYVHRQPAQCPDSPSSTTGDAVGCLQATSRPLLSLPEEGLWFSTSLLLILKFRYSGEVSSFCNLLKT

SEQ ID NO: 124140 - protein, 94 aa, Triticum aestivum
  Clone ID: PAT_TA_18558.pep
KKIKVDKPLGFGGGLTVDIDANGRKVGKKGVYQFVYKYGANVDGYSPIYTPEEWFEFGDRYAGGTTGFFIWAVTLAGLLGGGVLLVYNTSALAG

SEQ ID NO: 124141 - protein, 141 aa, Triticum aestivum
  unsure (1)..(141): unsure at all Xaa locations
  Clone ID: PAT_TA_18559.pep
RKKKGSSRQGKLGKEKKRTGMPSSSIVLTDTRLHKNTTTIDEELQSTETIHDASRLLVQLKGNERPSPHPNKESHAAEATTQQRHRRQSRRASRSRVYTRIVSPCSPTTMIAEGKLRHHRTTPEQGTTXRRRELHHHKQST

SEQ ID NO: 124142 - protein, 100 aa, Triticum aestivum
  unsure (1)..(100): unsure at all Xaa locations
  Clone ID: PAT_TA_18560.pep
PVEGIPXFAGGPARARSSDPLYPGGSFDPLGLADDPEAFAELXKVKEIKNGXRLAMFSMFGFFVQAIVTGKGPLENLADHLADPVNNNAWAFATNFVPGK

SEQ ID NO: 124143 - protein, 99 aa, Triticum aestivum
  Clone ID: PAT_TA_18561.pep
SSIRTASPRVLDPAPPHIMILDWAQVIAIREPGWCGLHAWCGEARGMSRTGMGKEQLGRSSGVVRVMVEWSRPSLWAAARRSSFIQSQLLIFGFTIFLP

SEQ ID NO: 124144 - protein, 85 aa, Triticum aestivum
  unsure (1)..(85): unsure at all Xaa locations
  Clone ID: PAT_TA_18562.pep
GEELKKLIGAPYYIECSSKTQLVXLSSYMFAYCIMQCEMLTEFVFLVLVDFQNVKGVFDAAIKVVLAPPKAKKKKKAQRGACSIL

SEQ ID NO: 124145 - protein, 93 aa, Triticum aestivum
  unsure (1)..(93): unsure at all Xaa locations
  Clone ID: PAT_TA_18563.pep
MVRAPVRRPXGEMLTVYPGAVXPLAFAEAPSLRGVQVKEIKTPLRHVLPCSGSFVQAIVTGQGPLGEPRRPTSXDPVNNNAWAFXATQFVPGK

SEQ ID NO: 124146 - protein, 115 aa, Triticum aestivum
  Clone ID: PAT_TA_18564.pep
PRCEIGTEEELNQRVFGRRREAADASHEADRLGPGMEAAGAGAERADAAAAKDREDEVASISEKRPIHLRAVTAGIAPPSPSPLVAPPYMLRTIMWLSVAVCSYPPRLHTSFLEN

SEQ ID NO: 124147 - protein, 91 aa, Triticum aestivum
  Clone ID: PAT_TA_18565.pep
YAPGVPIILVGTKLDLRDDKQFFVDHPGAVPITTAQGEELRKQIGAPYYIECSSKTQLNVKGVFDAAIKVVLQPPKAKKKKKVQRGACSIL

SEQ ID NO: 124148 - protein, 71 aa, Triticum aestivum
  unsure (1)..(71): unsure at all Xaa locations
  Clone ID: PAT_TA_18566.pep
TPWGLADDPEAFARLKVKEIXNGRLAMFSMFGFFVQAXVTGKGPLENLADHLADPVNNNAWAFATNFVPGK

SEQ ID NO: 124149 - protein, 83 aa, Triticum aestivum
  Clone ID: PAT_TA_18567.pep
TCALKKVNIFDNKMYLIHDKHCVQENGQLNHIIWFYTKGNFLFCVHPKDHPLVMNALSFESNGTAPVLCGKIIPINVQSKKIM

SEQ ID NO: 124150 - protein, 137 aa, Triticum aestivum
  Clone ID: PAT_TA_18568.pep
CLQTSATLRRRLCLNITKRRSLPRSRSEDALPWLLKHELRPDLLILLEAAGGSTFLHSSLVSSGCSFKMCGTHTAAHRVPWPHGEDVRQMGRWPACLRGGGRRTAARPGHRYERIRHHRQAAELLPCDHVTPGLSCS

SEQ ID NO: 124151 - protein, 101 aa, Triticum aestivum
  Clone ID: PAT_TA_18569.pep
AVVCSGGKKIKVDKPLGLGGGLTVDIDANGRKVGKKGVYQFVDKYGANVDGYSPIYTPKEWFEFGDRYAGGTTGLFIWAVTLAGLLGGGVLLVYNTSALAG

SEQ ID NO: 124152 - protein, 155 aa, Triticum aestivum
  Clone ID: PAT_TA_18570.pep
WHVEENVPLSQDDGKHRREEDLRDRKREDRDVSSSRVDDMDRDKGNTMKEDSDPNSASKRRKIKRDQSALEAGEYAPSAPQPPSLGAGNSQFEIRERERKGVISQHRPSHADDLPRMHAKDSISKTSRRETDQTHDREREEEKRPRTEARRKHRK

SEQ ID NO: 124153 - protein, 302 aa, Triticum aestivum
  Clone ID: PAT_TA_18571.pep
RISSYFVERHQFDKNCFVIQWSGDNPNSLAGLTLNTPGDLAISLGTSDTVFGITAEAKPSLEGHVFPNPVEPDGYMVMLCYKNGSLTREDVRNQCAEKSWDIFNNYLEKTPPLNGGRLGFYYKDHEILPPLPVGFHRYIVENFSDASSDNLKECEVQEFDPESEVRAIVEGQMLSMRGHAERFGMPNPPKRIIATGGASSNESILKLIAKIFGCPVFTVERPDSASLGAALRAAHGWLCKEEGGFVPISRMYTGNLEKTSLGAKLAVPAPGDEGRELLKKYTVLMKKRMEIERRLVEKIGRA

SEQ ID NO: 124154 - protein, 182 aa, Triticum aestivum
  Clone ID: PAT_TA_18572.pep
MVAAAILPELATQLVVPVAAAVGIAFAVLQWVLVSKVKVAPEPRGEGGSAAGGGTGAGAKDGASEYLIEEEEGLNDHNVVLKCAEIQTAISEGATSFLFTEYKYAGGFMTVFAVLIFVFLGSIEGFSTKSHPCHYSVGKTCKPALANAAFSTIACVLGAVTSLVSGFLGMKIATYANARTTL

SEQ ID NO: 124155 - protein, 335 aa, Triticum aestivum
  unsure (1)..(335): unsure at all Xaa locations
  Clone ID: PAT_TA_18573.pep
GYPGAPPRASEEQNLIRXEKLKEKFDDKYDRDXREKADRXERRRGEDVVERPTDRSLERRERSIEKMQDRVPEKGREDRNKEERNKVKHEPIDRAHTIKNEPIDRAYTIKNEPIDRAHTVKHEPIDRAHTSDERFRGQSLPPPPPLPTSFVPQSVAANRRDEDSDRRGSSTRHTQRSSPRRDEKERWHLEENAPLSQDDGKHRREEDLRDRKREDRDVSSSKVDDRDRDKVNTVKEDSDPNSASKRRKVKREQSALEAGEYAPSAPQPPSVGPGNSQFEIRERERKGAISQHRPSHADDLPRMHAKDSTSKTSRKEADQTHHRDWEEEKRQGLKQ

SEQ ID NO: 124156 - protein, 73 aa, Triticum aestivum
  Clone ID: PAT_TA_18574.pep
RICLVDSLNLLSETVLYGANVDGYSPIYTPEEWSESGDRYAGGTTGLPIWAVTLAGLLGGGVLLVYNTSALAG

SEQ ID NO: 124157 - protein, 116 aa, Triticum aestivum
  Clone ID: PAT_TA_18575.pep
HPTSRKKASTPSKIYWNHPRLNERNIAQFDHWIAHVLTVAHALVILSSLIHRAQCSLALAISQPASLLTNASITCMNFSPILCESYQSCASMISHMFLGLNHYGVMGRHPCKARCP

SEQ ID NO: 124158 - protein, 107 aa, Triticum aestivum
  Clone ID: PAT_TA_18576.pep
MAASMITSPIVAPTSVPSLARRGSSFAVVCSGGKKIKVDKPLGLGGGLTVDIDANGRKVGKKGVYQFVDKYGANVGGTTGLLIWAVTLAGLLGGGVLLVYNTSALAG

SEQ ID NO: 124159 - protein, 128 aa, Triticum aestivum
  unsure (1)..(128): unsure at all Xaa locations
  Clone ID: PAT_TA_18577.pep
GRRRRGSSPARQRRGWRAPGGLLERSLSFKNWEAEVGADEPEAATRSINGARPGTLLLHSPGSKQQQSPSKAHFVSPXPXXELDDAATKVQKLFKGHRTRRNLADCAIVVEELWWKAYDSASLNIKSI

SEQ ID NO: 124160 - protein, 110 aa, Triticum aestivum
  unsure (1)..(110): unsure at all Xaa locations
  Clone ID: PAT_TA_18578.pep
GTFFGVETLSGVLAGALVSGVQIAISASNTGGAWDNAKKYIEAGASEHAKSLGPKGSDCHKAAVIGDTIXGDPLKDTSGPSXLNILIKLMAVXESLVFAPFFATYGGILL

SEQ ID NO: 124161 - protein, 183 aa, Triticum aestivum
  Clone ID: PAT_TA_18579.pep
VWGHLGRKSQSRDKDGEQGDDVFDEDLEYEETDNPELDVKPVYVKDDFFDSLSGGTFGRGGQNGRPRFSELRKMDTETFGEFPRHRQPYRGGGRGGYRGGGGRSRGSYYGGGRGDYGNMGRGGGQENYYGGGRGGHGNMGRGGGGQDNYYGGGGGSGRGGYGRGGGQEDSYPQRGGGGSYGRG

SEQ ID NO: 124162 - protein, 106 aa, Triticum aestivum
  unsure (1)..(106): unsure at all Xaa locations
  Clone ID: PAT_TA_18580.pep
PSPVVLLGPXEGYRVPGXPLGEIVDPLYPGASLDPLALAEDPEPFAELKVKEIKNGRLAMFSHVRASSCQAIVTGKGPLXENLADHLADPVNNNAWAFATNFVPGK

SEQ ID NO: 124163 - protein, 57 aa, Triticum aestivum
  Clone ID: PAT_TA_18581.pep
RSGMHPLLATQTEETKAAKHCTADVDFGISHEPVILLDAHVKLTYFALCNCIIERLS

SEQ ID NO: 124164 - protein, 198 aa, Triticum aestivum
  unsure (1)..(198): unsure at all Xaa locations
  Clone ID: PAT_TA_18582.pep
MASKRILKELKDLQKDPPTSCSAGPAGEDMFHWQATIMGPPDSPYAGGVFLXVNIHFPPDYPFKPPKDYDTGASKGIAYIEFDDISSLPKALELNRSNIGESLSLFVDEAKPKADNRDGADSGNRSARRFNGGGGRRFDGGGGRGGKFDGGSGRRGGGRFGRGDRGGRSDRGRGRGGAPPRQSAGTPSSGKKITFGDD

SEQ ID NO: 124165 - protein, 488 aa, Triticum aestivum
  unsure (1)..(488): unsure at all Xaa locations
  Clone ID: PAT_TA_18583.pep
MGFSFFASRAAARFLQDIRRPSSAGVSTAALLLTAASGGGIVAYADSARAEEAPEPPPRKKKVVVLGTGWAGTSFLKNLDSSRYEVKVISPRNYFAFTPLLPSVTCGTVEARSVVEPIRRMFEKKGKDVAYYEAECFKIDPTKKAVHCRSAVGTNLDGNGDFMLDYDYLVVALGATVNTFNTPGVMEHCHFLKEVEDAQKIRKSVIDCFERASIPNISEEEKRKILHFVIIGGGPTGXVEFAAELHDFLVEDLVKLYPAIAQFVKITIIQSGEHILNTFDQRIAVFAESKFQRDGIELSTGFRVIKVSDDSITXKCKSSRCRNIGAXYGMAVWSAGIGTRPVITDFMSQVGQGKRRALATNEWLRVPECDSVYAIGDCSSISQRKIMEDISTIFKVADKDNSGTLTLKEINDVLEDICIRYPQVELYMKSMHMVDIADLIKGGVGDSNKESMVVNIEEFKKALSHVDSQVKTVPATAQVVSISREYMG

SEQ ID NO: 124166 - protein, 35 aa, Triticum aestivum
  Clone ID: PAT_TA_18584.pep
RGRGRGVRLENLADHLADPVNNNAWAFATNFVPGK

SEQ ID NO: 124167 - protein, 120 aa, Triticum aestivum
  Clone ID: PAT_TA_18585.pep
IHSNTPGVMGHCHFLKVMEDAQKIRKSVIDYFEKASPPNLSEEERRKILHFVIIGGGPTGVEFAVELHDFLVEDLVKLYPAIKEFVKITIMQSGEHTMRVERSCSNNLSFGQDDQGVAKL

SEQ ID NO: 124168 - protein, 144 aa, Triticum aestivum
  Clone ID: PAT_TA_18586.pep
ICISITSSDEHVVTLSLPMIDQSEIRDPTYVHDKNGSSADADVRHEHEHSTNENSKRKIINTEMDRPASPNLTYYQHGINGIQLKRTPCMRALQGYHGDHAACFHGSIGAAASPMPSGDACVYLGMARSVRRPVAITRPGRRRP

SEQ ID NO: 124169 - protein, 293 aa, Triticum aestivum
  Clone ID: PAT_TA_18587.pep
PRVRKNCLVIQGSGDNPNSLAGLTLNTPGDLAISLGTSDTVFGITAEAKPSLEGHVFPNPVEPDGYMVMLCYKNGSLTREDVRNQCAEKSWDVFNNYLEKTPPLNGGKLGFYYKDHEILPPLPVGFHRYIVENFNDASSNNLKEHEVQEFDPQSEVRAIVEGQMLSMRGHAERFGMPNPPKRIIATGGASSNESILKLIAQIFGCPVFTVERPDSASLGAALRAAHGWLCKEEGGFVPISRMYTGNLEKTSLGAKLAVPAPGEEGRELLKKYTVLMKKRMGIERRLVEKIGRA

SEQ ID NO: 124170 - protein, 234 aa, Triticum aestivum
  unsure (1)..(234): unsure at all Xaa locations
  Clone ID: PAT_TA_18588.pep
MERGIVVATFALLIMDQLDTAGGFTISXFLLFLSSTVAALTCMVMKLPADRFLGSAPVSELLQXTLLLLLLVTVHTLAAELLGEDVVLFCMPEVIPVLLWFSLNLDRPHHSPLTNIYKMKRHLKGLTIALGVLVVVPLFAYLVSSMDVSGLSYCTTIMVACGISGVLTYYIVFMLNYWHWPWQKQQAAAGSSSKDDVPSSCMLKFWADVLLIVAAVLLLLRYMVDVRLDLQQPL

SEQ ID NO: 124171 - protein, 287 aa, Triticum aestivum
  Clone ID: PAT_TA_18589.pep
MGNLCCCVQVDQSTVAIREQFGKFDSVLEPGCHCLPWIFGKRVVGHLTLRLQQLDVRCETKTKDNVFVTVVASIQYRPLAGKESDAYYKLTNTRSQIQAYVFDVIRASVPKLNLDDAFVQKNDIAQAVEDELEKAMSAYGFEIVQTLIVDIEPDAHVKQAMNEINAAARMRVAANEKAEAEKIVQIKRAEGEAEAKYLSGLGIARQRQAIVDGLRDSVLGFSVNVPGTTAKDVMDMVLITQYFDTMKEVGASSKSSAVFIPHGPGAVRDIATQIRDDLLQGQSASDN

SEQ ID NO: 124172 - protein, 163 aa, Triticum aestivum
  unsure (1)..(163): unsure at all Xaa locations
  Clone ID: PAT_TA_18590.pep
WAMLGALGCVFPXELLARTGVKFGEAVWXKAGSQIFSEGGLDYLGNPSLVHAQSILAIWACQVVLMGAVEGYRVAGGPLGEIVDPLYPGGSFDPLGLAEDPEAFAELKVKEIKNGRLAMFSMFGFFVQAIVTGKGPLENLADHLADPVNNNAWAFATNFVPGK

SEQ ID NO: 124173 - protein, 244 aa, Triticum aestivum
  unsure (1)..(244): unsure at all Xaa locations
  Clone ID: PAT_TA_18591.pep
STHASETVLTEMTGKWLGSRQIRCNWATKTNAEEKQETDNHNAVVLTNGGSSNAAMEANQDTGSKENPENNPDFTTVYVGNLGHEVNRDELHRHFYNLGVGAIEEVRVQQEKGFGFIRYTTHGEAALAIQMANGLVVRGKPIKCSWGNKPTPPGTSSKPLPPPDCFLSTXAMAGVPQGFTAAELLAYQRQLALSQAAAGQIAGQHGLAGPGILRGYSPXGSQALYDGLPRTRRRRSSSCTTTSI

SEQ ID NO: 124174 - protein, 149 aa, Triticum aestivum
  unsure (1)..(149): unsure at all Xaa locations
  Clone ID: PAT_TA_18592.pep
MASKRILKELKDLQKDPPTSCSAGPAGEDMFHWQATIMGPPDSPYAGGVFLVNIHFPPDYPFKPPKVSFKTKVFHPNINSNGSICLDILKEQWSPALTISKVLLSICSLLTDPNPDDPLVPXEIAHMYKTDRSKYETTARSWTQKYAMG

SEQ ID NO: 124175 - protein, 157 aa, Triticum aestivum
  Clone ID: PAT_TA_18593.pep
EHTATDNHIIVLQMLVVGIRTYCHQKSQSQPFQDQPQHIGRCHQGRGRRRRYPCSDSTQVDRPLLADGCNLVLPGLGRRHICPLRARPGRLHSLAEPIRLLALIRCFPPPAEDALVELLLRTYLAPRSLLLPRLPRNLGQMRTSRGGGSHRNGRRSP

SEQ ID NO: 124176 - protein, 170 aa, Triticum aestivum
  Clone ID: PAT_TA_18594.pep
MLLAQPKGNERSSPHPDEEPHAAETTSQQRHRRRSRRASRSRVYTRIASPSTPAQSGRATTTPPPHHTPPSTPVGRTNRPPAAPLSSTHTNTSRSSCLQDGASKKGMMPETPPPPDPASPTIGFHPENNETGGLRLKNSSTAAPPRGKRQPQPPLPPASTKSTQNFASGA

SEQ ID NO: 124177 - protein, 305 aa, Triticum aestivum
  unsure (1)..(305): unsure at all Xaa locations
  Clone ID: PAT_TA_18595.pep
MAASTMALSSPGLAAAKIISSNVFGEGRITMRKTAAKAKPAASSSPWYGPDRVLYLGPLSGDAPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEIVDPLYPGGSFDPLGVGXDDPEAFAELKVKEIKNGRLAMFSMFGFFVQAIVTGKGPLENLADHLADPVNNNAWAFATNFVPREVNMRRCLFPFGAWDVWNRHGLCETKQGLLRVFFSPVRLFVR

SEQ ID NO: 124178 - protein, 126 aa, Triticum aestivum
  Clone ID: PAT_TA_18596.pep
QNFNMSSKEVENHNPSSGRDNSGRLGACCRQPTASPVVLFGESGHWAGCRWTYSAFPMVPSILKSQVHSPPSLFLPPLVPSLSVPHLSLSCRDRAMALDRIEHPSRCLLPAGRCHCRRCPPSPSCR

SEQ ID NO: 124179 - protein, 189 aa, Triticum aestivum
  Clone ID: PAT_TA_18597.pep
GFLVGAMLPYWFSAMTMKSVGSAALKMVEEVRRQFNTIPGLMEGTAKPDYATCVKISTDASIKEMIPPGALVMLTPLIVGTFFGVETLSGVLAGALVSGVQIAISASNTGGAWDNAKKYIEAGASEHAKSLGPKGSDCHKAAVIGDTIGDPLKDTSGPSLNILIKLMAVESLVFAPFFATYGGILFKYL

SEQ ID NO: 124180 - protein, 153 aa, Triticum aestivum
  unsure (1)..(153): unsure at all Xaa locations
  Clone ID: PAT_TA_18598.pep
MASKRILKELKDLQKDPPTSCSAGPAGEDMFHWQATIMGXPPDSPYAGGVFLXVNIHFPPDYPFKPPKVSXFKTKVFHPNINSNGSICLXYSLKEQWSPALTISKVLLSICSLXLTDPNPDDPLVPEIAHMYKTDRPKYESTARSWTQKYAMG

SEQ ID NO: 124181 - protein, 140 aa, Triticum aestivum
  Clone ID: PAT_TA_18599.pep
VRPRVRPRVRPRVRPRVRRTQNAQASSARTEPATTTTMAVTTAQLPQPRALAALLVLVLLITLGGAAEAQPPLGTCGAQLSQLAPCARYSVPPLPGQALPTPGPECCSALGSVSRDCACGAIDIINSLPAKCGLPRVSCQ

SEQ ID NO: 124182 - protein, 148 aa, Triticum aestivum
  Clone ID: PAT_TA_18600.pep
MASKRILKELKDLQKDPPTSCSAGPAGEDMFHWQATIMGPPDSPYAGGVFLVNIHFPPDYPFKPPKVSFKTKVFHPNINSNGSICLDILKEQWSPALTISKVLLSICSLLTDPNPDDPLVPEIAHMYKTDRSKYETTARSWTQKYAMG

SEQ ID NO: 124183 - protein, 245 aa, Triticum aestivum
  Clone ID: PAT_TA_18601.pep
FVSFRNQQEAETAITEMTGKWLGSRQIRCNWATKTNAEEKQETDNHNAVVLTNGGSSNAAMEANQDTGSKENPENNPDFTTVYVGNLGHEVNRDELHRHFYNLGVGAIEEVRVQQEKGFGFIRYSTHGEAALAIQMANGLVVRGKPIKCSWGNKPTPPGTSSKPLPPPIASYQPIAMAGVPQGFTAAELLAYQRQLALSQAAAGQIAGQHGLAGQVSAGLLAAGSQALYDGYPSQTSAQQLMYYN

SEQ ID NO: 124184 - protein, 266 aa, Triticum aestivum
  Clone ID: PAT_TA_18602.pep
MAATTMSLSSWSFAGKAVKNLPSSAFIGEARVNMRKTAAKAKQVSSRSPWYGSDRVLYLGPLSGEPPNYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRIAGGPLGEIVDPLYPGGSFDPLGLADDPEAFAELKVKEIKNGRLAMFSMFGFFVQAIVTGKGPLENLADHIADPVNNNAWAFATNFVPGK

SEQ ID NO: 124185 - protein, 171 aa, Triticum aestivum
  unsure (1)..(171): unsure at all Xaa locations
  Clone ID: PAT_TA_18603.pep
SATLGLRHGPDSYGRQQWGIFRNGRKPDGAVDLGVAVQRACESQAEPLKFLYPLDSSIKEKIESIAKFYGASGVEYSEQAEKQIEMYTKQGFSNLPICMGKTQYSFSHVPSMKGAPSDFVLPIRDVRASIGAGFIYPLVGTMSTMPGLPTRXPCFYEIDIDTXTGKVMGLS

SEQ ID NO: 124186 - protein, 213 aa, Triticum aestivum
  Clone ID: PAT_TA_18604.pep
GSALSQASTKFTEEFDFMAMNEKFNKDEVWGHLGRKSQSRDKDGEQGDDVFDEDLEYEETDNPELDVKPVYVKDDFFDSLSGGTFGRGGQNGRPRFSELRKMDTETFGDFPRHRQPYRGGGRGGYRGGGGRSRGSYYGGGGRGDYGNMGRGGGQENYYGGGRGGYGNMGRGGGGGGQDNYYGGGGSGRGGYGRGGGQEDSYPQRGGGGSHGRG

SEQ ID NO: 124187 - protein, 148 aa, Triticum aestivum; identical to SEQ ID NO: 124182
  Clone ID: PAT_TA_18605.pep

SEQ ID NO: 124188 - protein, 392 aa, Triticum aestivum
  unsure (1)..(392): unsure at all Xaa locations
  Clone ID: PAT_TA_18606.pep
AFGSWLGLPYTFTIFNFGAQKTVHSWQLFLCVAVGLWAGLVIGFITEYYTSNAYSPVQDVADSCRTVFVTNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAGITTVDVLTPNVFIGLLVGAMLPYWFSAMTMKSVGSAALKMVEEVRRQFNTIPGLMEGTAKPDYATCVKISTDASIKEMIPPGALVMLTXPLIVGTFFGVETLSXGVLAGALVSGVQIAISASNTGGAWDNAKKYIEAGASEHAKSLGPKGSDCHKAAVIGDTIGDPLKDTSGPSLNILIKLMAVESLVFAPFFATYGGILFKYL

SEQ ID NO: 124189 - protein, 158 aa, Triticum aestivum
  unsure (1)..(158): unsure at all Xaa locations
  Clone ID: PAT_TA_18607.pep
MNGAGASQQQQQQQQRLRQQQQQQQQALLMQQALQQQQYQSGVLAAAAAAAMTQMEPVSNGNLPPGFDPSTCRSVYVGNVHPNVTESLLIEVFQGSGPVERCKLIRKEKSSFGFVDYYDRRSAALAIMTLXGRHIYGQAIKVNWAYASTQRXEDTSGH

SEQ ID NO: 124190 - protein, 211 aa, Triticum aestivum
  unsure (1)..(211): unsure at all Xaa locations
  Clone ID: PAT_TA_18608.pep
MSLLLKLGCVNLAKHISNTKGYGSXNVVVAINKFATDTDAEMEVVKKAAMTAGAFDAVVCSHHAHGGKGAVDLGVAVQRACESQAEPLKFLYPLDSSIKEKIESIAKFYGASGVEYSEQAEKQIEMYTKQGFSNLPICMAKTQYSFSHVPSMKGAPSDFVLPIRDVRASIGAGFIYPXLVGTMSTMPGLPTRPCFYEIDIDTTTGKVMGLS

SEQ ID NO: 124191 - protein, 356 aa, Triticum aestivum
  unsure (1)..(356): unsure at all Xaa locations
  Clone ID: PAT_TA_18609.pep
MTETSATASHSLNSLVRSKTPAVNPGSTLSHQTASQAISSTIASSCLAGLEVPPPLLASSGQLLQNAPSMISSSQSMQTPLQMSNNIAKPADPKTKVAEPLLPDPPARAQPENNEPILPLPKQTPQRHNGAGSQGHHNYRGRGRGRGSALSQASTKFTEEFDFMAMNEKFNKDEVWGHLGRKSQSRDKDGEQGDDVFDEDLEYEETDNPELDVKPVYVKDDFFDSLSGGTFGRGGQNGRPRFSELRKMDTETFGDFARXHRQPYRGGGRGGYRGGGGRSRGSYYGGRGDYGNMGRGGGQENYYGGGRGGHGNMGRGGGGGQDNYYGGGSGRGGYVRGGGQEDSYPQRGGGGSYGRG

SEQ ID NO: 124192 - protein, 269 aa, Triticum aestivum
  unsure (1)..(269): unsure at all Xaa locations
  Clone ID: PAT_TA_18610.pep
MATTTMSLSSAFAGKSVKNVASSALLGEARVTMRKTAAKAKQVSSGSPWYGADRVLYLGPLSGEPPSYLTGEFPGDYGWDTAGLSADPETFAKKPGKLEVIQLPGGAMLGAARDAVFPELLARNGVKFGEAVWFKAGSQIFSEGGLDYLGNPSLVHAQSILAIWACQVVLMGAVEGYXRVAGGPLGEIVDPLYPGGSFDPLGLADDPEAFAELKVKEVKNGRLAMFSMFGFFVQAIVTGKGPLENLADHLSDPVNNNAWAFATNFVPGK

SEQ ID NO: 124193 - protein, 363 aa, Triticum aestivum
  Clone ID: PAT_TA_18611.pep
MLRCHIPPQCGPAPLGRRGLPRAATAPAAVRCAARAPSRGTVAAAAAAAQVAAAVATAEGHEGVERPGLAERLRMGSLLEDGLSYKESFIVRCYEVGINKTATVETIANLLQEVGCNHAQSVGFSTDGFATTTTMRELGLIWVTNRMHIEIYKYPAWGDVVEIETWCQADGKIGTRRDWILKDLANGEVIGRATSKWVMMNQNTRRLQRVSDEVRDEVFIHCPKSPRLAFPEENNGSLKKIPVLTDPAQHSRLGLVPRRADLDMNQHVNNVTYIGWVLESIPQDIIDTHELQTITLDYRRECQHDDIVDSLTYIEEGEEINSNGSLFSAPHPEEQRQFLHCLRFAGAGDEINRGRTVWRKLAR

SEQ ID NO: 124194 - protein, 154 aa, Triticum aestivum
  Clone ID: PAT_TA_18612.pep
KAMSAYGFEIVQTLIVDIEPDAHVKQAMNEINAAARMRVAANEKAEAEKIVQIKRAEGEAEAKYLSGLGIARQRQAIVDGLRDSVLGFSVNVPGTTAKDVMDMVLITQYFDTMKEVGASSKSSAVFIPHGPGAVRDIATQIRDGLLQGQSASDN

SEQ ID NO: 124195 - protein, 379 aa, Triticum aestivum
  unsure (1)..(379): unsure at all Xaa locations
  Clone ID: PAT_TA_18613.pep
TGFDISVASEIMAVLALTTSLADMRERLGRMVIGNSKAGEPVTADDLGLGGALTVLMKDAIHPTLMQTLEGTPVLVHAGPFANIAHGNSSIVADKIALKLVGKGGFVVTEAGFGADIGTEKFMDIKCRYSGLTPQCAIIVATIRALKMHGGGPDVVAGKPLDHAYVSENVTLVEAGCVNLAKHISNTKGYGVNVVVAINKFATDTDAEMEVVKKAAMAAGAFDAVVCSHHAHGGKGAVDLGVAVQRACESQAEPLKFLYPLDSSIKEKIESIAKFYGASGVEYSEQAEKQIEMYTKQGFSNLPICMAKTQYSFSHVPSMKGAPSGFVLPIRDVRASIXGAGFIYPLVGTMSTMPGXLPTRPCFYEIDIDTATGKVMGLS

SEQ ID NO: 124196 - protein, 287 aa, Triticum aestivum
  Clone ID: PAT_TA_18614.pep
MGNLCCCVQVDQSTVAIREQFGKFDSVLEPGCHFLPWIFGKRVVGHLTLRLQQLDVRCETKTKDNVFVTVVASIQYRPLAGKESDAYYKLTNTRSQIQAYVFDVIRASVPKLNLDDAFVQKNDIAQAVEDELEKAMSAYGFEIVQTLIVDIEPDAHVKQAMNEINAAARMRVAANEKAEAEKIVQIKRAEGEAEAKYLSGLGIARQRQAIVDGLRDSVLGFSVNVPGTTAKDVMDMVLITQYFDTMKEVGASSKSSAVFIPHGPGAVRDIATQIRDGLLQGQSASDN

SEQ ID NO: 124197 - protein, 104 aa, Triticum aestivum
  Clone ID: PAT_TA_18615.pep
MMEVTTAQLPQPRALAALLVLVLLITLGGAAEAQPPLGTCGAQLSQLAPCARYSVPPLPGQALPAPGPECCSALGSVSRDCACGAIDIINSLPAKCGLPRVSCR

SEQ ID NO: 124198 - protein, 563 aa, Triticum aestivum
  unsure (1)..(563): unsure at all Xaa locations
  Clone ID: PAT_TA_18616.pep
MVGRSSLPDGALFLGLDSSTQSVKATVLSNELIIVASETVNFDSELPHYKTEGGVYRDPTDDGRIYSPTIMWVEALELLLEKLKPKINFSKVVAVSGSGQQHGSVYWKKGSQAVLSSLDPGKSLVSQLKDAFSTMDSPIWMDSSTTKQCREVENAVGGALELSKLTGSRAYERFTGPQIRKIYQTAPHIYENTERISLVSSFMASILAGCYASIDETDGAGMNLMDINKRTWSKAVLEATAPDLEQKLGNLAPAYAAAGRISSYFVERHQFDKNCLVIQWSGDNPNSLAGLTLNTPGDLAISLGTSDTVFGITAEAKPSLEGHVFPNPVEPDGYMVMLCYKNGSLTREDVRNQCAEKSWDVFNNYIEKTPPLNDWKLGXFYYKDHEILPPLPVGFHRYIVKNFNDASSDNLTEHEVQEFDPRSEVRAIVEGQMLSMRGHAERFGMPNPPKRIIATGGASSNESILKLIAQIFGCPVFTVERPDSASLGXAALRAAHGWLCKEEGGFVPISRMYTGNLEKTSLGAKLAVPAPGEEGRELLKKYTLLMKKRMEIERRLVEKIGRA

SEQ ID NO: 124199 - protein, 266 aa, Triticum aestivum
  Clone ID: PAT_TA_18617.pep
MAATTMSLSSSSFAGKAVKNLPSSALIGDARVNMRKTAAKAKQVSSSSPWYGSDRVLYLGPLSGEPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRIAGGPLGEIVDPLYPGGSFDPLGLADDPEAFAELKVKEIKNGRLAMFSMFGFFVQAIVTGKGPLENLADHIADPVNNNAWAFATNFVPGK

SEQ ID NO: 124200 - protein, 441 aa, Triticum aestivum
  Clone ID: PAT_TA_18618.pep
MDAKDILGLQKTSFPSAQEKKSRPPKEPQRKPDGVSREVYALTGGVGMAPLMPTIEASHLKRRPAVEKEKVAWQWLPFTSSARTDNLQLYHWVRVVNNVPPTGDYDFAKYNTKVDVLKYTDEEYEKYLTEPTWSREETDQLFELCQRFDLRFIVIADRFPTARSVEDLKSRYYSVTRALLIARARSFDEVAGNPLVKETFNAAHETERKRALSALFSQTKQQERKDAEVLAEAKRIMESRAANKNVEEAGAPTSLPNAAVPADGVSPLSNNLPSSAATHPAAAANTSIPDTLRMLKVYLRTHALDQMVQAVTASAGIRMIKRVDQTLQDLGVNLKPKVPTKAVCAEHLELRNEILTLLNIQKQLQNKEAEVLANRESSFTEAPTTPKRSNRDIDRPFVPDMAGFGGERAVKRDHKRKTTGRFDGPPSPTQGKRPRKMKASD

SEQ ID NO: 124201 - protein, 272 aa, Triticum aestivum
  unsure (1)..(272): unsure at all Xaa locations
  Clone ID: PAT_TA_18619.pep
MALSTMALSSPALAAKQAKIASFNVFGEGRITMRKTAAKAKPAASSSPWYGPDRVLYLGPLSGDAPSYLTGEFPGDYGWDTAGLSADPETFAKNRELEVIHCRWXAMLGAXLGCVFPELLARNGVKFGEAVWFKAGSQIFSEGGLDYLGNPSLVHAQSILAIWACQVVLMGAVXEGYRVAGGPLGEIVDPLYPGRVASTPSGLAXDDPEAFAELKMKEIKNGRLAMFSMFGFFVQAIVTGKGPXLENLADHLTDPVNNNAWXAFATNFVPGK

SEQ ID NO: 124202 - protein, 166 aa, Triticum aestivum
  Clone ID: PAT_TA_18620.pep
IHCRWAMLGALGCVFPELLARNGVKFGEAVWFKAGSQIFSEGGLDYLGNPSLVHAQSILAIWACQVVLMGAVEGYRVAGGPLGEIVDPLYPGGSFDPLGLADDPEAFAELKVKEIKNGRLAMFSMFGFFVQAIVTGKGPLENLADHLADPVNNNAWAFATNFVPGK

SEQ ID NO: 124203 - protein, 533 aa, Triticum aestivum
  Clone ID: PAT_TA_18621.pep
PVRNSRVDPRVRAKAPATAKKIEESSESSDSESSDSEKPATEVKNSAVATAQKKNQDGSDSDSDESSDEDMVTKKPVAKKVVESSESSDSDSEEEDTTAKPVQSSKAVAVKKGKESSDSSDSDSDSDSEEDTTAKTVSVKKEESSGSSDSDSDSDSDEPAKSTIPAKRPLTTEKKSEHSKDDSDDSSDESDEEEPPQKKPKDSSSGAAKPVSKAAKKESSDDDDSSEESSDSDEEKSKSVSVAKPKQNEPKTPASSGQATTGSKTLFVGNLSYNVETEQVKQFFGEAGEVMDIRFATADDGSFKGFAHVEFATTEAAQKAYELNGGDLAGRPVRLDFARERGAITPGSGRDNSSFKKPGQSNTAFVRGFDSSLGEEEIRSSLQDHFSSCGDIRRVSIPKDYDTGASKGIAYIEFDDISSLPKALELNGSNIGEGLSLFVDEAKPRADNRDGADSGNRSAGRFNGGGGRRGRFDGGGGRRGGRFDGGAGRRGGGRFGRGDRGGRSDRGRGRGGAPPRQSAGTPSAGKKITFGDD

SEQ ID NO: 124204 - protein, 557 aa, Triticum aestivum
  unsure (1)..(557): unsure at all Xaa locations
  Clone ID: PAT_TA_18622.pep
MSSLRPLNTEPSFLHSQKLQSPRDACGAPLRSPSPRVVAGPPKKRMARAGGLFERSLSFKNWEAEVGADEPEAASRCINGARPGTLVLQSPGSKQQQSPRPSPSKAHFVSPRPQAELDDAATKVQKLFKGHRTRRNLADCAIVVEELWWKAYDSASLNIKSISFFDEAKQETAASRWSRAGKRIAKVGKGLSKDEKAQKLALQHWLEAIDPRHRYGHNLHLYYDIWSASSSTEPFFYWLDIGAGKDVHHQKCPRSKLYSQLIMYLGPNERARYEVIVDQGKLMYRRSGLLVETTEDSKWIFVLSTTRSLYIGQKKKGKFQHSSFLAGAATTAAGRLVAKDGILKAIWPYSGHYLPTEXENFREFISFLEENNVDLANVKRCSVDDDEYPSFKKTSDEPTEMEEHDEKPTEAQHDGTLNSSQIELPEMDIIKEMVAEDNAETEAAATKMASLPSFKWATAAGARIGCVRDYPADLQSMALEHVNLSPRVVPSPSANRLPIPSPRPSPKIRLSPRLHYMGLPTPTGRRLPIPSPEIRRQQFMGFQTPEVSLTLPKHKAK

SEQ ID NO: 124205 - protein, 447 aa, Triticum aestivum
  Clone ID: PAT_TA_18623.pep
MNGAGASQQQQQQQQRLRQQQQQQQQALLMQQALQQQQYQSGVLAAAAAAAMTQMEPVSNGNLPPGFDPSTCRSVYVGNVHPNVTESLLIEVFQGSGPVERCKLIRKEKSSFGFVDYYDRRSAALAIMTLHGRHIYGQAIKVNWAYASTQREDTSGHFHIFVGDLSSEVNDATLYACFSAYPSCSDARVMWDNKTGRSRGYGFVSFRNQQEAETAITEMTGKWLGSRQIRCNWATKTNAEEKQETDNHNAVVLTNGGSSNAAMEANQDTGSKENPENNPDFTTVYVGNLGHEVNRDELHRHFYNLGVGAIEEVRVQQEKGFGFIRYSTHGEAALAIQMANGLVVRGKPIKCSWGNKPTPPGTSSKPLPPPIASYQPVAMAGVPQGFTAAELLAYQRQLALSQAAAGQIAGQHGLAGQVSAGLLAAGSQALYDGYPNQTSAQQLMYYN

SEQ ID NO: 124206 - protein, 219 aa, Triticum aestivum
  Clone ID: PAT_TA_18624.pep
MAPRVPSSSLLLVGAALLLGLAAGAARASNEEGDALYALRMRLSDPNGVLQSWDPTLVNPCTWFHVTCDSASRVVRLDLGNSNVSGSIGPELSRLVNLQYLELYRNNLNGEIPKELGKLKNLISLDLYANKLTGRIPKSLSKLSSLRFMRLNNNKLAGSIPRELAKLSNLKVIDLSNNDLCGTIPVDGPFSSFPLRSFENNSRLNGPELQGLVSYDFGC

SEQ ID NO: 124207 - protein, 218 aa, Triticum aestivum
  Clone ID: PAT_TA_18625.pep
MAPRVPSSLLLVGAALLLGLAAGAARASNEEGDALYALRMRLSDPNGVLQSWDPTLVNPCTWFHVTCDTASRVVRLDLGNSNVSGSIGPELSRLVNLRYLELYRNNLNGEIPKELGKLKNLISLDLYANKLTGRIPKSLSKLSSLRFMRLNNNKLAGSIPRELAKLSNLKVIDLSNNDLCGTIPVDGPFSSFPLRSFENNSRLNGPELQGLVSYDFGC

SEQ ID NO: 124208 - protein, 219 aa, Triticum aestivum
  Clone ID: PAT_TA_18626.pep
MAPRVPSSSLLLVGAALLLGLAAGAARASNEEGDALYALRMRLSDPNGVLQSWDPTLVNPCTWFHVTCDTASRVVRLDLGNSNVSGSIGPELSRLVNLQYLELYRNNLNGEIPKELGKLKNLISLDLYANKLTGRIPKSLSKLGSLRFMRLNNNKLAGSIPRELAKLSNLKVIDLSNNDLCGTIPVDGPFSSFPLRSFENNSRLNGPELQGLVSYDFGC

SEQ ID NO: 124209 - protein, 148 aa, Triticum aestivum; identical to SEQ ID NO: 124182
  Clone ID: PAT_TA_18627.pep

SEQ ID NO: 124210 - protein, 344 aa, Triticum aestivum
  unsure (1)..(344): unsure at all Xaa locations
  Clone ID: PAT_TA_18628.pep
KKSCARARFRGTAVAGGTLMAMEGPILCRPIMQARLPAALVNNSLIKSGQLGTAFLGAVSKYRNITRLVSPISQSSSKNFGPICRSFSSSSDGNGYMAGNFNENDEDYVNSTVLEAVEVRSGSEGYIVKMRDGKNLRCVHNNSQGREIPESAPQPAIVLRIEDGSGTLLPIIVLEMPSVLLMAAIRHVHIARPTIYQVVKELIDKMGYEVKLVRVNKRIQEAYXAELYLTKIGDQTESITFDLRPSDAINIAVRCKVPIQVHRSLAYSDGIRSVEPAKLVAAGGLSDGLLFTELDRPDGEPCVEAQEFSLVRNMFIAVVEERYKDAATWKDKLMRLRSKRKNWA

SEQ ID NO: 124211 - protein, 148 aa, Triticum aestivum; identical to SEQ ID NO: 124182
  Clone ID: PAT_TA_18629.pep

SEQ ID NO: 124212 - protein, 267 aa, Triticum aestivum
  unsure (1)..(267): unsure at all Xaa locations
  Clone ID: PAT_TA_18630.pep
MAGATMALSSPAMAGTPVKASRAAPFGEGRITMRKTAGKPKVAASSSPWYGSDRVLYLGPLSGDPPSYLTGEFPXGDYGWDTAGLSADPETFAKNRELEVIHCRWAMLGXALGCVFPELLXRNGVKFGEAVWFKAGSQIFSEGGLDYLGNPSLVHAQSILAIWACQVVLMGAVEGYRVAGGPLGEIVDPLYPGGSFDPLGLAEDPEAFAELKVKEIKNGRLAMFSMFGFFVQAIVTGKGPLENLADHLADPVNNNAWAFATNFVPGK

SEQ ID NO: 124213 - protein, 197 aa, Triticum aestivum
  Clone ID: PAT_TA_18631.pep
MSASRFIKCVTVGDGAVGKTCMLISYTSNTFPTDYVPTVFDNFSANVVVDGNTVNLGLWDTAGQEDYNRLRPLSYRGADVFLLAFSLISKASYENVSKKWIPELKHYAPGVPIILVGTKLDLRDDKQFFVDHPGAVPITTAQGEELKKLIGAPYYIECSSKTQLNVKGVFDAAIKVVLAPPKAKKKKKAQRGACSIL

SEQ ID NO: 124214 - protein, 266 aa, Triticum aestivum
  Clone ID: PAT_TA_18632.pep
MATTAMALSPSSFAGKAVKDLPSSALFGEARVTMRKTAAKAKPVSSGSPWYGSDRVLYLGPLSGDPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEIVDPLYPGGSFDPLGLADDPEAFAELKVKEIKNGRLAMFSMFGFFVQAIVTGKGPLENLADHLADPVNNNAWAFATNFVPGK

SEQ ID NO: 124215 - protein, 196 aa, Triticum aestivum
  unsure (1)..(196): unsure at all Xaa locations
  Clone ID: PAT_TA_18633.pep
PGEFPGDYGWXTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEIVDPLYPGGSFDPLGLAEDPEAFAELKVKEIKNGRLAMFSMFGFFVQAIVTGKGPLENLADHLADPVNNNAWAFATNFVPGK

SEQ ID NO: 124216 - protein, 148 aa, Triticum aestivum; identical to SEQ ID NO: 124182
  Clone ID: PAT_TA_18634.pep

SEQ ID NO: 124217 - protein, 147 aa, Triticum aestivum
  Clone ID: PAT_TA_18635.pep
DRGVLQMMRWNQQHRRRTETPWQGGEPGQNRTNRLFPCDLHPANTTKYTFYCLVACQGERTRHGKGRPTLPMYWYIKLYNTHVLACASSAYQHNYLSVMFGDRPESSCEQKGTRTSFDRQTETIYWMARFLLAPCGDKKASRKHSSA

SEQ ID NO: 124218 - protein, 266 aa, Triticum aestivum
  Clone ID: PAT_TA_18636.pep
MATTAMALSPSSFAGKAVKDLPSSALFGEARVTMRKTAAKAKPVSSGSPWYGSDRVLYLGPLSGDPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEIVDPLYPGGSFDPLGLADDPEAFAELKVKEIKNGRLAMFSMFGFFVQAIVTGKGPLENLADHLSDPVNNNAWAFATNFVPGK

SEQ ID NO: 124219 - protein, 127 aa, Triticum aestivum
  Clone ID: PAT_TA_18637.pep
MAASMITSPIVAPTSLPSLSRRGSSFAVVCSGGKKIKVDKPLGLGGGLTVDIDANGRKVGKKGVYQFVDKYGANVDGYSPIYTPEEWSESGDRYAGGTTGLLIWAVTLAGLLGGGVLLVYNTSALAG

SEQ ID NO: 124220 - protein, 261 aa, Triticum aestivum
  Clone ID: PAT_TA_18638.pep
MAATTTMALSSPAIKLAGASYALGGGGRITMRKAAPKASASNSPWYGPDRVLYLGPLSGEPPSYLSGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEIVDPLYPGGSFDPLGLADDPEAFAELKVKEIKNGRLAMFSMFGYFVQAIVTGKGPLENLADHLADPVNNNAWAFATNFVPGK

SEQ ID NO: 124221 - protein, 127 aa, Triticum aestivum
  Clone ID: PAT_TA_18639.pep
MAASMITSPIVAPTSVPSLSRRGSSFAVVCSGGKKIKVDKPLGLGGGLTVDIDANGRKVGKKGVYQFVDKYGANVDGYSPIYTPEEWSESGDRYAGGTTGLLIWAVTLAGLLGGGVLLVYNTSALAG

SEQ ID NO: 124222 - protein, 265 aa, Triticum aestivum
  Clone ID: PAT_TA_18640.pep
MATTTMSLSSTFAGKSVKNVASSALFGEARVTMRKTAAKAKPVSSGSPWYGADRVLYLGPLSGEPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRIAGGPLGEVVDPLYPGGSFDPLGLADDPEAFAELKVKEVKNGRLAMFSMFGFFVQAIVTGKGPLENLADHLSDPVNNNAWAFATNFVPGK

SEQ ID NO: 124223 - protein, 287 aa, Triticum aestivum
  Clone ID: PAT_TA_18641.pep
MGNLCCCVQVDQSTVAIREQFGKFDSVLEPGCHCLPWIFGKRVVGHLTLRLQQLDVRCETKTKDNVFVTVVASIQYRPLAGKESDAYYKLTNTRSQIQAYVFDVIRASVPKLNLDDAFVQKNDIAKAVEDELEKAMSAYGFEIVQTLIVDIEPDAHVKQAMNEINAAARMRVAANEKAEAEKIVQIKRAEGEAEAKYLSGLGIARQRQAIVDGLRDSVLGFSVNVPGTTAKDVMDMVLITQYFDTMKEIGASSKSSAVFIPHGPGAVRDIATQIRDGLLQGQSASDN

SEQ ID NO: 124224 - protein, 772 aa, Triticum aestivum
  Clone ID: PAT_TA_18642.pep
MLCAAVRVSSAMAILGELGTEILIPVCGVVGIVFAIAQWFIVSKVKVTPGAAAAGGSKNGYGDYLIEEEEGLNDHNVVVKCAEIQTAISEGATSFLFTMYQYVGMFMVVFAAVIFVFLGSIEGFSTKGQPCTYSTGTCKPALYTALFSTASFLLGAITSLVSGFLGMKIATYANARTTLEARKGVGKAFITAFRSGAVMGFLLSSSGLVVLYITINVFKMYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHDFTAMCYPLLVSSVGIIVCLLTTLFATDFFEIKAASEIEPALKKQLIISTALMTIGVAVISWLALPAKFTIFNFGAQKDVSNWGLFFCVAVGLWAGLIIGFVTEYYTSNAYSPVQDVADSCRTGAATNVIFGLALGYKSVIIPIFAIAVSIYVSFSIAAMYGIAMAALGMLSTMATGLAIDAYGPISDNAGGIAEMAGMSHRIRERTDALDAAGNTTAAIGKGFAIGSAALVSLALFGAFVSRAGVKVVDVLSPKVFIGLIVGAMLPYWFSAMTMKSVGSAALKMVEEVRRQFNTIPGLMEGTAKPDYATCVKISTDASIKEMIPPGALVMLTPLIVGTLFGVETLSGVLAGALVSGVQIAISASNTGGAWDNAKKYIEAGNSEHARSLGPKGSDCHKAAVIGDTIGDPLKDTSGPSLNILIKLMAVESLVFAPFFATYGGVLFRYI

SEQ ID NO: 124225 - protein, 127 aa, Triticum aestivum; identical to SEQ ID NO: 124221
  Clone ID: PAT_TA_18643.pep

SEQ ID NO: 124226 - protein, 197 aa, Triticum aestivum
  Clone ID: PAT_TA_18644.pep
IEIYKYPAWGDVVEIETWCQEDGRIGTRRDWILKDLANGEVIGRATSKWVMMNQNTRRLQRVSDDVRDEVFIHCPKTPRLAFPEENNGSLKKIPNLSDPAQYSRLGLVPRRADLDMNQHVNNVTYIGWVLESIPQDIIDTHELQTITLDYRRECQHDDIVDSLTYIEEGEEKSMNGLCFCRQAPSQRRAGQPVPALL

SEQ ID NO: 124227 - protein, 326 aa, Triticum aestivum
  unsure (1)..(326): unsure at all Xaa locations
  Clone ID: PAT_TA_18645.pep
MENQVSNIQGPTTAPSFAYIWMAKWTTCVSAYRAMDTDLLRHPDLLSFSKRSTNITALXLGTDLYRTVIGDARANLGARDAAAGGMAAVQLTVDLRPDVPSEAERIKKCRGRVFALGDQLTTRRLSILVFFAPGLAMARAFGDFCLKDYGVISKPEFFHWPLTDKDQFVILASDGVWDVLSNQAAVDIVSSSPSRSKAARTLVEAANREWKTKYPTSRTDDCAVVCLYLDGKMDHERDSTASMDNISIEDDSVADPNEAQEQQEPALTRNFTVRTVPGSAQEKALAGADAKVSGGADDHNWSGLDGVTRVNSLVQLPRFSEEKAVS

SEQ ID NO: 124228 - protein, 248 aa, Triticum aestivum
  Clone ID: PAT_TA_18646.pep
MSFREESNRLGDLKDAERKALAELRAKVEEAIVEGKLFDDDSASVKVKAKAEPMKQQVEQRDPRPPSAASLLQVTDLRGSPGPARKDLRVAMKQVLDLFQDNYPELVARNILINVPFSYYAFTTVFFPFLTQRTKSKLVVARPSKVTETLLKYIPIEAIPVKYGGLKRDGDAEFTGEHDAEIAEVVVKAGATETIEIEAAEGDTTLTWDVTVLGWERGCTEGVVPAVGGADSCVACVSVRDSTFFCAR

SEQ ID NO: 124229 - protein, 316 aa, Triticum aestivum
  Clone ID: PAT_TA_18647.pep
MNDLMTKSFMSYVDLKKAAMKDLEAGGDETETELTQAGGGGATDERLKGFFREAEAVREEMAAIRDALARLHAANEEGKSLHQPDALRAMRVRVNADIVSVLGRARGIQRALADMDVANAAQRRLSAACQEGTTLDRTRTSVTAGLRKKLKDIMLDFQALRQRMMSEYKDTVERRYYTLTGEVPEDEVIERIISEGRGEEIMSAAVAEHGKGAVLAALNEIQDRHDAAREVERSLLELHQVFLDMAVVVQSQGDKLQNIEHHVSNARDYVHSGNKELGKAREHQRGSRKCLCIGIILLLLLILIVIVPIATSLRRS

SEQ ID NO: 124230 - protein, 241 aa, Triticum aestivum
  Clone ID: PAT_TA_18648.pep
SGSFPLKWHLVKDVPNSTFRHIILENNENKPVTNSRDTQEIPYKSGINMLKLFKSSPMTTSILDDFPFYEGRQKAMLEQKRRSLGRSFGRLTYVPALVAKRSVVVEGEPSEVGEGISSKDPHPGKTGQDSGACEQPDKTSQTKDGVVTQVLKKDAVSPVEQPEHVKTERHSLDDIHQQNEGCSVSVSPENAGREHAGLSELVKSNGKVYSDRESQPVISSTEPNSSGRKGLSQELGGHDPS

SEQ ID NO: 124231 - protein, 78 aa, Triticum aestivum
  Clone ID: PAT_TA_18649.pep
CTHRNSQACPATKQGQGADQDPALFDVVYHGQHTCRPTGGGGGRRPPTNQHNPDAESLLQSLRAGLTVDAEHGGLNGS

SEQ ID NO: 124232 - protein, 143 aa, Triticum aestivum
  Clone ID: PAT_TA_18650.pep
MASTEHGDKLRILIVPFFATSHIAPHTELAVRLAAARPGAVEPTVAVTPANVSVVRSALDRHGHSAASNAVRIATYPFPDVDGLTPGVENLSAAGADAWRIDAGPVDEELTQGAQRALIPWLLPDPRRKAGRRTMICTGLSVI

SEQ ID NO: 124233 - protein, 397 aa, Triticum aestivum
  Clone ID: PAT_TA_18651.pep
EFGTSIDELERLRAPLAVAVAEEVSVAPAPAPAPAPAPEPSGSDSSVQDLLALVYFGTLFDVKPQSDFIATMVAREHERSSCITYDCVGDDTVDLLVEGDLDVVSAVAALAAARPASAVGVSHRDALQACAHHARLWLARADEPIHPGSSVTYAAVRAKLDRIMASDYYTAAAVGGGSYGAEGVQAQESMTASPEASAVEENLAAEGHKEEKEDSHATEIYNDHQSDSADVQNVDREAPVNPPEEYPSVQAEQEKFDMEEQDERDAEPKEQQFQHPRRSHQNQRGGGRGRRGAYPNGRGGRGGGRGMGGGYQNGRGYQGGGGGYQGGGGGYQNGRGGGGGYYNNNNNEEGYYQPRNFNNNRGRGGRSGGGNSYYGNQGGGGAQGGGHAYAERVEANA

SEQ ID NO: 124234 - protein, 166 aa, Triticum aestivum
  Clone ID: PAT_TA_18652.pep
MAIRLLSRQNLRKLAASFTLLNPSQKILLSPPPPAHRSDAISPSKCLSPFYPFMYSRGVRWASYESVNLVLSDDGKPKFEIEEVEPSKKGRFLTKRRLKLQRKREKRKRKEANKNDPRRIRPKGKKIKQKFPTPEARLKYKIEKSKLKKAMLVEKLKRYEVAKAEG

SEQ ID NO: 124235 - protein, 196 aa, Triticum aestivum
  unsure (1)..(196): unsure at all Xaa locations
  Clone ID: PAT_TA_18653.pep
RPPTRPPNRGQIESIVPSPPPPTAMCPRRRPXQPPPLRPLPVSPPAPHRSAADHQXHGSNSPAGRPPSPSPSPLSSILRSRSPFAAFPAPPKXVYPSTHSPLAAPSTRPPPRPAAMGQAPAYAPAPPAPPGGGPPSSRLRRWSTSTSCSPIILCPCSPSFVLPRPPRPLLASGKNHQVNMMLVFKLRVIPFKIFND

SEQ ID NO: 124236 - protein, 85 aa, Triticum aestivum
  Clone ID: PAT_TA_18654.pep
MAAAKDVRSELEKEMMFGMAEKEMEYRVELFNRLTHVCFEKCIEKRHKEGELNMGENSCIDRCVSKYWQVTNIVGGMLGTQQTPM

SEQ ID NO: 124237 - protein, 244 aa, Triticum aestivum
  Clone ID: PAT_TA_18655.pep
MWAVTLLSLYVRVQVTILGRHLYLDFARGTDGAQLQAESDTFSGNGHKDFLGTADYLATYGITALIRQMQHAATEILKEKQLKDPMSMDQVLQTMLQISEQFMSLCEGNSWINFLVPENANRYAQLMAVSSSGFDDSSLLMDVGKLDQLMTETRIVLASDDFRNIMDMSLRKVADLVIEDLRAQVGAALPPSGLPLAKLLARVAQLSSMLLEEPSKNKHIQTIRSMPEVGLFYTFLYANMPPQT

SEQ ID NO: 124238 - protein, 353 aa, Triticum aestivum
  unsure (1)..(353): unsure at all Xaa locations
  Clone ID: PAT_TA_18656.pep
RPRTRGRTRGRTRGRTRGADGRLPYWLSNTSALLCLLQKNLRSNGFFGTPSRRSAGGLGGKLAQLAGRGDTAQVDARYPAILFKQQLTACVEKIFGQLRDNLKKEISPLLSLCIQAPKSTRPGKAPKAPGVSAQQPSNSHWDNIVSFLNLLMDTLRENHVPSFFIRKLITQLFSFVNIQPVARLRLPPGACSPAWGESGFPALSLLEKWITDVSEEFAGTSWHELNYIRQAVGFLVIHQKRKKTLEEISQDLCPSLSLRQIYRICSMYWDDKYNTQGISNEVVSAMREMVNKDTQNLASNSFLLDDDLSIPFSTEDLSIAIPAIDYADVELPESLHHYPSAQFLLXHHDPLPV

SEQ ID NO: 124239 - protein, 137 aa, Triticum aestivum
  Clone ID: PAT_TA_18657.pep
TTCCDRVSHGRKEGRFLLPLAPRPPPEASRRLSSRSRQCTALAAQDRCRVLLRFAHLMERHTDQIAALESWDGGKPLEQSAGGEVPMAARCMRYYAAAPGHLHGMLPPPGAPPCAPFFSRKDVPDGGPPHRRGHRAR

SEQ ID NO: 124240 - protein, 136 aa, Triticum aestivum
  Clone ID: PAT_TA_18658.pep
MLSPRVVRPQPHDGTASAGSSSSRRHMVDRVSEWELGLPSAAELTPVSQALIPPALAAAFGIGPADALSSPVDTGFLHDSPTSHLTSRFDEYDEEDEEEGEGETDDAAARARRGGGGGKKARIVWTPELHHRFVEA

SEQ ID NO: 124241 - protein, 352 aa, Triticum aestivum
  unsure (1)..(352): unsure at all Xaa locations
  Clone ID: PAT_TA_18659.pep
QNIFGENLVEKDEFLEAFSKECQCISDVVKNGNSIKHDASDEDDLSVQIVRVELQGAAAYLYSRLVSLVLLLVEGSTPIDITEHGWQMLLVVKKAELESSASKFQLLGFAAVHHFYHYPESTRLRISQILVXLPPYQGEGHGRRPPEAINSIAESENMYDVTIEDPSDYLQYVRSSIDCLRLLTFEPIKPALGAMVLSLEQTNLSKRTRSSIMVPPSDLAETVRQKLKINKKQFLRCWEILIYLHLDAENLKCIDNFRACIYDRTKGELLGGASGTNGKRLVQVPTSFDEDTSFAVFWTKEGGDEDNQTVQLQPEDLATQEEQLNELVDNQMEEIAEVAKNVASRGKDKLAA

SEQ ID NO: 124242 - protein, 267 aa, Triticum aestivum
  unsure (1)..(267): unsure at all Xaa locations
  Clone ID: PAT_TA_18660.pep
MSLALLGGYSSAEDDDPAAGAGVELSDSGDSSAEEAGSDGDEKSAPSKPAAKPRPRVNPSPGDGDSSLPSALDVFAEISGPPAFLNRRVAQPEEVGEALGVLDRRSNSKRRKPPPXGAVVAAKPQLVAIRERVSSDVKNGANPPVAVVSAKPQLVAGHERVSSDMKNGASPPGSVEGKRKIGAANPGPEDAAELLRMCLQCGIPKTYSHAQGMVCPVCNDRPVQAKEPEKKKGSAVKDKEKVKRMRGQSSHASWKSETEMALRQQFD

SEQ ID NO: 124243 - protein, 279 aa, Triticum aestivum
  Clone ID: PAT_TA_18661.pep
MAGRNGFEDDDVNPFAGGSVPPASNSRLSPLSHEPAGFYNVDIPMDSTKDVKKKEKELQAMEAELNKREKELKRKEEAASRAGIVIEDKNWPPFFPLIHHNISNEIPIHLQKMQYLAFSSFLGIALCLFFNIIATTTAWIKGEGVMVWLLAIIYFISGVPGAYVLWYRPLYNAMRTESALKFGWFFLFYMIHIIFCVWSAVSPPFPFKGNSLTGILPAIDVITKSLIVGIFYFVGFGLFCLESLLSIGVIQQVYMYFRGSGKSQELKQQAARGALSSAF

SEQ ID NO: 124244 - protein, 211 aa, Triticum aestivum
  Clone ID: PAT_TA_18662.pep
KPSLSIMGPEIDLQEPRFGVVNRPNRITCDFMHNETNINANMSGCDGLYAEFDRFDDDCLLNEVTKTMGDISCPEMPHFSDGFYHEGCSTPIILKRCSTRKQLGTAAGYVDGLETNAIAQMNFPDIHAAWESDAMDMSSIKDNHLHLSHPFLLPDTPSSQSHARTGLELQGRSSKSFASWNCENMDSDFRSTYYRDNSNSSKAVGEICTIR

SEQ ID NO: 124245 - protein, 345 aa, Triticum aestivum
  Clone ID: PAT_TA_18663.pep
MSPQSFTLETTTTTPAAKGSDPSYFQSAPACHEMIQHKELLLHLYAYQNVQKTPDANQAVIVESKRPECFGILAANDWTVYDGPAHNANLVAHAQGLHLGASMAKENWFICFNMVFVNQRFTGSSFKVMGDFQGTAHNGEWAIVGGTGEFAYAQGVIAFKKTQQSERNARMELHVRAMCLSFLRPLLSLGDGSAVAKIGPWGKMSGELLDIPSTPQRLERITIRHGVVIDSLAFSFIDKAGEPYNVGPWGGRRGDNKDTIELAPSEIVTEVSGTVGIFAEDNVEYNAIASLTITTNHRPYGPFGETQSTPFSVPVQDNNNIVGFFACAGKYVEALGVYVRSPVST

SEQ ID NO: 124246 - protein, 80 aa, Triticum aestivum
  Clone ID: PAT_TA_18664.pep
MAEQFAESANNVIIEEVNKGLNPGMIVLLVVATTLLLFFVGNYALYLYAQKTLPPKKKKPVSKKKLKREKLKQGVSAPGE

SEQ ID NO: 124247 - protein, 80 aa, Triticum aestivum; identical to SEQ ID NO: 124246
  Clone ID: PAT_TA_18665.pep

SEQ ID NO: 124248 - protein, 177 aa, Triticum aestivum
  Clone ID: PAT_TA_18666.pep
PAGPGKIIIDLCGGCCDESQGRYLSKVALEKGPPSLIIHPKLILISEQAERKSRGPRGPSCSQRRRGGCGAWSRSRGRHGGAVRGVSEQCNHRRGEQGPEPWNDSPACGCDHPAAFLCWELCAVPVCAEDAPSEEEEASLEEEAQEGKAEARGFCTRGVKRSIDFSCRLLYAGLLFT

SEQ ID NO: 124249 - protein, 117 aa, Triticum aestivum
  unsure (1)..(117): unsure at all Xaa locations
  Clone ID: PAT_TA_18667.pep
SAHEANKGLXNLGMVVLLVASTTLLLFFVGNYALYLYAHKTXEAKKKRPVSKEEXLKREKLKYRVSAPGEVKMIHSDFPLCLIGLCWAPFLPLNKKYLPSWELRCCSKLISVWKTLS

SEQ ID NO: 124250 - protein, 210 aa, Triticum aestivum
  unsure (1)..(210): unsure at all Xaa locations
  Clone ID: PAT_TA_18668.pep
RFWKFLMXPXPHFILGVLIXPCYVLVIXSIILNKVVAXQEMFEKTYGFILXVKDLSPNIGVLWYFFAEVLDFFRSFFLXVFNMNIIFMVLPLAIRLKHRPFFLAFVYTAIVAMLKSYPSAGDSALYLGLLGLFANELAEMQFTFFLFFGYIGVSLLSPVMHNLWIWRGTGNANFYFATGLAYTCLQTVLVVETVSSMIKHDRKLRLLTKA

SEQ ID NO: 124251 - protein, 39 aa, Triticum aestivum
  Clone ID: PAT_TA_18669.pep
TGNTIISEFPSMLARVNVLSMQSFLLDGLDNGYGEITHL

SEQ ID NO: 124252 - protein, 153 aa, Triticum aestivum
  Clone ID: PAT_TA_18670.pep
RERRVSFEPLLAADRPSSVMCSGPRKPSTPPPAAAAPKDPAAVASLLLELAAADDVVEFRRVVEEEKACLDAAGSWYGPSAVGQGRLAAESRTPAMVAALYGSTAVLAHALSVAPGEACRASGTDGATALHMAGAGGAANAVGATHPVARRGG

SEQ ID NO: 124253 - protein, 157 aa, Triticum aestivum
  Clone ID: PAT_TA_18671.pep
RERRVSFESLLAADRPSSVMCSGPRKPSTPPPVAAAPKDPAAVASLLLELAAADDVVEFRRVVEEEKACLDAAGSWYGPSAVGLGRLAAESRTPAMVAALYGSTAVLAHALSVAPGEACRASGTDGATALHMAAPGGAANAVAARACRSPLQPPALR

SEQ ID NO: 124254 - protein, 445 aa, Triticum aestivum
  unsure (1)..(445): unsure at all Xaa locations
  Clone ID: PAT_TA_18672.pep
RPHAVVYRALFLPRNQTVAVKCLDLDQLNNNIDEVQREAQIMSLIDHPNVIRAYCSFVVEHSLWVIMPFMTEGSCLHLMKIAYPESFEEPVIASILKETLKALEYLHRQGQIHRDIKAGNILIDSAGVVKLGDFGVSACMFDRGDRQRSRNTFVGTPCWMAPEXVLQPGTGYNFKADIWSFGITALELAHGHAPFSKYPPMKVLLMTLQNAPPGLDYDRDRRFSKAFKEMVAMCLVKDQTKRPTAEKLLKHSFFKTAKPPESTMKGMLTDLPPLWERVKALQLKDAAQLALKKMPSSEQEALSLSEYQRGVSAWHFDIEDLKAQASLIYEDEPSETKEDDVAARIIESEKSLYSRTPSGQSSSANENTCSEETSTTNPDCRRMPNGHENSRSENDSLPSTSKEPESKYWRTNVGQKNRHWGSSESGVNSSTTERSHNFERDATAD

SEQ ID NO: 124255 - protein, 310 aa, Triticum aestivum
  unsure (1)..(310): unsure at all Xaa locations
  Clone ID: PAT_TA_18673.pep
MASGRFMEEMMREHEQSLLEATCGGLFDHIEDLLDFPKEDSAEDVLLLDAPVPDSPLAARVLAGGAPPPAPASLEQQQQQASLMVPPPPLPAGDHSAAFLGALGDTHIGTCDELDMDMAQLEWLSGLFDDTSIPHEPAFACAAPIIRASALSANAGVVLPDKMEDALFRSSSPTSVLEDGGANNANMNMNNNSGGSSASSTSSSASSSSESFSGSGRPWSVPLSPRPEPPVLVIPARARSKRSRASAFPAAIRAAVPAPEATILVPTPMFSSTSSYSEEPECIAESNSQPKKXXKAKRPTPAVTXDAEGD

SEQ ID NO: 124256 - protein, 324 aa, Triticum aestivum
  unsure (1)..(324): unsure at all Xaa locations
  Clone ID: PAT_TA_18674.pep
FGTRQHLEERXGIQSAGALLMAGKEEVEAARRWMMSPCTAAKSTDGAAAGDDGPVMRFPSKRKAASGSIYKVGEPLPANGWIHPAGEGDLSALHRREAAIDKMLQESKLPATVKQGTDANAAVKQSADTSAVVKQGVYSSAAAACGSKGKKYRLKKSELRTIIALRPEPYPPADDYLELAPFFPPGWLEQKKREEEEDAVQFARMEAEFEAFRQQVIEGVKKNGYFEVDEDPSDGREREEANEYARQEMAEIDFSELRLLDARPNLPQAKFFPYVPNEDDALLDDIPSDDDDFEEEDALPIQGEDFEGEAAAAAHKLVPPIQSS

SEQ ID NO: 124257 - protein, 627 aa, Triticum aestivum
  unsure (1)..(627): unsure at all Xaa locations
  Clone ID: PAT_TA_18675.pep
MGYSAPPRRNVLSAINNGGGANAEPAPSEAGSEAPAFEFSGREDVDRLLNEKMKVKSKNDYKGRTEQMGEYIKRLRACIRWLVELEDGYLAEQEKLRGQIDSDNARHAEFEAQLSGALEELKAANLEMTTRCDSLEESLNKEKAARLLAVESYEKEREERESAEASRDVLTVDLERVTHEAKRFSEQLKMVQDTNKRLQEYNSSLQQYNSNLQADTSKNGEIISKLQREKSAMMEAMTNLKDLNNSMKNQLDSSMSSQKEAIRVKEELRKEVECLRADLQQVREDRDQSVAQLNTLTAELATYSEQARKSSKDSELLRIKAAAFEETCKFTARANXKHCRSSFAVATEKLKHADVTAIEXMTGYESQKETIKDLEERLAYAEFQIIEADKLRKKLHNTILELKGNIRVFCRVRPFLSDSDSNGQEEAIISYPSSVENAGRGIDLLNQGQKCSFSYDKVFDHSASQDDVFVEMSQLVQSALDGYKVCIFAYGQTGSGKTYTMMGKPGRDQKGIIPRSLEQIFKTSQSLESQGWKYCMQASMLEIYNETIRDLLAPGRSSSDMPGGKQYTIKHDSQGNTTVSDLTTTNVFSTAGCDXLFLEKHPYKSVGKTQMNEHLPRXFCLHTXXLG

SEQ ID NO: 124258 - protein, 141 aa, Triticum aestivum
  unsure (1)..(141): unsure at all Xaa locations
  Clone ID: PAT_TA_18676.pep
MRHLLLPRRLLAMAPLSASAATKALLLNPARGRLPSSLACLSAHGARSFRAASLRCYAAAAVAEQHRIKVNNPIVEMDGDEMTRVMWKMIKDKLIFPYLDLDVKYFDLGVLNRDATDDKSLSRVPRYLKYNVXVKCATITL

SEQ ID NO: 124259 - protein, 407 aa, Triticum aestivum
  unsure (1)..(407): unsure at all Xaa locations
  Clone ID: PAT_TA_18677.pep
RPVLSSKTLADVVEALIGVYYVAGGKIAANHLMKWIGIHAELDPQEIPPPKPYNIPESILKGIEFETLESILGMKFQNKGFLIEAITHASRPSSGVSCYQRLEFVGDAVLDHLITKHLFFTYTDLPPGRLTDLRAAAVNNENFARVAVRRKLHGHLRHGSSALEKQIREFVKDVREEISKSGFNSFGLGDCKAPKVLGDIIESIAGAVFLDSGYDTSAVWKVFQPLLEPLVTPETLPMHPIRELQERCQQQAEGLEYKASRAGNVATVEVFVDGVQIGVAQNPQKKMAQKLAARNALVVLKEKETAAKKETEKDGDKNNAGFTRQTLNDTCLRRQWPMPQYRCINEGGPAHAKRFVYAVRVNTSDRGWTDECXGEPMPSVKKAKDSAAMLLLELLNRSFPEKPDGKK

SEQ ID NO: 124260 - protein, 267 aa, Triticum aestivum
  Clone ID: PAT_TA_18678.pep
GQQFDIRGTVDEFRHEINMYMFWKPGMELAVSHVRRKEIPAYVFPEGYKRPRPQRHVNHQHQSDKNNTANGTLTGSPDSQLKRKHDTTGIDDTEPCRSVKRASISPVHPKTLSPRSGNISDEPRSDSQQKVTSNASGGSQDSPGSGNRDKTKCSSSSHASEKSLDSVASGSKCVKMEAVCSDDVTSKHVDCISPVKDSTAPTVAVSTTLKRVAEKVVLELVGSESIGGNNAELLQIAEKDMGNVLVENLHFGGNGVPQSGLPEELEV

SEQ ID NO: 124261 - protein, 653 aa, Triticum aestivum
  unsure (1)..(653): unsure at all Xaa locations
  Clone ID: PAT_TA_18679.pep
EVAISNKPISLAGPLDAVVQRMVELNKFLLEVVLYVSVEVSVRREEVLGSIDIIVLAWVFQLTSQRGFTDQMVEEANXAVLFTFGSYRLGVHGPGADIDTLCVGPSYVNREEDFFIVLHDILAQNEEVSQLQPVPDAHVPVMKFKFHGISIDLLYASVSLLVVPSDLDISQEAVLYDIDEATVRSLTGCRVADQILRLVPNIESFRTTLRCLKHWARRRGVYSNVTGFLGGVNWALLVARVCQLYPNAVPSMLVSRFFRVFTQWRWPTPVMLCAIEEEELGFPVWDPRKNPRDRTHHMPIITPAYPCMNSSYNVSTSTLRVMIEQFQFGNKICQEIEMNKASWSALFEPFNFFEAYKNYLQVDIIAEDDEDLRLWKGWVESRLRQLTLKIERDTYGKLQCHPYPYEYADPSRQCAHCAFFMGLSRKEGVKIQEGQQFDIRGTVDEFRHEINMYMFWKPGXMELAVSHVRRKEIPAYVFPEGYKRPRPQRHLNHQHHSDKNDPGNGSPDSQLKRKHDSTGIDDTEPCRSVKRASISPVHPKTSSPRSGNVSDEPISNNQQKVTSNASGGSQDSPGSGNQDQTKCSSSSHASEKSLDSVASGSKCVKIEAVCSGDVTSKHVDCISPVKDSTAPTVAVSTTLKRVAREGCFGACWK

SEQ ID NO: 124262 - protein, 173 aa, Triticum aestivum
  Clone ID: PAT_TA_18680.pep
RRLNFTSQEVGTVLAISGFGVLVYQLLIYPFLAKYAGLVKPFRSAAVLSILLLATYPFMANLYGVELKVLINIASLLKNMFAATITIACNILQNTAVAQEQRGVANGISVTLMSIFKAVAPAAAGIMFSWAQKNITGLFIPGDQILFWMLNMVSVIGLSLTFKPFFSMPSALK

SEQ ID NO: 124263 - protein, 274 aa, Triticum aestivum
  unsure (1)..(274): unsure at all Xaa locations
  Clone ID: PAT_TA_18681.pep
MAISGDDRYAPAADSGGGKLWNLCRMPFRQASGAPAPASSSSSSGIHHSAGRYGHEAPVAGDGGAPVAPAGISTVAKSLLPARRRLRLDPSNKLYFPYEPGKQVKSAIRIKNTSKSHVAFKFQTTAPKSCFMRPPGAILAPGETIIATVFKFVEHPENNENILQKCKVKFKILSLKVKGPMEYAPXELFDEQKDQAVVEXILRVVFXLDVQNPGPQLEKLNTQLAEAEAALEARKKPPEENGPKIVGEGLVIDEWKERRERYLAQQQVEAVDSV

SEQ ID NO: 124264 - protein, 255 aa, Triticum aestivum
  Clone ID: PAT_TA_18682.pep
RPPTRPQTLRSVLGRLEQAYCGTSGYEYMHIPDREKCNWLRERIETVNPREYTYDRRQVMLDRLIWSTQFENFLAQKWTTAKRFGLEGAETLIPGMKEMFDRAADLGVESIVIGMPHRGRLNVLGNVVRKPLRQIFSEFSGGTKPVNEGEGLYTGTGDVKYHLGTSYDRPTRGGKHIHLSLVANPSHLEAVDPVVAGKTRAKQYYSYDLDRTKNLGVLLHGDGSFSGQGVVYETLHLSALPNYTTGGTIHLVVNN

SEQ ID NO: 124265 - protein, 107 aa, Triticum aestivum
  Clone ID: PAT_TA_18683.pep
ELGPITKRKGTTVANDQKGDDTVVVPHVPLNNMFGNSTALRSMTQGKGELELEYMEHNTVSQDVQMQLVNAHKATKSADLFFWSTEKTNFVSIIFVNFVSTAPQMVS

SEQ ID NO: 124266 - protein, 234 aa, Triticum aestivum
  Clone ID: PAT_TA_18684.pep
MPPGGGGGGGEHGSTVRRDDDAPSDSTPPLPAIVPVASEDAKKKQRVEEQQTAPSLPEGAIVEILSRVPYRSLCRFKCVSKPWLALCSAPDIRKRSPQTLSGFFYHDEGDALRFCNLNGRGPPLVDPSLPFLRRTYRHISGQQVCAGLLLCSWSNSSGDQSFLELEFFARRKAGMLSAILAQKRGLGLLPWEFQKGDQTPFLRFEGWWALPPLGGLGPRPNTFKWAPFLPQGEI

SEQ ID NO: 124267 - protein, 107 aa, Triticum aestivum
  Clone ID: PAT_TA_18685.pep
MAAKLASELMPSDVAKALWGTTKSSSKINKEVQELLKLTLSKARVKLTENTIFNRIVTDSNGSDPFNGLYVGAFSPYGPEVVQLRRKFGHWNSTDDVEFFEYVEAVK

SEQ ID NO: 124268 - protein, 341 aa, Triticum aestivum
  unsure (1)..(341): unsure at all Xaa locations
  Clone ID: PAT_TA_18686.pep
GKSPTQTAASVLRSSPSFFPSPEARSTGHRLPSAEARSAGHPLPSAVAISTPAAAGRSERDPSIRSPPFLPRRVQLKVCGRWAGGISRLIGXLKAAVLLTAAYFVHGLGMKLLSLPLIYTCLIAVLISIASHPSVDLPLLLGKASNGSFPLWSWVMFSPFLFFIHLFVLLRRFVKNEPLYTEIADGVYVGGWPSSVERLPPGEPAVIDCTCELPRSSTISENSYLCVATWDTRAPQPPQIESAVRWAVRKRSQNKPVYVHCAYGHGRSVCVMCALLVALGLADDWKAAEQMIREKRPSISMNTLHRKSLEEWSKHLLSPSKGSGESDVSSVILSDYTRKKH

SEQ ID NO: 124269 - protein, 166 aa, Triticum aestivum
  Clone ID: PAT_TA_18687.pep
MLLYMGYKYDCIFVGSSDVNDLKVSGTPRKRSLDGGFDTEAIVAARNKDVVASSPIIRNGAILSNQCFPAPVIKPSVTNVANSRAIGTPASPLPGFTAPIHTGISTELSSKDEREVKREKRKQSNRESARRSRLRKQAETDELATHVRSLTAENTCVICEIGKLTK

SEQ ID NO: 124270 - protein, 444 aa, Triticum aestivum
  unsure (1)..(444): unsure at all Xaa locations
  Clone ID: PAT_TA_18688.pep
MSPSSDRDKLGSIPENPTAEEEINKEEHPHLQKGLGFEISLSGHLLRPGMGQTSADEVFHXNLVPEEDFKLSGPSIIKNANLIVRIGCNYFTWSKVSHVVLGKAVFGPDFCVEPIDAIPVERQETPNSRDDSLGLSPSRRWRLWPIPFRISRSLQRSNSDSSEDIFLDTETVLSPMDEQAPANNKDQSPRKQFVRTLIPTSEQVASLNLKEGQNIVTFSFCTRVFGKQQVDAHIYVWKWNAKIVISDVDGTITRSDVLGQVMPLVGRDWSQSGVARLFSAIKENGYQLIFLSARAIVHAYLTKTILFTLKQDGKVMPNGPVVMPPKGESLSAYSAVIRTETGKLTKSSEELIIALSPSVYNPFYAGFGNRDTDELTYKKMGISKGKIFIINPKGEVAINSSVEVRSYTPLQPRVPDLRPPPASGAPADVVAANCWMVPPPAGAV

SEQ ID NO: 124271 - protein, 130 aa, Triticum aestivum
  unsure (1)..(130): unsure at all Xaa locations
  Clone ID: PAT_TA_18689.pep
AVEREGPSSRYVHTRYPVCYLRVGCWSVGAVRQRIRYWVAELRSXPSMLSPPLPQAVRLYSSARKKNGKGIEEDNAEAQARERRALLKARNSDDFERFGSFTFSNLKEDFGGRASQRQSKRKKVSQRLTS

SEQ ID NO: 124272 - protein, 44 aa, Triticum aestivum
  Clone ID: PAT_TA_18690.pep
FDACVRALVRSTPSLFQVVFNFSCQFHLIIVNAHFFSERRLYPR

SEQ ID NO: 124273 - protein, 212 aa, Triticum aestivum
  Clone ID: PAT_TA_18691.pep
MANAMLLPVLISFLVLPFSALALTQDFCVADLSCSDTPAGYPCKAGVGAGDFYYHGLAAAGNTSNLIKAAVTPAFVGQFPGVNGLGISAARLDIAMGGVVPLHTHPAASELLFVTEGTILAGFISSSSNTVYTKTLYKGDIMVFPQGLLHYQYNGGSSPSVALVAFSGPNPGMQITEYALFANNLPSAVFETVTFLDDAQVKKLKSVLAGTG

SEQ ID NO: 124274 - protein, 212 aa, Triticum aestivum
  Clone ID: PAT_TA_18692.pep
MANAMLLPVLISFLIMPFSAMALTQDFCVADLSCSDTPAGYPCKAGVSAGDFYYHGLAAAGNTSNLIKAAVTPAFVGQFPGVNGLGISAARLDIAMGGVVPLHTHPAASELLFVTEGTILAGFISSSSNTVYTKTLYKGDIMVFPQGLLHYQYNGGSSAAVALVAFSGPNPGLQITDYALFANNLPSAVVEKVTFLDDAQVKKLKSVLGGSG

SEQ ID NO: 124275 - protein, 188 aa, Triticum aestivum
  unsure (1)..(188): unsure at all Xaa locations
  Clone ID: PAT_TA_18693.pep
AGPPAPGIRLPPSDLGPPPPPTHPTATVDEVEADPRSSPXPMTRSRTSEAPRSCPQTAPLPQPPIPLQSLPPPSIPTPIGDLVSPSSPSPSPPPTDLPPHLVHPPMETPSSTDPPTHPRPPMDGWMDGAHQFWRWRRRIRTHLCDGGRPHQDPPARWRPAGSVWRGTPHHTGACCCGGCRQRRISGGT

SEQ ID NO: 124276 - protein, 593 aa, Triticum aestivum
  unsure (1)..(593): unsure at all Xaa locations
  Clone ID: PAT_TA_18694.pep
VQKNQFVDMVKVGDPGFAERRPVEKFRDVQQQQPIDQVPTHVAPKYAEGLCWVMRYYYQAVWPWQWFYPYHYAHFTTDLKHLTLXEINLFRGQAVKLVDRLMGQPPDGSPDXDNHAESVSRLICRNAARCSIVVFHXARMNGKRFAYPAIAKLPFIDERRPLVDTQKLAAAVTAEERCRNTADFDVMCGRAAHPWAIQNAYLDQMYSQQMIADPSYCIPIAPAASGGMNGFLCLSQRNWYSISVGSPVKGFNGITNNRVLNATYVNPQYHKHIPEPPEGAIIPPKILKPYDFKPFPVLWHEDNSRRQTRDRPQVHGALTGSVLGEAAHRLLKNSLQIKSGSSAGLLHVPYGAAPYGPGNRARPSGPLGYERGFVDNPYHAHMSRSAPNPRPQFFGEAQANRQNVRILERPNNRNNDGGIHSGMSKLTIQDGPRMHQNPRMQSPGYFPNQPYPNQYGGFPPQRPMQNANFAPQRPFQNAPFPQQRPVQQRPVQNAVFPQQRPVQNAGFMQQQQQQQPVNGVPPPLPPSTWIGKQPSGGQAGTPAKQQDPRANRQPKQDNRQPKQDNLRSQHESRQQAAKVVYRVKGQAPNGLPE

SEQ ID NO: 124277 - protein, 260 aa, Triticum aestivum
  Clone ID: PAT_TA_18695.pep
AQGRRKSATRKNRLPTSRSPPPDVSPGVTRKHSPSSIRNKRLSPPSDRKVGQAKNCDYKVDTAIAPDATPIKEVTEEKLLKGGNLRSRLETRRTLFQGNEERATKLAGAKAGSRVVPYECGGNMEELSSCTAPASLSQRGFSLAGSVSDGRYPAASLGSNSVQSATRKNRLPTSRSPPPDVSPGVTKKHSPSSIRNKRLSPPSNRKVGQAKNCDYKVDTAIAPDATPIKEVTEEKLLKGGNLRSRLETRRTLFQGNEEKA

SEQ ID NO: 124278 - protein, 101 aa, Triticum aestivum
  Clone ID: PAT_TA_18696.pep
SGVEGKKTRAVLISCPSASNTFWIIEEPQPLFLQPRVRVQLKRLSSTSDLMPNSGTLALHEATWISVIHVRHMLGAPTEEKNPPKVAAQDGNFTCLDAYML

SEQ ID NO: 124279 - protein, 169 aa, Triticum aestivum
  Clone ID: PAT_TA_18697.pep
VLMSMEVLHDTTGKKEAVVYYMDAPLPYAIEENFGGCFFEDDVDLAQVLQDQEIVYQLIQGNDGSGLSRTHSDPSSSCGHPRKSSGRRLTRGANYESQLAVDEALARDLQAMEDQIAKATIDDKKRKEVRKPVSSSTSNNGNTSVSRSSQVLTESEVDPDNMTYKELEQ

SEQ ID NO: 124280 - protein, 281 aa, Triticum aestivum
  unsure (1)..(281): unsure at all Xaa locations
  Clone ID: PAT_TA_18698.pep
DTESSHGVDASSKELSKPECSGGAGQDEGPSVSCPKKRKRPSQDRGVKHVQEGSQQLATLAAKQEKDDDXXDXPKRPVGTSRKSNGKQTEDKSDAPKEDYIHIRARSGQATNSHSLAERVRREKISERMKFLQDLVPGCSKVIGKAVMLDEIINYVQSLQRQVEFLSMKLSAVNPALDFNIERILSKDLFQSQGTASSTFGFLPDIGHQFLHPPKHSQAALHSIVNPADAFGRVTNAPVGCTFKEATHQVPNSFDGEFHNVIGMPFTLFNDQGIHMVNLEQ

SEQ ID NO: 124281 - protein, 306 aa, Triticum aestivum
  unsure (1)..(306): unsure at all Xaa locations
  Clone ID: PAT_TA_18699.pep
RSSKSCVCTYINGRVVAIQVPSPAGAQGDREFTXAEMETIGKIKHRNLVPLLGYCKIGEERLLMYDFMKFGSLEDVLHDRKKIGIKLNWAARRKIAIGAARGLAFLHHNCIPHIIHRDMKSSNVLVDENLEARVSDFGMARMMSVVDTHLSVSTLAGTPGYVPPEYDRGFRCTTKGDVYSYGVVLLELLTGKPPTDSTDFGEDHNLVRWVKMHTKLKIADVFDPELLKDDPTLELELLEHLKIACACLDDRPSRRPTMLKVMTMFKEIQAGSTVDSKTSSVATGLSDDPGFAVMDMTLKEAKEEKD

SEQ ID NO: 124282 - protein, 165 aa, Triticum aestivum
  unsure (1)..(165): unsure at all Xaa locations
  Clone ID: PAT_TA_18700.pep
XLLPXRXPXDLLYLPPRSVLHQRRGKISCFYSMDHLESISSQRVQRTRAHRAASSGSFGPVGGISSNIHRIVLGHPHSPLPAERVMWQFHLPRLSPMAPPLRGTAKRRRRDSPPARGRKEAEPELEGAGRARGRRAPATPTGAVNAMDGRRELGGDWVRRTRGRT

SEQ ID NO: 124283 - protein, 245 aa, Triticum aestivum
  Clone ID: PAT_TA_18701.pep
FGTRYLGGSSFPSPPPPAIAGRRIGEDAATIPFPEPPPLATALSPSPGLIHPTPRRQATASRSPCSCSTDNHTLTQRPRSPGQRRSIIDGRGSTRNEEARRLPALANGHLTGSGGAKAAHAQRKLGLGASSSRGGAAQGPAEDGRAVRCVVRGGAGLLHEQLAQHAHAPAPLHEGHAEAVGLEVAHPALQQKVSQCGRACRVYLALLRLGGAETRSRGKGKACGRGNDGVLPDRLRTNQRSIKDE

SEQ ID NO: 124284 - protein, 500 aa, Triticum aestivum
  Clone ID: PAT_TA_18702.pep
SAFTETEYTCYHFEVNREYLKGALDRFSQVWVSPLVKAEAMDREILAVDSEFNQVLQSDSCRLYQLQSHTCSQGHPLNRFTWGNKKSLSNAMGSGINLREEILQMYMSNYHGGMMKLVIIGGEPLDTLEAWTIELFSEVKAGPLLEISPKSDMPFWKSGKLYKLEAVRDVHSLFLSWTLPCLHKEYMKKPEDYLAHLLGHEDKGSLLYFLKAKGWASTLSAGVGTGGTQRSSYAYIFEMSIRLSDSGLKNLFEVITAASQYIILLKQSEPQEWIFKELQDIGYMEFRFAEEQPPDDYVVDLAENMLFYSEKHIISGEYIYEGWEPELVKHVLSFFHPDNMRVDILSRSFDKQSQAIRCEPWFGSQYIEEDIPPALIESWRNPVEIDGNFHLPRKNEYIPGDFSLRNASIPKSSNDDNPRCIVDEPFIKLWHKMDITFNVPRANAYFLISVKDGCSSLRNSVLTDLFANLLKDELNEVLYQAYVAKTPDNQYLSVGKQPLS

SEQ ID NO: 124285 - protein, 258 aa, Triticum aestivum
  Clone ID: PAT_TA_18703.pep
MKIIPVACLEDNYAYLIVDESTKAAAAVDPVEPEKVLAAASEVGAYIDCVLTTHHHWDHAGGNEKMRLLVPGIKVYGGSMDNVKGCTDQVENGTKLSIGKEIEILCLHTPCHTKGHISYYVTSKEEEDPAVFTGDTLFIAGCGRFFEGTAEQMYQSLCVTLGSLPKSTRVYCGHEYTVKSLQFMLTVEPENEKMKQKLEWAQKQREANQPTVPSTIGDEFEINTFMRVDLPEIQAKFGAKSAVEALRTVRNIKDTWKG

SEQ ID NO: 124286 - protein, 135 aa, Triticum aestivum
  Clone ID: PAT_TA_18704.pep
MDSIKIKLAVDRSRNRVLFADAGSDFVDVLLSFLTLPLSAIQFCAATSPGCLFNLCDSVNRLTGGRLLKVEACHDMLLTPSTAHEFGGSSFWNSHDAFVKNQPNLQVDGDYCRCWQVMARLVHVYNKVSSGSVMF

SEQ ID NO: 124287 - protein, 149 aa, Triticum aestivum
  Clone ID: PAT_TA_18705.pep
RLDSPKSKYTLCGHSDSVHCQDSDWVHSLDYLISGSVDKTAKIWDLQKKECVHTLQNKSTVYSVFAHPSLPVLITGTRNGAVRVWSSTDFRLKTKLGDISPVCGFACLMGSERVAIAHCDGVSVMEIGDEKEQGGSEASNEYSISAIDY

SEQ ID NO: 124288 - protein, 198 aa, Triticum aestivum
  Clone ID: PAT_TA_18706.pep
MAAVATVSSAGGILAMLHEPAEELKLHALASLNSVVHLFYPEISTSIPTIESLYEDEEFDQRQLAALVVSKVFYYLGELNDALLYALGAGPLFDVSEDSDYAHALLAKALDEYASFKTRASKATEEEENVDPRLEAIVERMLEKCVLDGKYQQAMGMAVECRRLDKLEEAIVRCDNIHGALSYCINLSHQYVSHREYR

SEQ ID NO: 124289 - protein, 274 aa, Triticum aestivum
  unsure (1)..(274): unsure at all Xaa locations
  Clone ID: PAT_TA_18707.pep
MAPPLLLLLLPLAAATAPCAHPAYPSQPASCPAEPVLAPERRETHGGGRILDITHYYREDMPSWESGAGVGQFLWLPASMRNGSLANNSEMRMPTHTGTHVDAPGHVFQHYFDAGFDVDTLDLDVLNGPALLVDVPRDENITAKTMESLHIPKGVQRVLXFRTLNTDRNLMWKKEFDTSYVGFMKDGAQWLVHNTDIKLVGINYLSVAAFDDLIPSHLVFLENRDIILVEGLKLENVIPGIYSLHCLPLQLRGAEGSPIKCILIKRRHLYPAAI

SEQ ID NO: 124290 - protein, 317 aa, Triticum aestivum
  Clone ID: PAT_TA_18708.pep
MAAPAPEERLDVLTAAGDKTGVSKPRSEVHRDGDYHRAVHVWIYCESTGELLLQRRADCKDSWPGQWDISSAGHISAGDSSLSSARRELQEELGIKLPVDAFELIFVFLQECVINNGTYTNNEYNDVYLVTTLTPIPLEAFTLQESEVSAVRYMHRDEYKSCLAAESGEYVPYDVNGQYGQLFSIIEERYKDNTESRSLTLQKQISRYAPIHLEPELTTLSEGDKEALGYILKASMVIDEIFYEQVWNSNTMLRDWLKAHADSSSLDSLKWAYYSINKSPWSCLDENKAFLSTADSAVKLLTDATKPISGWKGLEYR

SEQ ID NO: 124291 - protein, 347 aa, Triticum aestivum
  unsure (1)..(347): unsure at all Xaa locations
  Clone ID: PAT_TA_18709.pep
VSMNVLAFGIQSSDITPAFPYVAPFSCTVPDICRIVRSFIEDSVNFXAHGGGGDTYAAXVKKYLGRILSEVVNASIRTRVDSGSGLSVSQAMQVAANMSIMERACEFFTRHAAQLCGVPLRAVERGRRDFPLRKSRDAAEALLLRLLCSKVDEFMRQSDGVNWIADDPPAGGNEYANEVTIYLETLTSTAQQILPLPVLRRVLVAVLKHISERIIALFLNDSVKRFSGSAVIGIDTDLKMFESFTENMSSLFLDSHQDSAASEMKSALMEPRQLVNLLMNNSPENFLNPVIREKSYNKLDYKKVAIISEKFRDTSESYFSTFGTRGARQNPKKKSLDTLIKRLREAS

SEQ ID NO: 124292 - protein, 94 aa, Triticum aestivum
  Clone ID: PAT_TA_18710.pep
MASGQEKGRSELDSLAREGQTVVPGGTGGKSYEAQEKLAEGRSRGGQTRKEQMGEEGYSEMGRKGGLSADHAAGGERAAREGIDIAESKFKTKS

SEQ ID NO: 124293 - protein, 142 aa, Triticum aestivum
  Clone ID: PAT_TA_18711.pep
WNESSWPERPYDHCQGSDPYLGNSKQWLSWHPISQTNSSMMRPWQVENYGAAIVEVLILINGSANLGLSALDRRDDGGGATAAEQEARWIEAWASAKWKQRRRRNMRMAPSSWICKAAAQIQLGEARNRLKKGDGMDPIRLR

SEQ ID NO: 124294 - protein, 129 aa, Triticum aestivum
  unsure (1)..(129): unsure at all Xaa locations
  Clone ID: PAT_TA_18712.pep
RPGRVVTLKVFEXNVLVREFLEEKGQGRVLVVDGGGSLRCAILGGNPVQQAQNNGWAGIVVNGCIRDVDEINGCDIGVRALASHPMKANKKGMGEKHVPVTIAGTRICDGEWLYADTDGILVSRTELIV

SEQ ID NO: 124295 - protein, 172 aa, Triticum aestivum
  unsure (1)..(172): unsure at all Xaa locations
  Clone ID: PAT_TA_18713.pep
MAALPLATAEVCDANSHLITGGELRALQPVFQIYGRRQVFAGPIVTLKVFEDNVLVREFLEGEGPGQGCWWVDGGGSLRCAILGGNPVQXQAQTKGWAGTVVEGCIRDPDESNGXTTGVRALASHPMKAXNKKGMGEKHVPVTIAGTRXICDGEWLYADTDGILVSRTELIV

SEQ ID NO: 124296 - protein, 149 aa, Triticum aestivum
  unsure (1)..(149): unsure at all Xaa locations
  Clone ID: PAT_TA_18714.pep
MVSLKLQKRQASSVLKCGKDKIWEFEQFTXRFQFVYNRMGGIYHEILPKSEYFSKALYTFHFAQNDLTLGYFTNKTTKQIEAYDPDPKERFTVAMQLSSYCTSGHELQVVLGFDCWMEQHQERALLLQPHGSKQAWRRPRGLISDQPHV

SEQ ID NO: 124297 - protein, 532 aa, Triticum aestivum
  unsure (1)..(532): unsure at all Xaa locations
  Clone ID: PAT_TA_18715.pep
MYKNLLQELAQRRCFNLPAYTCLREGPDHAPRFKAAVIFNGEQFESPGFFTTLRQAEHAAAEVALAALARRGPSYSLAARILVETGVYKNLLQEVAKRVGGPLPSSIGERSGLGLLPVSTSSAELSCNGYVSCSFARSGRCLYFTVYGSSGSXLAGFTFAPPCSAGHPVPLGKDYEVAIITSYVRXRVREKIAMANNPNASPFPKKFPMQPERKPCFGQSSQSSYSKILPLFRPKSSSRSRPESPAAADGASQSPFWPIESSNSRSRFPAAEAAPYVPVGHYRMPCHSMAPPVTVRSSIPVFSAPPLPPPSGRTQQLPPLLSNPPSVRMASPVHIRPASPHFAPSGPAQRPRPVMSVQMKDVQHKPIRESMSSAIPIQVKDAQQRPTKGSPSSAPPVQPWVAPHRLAPGPMSWFDPRVQMKDVQPQPAREPLSEGKDAPPAATEPPVKIEAPAQVKEASEVVTSEVVPCPAAGSVAAAASSTSTSTSECSTAAPASQSGADDDAAKGEEAREDVLETEAALEEGIIKLLEIK

SEQ ID NO: 124298 - protein, 584 aa, Triticum aestivum
  Clone ID: PAT_TA_18716.pep
STHASADSYRSAPCSPTVLGMDDMYGPCGNSRAFSRQLSSIQSFNSRFGSFNSRLGSFNCRPSGPRSENMSIPPEELRCPISLQLMYDPVIVSSGQTYERVCIEKWFNDGHSTCPKTQQQLAHLSLTPNYCVKAMISSWCEQNEFPVPDGPPGSFDVNWRLALSDSQATGCVSVDSFDTSNIKGVKVVPLENERKEEPANSESGTLDDSSCFEFDMNEGYRNLLLVLNERNNILSQCRLVEQIRYLLKDDEEARIQMGSNGFAEALVQFLRYSVEEGNEKAQEVGAMALFNLAVNNNRNKGLLCGAGIVELLEQMTSNPRLAAAATALYLNLSCLTDAKSVIASTQAVPFLVDRLYNHDACDPKASSCKHDALYTLYNLSTHQASIPSLLSAGIVDALHTLLTDSSVSEGIGWTEKALAVSISLAATQAGRKEIMSTPGLVSTLAMLLDTGEPTEQEQAVSCLLAMCAADDKCIAPVLQEGVVPSLVSISATGTGRGREKAQKLLKLFREQRQRDGGQPPASQQQQQQAPSSEAGNGNGNGNGNGGGVMVCHRESKPLCKSKSRKLGRTLSSLWKNRGFSLYQC

SEQ ID NO: 124299 - protein, 324 aa, Triticum aestivum
  unsure (1)..(324): unsure at all Xaa locations
  Clone ID: PAT_TA_18717.pep
MSQSSPFFSIARAHAGAGGRAAAAALLLRCPAAQLPPTIHCPRYFRLAKVSPAKTLSSHLVLPRATLSSFADADDGSGANPDASGERSGGSELSEMAKAFHISPRMAMSISVVIAFAALTVPLAMRSLLFHGTTKMKVLAYLTLLSGFYMAWNIGANDVANAMGTSVGSGALTLRQAVLTAAVLEFSGAFLMGTHVTSTMQKGILVTSVFQGNDSLLFAGLLSSLAAAGTWLQVTFHHRXSFELCYTXVNQMTRSRGSTGRVGGRFWSSLARVSSSWLISPLMGAAVSFLVYKCIRRFVYSAPNPGQAAAASAPIAVFTGVTAI

SEQ ID NO: 124300 - protein, 390 aa, Triticum aestivum
  Clone ID: PAT_TA_18718.pep
MDRPAPDQRPTLFSPYQMRRFSLAHRVVLAPMTRCRAIGGLPGPALAEYYAQRATQGGLLISEGTVVSPAGPGFPHVPGIYNQEQIDGWKKVVDAVHAKGGIFFCQLWHVGRASHQVYQPDGAAPISSTDKPISARWKILLPDGSYGTYPTPRRLATSEIPDIVEQYRQAAINAIKAGFDGIEIHGAHGYIIDQFLKDGINDRTDEYGGSLTNRCKFLLEVTRAVLSAIGAERTAVRVSPAIDHLDAYDSNPMQLGMAVVERLNALQQEAGQLAYLHVTQPRYAAYGQTESGPHGSAEEESRLMRTLRGAYRGTFMCSGGYTRELGLEAVESGDADLVSFGRLFISNPDLVERLRLNAGLNKYVRKTFYTPDPVVGYTDYPFLGKPKSRM

SEQ ID NO: 124301 - protein, 269 aa, Triticum aestivum
  Clone ID: PAT_TA_18719.pep
MTKKRRSCDFDAALDSSKVLKSLSESLSHSRDSVNITREDRFSHYRPLEEHAPSATRNGPVNTPWRPPQQPNMYGAPNSDFGSGRPSFAPAPTEPTSGSYSRSYVETVQRGDNRSSGTKTQQALEMLQHAEQKLAYRSNAYLSEDGSYSQAQDNHAPSYHQNGKAPDFHAEEPRPLAYSSGVVERPPPQRQWVPPQPPGVAMPEAAAAIRQQKSLTKQPSSDTSEAAGEVQVNGAASSPSVAAAEVPVNGSAASDAGRSEIEEQAEAAA

SEQ ID NO: 124302 - protein, 338 aa, Triticum aestivum
  Clone ID: PAT_TA_18720.pep
ASFCSACCSISNASSAILAEIAIFSHQKASQSGSDNVLDRTKSADLRNSWNMLSNQYMEEHEQCIQKLLPPEEAKSVDYDQLYKGLEVLSEFERQANSRVIDSGVLRGMNLDDIRKAGERLILQDGCRNFFKKIGETREKVNLDIHILSYCWCAELIRSAFSSVGCLDGVNIHSNEFTFEGSVSTGHINRKIESPLDKVEKFKIIKSDLDSITPSLSVYIGDSVGDLLCLLEADVGIVVGSSTTLRRVGKQFGVSFVPLLPGLVEKQRRLWKQEASIFKARSGVLHTVSSWSEVQAFILGNDSKLIVAGCPYHSLFLWHQDWYQLMQIRREIPVVAIL

SEQ ID NO: 124303 - protein, 74 aa, Triticum aestivum
  Clone ID: PAT_TA_18721.pep
MASISSPLPVAWYPALAVLTVAVGLMLTASFFIYEATISTRSRSLAKELTTAAVASVFLGFGSLFVLLASGVYV

SEQ ID NO: 124304 - protein, 52 aa, Triticum aestivum
  Clone ID: PAT_TA_18722.pep
IPLVLVLPIDRSGSERSAAAASLILSSSPLPFSESVLGETRPQVSKSVSQSV

SEQ ID NO: 124305 - protein, 125 aa, Triticum aestivum
  Clone ID: PAT_TA_18723.pep
MAMEARMKGTVKWFNDTKGFGFITPADGSEDLFVHQSSIKADGFRSLAEGEVVEFAVSEGDDGRTKAVDVTGPDGSFVQGGAGGGGGGGGFGSRGGGGSRGGGGFGARGGDGSGGYGGGYGGGCG

SEQ ID NO: 124306 - protein, 486 aa, Triticum aestivum
  Clone ID: PAT_TA_18724.pep
MEKKQASYGKGAARMAPMEVSVEAGNGAESDWLDDDGRPRRTGTVWTASAHIITAVIGSGVLSLAWAIAQLGWAAGPAIMLLFALVIYYTSTLLAECYRSGDPETGKRNYTYMDAVRSYLPGTKVKLCGVIQYANLVGVAIGYTIAASISMRAIGRADCFHYHDVRGRSGKDECKTHGSAHAFAHASVQILFSQIPDFDQIWWLSIVAAVMSFTYSTIGLGLGIAQTVANGIQGSLTGLSVGPGVTSMQKVWRSLQAFGNIAFAYSYSIILIEIQDTVKAPPPSEAKVMQKATGISVATTTVFYMLCGCMGYAAFGDAAPDNLLTGFGFYEPFWLLDVANAAIVLHLVGAYQVFCQPLFAFVEKWAAARWPDSAFIARELRVGPFAISVFRLTWRTAFVCLTTVVSMLLPFFGDVVGLLGAVAFWPLTVYFPVEMYIVQRGVRRGSTRWVCLKMLSAACLVVSVAAAAGSIADVIGELKEYRPFSG

SEQ ID NO: 124307 - protein, 118 aa, Triticum aestivum
  unsure (1)..(118): unsure at all Xaa locations
  Clone ID: PAT_TA_18725.pep
GACFKCGEPGHMARDCSVNGPAGGGGGGGCYKCGEQGHIARDCFNXGAGGGDGGYGGGGGGNCYNCGEPGHIARDCPTSTGFGGGGGGGRFGGGGGGGNDRSCYNCGEPGHISRDCTK

SEQ ID NO: 124308 - protein, 178 aa, Triticum aestivum
  unsure (1)..(178): unsure at all Xaa locations
  Clone ID: PAT_TA_18726.pep
TKRPRGSPQPRTRTHPRASAPPLPVDPPTTSSSAARPPAMSXAPTARDPAAAACSPSSSPPASSSSSTGPSSSRTTSARRSAPPRSPTSPWPATTPPSPTASPSGSSSTTPASACPSTTTRSTPSSAPAAAAPPSAAPLPASPPPRRSSCSAGRAPTRSGWSSTGAAASASPATSPGS

SEQ ID NO: 124309 - protein, 205 aa, Triticum aestivum
  Clone ID: PAT_TA_18727.pep
MGERLKGTVKWFNVTKGFGFISPEDGSEDLFVHQSAIKADGYRSLNENDVVEFEVITGDDGRTKATDVTAPGGGALAGGSRPSEGGGDRGGRGGGGYGGGGYGGGGGGYGGGGGGYGGGGGSYGGGGGYGGGGGGGRYGGGSGGGRECYKCGEEGHISRDCPQGGGGGGGGYGGGGGRGGGGGGGGCFSCGESGHFSRECPNKTN

SEQ ID NO: 124310 - protein, 232 aa, Triticum aestivum
  unsure (1)..(232): unsure at all Xaa locations
  Clone ID: PAT_TA_18728.pep
MGERVKGTVKWFNVTKGFGFISPDDGGEDLFVHQSAIKSDGYRSLNENDAVEFEIITGDDGRTKASDVTAPGGGALSGGSRPGEGGGDRGGRGGYGGGGGGYGGGGGGYGGGGGGYGGGGGGYGGGGYGGGGGGGRGCYKCGEDGHISRDCPQGGGGGGGYGGGGYGGGGGGGRECYKCGEEGHISRDCPQGGGGGGXYGGGGGRGGGGGGGGCFSCGESGHFSRECPNKAH

SEQ ID NO: 124311 - protein, 389 aa, Triticum aestivum
  unsure (1)..(389): unsure at all Xaa locations
  Clone ID: PAT_TA_18729.pep
ITPRDRAGVCCAGRRAIGFLLVVLARRLRGRRERWDGSTWVTVTGSTASRGAGRSLPAALPPEAPRPRQAHTEAGGRPAAAEAAANPGADGRTAAPHPAGAGPGAPVPASRRRGPRRGARRAPARRPGPRVSAQGVGPAVAAAQGGGEGQAEPVKWFDVAKGFGXISREDGSEDLFVQQSAIKSDGYRRXNANDAVEFEVITGDDGRTKAXSDVTAPXGGGAVPGVLPALAMGGGGPGGGGRWRACGGGWAXGAAGAWALGGPPSAGQVPAPGPWRPSDSCRSAWPCVDALLSLPRIATTLQELPLXGDGCGGYACASDGRGVVGCREGXMGVYEGRVFIGWPQGGCGGGGCCGYGGGVGCGGDGGGGGMLLLAAKSGHFSRECPNKAH

SEQ ID NO: 124312 - protein, 191 aa, Triticum aestivum
  Clone ID: PAT_TA_18730.pep
MGQAFRKLFDAFFGNSEMRVVMLGLDAAGKTTILYKLHIGEVLSTVPTIGFNVEKVQYKNVLFTVWDVGGQEKLRPLWRHYFNNTDGLIYVVDSLDRERIGKAKAEFQTIINDPFMLNSVILVFANKQDMKGAMTPMEVCESLGLYDLKNRVWHIQGSCALKGDGLYEGLDWLSSTLKDLQASGRLPSGGT

SEQ ID NO: 124313 - protein, 240 aa, Triticum aestivum
  unsure (1)..(240): unsure at all Xaa locations
  Clone ID: PAT_TA_18731.pep
VRGRVGSESVDSKVFDSWEWIEREYVLVQANTTSMELLSSLEKPMKDVTGARPRCDDISTISGPVQSQNRDSLYRVKSHGCTPLSASRESTTMENLRGRPLDCYTRLHLLNQYIVILTELAQEKLFKGLDLEALSLELVILAIWKEALNACSLLPDALDDGSFSTFAHENYFPKSDQRLSQNVAHGLDFTRLASVRYWVESGFIKAYDRAEKISHRLRENNDNTEMPDAMEIIFQTAXVY

SEQ ID NO: 124314 - protein, 68 aa, Triticum aestivum
  Clone ID: PAT_TA_18732.pep
MSTAKVVDPAFQGAGQKVGIEIWRIEDFKPVALPKSDYGKFYSGDSYIVLQTTFPKGGAYLFDGHFWI

SEQ ID NO: 124315 - protein, 114 aa, Triticum aestivum
  unsure (1)..(114): unsure at all Xaa locations
  Clone ID: PAT_TA_18733.pep
WRLGSTNGTKKQVCRKFLFPLKTCICWDHSQPSAESVLYLLAEFSGHLLFLASSQQNCDGAFLSAWYALQRLRTRAGITTQAVASRVYTKCPHILDYRTDHFPLRYRSLHMXRH

SEQ ID NO: 124316 - protein, 79 aa, Triticum aestivum
  Clone ID: PAT_TA_18734.pep
SVESGSISVIRNQGKINSLLKFLDDQALRQVTRRSDLLFCLIYCVKPSSTFATSHLKLRPGWLSVSIEDWIGKKREREE

SEQ ID NO: 124317 - protein, 321 aa, Triticum aestivum
  unsure (1)..(321): unsure at all Xaa locations
  Clone ID: PAT_TA_18735.pep
DTAKLDHPFLPTLYSYFTTDNLSCLVMEYCPGGDLHVLRQKQPARCFSEAAARFVRAEVLLALEYLHMLGVIYRDLKPENILVREDGHIMLSDFDLSLRCSVNPMLVRCSSVGRDEPPRPSGPCAESCIDPLCIQPSWANSSCFTPRLVSSTPSRTRRAEPVKKPSLPQLVVEPTDARSNSFVGTHEYLAPGDXSRGDGHGSSVDWWTPGIFPGMNCSYGKTPFKGTWAMMKHLQNVVSQGLKFPDSPXVSYQAXRSDXEGCSVXEQELRVGXKKGXAEXKRXPFLQXLKWALIVGTATRRTSLNLTHVDEEKEEFPSNDK

SEQ ID NO: 124318 - protein, 164 aa, Triticum aestivum
  unsure (1)..(164): unsure at all Xaa locations
  Clone ID: PAT_TA_18736.pep
MSGGAAATGEYPVVLNVYDLTPLNNYVHWCGLGIFHSAVEVHGSEYSFGAHDLPTSGLFEVEPKSCPGFLYRSSIFIGRTSXSLGNFEISFREWPRSINGDTYHLISKNCDHFTDDLHTRSAGSPSAGSIVRLAHRGALPNCLLPESMRLDSTETKNLTDYHFL

SEQ ID NO: 124319 - protein, 153 aa, Triticum aestivum
  Clone ID: PAT_TA_18737.pep
DQLMEEKTRARGLSPEVASALPHPWPPAEEQHHQTAPVCAGRPPDLAQPSQLHTCPATPVAPATLREEGLHHHHCTGGGSALAPVRRRAGHRRPSRSQKAHRCWQLGCGSGQPPLPRTGEQHLGGEVDGEEERKRRSNDGWSGSRRKMVADGR

SEQ ID NO: 124320 - protein, 380 aa, Triticum aestivum
  Clone ID: PAT_TA_18738.pep
SAHASAHASADAWALKRADMLKLTSLLSFDHISLAKFDLKHVQRPLVSFGPNGSTKLRTCPADVCKNLRLSSHVLSDFGADGLSISSDNGSFSTSWLKNLSDASSSWCSSSTKPRKFITNDFDNFHFHAQPSSIPTSVLQLAGSAYLMRATAWEHYGSAPMVRMNTLVYATCFADAASSSELSLAYVKLIEQLAVFKGYSAAFCALKLAEEKFPSSTNSQIHLLKMQLLHERALHRGHLRIAQQIGDEFGVLSSSVSGVDIELKTEASLRRARTLLAAKQFSQAAAVANSLFTTCYKYNMQVENASVLLLLAEIHRKSDNAVLGLPYALASQSFCKSFNLDLLEASATLTLAELWLALGSTREEGLSLFIKAFQDPGMAV

SEQ ID NO: 124321 - protein, 362 aa, Triticum aestivum
  unsure (1)..(362): unsure at all Xaa locations
  Clone ID: PAT_TA_18739.pep
EKGGKPALYIVQYTXSTFNWRSVGFTVTQQVKPLSSSDQNLQVSLSISAKTNGQYATVNVRIPSWASANGAQATLNDKDLQMASPGTFLSVTKQWGSGDHLTLQLPISLRTEAIKDDRPEYATLQAVLFGPFLLAGLTTGDWDAKAGGAAVSEWITPVPASYNSQLVTLTQESGNGTLVLSLLSTAKATSLTMQPHPEGGGTDAAVHATFRLVPQGRSPRRRASGATPPTAPPPXATLASALIEPFDMPGMAVSNNLTLAAEKGPSSLFNVVPGLDRAPGSVSLELAARPGCFLIPAGAKANVQVGCGPGFSLQAASFARAEPLRRYHPISFAARGARRSFLLEPLFTLRDEFYPVYFNVGA

SEQ ID NO: 124322 - protein, 146 aa, Triticum aestivum
  Clone ID: PAT_TA_18740.pep
MPVARPEPQEPRVIAHLDLDCFYVQVEQRRNPALRGQPTAVVQYNDWKGGGLIAVSYEARKFGVKRSMRGDEAKNVCPGINLVQVPVSRDKADLNVYRNAGSEVVAILSTKGKCERASIDEVYLDLTDAAKEMLLESPSESSEFTF

SEQ ID NO: 124323 - protein, 297 aa, Triticum aestivum
  unsure (1)..(297): unsure at all Xaa locations
  Clone ID: PAT_TA_18741.pep
MALLSPPSAPPLLTPARHRLASPHLLAIPASPSSLLSLPHHHHSLLLPCAANAWPPRRHRRRGGIAASLGQEEPGVSDAXITSEGEFGEGDSELPINFDAEAGAVAVSAEPPADASLEDLENIREIKRVLELLQKNRDMTFGEVKLTIMIEDPRDVERKRLLGIEDPDELTRDDLADALVEVNEGRLPENRDTLRLLAKEMAEWPDVDVKIESQKGKGFFGRSVYAKATDTGIDPVAAAKRLNIDWDSAADIDEGEDEDEEDEVPSAVGYGALYLLTAFPVIIGISVVLILFYNSLQ

SEQ ID NO: 124324 - protein, 271 aa, Triticum aestivum
  unsure (1)..(271): unsure at all Xaa locations
  Clone ID: PAT_TA_18742.pep
MKGKGGALDRRSSARWRLLLLCAFSFGLGMLFTNRFWTAPNTNNHIMSQHRRQDQELQLVSEDCNTKRKHGEHKDIMGEVTRTHEAIQLLDKSISTLQMELAAKRSTLELVRSGVPVTSETSQSRKKAFVVVGVNTAFSSRKRRDSVRETWMPQGEKLLQLEEQKGIVIRXFTIGHSATSNSILDKAIDAEDAQHHDFLXRLDHVQGYHELSRKDKNLLXSTAVGIWDADFFVKVHDDVHVNLGAPATSLAWRKPGPWADIARHAARPSSS

SEQ ID NO: 124325 - protein, 297 aa, Triticum aestivum
  unsure (1)..(297): unsure at all Xaa locations
  Clone ID: PAT_TA_18743.pep
VRAARFYAAEVLLALEYLHMLGVVYRDLKPENVLVRDDGHVMLSDFDLSLRCAASTTLVRPSLPCSASGPNGGACIQPTCFMPKLFGGRSSKKSASAASRSKSGEQQQGAMPELVVEPTGARSMSFVGTHEYLAPEIIKGEGHGSAVDWWTFGVFLHELMYGKTPFKGQTNRATLFNVVGQQLRFPEGGPPTSCASKDLIRGLLAKEPQGRLGVKRGAAEIKQHPFFXGVNWALIRCSTPPGVPRPVEPIAFAAMPAKSASMDRVETNYNSSKRVPAGPGADHVESGGKFLXDFEFF

SEQ ID NO: 124326 - protein, 88 aa, Triticum aestivum
  Clone ID: PAT_TA_18744.pep
NTNINSQMRAIHLQPEEEIHQTYIDTQKSKECTRENNNTKTRLANRQANRRSSCSLGVAGAGHEALSYYSSSSSSSSSSSSSSSSSSS

SEQ ID NO: 124327 - protein, 135 aa, Triticum aestivum
  Clone ID: PAT_TA_18745.pep
MSGEAGNRKEEARKTGLEGTGLPLPGGSHGSVRCAGSDPQLRHMLDSLKSSKASAVINYGASWCGVCNQILPPFCKFSNEFKNLTFVYAHVDECPETTQNIRYTPTFHFYRDGERVDEMFGAGEERLRDRLWLHS

SEQ ID NO: 124328 - protein, 276 aa, Triticum aestivum
  Clone ID: PAT_TA_18746.pep
SGGVADALVQGGVIGFAGELPERYMQAVVAGTAASGVLVSALRVITKASFPRDPNGLRQSAILYFMVGMVVMIICIVCYNVARRLPVVVYYKNIKQRAQKAEVGGGMTGPAWRSTLWSIVGTVKWYGIGVVLIYAVTLSIFPGFITEDVHSEALKDWYPIMLISAYNVFDLIGKCLPAIYLLQNSNVAVAGSFARLLFYPLFYGCLHGPSYFRTEIPVTVLTCLLGLTNGYLTSVLMILAPKAVPIHHSETAGIVIVLFLVVGLVVGSFVAWFWVI

SEQ ID NO: 124329 - protein, 122 aa, Triticum aestivum
  Clone ID: PAT_TA_18747.pep
QTDKWILANCRRLVLSGNQRDAQLLCHVVCVGQLHDRPCQKTHLRQDSGPPHLSRLRSRGAAGWVARGGRPGVGARPGRRSRSTAGSRPPSRRNPEEEEGAKGVARSRSGELRRRMGDAGSP

SEQ ID NO: 124330 - protein, 71 aa, Triticum aestivum
  Clone ID: PAT_TA_18748.pep
GSIAYNWSRPGMKTSVKLIHARLHAQALTLAALGCSALVEYYDHQSGSGSKVHDYAKQFLPSDRNAKKDSV

SEQ ID NO: 124331 - protein, 103 aa, Triticum aestivum
  Clone ID: PAT_TA_18749.pep
MAEEKGTLQAMRGWVVDHKLRAVGTLWLTGIAGSIAYNWSRPGMKTSVKLIHARLHAQALTLAALGCSALVEYYDHQSGSGSKVHDYAKQFLPSDRNAKEDSV

SEQ ID NO: 124332 - protein, 163 aa, Triticum aestivum
  Clone ID: PAT_TA_18750.pep
QVLELAIPLTHSVLAARSFRSATNTLIQSWDGLTLDVTGGQSTRSPSARTQGSQGEGLSVKPGVDELDAGLHPGPGPVVGDGSRDPREPQRPYGPAACGPRPTPSSPAASPSPPPLLPPKGNESFCYQTEFSGSNSVCACACATVGWVGNGAGGSRSRGEKGF

SEQ ID NO: 124333 - protein, 224 aa, Triticum aestivum
  Clone ID: PAT_TA_18751.pep
MAGRTAERFREVQSKIDSYLILFPVISHIGITRRLDRIYNVLVQDGSTRDEPSRLPQSSQLQESAEVVQEVLSQGIKEFTLAEIIAATKNFAHDTMMGYGSHGRVYRGRLHDGREVAIKRMSENIQLEDFRTELDVVAQLQHKHIIHLLGWCVSSKGKRLLTRRTKELERLVVSGYVENGTLFDHLHRNQAGSSMPSPVTMSWKMRIDVLLRVSQAIEYMHCHS

SEQ ID NO: 124334 - protein, 350 aa, Triticum aestivum
  Clone ID: PAT_TA_18752.pep
MERRGLLKTALLACLLVVCSGRVPMVIQQPSTTIYNSTLAKTLVEYAAAIYTADLTQLFTWTCDRCGDLIEGFEMMDIIVDVENCLEAYVGFASDINAVIVVFRGTQENSIQNWIEDLLWKQLDLDYPGMPEAMVHRGFYSAYHNTTIRDGIVSGIQKTRKLHGDVPIMVTGHSMGAAMASFCALDLVVNYGLDDVKLMTFGQPRVGNAAFASYFKRYLPHAIRVTNANDIVPHLPPYFSFFPQKTYHHFPREVWVHDVGLGSLVYTVEQICDDSGEDPACSRSVSGNSIQDHITYLGVSMHAEAWSSCRIVMDYAELRYKMDLHGNVVLSKQQQQQPGLSDQRRRHSAQ

SEQ ID NO: 124335 - protein, 188 aa, Triticum aestivum
  Clone ID: PAT_TA_18753.pep
SADAWEVFDIFSTYACRRDSFITHRAFCDALAQESARLPPIGAGMYGGPGNMALGNLSGMAPQMPSGFPDQSGHHSSASAIDVLNLGGGSGNAGQFEHLMPSSSGSSMFRSQAANSSPFYMGGGAAQDFAEDDVHRSHGNQGSVLQGKSPAAFHGLMQLPDQHQGSGGGNGNNNLLNLGFFSGNGNGS

SEQ ID NO: 124336 - protein, 113 aa, Triticum aestivum
  Clone ID: PAT_TA_18754.pep
ELHRVSGLAMRDVIVRLWPAEPVASSYFGLVQRLVDALSQIVMVKRSSCIEGARLAFARVKMHWAKMKAAIVAVEGPPGGKDHRKPERYFEDVLEGARLIEGQCSKDIMFELM

SEQ ID NO: 124337 - protein, 402 aa, Triticum aestivum
  unsure (1)..(402): unsure at all Xaa locations
  Clone ID: PAT_TA_18755.pep
IRHEATDMLSVSQFIPDLDVPTLMLGDIVISVETAARQAEARGHTLLDELRTLVVRGLLRLLGFDRVRGRVGCNGIEPHHYDILKSLRWKGKGLAKNAPDLSKPNTXTLDGQVTNSLKRAGSLRFYRPKFKYIFCDMDGTLLNSKSQVTARNAEALKEARSRGVNIVIATGKTRPAAIDALNMVDLSGRNGIVSESSSGIFLQGLLVYGLEGXEIYRNTLNQEVCREAFLYSLEHKVPLVAFSQDRCFSMFEHPLVDSLHDVYHEPKAEIVASIDQLLGTAEIQKLVFIGTSEGVSSTLRPYWTKAIKERAGVLQAQPDMLELVPPATSKGTAVKILLDHLCISPDEVMAIGDGENDIEMLQLASLGVALANGAEKTKAVANVIGATNDEDGVAQAIYDYAF

SEQ ID NO: 124338 - protein, 249 aa, Triticum aestivum
  Clone ID: PAT_TA_18756.pep
MAFYPPPPLAFRYANALGGVATGGTVSFQQPAPGVGAITSPTAAPQAVGDNKESASKRKRGGPGGLNKVCAISPELHTVVGETAMLRTQIVKQLWAYIRQNNLQDPDDKGKIICNDELRIVFGTDSTDMFKMNKLLAKHITPLDPEDQPSEAKKVKAATPAPQQMPTINQNQPYVVVSDALAKFLGVEGTVPHDDALKYLWDYIKANQLEDPASASILCDSSLQELFGCESIPASGLSDLLAHHFIQRT

SEQ ID NO: 124339 - protein, 171 aa, Triticum aestivum
  Clone ID: PAT_TA_18757.pep
MGPRKFLLATISTVSVLLYMFPHANSESVALPPESAYGPAAESPDAGAPELSPGPPPMVFDVDDYGASAGGDATEAFLAAWKDACNSSSDPSLFLVPEGKTYLLMPLSFGGPCRSTTITAMIRGTLEAPSNRSVWLDGDRRERWITFEDVDGLHVMGGGTLNGHGQEWWIN

SEQ ID NO: 124340 - protein, 451 aa, Triticum aestivum
  unsure (1)..(451): unsure at all Xaa locations
  Clone ID: PAT_TA_18758.pep
MAADSPDAAAMAVAVTGTRTVAPAKTTVTLATFDLPYITFYYNQXKLLLYRLPQGAADFQDVTARMADALGAALAYFYPLAGRIRQEKGDGGALYVDGEDGAEGVEGRRRGRSPWTTLARSRXAGEEAEKLMQQLIPYTRVMNLGRLHRPPLAGQFTKLQDGLXVGCPFNHAVLDGTATWHFMSSWAELGRGAADLSLDRNPQTRHGTTSAPRRSRLPDRVGARACGXLVSSKKQSRGPXFSFSEPVVARIKAGANAALPPGAKPFSAFQSLGAHIWRSVSRARELGPADITVFAVFADCRTRLDPPVPATYFGNLIQAVFTGVPAGMLLGGPPELAAGMLQKAIGEHDPPPRTPGLDAYEAAPKLFHYSDAGPNCVAVGSSPRFRVYDVDFGFGRPERVRSGGNNKFDGMVYLYPGRGGDSGGIDVELALQPEPMQRLEKDEEFLQIAAA

SEQ ID NO: 124341 - protein, 134 aa, Triticum aestivum
  Clone ID: PAT_TA_18759.pep
RRAQLYAHMWTPDLCNIHNEPLIKNYRRVQSTRELAVQTLVRRKATDAMGRTARSRWLSCMRRVQNRSRGSGRRCGPNCTPPLAELHFPMGRTTRLCAESQSPAWTATVLVGALSRLDLAHELGNETRLSWNST

SEQ ID NO: 124342 - protein, 192 aa, Triticum aestivum
  Clone ID: PAT_TA_18760.pep
MSSRRENGSDGEGLGAEGGVPPSPLYAAPVVCLLRPAGDLGAGAFVGGVVGYGQGLITKKGFKGSLTNAGSAAKTFAVISGVQSFIVCLLKKLRGKDDLVNSGIAGCCTGLAFSFPGTPPAMLQSGATFAAFFCMLEGLDKQQAAMAHTLGGNALTFGHGKGGVLPPFTLPPILDASDALASCCQTLVKPKH

SEQ ID NO: 124343 - protein, 178 aa, Triticum aestivum
  Clone ID: PAT_TA_18761.pep
MGPRKAEELFRKLLEGGSKKQPRLLGLDVGSKYVGLAVSDQKNRIALPLSVLGRTKTNINLMADDFKTLVENYSLAGLVVGYPFNLQGQSSPDASQVSLLVGELCKTGKLDDLSYTYWDENFTSKCVEALLNPLKLNDPVETKTMTDKFAAVCILQGYLDNMNRALRSADKCDSASGQ

SEQ ID NO: 124344 - protein, 189 aa, Triticum aestivum
  Clone ID: PAT_TA_18762.pep
ARAPEVFEGSYYDVNSDETEKQLALLSNSEHSSSTNSSGSDDWVEPAAYVLNSTALLTREHRNVLDAFRLLQRDPNVQKMVMSRSCDRTVWDAVMNNEAVQEFRRSFQDGKEVNRKGNSCGPAVVLKWILANTQAKITEFFDNIAKIVSMLFHPQSDEDKPDLYSDAVKESFMLSVFVIIVAGVAAYQL

SEQ ID NO: 124345 - protein, 265 aa, Triticum aestivum
  Clone ID: PAT_TA_18763.pep
RLRHVLRGGARGARTVLLDAAAVGNLDRRLHQLLSEDRDADRRAPAEGPATTATAVAVQEWGERGYSVVTVSCRDRPKLLFDVVCTLTDLDYVVYHGTFDTDGDHAQQEFYIRRLDGRAISSEGERQRVIQRLQAAIERRASEGVRLELRISDRRGLLAYVTRVFRENSLSVTHAEITTRGDMAVNVFHVTDVAGRPADPKTIDEVIHGVGTESLRVDEERWPRLCSTEGDAGGGGGAGAGLFSLGSLVKKNLYNLGLIRSCSCS

SEQ ID NO: 124346 - protein, 361 aa, Triticum aestivum
  Clone ID: PAT_TA_18764.pep
MEVAPDLSAVSALALQVDLLQLPPEIPAPGAPALRGVLDHLFAHSLSLPDTVAVVSCLAQKAKANGAGFAGGAMLPSMMMQGGANVPPLSPRSPRRSRKPSGVGGHSNRCASPLRPATARAVKEVIPQFYFRDGRPLPYEQKRQCISIVEQLFAGHSNGLRIQEFRMVTRELCKLPSFFTTVLFGKIDKDNTEFVSRDAFMDFWVNSNMMTMDSATQVFTILKQPDHDYLTKEDFKPVLRDLLDNHPGLEFLKSTPEFQERYAETVVYRIFYCLNRIGNGLLSLRELKRGNLLDSLRHADDEEDINKVLRYFSYEHFYVIYCKFWELDTDHDFFIDKENLIKYGNHALTYRIVDRFFLGFP

SEQ ID NO: 124347 - protein, 267 aa, Triticum aestivum
  unsure (1)..(267): unsure at all Xaa locations
  Clone ID: PAT_TA_18765.pep
MLFNLDGATLPGDVSMSQVRSFANWRGSLNIPPLVEFKYLRVFIADFTSSSEDDNRKIDLTGLCKLYQLRHIWIRGCSKYQLPTQISGLQMLETFDIDGSCIPMDIFLLPQLLNLHVPFVQRLPEGIGKMRSLQRPRTRGLHNSLDSMKGLGELTNLITLSLVTGFSEDVDMDVLSSSLGKLCNLEFLLILSPWIPEALTXSPSXPPPNLVTLDMNRSCHVPXWIGELHNLQTLDLVVEKLDRDGVGILAGLPALIDLNLTFDSALE

SEQ ID NO: 124348 - protein, 224 aa, Triticum aestivum
  unsure (1)..(224): unsure at all Xaa locations
  Clone ID: PAT_TA_18766.pep
MASFLAARRLLSPAAARRLLPCTSPPPPAPAALCWLSTDASPPPPLPVPPLEPTVDPPKKDGASFSAGSGAGGAYRTGQGAASGGRRSGGAGYEEEQQKVLRASLLHVPRMGWSESAMIAGARDVAVSPAIVGAFPRKEAALVEFFMDDCLQQLMDRVDAGEGELLXNLMLTERLSRLVRMRLEMQTPYISKWPQALSIQSQPANVSTCLKQRAVLVDEIRQCC

SEQ ID NO: 124349 - protein, 105 aa, Triticum aestivum
  Clone ID: PAT_TA_18767.pep
KMAKFVQHLDAVNRVGTIGWQVVNPGHLGLNSSFPVPLSRLTCLQGRRRSGAEGGGGAGEGRRATSSVHESMLQISCSWMQSGGEDRRKKEKTGRRKRMPQNRRL

SEQ ID NO: 124350 - protein, 120 aa, Triticum aestivum
  Clone ID: PAT_TA_18768.pep
THASGTWYLSKSVKPISGHFPVGKMPFLSLAILGSLHICVIVGIFLQRPQHIIYVFGLENPINPLVISISSSEQVCTHVILHHVVVLSLMWIIMQRCYVLVLHMNMLFIMPLADRINCLP

SEQ ID NO: 124351 - protein, 328 aa, Triticum aestivum
  Clone ID: PAT_TA_18769.pep
MSWAPIENDPGVFTELLQQLQLKGLQVDELYSLDLDALNDLQPIYGLIVLYKWRPPEKDERPVIKDAVPNLFFANQIINSACATQAIVSVLLNSSGITLSEDLKKLKEFAKDMPPELKGLAIVNCESIRMTSNSFAKSDDYSEEQKSKDDDVYHFISYVPVDGVLYELDGLKEGPISLGKCPGGIGEMGWLKMVQPVIQERVDKFAQNEIRFSVMAITKNRKEIFIMELKELQRKRENLLSQMGDPSANRQRPSIERSLAEVAAQIEAVTEKIIMEEEKAKKWKTENIRRKHNYVPFLFNFLKILEEKQQLKPLIEKAKQNSHSRNPK

SEQ ID NO: 124352 - protein, 491 aa, Triticum aestivum
  unsure (1)..(491): unsure at all Xaa locations
  Clone ID: PAT_TA_18770.pep
DPRRLFYSDLKDDNALDCIVSKVSIVQVSPCVDNQSKSIPSSQYYYDMKYSQDYSTFSTFEMEDTHAKLQSSQVSSISMKKEDFNKTQKSHVPNKKELSLLDLYRGRGRVAPGRGLGARGGGVNLVTRWAVDDDEVACESFRMNHPETRVRNETTDDFLELLKEWQKLCKQYVKESEVQDNADAITEFGNGTPDDSAVPPEELEVWKLVDICFGDPSNVRKRCLYFKVRWKGYGPNDDTWEPIEGLGNCNDAIKDFVIEGHKRKILPLPGAVDVVCGXGPPCQGISGYNRNREFDEPFNVGPRVRGRVGMDIMQFLRPKYVYMENVLDILKFADATLAKYALSRLIGMHYQAKLGIMAAGCYGLPQFRMRVFLLGCHPEEKLPPFPLPTHGAIVKNNGPLAFERNLVGWSDSTSVQLEKPIVLEDILSDLPKVGNAEDRDEMPYVKGPQTEFQRYIRTFSSEVQGPKSHAAAKSKKSKPKLYDQSAVGHWS

SEQ ID NO: 124353 - protein, 189 aa, Triticum aestivum
  Clone ID: PAT_TA_18771.pep
PPSPPPRPWASPGPWASAAAPHPSTSRARRRHSRSRSTSARRCPSAINHCLPRRSGQRSRVRKLQYIADLERTVDSLQNMGADLAVRVASHFQLRNALSMENKQLRRQIASLQQAKLMKDGQTHFLKKETERLKQISARHRRSRSVTSCFEPGSIGADPSAINWQTVDMSKLSLNGSPAPVPPRGGYGL

SEQ ID NO: 124354 - protein, 187 aa, Triticum aestivum
  unsure (1)..(187): unsure at all Xaa locations
  Clone ID: PAT_TA_18772.pep
MPGNREEGPPRAGSKSRNFELQEEYDTYDDPFVQLPLAWNRRRIIEIVAARDLIFALAECGLCGAFNRTTNKRICHLNISPDEVIXRSLFYNKNNDSLITVSVXESDRYSSLXKCRTTPIEYIXEGSYKNGFPLFETESAEXPGLLFEFDDVNGKVLTFSAHDSTYKVFDLKNYNFLYSICDKDIQE

SEQ ID NO: 124355 - protein, 291 aa, Triticum aestivum
  Clone ID: PAT_TA_18773.pep
MFWRMTGLSAASPVDTILDKENFTLEELLDEDEIIQECKALNTRLINFLRDKAQVEQLLRYVVEEVPDDAEKKRSFKFPFIACEIFTCEIDVILRTLVEDEELMDLLFSFVKPDHPHSTLLSGYFSKVVICLMLRKTAPLMNYVQEHPEIVVQLVDLIGITSVMEVLIRLIGADETIYSNYADTMQWLENTDVLGMIADKFSSSDSPEVHANAAEILCAVTRCAPPSLAAKICSPSFVGRLFCHALEGSRPKSVLVHSLSVCISLLDPKRLASASYQAFRSNVSHGALVTA

SEQ ID NO: 124356 - protein, 428 aa, Triticum aestivum
  Clone ID: PAT_TA_18774.pep
REPFSQSAIKRSIDLFFEYPYNNFLHHHVENIIVSCLEGKRTELVEHVLNECDIVGKILAADKLSSLATESNGPTVPSEGKTPSKIGNVGHMTRIANKLIQLGNSNSTIQTHLQGNSEWVEWQTDVLVRRNEVENVYHWACGRPTSLHDRGRDSDDDDFRDRDYDVAALANNLSQAFRYGIYSNDDIEEAQGSLERDDEDVYFDDESAEVVISSLRLGDDPDGSLFTNSNWFTFDGERGINDRLAASVPSSSPNSEEASPDIEEADDGEAIGTEDQMETLGHGNGPAKEAEDAAECTKQTNFSTENEQLESAEGTERHPDVSIGRTEASTDEAASEAAESSAPATETQAERTVDKPAVSSDLDNPISEASPDPDVNVSDLAGSALSSEQAVRHDYVEVPIKTDAVVDTENKTDTVVESEAVGDVGSEG

SEQ ID NO: 124357 - protein, 108 aa, Triticum aestivum
  Clone ID: PAT_TA_18775.pep
QNSLPIPFLRDRLRCFRPPPVASVELVYVPSSARPRLAPMGFIQSNFSLLVVAADGIYLAQNYDEPDHDQKLHAGPNGQRHGVGPCLHEARAWQQEPGLLSTLPVLTI

SEQ ID NO: 124358 - protein, 373 aa, Triticum aestivum
  unsure (1)..(373): unsure at all Xaa locations
  Clone ID: PAT_TA_18776.pep
KHVVRLTKFDYRLANRLDSDLQKLRCRVNYHALRFTDPIQEMGEKIIQRMRERSTYFIALHLRFEPDMLAFSGCYYGXGGEKEKRELGVIRKRWKTLHASNPEKERRHGRCPLTPEEVGLMLRALGYRKNVHIYVASGDIYGGAKTLAPLKALFPNLHTKETVTSKDELAPFSKYSSRMAALDFIVCDGSDAFVTNNNGNMAKILAGRRRYLGHKRTIRPNARRLYSLFLSRGNMSWDAFSSKVHMAQKGFMGEPKELRPGRGEFHENPSTCICENTDPKTPTKPNLQSEQGLSNGTEGRKAITEPTVANHTNEELVGSSAEEDDASVEKEDDTSAEKEDGASEEKEEIADPEAEDDALVRPDDPELEEVLSD

SEQ ID NO: 124359 - protein, 84 aa, Triticum aestivum
  Clone ID: PAT_TA_18777.pep
DNSAMWLHGAAGSRAVSAGPPGFFQALQGLRPQRPLREVQQPSQYGGLGYPSFYQSQNGMHQEHPQNSAEGSLNSSQTPPSQTS

SEQ ID NO: 124360 - protein, 230 aa, Triticum aestivum
  Clone ID: PAT_TA_18778.pep
CLVEPCLQGRVISRGGDGISRGGDGDTFDSDDRVPKSKDLDGVLGMESAVVIIDDSVRVWPHNKNNMIVVERYTYFPCSRRQFGLPGPSLLEIDRDERPEDGTLASSLAVIGRIHQNFFSHPNLNDADVRSILSSEQRRILAGCRIVFSRIFPVGEANPHLHPLWQTAEQFGAVCTNQIDDRVTHVVANSLGTDKVNWALQTGRFVVHPGWVEASALLYRRANEHDFAVK

SEQ ID NO: 124361 - protein, 357 aa, Triticum aestivum
  Clone ID: PAT_TA_18779.pep
VRPRVRPRVRPRVRAGVGFSYSNTSSDLKTCGDERTAQDSLQFLISWMSRFPQYRHRDFYIAGESYAGHYVPQLARKIVEYNKASPSPFINLKGILVGNAVTDNYYDNIGTVTYWWTHAMISDSTYRAILKLCNFTSANVSNACNRAMSYAMNHEFGDIDQYSIYTPSCHATSDSSAASGNSTAPRRHRRAVLKFKDTLIRRRSNSYDPCTETYAEKYYNRLDVQRAMHANTTRIHYRWTACSDVLIKTWNDSELSMLPTYRMLIKAGIRIWVFSGDTDSVVPVTATRFSLSHLGLKTKIRWYPWYSAGQVGGWSEVYEGLTFASVRGAGHEVPLFQPRRAFRMFVSFLAGKPLPKS

SEQ ID NO: 124362 - protein, 371 aa, Triticum aestivum
  unsure (1)..(371): unsure at all Xaa locations
  Clone ID: PAT_TA_18780.pep
MDSTTNQFVRADAAAGASSANTAPLPAMLADALIGAGAGGGDGDPSAALQRLAALGDRMAAVRRLLVASISGESQPLSSSDIQSVSPRSHLPLTSSSQRRLLLLWSLPFPAPLQSRPPPAPIQELPAAASTADVLPQESTKGYDVVELDADELLAEHVHFCNICGKGFRRDANLRRHGRAHGDRFKYPGXALSRPGQAKPVDGRDVRFSCPFTGCNRNRAHHRFRPLKSAVCARNHFRRSHCPKLYACERCGGKKRFAVLADLRGHLRHCGEEAQWRCSCGTTFSRKDKLFGHLALFEGHMPAMSPPNKDAVTTTTEAPLDIMDEGGIEEQEDGGEGGFDPEFFKEWMEELKDDGVPAGGTVWPGRAAAGQ

SEQ ID NO: 124363 - protein, 117 aa, Triticum aestivum
  unsure (1)..(117): unsure at all Xaa locations
  Clone ID: PAT_TA_18781.pep
MARAQVMLMAVALVLMLAAVPRAAVAIDCGXHVDSLVRPCLSYVQGGPGPSGQCCDGVKNLHNQARSQSDRQSACNCLKGIARGIHNLNEDNARSIPPKCGVNLPYTISLNIDCSRV

SEQ ID NO: 124364 - protein, 191 aa, Triticum aestivum
  Clone ID: PAT_TA_18782.pep
MDGLPKSSIFSSRHYSEKSSPPLEHMKISFHPMSAFETSKLNLDFSDGNLHDNVDDMMLPTFQLLPGSSVPQPGSGSESEDDTFGRSYSYSSYDDLSPRLYSNSELWDQEDGIGLEDHELHNDSNQIGSSTTPVSSYMGFEQMNLSGEKSTISLSDIGDHNGLGSLKSHPAGELPNFDTFVSTSNHQNGDA

SEQ ID NO: 124365 - protein, 284 aa, Triticum aestivum
  Clone ID: PAT_TA_18783.pep
MELGWGVLGRFMVPIRLGPPPSPRPRYMGFEQMNLSGEKSTVSLSDIGDHNGLGLLESHPAGELPNFDTLMSACRLQNGDALIPHNPVNLSPDEDQMPPPPPLPPMQWRTMRQTTSLDEERDSTAKDMLKNASSLPPVHTPVQEQYLPPCAPPFPQGNVKEVNHQKVDVIKETSNLPNIFEIKSSLLQQIRDKPDLHKLNGHEKPKAVFNDVNSLDERGELLQQIRSKTFNLRRTNGSKTNTSSQSTESTANSSVVAILEKANAIRQAVASDEGGDDDNWSDIN

SEQ ID NO: 124366 - protein, 364 aa, Triticum aestivum
  unsure (1)..(364): unsure at all Xaa locations
  Clone ID: PAT_TA_18784.pep
MAPAPAPIRDLLTSFSPSSDFLALSSGDGRIKVWDAVRGHLQTEFADIPPVEVGALPETKRGHLALDYTCMKWVQLSTKKKRKAGSSLLVLGTGSGDVLALDVAAGHWKWRISDCHPGGVTAVAYSRHGRSVYTAGADGMVCKIDASVGSVAGKFKSSSIAISALAVSSDGTVLATAARLLPSLDASDNKKIQKSSGHPVSVRNMIFSNNGKYVLSSGVGERYVAIWKLGSGKSQSSSCILSMEHPAIFVDCMCSGTNATEGEIDVLAISEVGICYFWSGNNMDDLRNKKPTKIALSESSLSRTNQDFTIFAAKLQGIDGPNSAHVLLAYGSVVKPSFDKLLVCYGKDXLILGVSEDGVLLPTV

SEQ ID NO: 124367 - protein, 175 aa, Triticum aestivum
  unsure (1)..(175): unsure at all Xaa locations
  Clone ID: PAT_TA_18785.pep
SADAWADAWEEISEAGNEDDQDRGTKDNHSQVFDCEHQTDESHLTLNYEKKRVTSQHKDYQAPGQSSQNSVSRTEGRRSRSGKKGKKRPAHRRSQKTDDLSAVESDSNYSFRRDDDNATSGRDQVVSSSSRFASPEDSKYPRPAPALSPMGNNSEXELPVMLXKXPDTLKEVFVL

SEQ ID NO: 124368 - protein, 220 aa, Triticum aestivum
  Clone ID: PAT_TA_18786.pep
MANTTAACDQALEEYFAVYRLIYMYSLYTPVCTDGSSSSPLAKRVGVHGAAPKIFSKYHGWYMRPAGYDPCTTQYSEVYFNRPDVQAALHANVTKIGYNWTHCSDVIGKWNDAVPSTLPIIRKLVAGGIRVWVFSGDTDGRIPVTATRLTLNKLGLKTVQEWTPWYDRLQVGGWTITYEGLTFVTIRGAGHEVPMHTPRQALSLFSHFLGDTKMPPAAFS

SEQ ID NO: 124369 - protein, 191 aa, Triticum aestivum
  unsure (1)..(191): unsure at all Xaa locations
  Clone ID: PAT_TA_18787.pep
NTRARQQPAVKFAQYAGYVTVNEAHGRALFYWFFEATAGAAKKPLVLWLNGGPGCSSIGYGEAEELGPFLVHKGKPELKWNPYSWNKEANLMFLESPVGVGFSYTNTSSDLGKLGDKITGADAYVFLLNWLKGFPQYKHHEFYIARESYAGHYVPXQLAKKNFDGNKHGPKENRINFKGPMIRNALMGNET

SEQ ID NO: 124370 - protein, 394 aa, Triticum aestivum
  Clone ID: PAT_TA_18788.pep
AWNMQWGSLAHNHRSYEYEVVEVLSNFSVSAGVTVVPLVRIEGFVSLFMTVKDKSEIVVAPSELLRFSHSVPFYRTNGNEKVGVPGGFLELDTACLPIDLDAAFPCVSLHSCMSPGKKEGSTSIDLSTDSASSRGENEYISSEPKTSLQRNPDGPNSLGDFSEQNSPSLVYTYPDSEFYNFEECRSCEKFERGQIWALYSDVDNFPKFYGWVSKVELEPFKVYLTWLEACPQAEQEKQWLEQDIPVSCGKFKIRNWTTMYETNDTFSHLVCTGHDPKQQIEIFPQVGEIWVIYMDWTPDWTPSSPHACGFGIGEIIERTEASTKVSLLTQVNGYTAVFKPGKRKRVVEIPTRHNLKFSHRVPSFCLTEENGGKLSGFYELDSASVPDVFLYKHA

SEQ ID NO: 124371 - protein, 144 aa, Triticum aestivum
  Clone ID: PAT_TA_18789.pep
SSSLGTYLACQRRMQGWKVKQNSQAREASERPDQRGKRGADVQRDHGGRYLPETHAPRPLASTAQRPRSRSSTRTLAHITQPRHRGPARRTTQGLDGQGAGARQGGRGGDEVAAAGREGGGEGGGTQYAERREYPFLSDLCAPG

SEQ ID NO: 124372 - protein, 118 aa, Triticum aestivum
  Clone ID: PAT_TA_18790.pep
FLRVRNALAYNRNLLVRQVGNEGTPLRPRQRLEVYLFALFNEDMKPGPTSERNYGLYQPDGRMVYNVGLAQQQTTSAASLSLAASSAPPAMDVGKDLTSLCLISALAILLTSQAFLLG

SEQ ID NO: 124373 - protein, 381 aa, Triticum aestivum
  unsure (1)..(381): unsure at all Xaa locations
  Clone ID: PAT_TA_18791.pep
MAAPWWAAALVTLGVVGLAAGPRGCAAQPVVLASYAQPKLSLRPYDWTYLRVDLPASFSSTHMYSHADGDIPREHLRDLPKSDLAIICLMIANPPIPDTSDYYLDNLLSNFLAVGSFGNTNNQSNLVQCIPFQKNTTIVLTNGQISPGIWYIGYFNGLGPARTQSKMISRGRALSVSTSITVEGCPTSALWGPYCSQTIETIACSQFSRYNNSRDLLGLTINTRKILKTKENTRRTSFLSRSNHPIGHQLESNGTSVMGVENLITCAISNDSLCLRQGDIKFYFLDIVNQALQFEITATNFRLSQSASLICYLRCNALPQRDWHDYSGDISSAPVVIKLPNIGRWYIAIEILNXTQMRNTTAPMLDTICFSFDWQVTGCLN

SEQ ID NO: 124374 - protein, 111 aa, Triticum aestivum
  Clone ID: PAT_TA_18792.pep
FIAANLIATSLATPSPSAEDLTSILESVGCEIDNEKMELMLSQVKGKDITELLAAGREKFAAVPSGGGGVAVSAAAPAAGGAAAPAAESKKEEKVVEKEESDDDMGFSLFD

SEQ ID NO: 124375 - protein, 104 aa, Triticum aestivum
  Clone ID: PAT_TA_18793.pep
SADAWALTGSLPPSLGGLKGLLKMDLSNNRLDGRIPPELAGLESLTLLDLRNNSLTGGLPDFVLGMPALQDLLLSSNPLLGGTLMQRGWEKMASLATLDLSNVG

SEQ ID NO: 124376 - protein, 109 aa, Triticum aestivum
  unsure (1)..(109): unsure at all Xaa locations
  Clone ID: PAT_TA_18794.pep
LRFLTEVDHLGLKEETXLKVPGYSTPVQFVVLIPFEYPLEGGLGEIVVATRIGTMLGDTTIFVHPGNKRYKHLHGRYAIHPFNGRKLKIICDAVLVDPSFGTRSVKGVI

SEQ ID NO: 124377 - protein, 921 aa, Triticum aestivum
  Clone ID: PAT_TA_18795.pep
MDPITIAAVGWSVAMVGWVASATISKLLAKGFDYLEYDTAKKLAQLEPKILVLERVMEVVETSPYRPRLEQLFKRLKYAFYEAEEILDAVEYHCLEKQIKTGKLQPGGGSSLPKKDRLKKKESRMSNKKLVKSLKKIENIINEAHQILEKLNLSSISDGNIRHTMVVNPTTTAVSPQKVFGRDNDRDKIIAMLHEKEGGLDPSTSKGLCFSVIGIHGVSGSGKSTLAQFVYAHEKNDKQDNKEDHFDLVMWVHVSQDFSVWGIFKELYEAASDPKVPCPQFNNLNALEEELERKLDGKRFLLVLDDVWCNADVGNQELPKLLSPLKKGKKGSKILVTTRSKYALPDLCPGVRYTAMPITEVDDTAFFELFMHYALEDGQDQSMFQNIGVEIAKKLKGSPLAARTVGGNLRRQQDVDHWRRVGDQDLFKVWTGPLWWSYYQLGEQARRCFAYCSIFPRRHRLYRDELVRLWMAEGFIRNTDEGADAEDVGLGIFNELLSISFLQPGGQDWYNHGKEYYLVHDLLYDLAGAVAGTDCFRIDNNMIQKGESWAKDVPRDVRHLFVQSYDAALITGKILVLENLHTLVIYSVGGDTTVEEIVIKNILKSLPKLRVLAIALCLEKDGFICRPNILSVPESISQLKHLRYLAFRTDIECRVILPSSLNQLYQMQLLDFGVCMNLVFSCGDLINLRHVCSGPGLQFSNIGRLVSLQTIPAFKVSHEQGHEAKQLRYLNRLSGELSIYGLQSVESREEALAFDLAAKKRLAELTLSFGGSSEVAAEVLEGLCPPVGLVTLDIRDYDGLVYPKWMVGRQNGAPEKLQQLGLSGWSQPGPAPALKAFNHLRCLNLMHCSWNALPCNMEHLSSLETVIIIKCLNIRSLPTLPQSLTYFWLLKCDDGFMESCQTVGHPNWKKIQHICRKYFSE

SEQ ID NO: 124378 - protein, 123 aa, Triticum aestivum
  Clone ID: PAT_TA_18796.pep
DAPKPREELDLLFYQLQETARRVPNLQLECKIQIDVESFVNSFRPDVMEAVYSWARGSKFHQIMEMTQVFEGSLIRAIRRLEEVLQQLILASQSIGETQLEAKLEEAVSKIKRDIVFAASLYL

SEQ ID NO: 124379 - protein, 249 aa, Triticum aestivum
  Clone ID: PAT_TA_18797.pep
RPILYEKYLLLLLSSEVSLQSDDYENGIAQVTDALRVAPPSVDTFFAHLQLCRAYVVQGDLSNSRKEYMKCLQNRTNTEVGWVMLKQLESLCSVNRGSDEIEINLKECIERNGSYPSKWAALFNLACAQCFMRDEDFASAEKALAQACAEKDADSCILFLNGAMHMEIARRYAAPQYITRAASSLRKAQQKSQAAVPIISLLLAQAEGSLGSKAKWEKNLRLEWFSWPPELRPAELYFQMHLLASQSTA

SEQ ID NO: 124380 - protein, 44 aa, Triticum aestivum
  Clone ID: PAT_TA_18798.pep
RPRTRGLGLVCTSQVPSNRPDMSEVVNILELIRCPQDSPEAELG

SEQ ID NO: 124381 - protein, 145 aa, Triticum aestivum
  Clone ID: PAT_TA_18799.pep
GTRGLAKLLPLLDRYVLSSKVQSALGYMAPEFTCRTVKITEKCDVYGFGVLVLEVMTGRTPVEYMEDDVIVLCDVVRAALDEGKVEECVDEKLCGKFPLEEAVPIMKLGLVCTSQVPSNRPDMSEVVNILELIRCPQDSPEAELG

SEQ ID NO: 124382 - protein, 83 aa, Triticum aestivum
  Clone ID: PAT_TA_18800.pep
GDALPLKRELPLGVKRKLRQRRGPFSIMKKINDNAYVIDLPSDMGISNTFNVADLTLYHPEEALYEDNSRASSKQPGENDEEH

SEQ ID NO: 124383 - protein, 385 aa, Triticum aestivum
  unsure (1)..(385): unsure at all Xaa locations
  Clone ID: PAT_TA_18801.pep
MDGNKDDAVKALRIGKNALDAGDTARALKFLSKAKRLDPLLPIDHLLNPLLNKDDPSSSPASSSSSSAPHPPPPPPSRAASSAAGADGLRERKQKGKKKDGEEGGGDTAGVRTYTEEQLEVIHRIKKHSRDYYKILGLEKDCTVEDVRKAYRKLSLKVHPDKNKAXPGAEDAFKPVSMPFQCLSDAESRKHFDAXGSDDPPAYNRRAASTARSYNGFYEDDIDPGXRYSRNFSFSVGSRLPPPSIFGSFGRSISGLAGMHHAHGAQQGSGGSTVRMLVQLLPVLLLLLLNFLPSSEPVYSLSRSYPYEYKFQTQRGVTYYVKLPNFEDQYPHQSTERTTLERHVERDYYSIITQNCRVELQRRQWGLAYQTPHCDMLQKFEATAQ

SEQ ID NO: 124384 - protein, 138 aa, Triticum aestivum
  Clone ID: PAT_TA_18802.pep
SGRVVMYMPEVSKTHMGNTMRLGCRRTFFRKPDCLTSKLYGNPPHVDERHRHRYEVNPSFVPMLENAGLQFVGCDESGNRMEIVELQDHPFYIGVQFHPEFKSRPRKPSPPFTGLILAATEHMRTLTNVSNGDAGASE

SEQ ID NO: 124385 - protein, 136 aa, Triticum aestivum
  unsure (1)..(136): unsure at all Xaa locations
  Clone ID: PAT_TA_18803.pep
MARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAXRVTIMPKDIQLARRIRGERA

SEQ ID NO: 124386 - protein, 312 aa, Triticum aestivum
  Clone ID: PAT_TA_18804.pep
RPCVSSFREQASHVTKVPCVKVQYKLCQTFRDGMIPTDPIEVMYHCPEEEIAFGPSCWLWDYLRRSRASGFLLPLSGGADSSSVAAIVGCMCQLVIKDIDKGDEQVKADAMRIGQYRDGEFPTDSRELAKRLFYTVYMGTENSSEDTRSRAKRLAEEIGSFHFDVPIDSVVSAFLSLFERLTGKRPRYKVDGGSHTENLGLQNIQARIRMVLAFMMASLMPWVHNKSGFYLVLGSSNVDEGLRGYLTKYDCSSADINPIGSVSKQDLRAFLRWAAVHLQYSSLAEVEAAPPTAELEPIRTDYSQLDEVDMGM

SEQ ID NO: 124387 - protein, 369 aa, Triticum aestivum
  unsure (1)..(369): unsure at all Xaa locations
  Clone ID: PAT_TA_18805.pep
MQLGARWVHLPLETLEASSSRMGCSAEGPRAPAGWAPAYLVPRGARDLAHRGMHVRGFLCGAPSCIGPYSPAPLYGEIFYVAGQLGLDPHTMXLCPGGATALLELALRDSEAVANAFKSSIVSSAVHFLVYCSAHLTSTEKEAVEQKLQNSYIAHLDSARSGSYPTILYVLAPDLPKGACVEIKPTLYVPTDDYNDNDDDGDITREPEAGGSKPSSSKVPSEWSAQYSGLHDSCCLANTVAGKICSAVVSVTNDIASKICPSTEHLHPSKEHLKAITRFCAFQLAKTLTDNSFTWDDVTMLRFYYSVERAVAADVVSRAFSEAFAELGAADGSLRIDGAPVFNLIPVSGSGRSASMDDVVTCELLASKA

SEQ ID NO: 124388 - protein, 102 aa, Triticum aestivum
  Clone ID: PAT_TA_18806.pep
MPSHQNLYTDHVRPAFNPIQNDNYLTSRLLPQNHGSLSPYAQMSLQQPRNSQLANGHWDGWSDLRQGNNVPMSDMSRMLYPTEANNFHMLGSNDMYNRTFGL

SEQ ID NO: 124389 - protein, 117 aa, Triticum aestivum
  Clone ID: PAT_TA_18807.pep
VIPLLIHGTTGPAIRGSSTLEPHVHAPTPCAGWASKAEIKLGMPRTTSGLQSKRAPLPVAASAHRTLSTPSLTKLDGGLDYADFVRTLDDADLVGTLDDADAAAGDTGDEIGVLLPE

SEQ ID NO: 124390 - protein, 254 aa, Triticum aestivum
  unsure (1)..(254): unsure at all Xaa locations
  Clone ID: PAT_TA_18808.pep
TRRDDSAGGESACTALVAVLAAALHANHPLMPTRAELDALIRDGSSEWRRLCDDEAHMAQFPNRHFDLETVLAARTRPIAVEHDRAFVGFFQPESFASLSGAMSFDDIRPDIWREISAGERAPGEADVYIVSWNDHFFVLKAESDCYHVVDTLGERLFEGCDKAYMLRFDATSEMRALPSPDSSPSSGPEEEVXVATGKECCGEFIKRFLAAIPLREELHIEQSGCADAGAPHRRLQIEFHFTVLQQQQQDGGR

SEQ ID NO: 124391 - protein, 333 aa, Triticum aestivum
  Clone ID: PAT_TA_18809.pep
MAGAGSSSGGSGGGGGGREGDWDCGGCGNRNYAFRSLCNRCKQPRLLVDPNTPRDSKWLPRAGDWICNGCSNNNYASRKNCKKCNLPKEEAAMPQLSMGGMMPAYADYMARVQEIANAGYKMNFGNPAMQQQLLANANWPYGMAGRYGMQSSAWPFAGNSTNQFQGVPKDWRSGDWLCSCGFHNYSSRAQCKECNAPVPSGMASTTMKSTGADSSSTLGNKRLASEELGNDWDNKRLNPGNANYPLSAAGSDNLFMGQGAGNNNGQTTYSAYDNGNSMASGQIPGMSGVVGKGAKWREGDWLCTNCSNHNYASRAFCNRCKTAKESSVHPGAL

SEQ ID NO: 124392 - protein, 332 aa, Triticum aestivum
  Clone ID: PAT_TA_18810.pep
MAGAGSSSGGSGGGGGREGDWDCGGCGNRNYAFRSLCNRCKQPRLLVDPNTPRDSKWLPRAGDWICNGCSNNNYASRKNCKKCNLPKEEAAMPQLSMGGMMPAYADYMARVQEIANAGYKMNFGNPAMQQQLLANANWPYGMAGRYGMQSSAWPFAGNSTNQFQGVPKDWRSGDWLCSCGFHNYSSRAQCKECNAPVPSGMASTTMKSTGADSSSTLGNKRLAPEAPADGGVKITLAPGPPYSPLSAAGPELVLMAPGAGTCNGQSTSAAGDDGNALASGHVPGSPRVVGKGAKWREGDWLCTNCSNHNYASRAFCNRCKTAKESSVHPGAL

SEQ ID NO: 124393 - protein, 364 aa, Triticum aestivum
  Clone ID: PAT_TA_18811.pep
MVGPQYDLVGNPLGAVRATFERAAAAESGGRDPVAAFRSKDWGASEVFRSFLFEQGGLDKVPLLDASNLGLIKPNTLVRFRGMVQDMLGNEFYAGAFKDGSTWRTNKFTDFSPFAMPHPCDSHLWERHLFHCVPVPGQNSWTLESSPGPDLRQMANCLTPEQREKRKRDGDDVAMDVSENGNGESSSCSKKPKEDDVQIPSSSAEMPASENVPQMNGNDHHIPGSSFSCLVKIYDMPESQVKLNDVAEFIGVYTFDPELAAPNDNSDDIMFDLIEDVTAQLPPSKVPRLHCLVWRKLSSVDFLAKHPAVEPLPSLLKGIRQSLLSHLTLVLGKDDLAANCLLLHLLSRLRTRVDVVTVGRLSLN

SEQ ID NO: 124394 - protein, 244 aa, Triticum aestivum
  unsure (1)..(244): unsure at all Xaa locations
  Clone ID: PAT_TA_18812.pep
FGRPPREGQPFTESDLEELQARIVVAENLPDDHCYQTLMKIFSSVGSVKSIRTCYPQSPNGSGPVTNRSAKLDMLFANKLRALGWYENXRHGEEDVSFSDLRGNKHAEETXSTVKMRKGEHVSEERHWQIQAVGVAEGRGRGGRGRGRGYHNNNQYHHNNHPQQQQHYQNSNNQGNNNRSGAHPVGTPPSSHPVKAEQQQTQSSPPAGANKQLPGPRMPDGTRGFSMGRGMPQTSTPSISTSEP

SEQ ID NO: 124395 - protein, 150 aa, Triticum aestivum
  unsure (1)..(150): unsure at all Xaa locations
  Clone ID: PAT_TA_18813.pep
TTGEGIAAAGAVAEEGGGGADRPGRGGGDGERQGRRGSRSSKRVQQPDTXKPLFFVLLLYTKYLQQXHGDGELTALCRVLAFAVTGAEILKNYGLAVEKKIRTSTVEINDESRGRPFQKAKIEIELGKSEKFDELMASAAADAEEGEEEA

SEQ ID NO: 124396 - protein, 151 aa, Triticum aestivum
  Clone ID: PAT_TA_18814.pep
WIPRAAGANVAEAPAAAYLSLNITLLFTAVNPNKVGIRYAATAFDVMYHGVPLGVAAVPGFEQPAHSTRLLQTRVIVDRFNVLQSDAQDLIRDAAPSDRVEFRITGDVAAKILVLGFSSPKVQVSVDCAIDISPKRQSVTYKQCGVDGLSV

SEQ ID NO: 124397 - protein, 203 aa, Triticum aestivum
  Clone ID: PAT_TA_18815.pep
MKKASRFLKQLFSAIVAAVRERSAATRARTSAARTRFVFFGILRNKQLLRNAINSKIHAIVGGGSGSGQHLVAASGGGRTVAVLEKLPSFVADQGRRAAVLLNSLPSFAMGRDGGSDSPLVGGGGEEKEEGDEGVPKQLQLANAAPGSVIELARGAAERGGVEFKLEDEIDHVADVFIRRFHDQMKLQKLESFKRFCEMLERN

SEQ ID NO: 124398 - protein, 463 aa, Triticum aestivum
  unsure (1)..(463): unsure at all Xaa locations
  Clone ID: PAT_TA_18816.pep
DLRHVRVFSVDPPGCRDIDDALHCTPFPNGNFEVGVHIADVTNFVHPGTPLDEEASQRATSVYLVGQRIDMLPKPLTEDVCSLRADVERLAFSVIWEMTPDADIISSRYTKSVIKSCAAMSYVEAQARMDDSRLADPLTVDLRNLNSLAKIMRNRRCERGALTLASAEVKFEIDSETHDPLDIGIYQIRQANQMIEEFMLAANVSVAEKILQHYPLCSLLRRHPSPTKEMLEPLLRTASSVGLSLDVSSSKALAESLDNAKRDDPYFNKLIRILATRCMTQAVYFCSGDLSLSEYYHYGLASALYTHFTSPIRRYADVVVHRLLAAALDIAKLPPVFQDGPQLTGIADNLNYRHRNAXQMASRASVELHTLIYFRARPVDTEARIVKIRANGFIVFVPKFGIEGPIYLTAKGDKGADWVVDEVHQKVTKPGTNISYAVLQSVMIHMEVVEPQPHRPKLQLTLI

SEQ ID NO: 124399 - protein, 254 aa, Triticum aestivum
  Clone ID: PAT_TA_18817.pep
SAHASEDTYLESNSNAVDLGILSLTSTRCMAPNSKQIAEHRHECGGAHWAADLPADIVLAGRLMAQYIDSRMLTGKSSAISGPNLDLIQHYDIDSPTSKLESHICAIVLLLCLQKHYISDLSWKEETLSQLVLLICQVKVNSIAIGCMKSMDGGQGLTESKGYSAADDAVMCSVEQVKVAQAIYMSGSLFNHSCRPNVHAYFHSRTLFLRSTTYINSGSPVELSYGPQVGEMNLVKRQKSLQENYKFTCQCSSC

SEQ ID NO: 124400 - protein, 86 aa, Triticum aestivum
  Clone ID: PAT_TA_18818.pep
FGTRRTPCPPALHHGHPFLHWLSFLGFRVGSFVGAWLVLSLLSRLFHLANLVQNLRLAHRRVFILLVGSRQDCRLHSNFMFLVAIH

SEQ ID NO: 124401 - protein, 216 aa, Triticum aestivum
  unsure (1)..(216): unsure at all Xaa locations
  Clone ID: PAT_TA_18819.pep
MTRGSTAMTEEETRPPNNRGQKEFPPQVRTVNMIYATHIPKRERKHALKDVYVMEPVAPKFNPWSSCPITFDRRDHPTSIRHDGFAALVLDPIIDGFHLTRVLMDGGSSLNLLYQDTVRKMGIXSSRIKPTKTTFKGVIPGVEANCTGSVTLEVVFGSPDNFXSEELIFDIVPFRSGYHALLRRTAFAKLTRCHKPYSSSRCRPPXGXVPXRPRSL

SEQ ID NO: 124402 - protein, 329 aa, Triticum aestivum
  Clone ID: PAT_TA_18820.pep
HASELIENGYAPPDWVALLQVVVKRISVEDENESALASQLLGTIVDAGQEKVAAHIPGTVSNIANTITNLLPPVPDPWPQVVEQGFAALVAMVQAWDSPAPDENKEHEKSAWQLGQTAIAQTSSTVLQKAWLLPVEQMEPTLDSALPPPSCVNDASVLLEFILRSITSMEEITHMKAFELVVIWADIIAYWDSWEEEEDQGVFNAIKEAVSFHQRFDSSGFFLKMLPSQSANGSQSSVISRVSSFVTRAIAAYPSATWRACSCIHTPSDAPDFSLGAEDTRMTLAVTFGEATFSYFKGVSDSPAGIWKPLLLAISSCYICYSDAIQQGL

SEQ ID NO: 124403 - protein, 114 aa, Triticum aestivum
  Clone ID: PAT_TA_18821.pep
LQHMIQQLSFHHKRMAFMHRQVWNGTAKLLAEFLEPLRENQSGYPSHVASFARLHSSLAVSSSQLAILHVPSPTGLQMLSLVHQASRPTPLDAFSLSSTSPRCFSPPNPFIVSW

SEQ ID NO: 124404 - protein, 536 aa, Triticum aestivum
  unsure (1)..(536): unsure at all Xaa locations
  Clone ID: PAT_TA_18822.pep
MEISEVMGRIPEVCYPDKASVLWCVTACYRPLGSLLRGMPSLPGGRPWSRVPACPPGDRLSRGLARRCGASLTLGLSAVWNLSRLSTSKPGTAVWHIALQSSINRIDEVRMKAIRLVANKLFPMSSISKRIEDFANEKLNSVLEVIPAAESASAAEMGTPEVHQVYNIYITLNIXMVVLENISSVADALTLMSLYFALCTKKHSLLRRVFEIYGSLPQAAKQAVHRQVPILIRTIRSSPDLLGIISDPPAHCRDLLMQVLQTLTDGAVPSQDLISSIKNLYSKTKDTEFLFPVMAHLPKDEILSVFPNIVNLPXDKFQVALSRILQGSPQHGPIPDPSEILIAIHVIDPEKEGIPLKKVXDACAACFEQRTTFTQQVLAKALNNXVEQIPLPLLSMRTVMQPIRASPALVDFVMEIMSRLVSKQIWKYPKLWVGFLKCAILTKPQSYGVLLQLPAPQLENALNKNPVLKAPLVEHASQPNVRSTLPTSRVAALGLAEDQQQQPAPEAQSSQNQAAETSSSAAEATTEVTQESSAAS

SEQ ID NO: 124405 - protein, 182 aa, Triticum aestivum
  unsure (1)..(182): unsure at all Xaa locations
  Clone ID: PAT_TA_18823.pep
GDLVMVNGLLFQLSLPLNFLGSVYRESRQSLIDMKSMFQLLEEKPGIKGEPRPRPRGRTRGCIEFENVHFGYVPERQILNGASFTVPAGKSVAIVGTSGSGKSTILRLLFRFFDSTSGSIRIDXQDIRGVTLESLRKSLGVVPQDTVLFNDAIKHNIPYGRLSANDEEVYDAARRASIHDTI

SEQ ID NO: 124406 - protein, 131 aa, Triticum aestivum
  unsure (1)..(131): unsure at all Xaa locations
  Clone ID: PAT_TA_18824.pep
DASVGGYNIXVGTRVLINVWSIGRDPAVWDSPEEFVPERFESSKIDIKGHDFELLPFGSGRRMCPGYSLGLKVIHVSLANLLHGFVCELPDGVATDQLSMEEIFGLSTPRKFPLQVVMKPKLPGHLYARGH

SEQ ID NO: 124407 - protein, 175 aa, Triticum aestivum
  unsure (1)..(175): unsure at all Xaa locations
  Clone ID: PAT_TA_18825.pep
MKLRTKRPGWKSLVPLQLSRKSTMRFFLFPKVQASGQSPNDTPVYLNVYDLTPMNGYIYWAGLGIFHSGIEVHGVEYAFGAHDYPTSGVFEVEPRQCPGFRFRRSIFLGTTCLDPIQVRHSWSYNPVNYNGRFLTILIXERIATTLQGMCYKXDRXQIPKGVNRRQNSASATPPR

SEQ ID NO: 124408 - protein, 122 aa, Triticum aestivum
  Clone ID: PAT_TA_18826.pep
SLALLSVYLYIDFMYASIPGTSLHHEIHFPVLYEDPAPGGVGRPSFVRPGRRSGDGRTACEQGEQRDGAKRSGMEGRGIGVDRGRWPWLAAVVRAGGGHGAAAMRGRRGWGREGAWERGSAD

SEQ ID NO: 124409 - protein, 112 aa, Triticum aestivum
  Clone ID: PAT_TA_18827.pep
GELESRLAEVRTENSKLKDKLDVVKLSHNELTKELRSVENQLAAEGSRCQKLESQIAAAHKRLESASSLENELEALQQQISQAEQTMTTSQRRKSGGVWKWVGGSAEVSDNE

SEQ ID NO: 124410 - protein, 329 aa, Triticum aestivum
  unsure (1)..(329): unsure at all Xaa locations
  Clone ID: PAT_TA_18828.pep
NRKGGPAPRYDHSAAVYAEHYLLXFGGSSHSTCFNDLYLLDLQTLEWSQPDTQGAHITPRSGHAGMMIDEDWYIVGGGDNASGSTDTIVMNASKFVWSVVTSVSVRDPLACEGLTLCSTTVDGEKFLIAFGGYNGKYNNEIFVMKPKPRNFVQPRLFQSPAAAAAAASVKAAYAAITATDEKTKDIVATDDLDVKRAEPGSSSKEMVAEIDALNGEKGELESRLAEVRTENSKLKDKLDVVKLSHNELTKELRSVENQLAAEGSRCQKLESQIAAAHKRLESASSLENELEALQQQISQAEQTMTTSQRRKSGGVWKWVGGSAEVSDNE

SEQ ID NO: 124411 - protein, 149 aa, Triticum aestivum
  unsure (1)..(149): unsure at all Xaa locations
  Clone ID: PAT_TA_18829.pep
MSPRKDAGPSPAAAPATAPALTPSPFMPMCQMRRDECADLLKLISGVSRPLEDVVADFLARVPPERRLRFGSAIKFLLEDKVMFQPAERLIALAILHQGYSSQAXQIPLVPFLINVACDEISERPERVFLQLLANSSLWGRQGDLTSKK

SEQ ID NO: 124412 - protein, 223 aa, Triticum aestivum
  Clone ID: PAT_TA_18830.pep
MSDVVDEARWREQVFREHEFSVVRLHSVAANDFRANGFIVYHSKTRCLIVSCQHVVKIVEDGGTMYAYFSNSVAPYNARVLYTDEHRDLALLWAEEVVEPMTSLRFFDSPYASGWNVVALSFISLGASSNPILEPGTFSGDITNEPDEPHLHCSCSSKEAASGSPIILANVNEVVGVLGGASRASVYAVPVRTIKEFLGQRLGGVNMDMPIAGMVRLVALQQA

SEQ ID NO: 124413 - protein, 99 aa, Triticum aestivum
  unsure (1)..(99): unsure at all Xaa locations
  Clone ID: PAT_TA_18831.pep
SPWARPLLRYRWRGPLGPHRSPPRQHRCPVCVCAPPARSTGLPGSGPAGTRKRKVKRSVXELVEKEGIDWYEGNPGXIVLPTXGGPREYPVLEHDSDSD

SEQ ID NO: 124414 - protein, 178 aa, Triticum aestivum
  Clone ID: PAT_TA_18832.pep
MEQAMLARVLAVTSVGLSWAVVWSLLSQQLKPFSTPAILRTLDAAASDPVIGRDDDIDRVICILCRRSKNCAALVGPAGVGKTAIVEGLARRIAAGTVPEALAGARVAELDVGAMVAGTHWRGMFEQRLKDAIKKAEDSAGKLILFIDEMHMIIGAGDQRGGTGDAANILKPALARGR

SEQ ID NO: 124415 - protein, 471 aa, Triticum aestivum
  Clone ID: PAT_TA_18833.pep
MLLRSLLRRGAAAVSAGGVRAPAARSEPPASLASPPRGTRPEAKAKGGGGKPAASTSNRGKVRVKDPKGVASEDASASGESAASAGGADEIDAEFEMPTDPLPPTYDPALDVGPGGRPLFAFTDTFASFSHRGANAYVDFTLDEWKAMLPEGLPAGMLKEFQDTRRCAVMVRESFLDLRDNFRRIVDPAITAKCKDTKRQIILDGPRSCGKSIALAMLVHWARTEGWLVFYVPQGKDWTHGGFFYRNTYSDLFDTPVQAGKVLQDFLKYNETRLQQLPCQILEPIPLGEGTGVGMMKGADTVEMPEGSTLYDLIQTGITHSHAAVGVVVRLRKELSLVKDVPVLFAIDQYNSWFTFTEYQEPVTVRSCRSIHAKELTTVNAYRSMLHNDMMVGAFSHSTAVGKLRQELPDVPSDARLIFPRYTVDEAETVCHYYMRQKIIRHESFSEEKWKKIYYLSNGNGSEMRWLAAFI

SEQ ID NO: 124416 - protein, 55 aa, Triticum aestivum
  Clone ID: PAT_TA_18834.pep
GSTGHPKLIIKQHGTIENYRYVGDISVILKMSVYSLVIAQEYGGNRNSQSQSNNT

SEQ ID NO: 124417 - protein, 471 aa, Triticum aestivum
  Clone ID: PAT_TA_18835.pep
SADAWADAWVCPECNKISVTFDPFMYLSLPLPSTVTRMMTVTVFSGTGDSLPMPYTVTVPKNGVCRDLCKALSDACCLKQSEMLLLGEVYDYRIYRYFSPLELLNIIKDGDQLVAYKLPAGHEKLLRIEILHRNVDRFTPEPQFNARKLIGSPLVTCIPNDSTRKADIYAAVSAVLAPFVRAKVHAPGESLLNGSRPSLDGIVLRDNGASCEKGLSTSNVDEATSDAEFLPFKLYLSDDKGHIRNPVEEDSDHVFGLPMRLLMGWSDKEHEIYNLKYMDDLPDVFKPGFMSKKTRQEAVNLFSCLDAFLKDEPLGPDDMWYCPCCKEHRQASKKLDLWRLPEILVVHLKRFSYSRYMKNKLDTFVNFPIHDLDMTKYAKHTSGGDQPHIYELYAVINHYGGLGGGHYSAYAKLIKEDSWYHFDDSHVSSVNEEETRTSAAYLLFYRRVDGNSCAMSDVVPVDTHMVDSLEA

SEQ ID NO: 124418 - protein, 140 aa, Triticum aestivum
  unsure (1)..(140): unsure at all Xaa locations
  Clone ID: PAT_TA_18836.pep
MEQALTGEQMVAFQEAFSLFDKNGDGCISLEELAAVTRSLGLDPTNQELNDMMREVHMDGNGTIDFQEFLSLIARKMQDGDADEELKEAFEVLDKDRNGFISPIELMTVMINLGEKITDHEVEQIIREADTDCDRRVNYX

SEQ ID NO: 124419 - protein, 87 aa, Triticum aestivum
  Clone ID: PAT_TA_18837.pep
AVLGGRQNLDDQRMTIKSSQGILPTRPRTPLDCLVVHRSATLCRVWSNFTAQLLFTTVIRSLWEQAVRRCIRHLARIIIYFETGPQV

SEQ ID NO: 124420 - protein, 152 aa, Triticum aestivum
  Clone ID: PAT_TA_18838.pep
DLTRTSPRGGIKTSILEATLKGSFVMADYFFTSGHQHLMVTLKFDSHNSEIWDLKTRKVVHTLSVSGHKTTWVACHPKLPILVTMLDDGTVCLWDASTYRLEKMVHITNSECRDLVFVQDTNGRPRLVIAFETMIAIMKVNLPIANTSNASG

SEQ ID NO: 124421 - protein, 497 aa, Triticum aestivum
  Clone ID: PAT_TA_18839.pep
GDSRVIGCYIDLDRTENDASCKLAVSIGPSTLHNALPDGILNGLEIMKMGSGSGSAFTVGNNGSNKKLPIIIGSVLGVVGLLIIVLVVVLLCRRKKTDDKQHSKTWMPFSINGLTSLSTGSRTSYGTTLTSGLNGSYGYRFAFNVLQEATNNFDESWVIGVGGFGKVYKGALRDDTKVAVKRGNPKSQQGLNEFRTEIELLSRLRHRHLVSLIGYCDERNEMILVYEYMENGTVKSHLYGSDNPSLNWKQRLEICIGAARGLHYLHTGSAKAIIHRDVKSANILLDENLLAKVADFGLSKTGPELDQTHVSTAVKGSFGYLDPEYFRRQQLTEKSDVYSFGVVMLEVLCARPVIDPSLPREMVNLAEWGMKRQERGELHQIVDQKLSGAIRPDSLRKFGETVEKCLADYGVERPSMGDVLWNLEYVLQLQDVDSSTVSDVNSMNRIVDLSSQVQHVGAMESISVTMAEDGALHEPDHDLSDVSMSRVFSQLIKAEGR

SEQ ID NO: 124422 - protein, 82 aa, Triticum aestivum
  Clone ID: PAT_TA_18840.pep
VAPPPRPARPPPPPRRPGESARSGRESRCRASTSVEQHLLPRAPPPPPASRPFAATPPPSAAPARNPNPIPPCFAASPLEPR

SEQ ID NO: 124423 - protein, 146 aa, Triticum aestivum
  unsure (1)..(146): unsure at all Xaa locations
  Clone ID: PAT_TA_18841.pep
SADAWGISRIVSETFRLGLPGVRWFVMGDDDTVFLPDNLLAVLGRLDHRQPYYIGSPSESHLQNIFFSYGMAFGGGGFAISQPLAARLXRMQDACIRRYPWLYGSDDRIQACMADLGVPLTRHPGFHQTNVSGDFLGLLAANPGAP

SEQ ID NO: 124424 - protein, 558 aa, Triticum aestivum
  Clone ID: PAT_TA_18842.pep
MAPSIAPPSSPSCLRGKLFPRFTGTNSQPINSVLRCDISVSPTLASNSLRRTSSLHLANNNRIKSFHVCHAGVDPSERIVINGQASPSKTVQADAAALGTISADMAPVVDGFSADDDELDLDLPTEGFSSIPEAIEDIRQGKYVIVVDDEDRENEGDLIMAASTVTPEAMAFIVRHGTGIVCVSMKEDDLERLQLPLMVVAKENEEKLRTAFTVSVDAKEGTTTGVSAKDRANTVLALASPYSKPEDFNRPGHIFPLKYREGGVLKRAGHTEASVDLAMLAGLPPAAVLCEIVDDDDGSMALLPKLKEFAERENLKIVSIADLIRYRRKRDRLVERLCVTPLQLQWGSFESYCYRSLIDGMEHIAMIKGDVGDGQDILVRVHSECLTGDIFGSARCDCGGQLALAMTMIEKAGRGVVVYLRGHEGRGIGLGHKLRAYNLQDAGRDTVEANEDLGLPADSREYGIGAQILRDLGVRTMRLMTNNPAKYTGLKGYGLSVLGRVPLLTPITNENRRYMETKRLKMGHIYEDPPNGHTSGMSDEEQYQEDSGSEQDQTLEPQ

SEQ ID NO: 124425 - protein, 240 aa, Triticum aestivum
  unsure (1)..(240): unsure at all Xaa locations
  Clone ID: PAT_TA_18843.pep
SAHASAHASGIILQDVTVIFRRRGGDDLVQSHSEWARTVNSAPDVIHMTLFPIMTLLEAAIPGKDHLIRAINLYLEYKPPIEELRYFLEFQLPRVWAPIRDEHPLHQRKEPVCPSLQFSLMGKKLYINQEQVSVGRKPITGLRLCLEGAKQNRLCIQLQHLASLPKILKPYWDAHITIGAAKWQGPEEQDSRWFEPVKWDXFSHVSTLHLSTTSVHXGDXSGXSIFTRAXLGVWSFKPVK

SEQ ID NO: 124426 - protein, 211 aa, Triticum aestivum
  unsure (1)..(211): unsure at all Xaa locations
  Clone ID: PAT_TA_18844.pep
TESNISTTLTVLDVLPSTKVVPSTKLAASNAGPEEEAGKEEEATFAAAAGMAAAAGVEPSPVVXVPEWPAVGGVAVVATSGRMPTKYGCACPREFSFKYTGAPRSTKRGLSAVPGLSDTGDTSRVSGECHRGDKRXAEDMAESTRSRSTDDNKLTACGRWGADPLQHGNAGNYIAGHVITKARHEAKATSLLTINGEVDTIPLESQPKCRL

SEQ ID NO: 124427 - protein, 245 aa, Triticum aestivum
  Clone ID: PAT_TA_18845.pep
MASLFRARRRRSPEHEGDDGDGSGSGRGKRRRLSPEEGALVPAEGGRSPGWLSTIVTGAKRVISSVLFSSSEEQASGDEEEEEEEDGSEQDSDGNEDTRDTHGKIVPYSESKLAIEEMVLKETFSRDECDKMVKLLQSRVTDSAFPEAYEHGTPKETPRRNGHDFTGAWRSLNRNRNGPGSGPFFSTGPGNFSPGSPLQASPELCSAAVMEAKKWLEEKRQGLGSKPDHGPCTFDTDVLNADLKS

SEQ ID NO: 124428 - protein, 72 aa, Triticum aestivum
  Clone ID: PAT_TA_18846.pep
DGWGRWQSKILHSSPLTMRLGSEQMNSLFIGPSRGVDYQLPCMMTQNTIKPLCNVIHILYTSSYADALLRQK

SEQ ID NO: 124429 - protein, 217 aa, Triticum aestivum
  Clone ID: PAT_TA_18847.pep
MGDDSDGEAEEYLFKVVIIGDSAVGKSNLLSRYARNEFNLHSKATIGVEFQTQSMDIDGKEVKAQIWDTAGQERFRAVTSAYYRGAFGALLVYDISRRGTFDNVGRWLQELNTHSDTTVAKMLVGNKCDLENIREVPVEEGKALAESEGLFFMETSALDSTNVNTAFELVIKEIYSSVSRKILNSDTYKAELSLNRVSIDDGDSKDSQKQTSRFGCC

SEQ ID NO: 124430 - protein, 72 aa, Triticum aestivum
  Clone ID: PAT_TA_18848.pep
MASGEKVDYVFKVVLIPGTGRRASRGPGAVRAQRRSAWPPRQPSVSSSRRARVLVQDRAHRGHRRGPARPGR

SEQ ID NO: 124431 - protein, 321 aa, Triticum aestivum
  unsure (1)..(321): unsure at all Xaa locations
  Clone ID: PAT_TA_18849.pep
MAASDVPMSPELEQVDGEIQDIFRALHNGFQKIDKMKDSNRQSKQLEELTGKMRECKRLIKEFDRVLKDEEKSNTSEVNKQLNDKKQFMIKELNSYVTMRKTYQSSLGNKRIELFDAGNDQVAEDNVQMASEMSNQQLIDSGMKQMDQTDQAIERSKMVVAQTVDVGAQTATTLTQQTDQMKRIGNELDSVHFSLKKASQMVKEIGRQVATDKCIMGFLFLIVCGXVIAIIVVKIVNPHNKSIPDIPGLVPSCTSFHKIRKLPYVVSFRLLLAFGHGNLVACISLALNSKHPMSSVSLVASFFLLVAVSFVCMVHFGCVVF

SEQ ID NO: 124432 - protein, 114 aa, Triticum aestivum
  unsure (1)..(114): unsure at all Xaa locations
  Clone ID: PAT_TA_18850.pep
EERPPGVGVHKAPPPPPVPEPAHPSPTRPTPTPPAAPSPPXVCPPPPPPXPPPPPPPPCAASAVRSPSGGVPARPAQLWPSLRLRPWVRRCQVLRPLAGRWLHVEGVLLSLGVS

SEQ ID NO: 124433 - protein, 189 aa, Triticum aestivum
  unsure (1)..(189): unsure at all Xaa locations
  Clone ID: PAT_TA_18851.pep
MARFPRARNLPARRGRSSSSDARSSCWKTKEADEQSDLPLACEKREWKGATCPVCLEHPHDAVLLLCTSHHKGCRPYMCGTNYHHSNCLEHFKEAYAKEKLALGDSAESALNLPFSPNTEPANKHPSTMELACPLCRGDVKGWTXVEPARQYLNRKKRACVHDACSFVGSYRELCKHVNSKHPSAKLGG

SEQ ID NO: 124434 - protein, 90 aa, Triticum aestivum
  unsure (1)..(90): unsure at all Xaa locations
  Clone ID: PAT_TA_18852.pep
XXXGXVDSLXRPCXXYVQXGXXPXGQCCDGVKNLHNQARSQSDRQSACNCLKGIARGIHNLNEDNARSIPPKCGVNLPYTISLNIDCSRV

SEQ ID NO: 124435 - protein, 288 aa, Triticum aestivum
  unsure (1)..(288): unsure at all Xaa locations
  Clone ID: PAT_TA_18853.pep
EKSKHQDKETSLKKAAAKGXAKPEQKAKKKQVEERDIAPLTLHYRRNMLQELATFGYKPAESSEKGNLDTLVKAIAGVSVSSNADSAKPGKAAKRREKKAKEEAAREQRIQEEQTNLVSDRMLEDEKLGRRLEPLGLTIHEIKPDGHCLYRAIENQLSLHSKGTTQYNHQELRQMTAKYMREHAADFLPFFLSEGKAESGPDPSESFEKYCEEMESTAAWGGQLELGALTHCLKKHIVVYSGSFPDVEMGKEYNKSGPGGDPSIRLSYHRHAYGLGEHYNSVIPTELS

SEQ ID NO: 124436 - protein, 560 aa, Triticum aestivum
  unsure (1)..(560): unsure at all Xaa locations
  Clone ID: PAT_TA_18854.pep
ETIQNEFGATVSRIVEGETKVSKLGKLQCKNEGSSKQDVKAEDLRQMFLAMTEEVRVIRLERAVRCHYWRSLPQVPPHRPFAFATLSLLGCAPLPFLLGLFPIKSELEYLSFMYMNPGDFAELRKRVDDIFKAHEQELEEANKILKQKIAEDQFLDLVSVETEVRSVCKELYSIYKTALKSKSSLNEVNQVAQLRIIIKPKSCNGVGPLCTAQQICYHVLGLVHGIWTPIPQAVKDYIATPKPNGYQSLHTTVIPFPSESMFHLEVQIRTEDMDLIAERGIAAHYSGRGVVSGPVHPGISSGRNLDGKVICLNNTGFALRVYVLLLSIIAVVCXSLLQFTLFLLPRLTKKNPPIICHLPXIGWLNAIREWQEEFVGNMSSREFVDTITRDLLGSRVFVFTPKGEIKNLXRGATVIDYAYLIHTEIGNKMVAAKVNGNLVSPIHALANAEVVEIITYDKFSSKYAFQRHQQWLQHAKTRSARHKIMKFLREQAALSAAEITADAVNNFVADLEDESDSEQLIPTTQNEDYKFNWQKILSSNKLSFVNKNSDGFLPVNNIHT

SEQ ID NO: 124437 - protein, 204 aa, Triticum aestivum
  Clone ID: PAT_TA_18855.pep
MGVKGLTKLLADNAPKSMREQKFESYFGRRIAVDASMCIYQFLIVVGRTGMETLTNEAGDITSHLQGMFSRTIRLLEAGIKPVYVFDGKPPEMKKDELLKRHAKRNEATEELTKAVEAGDTDAIEKFSKRTVKVTKQHNDDCKRLLRLMGVPVVEAPCEAQSQCAALCKNDKVYAVASEDMDSLTFGATRFVRHLMDPSSRKIP

SEQ ID NO: 124438 - protein, 271 aa, Triticum aestivum
  unsure (1)..(271): unsure at all Xaa locations
  Clone ID: PAT_TA_18856.pep
LRGPGPASLDALRSRFRCTASIRLSPSPQLRGFAFDSEWALRCTDEPCYVPVYCAXCPFTSNFRPLFPAFCSLXPRNNPFALSEPSATPSXILRVKVSKVGHGMGSTHLTTRAWSVRAIHLLCSAPVLSSRTTGLDXLQIIVDDHPRDRWEFRXPCQDGRSLRKMADDEPFVFLGALFIIMKVVAHFIPTVISQLRAFLIVRVQNLNLRIRRGSSQLTERALTVLDVKRLWSKLRLSSKTRDLSKGASNARAWAPSLPPRAPAAPAAFRPA

SEQ ID NO: 124439 - protein, 165 aa, Triticum aestivum
  Clone ID: PAT_TA_18857.pep
PATVPGDACCWDCNPAHPAAQTIHAHQQCLVKPANGSEIHHIPTRPKSGGLVDNDSDKNYNPSPKRPVKADEALNIPMASRSSLDSKDADGNILKKPKLEDKPSPLSPASSINNSDGPDDVGKASPGSPGHHQHAPLCPVSGRLTRVAPSIGPEETTDSEPSTAG

SEQ ID NO: 124440 - protein, 424 aa, Triticum aestivum
  Clone ID: PAT_TA_18858.pep
LELLDPEHNINFLDHYLDVPIDLSKVLFVCTANVIDTIPNPLLDRMEIISIAGYITDEKMHIARDYLEKNTREACGIKPEQVEVTDAALLALIENYCREAGVRNLQKQIEKIYRKIALQLVRQGVSNEPALEAVIVTPSVEPTDGGSATIVKDEELNDPAVKDPEEAKELSLKETLVTEPALSTDTLSTPEGNKDTDGVKEEAVDKAVKKVLIDSSNLDDFVGKPVFHAERIYEQTPVGVVMGLAWTSMGGSTLYIETTKVEEGGGKGALVMTGQLGDVMKESAQIAHTVSRAILRDREPDNQFFANSKLHLHVPAGATPKDGPSAGCTMITSMLSLAMGKPARKDLAMTGEVTLTGRILPIGGVKEKAIAARRSSIKTIIFPAANKRDFDELADNVKEGLEVHFVDTYSEIYKVAFQNETETS

SEQ ID NO: 124441 - protein, 281 aa, Triticum aestivum
  Clone ID: PAT_TA_18859.pep
METETEWIGGLDDMEVGTAVKGVVLPEHAADLDEMDAEGTADADADAGGEATATTEEKECWEYVAEWEYEQALTFRDSWISIWGAKFGSFDQTTDIQPMRYTDAEAPGGYAQPLDSLQIYSIKVAEIRGGLRWPIHVYGMIAARDIVDRNRNIVFHRSRDHCQTLTKEDSCLVMTGPTRPIVMLGAMNFEITLKVKEGSTESRDKVLSFLAVPHDTVNCLELSCATDRKYISKLSTLEFTMSQIARSVEATISVQMVDGSSWPHGVRGEFSACTTSMADRK

SEQ ID NO: 124442 - protein, 231 aa, Triticum aestivum
  Clone ID: PAT_TA_18860.pep
MATAMMAAATTSCSPRRALLKPAASSSSAPPPRPQPRSFLKQLPGLAATAAAAAVASVPLPALAVEMEKAALFDFNLTLPAITIEFLLLMVALDKLYFSPLGKFMDERDAKIRAELGGVKDASEEVRQLEEQAQAILKAARAEIAAALNKMKKETTTELEAKLDEGRRRVEAELVEALASLEGQKEEAIKALLAQIVSLSDELVKQGPPIRVKTLEFYASRSIRRNRPVFP

SEQ ID NO: 124443 - protein, 193 aa, Triticum aestivum
  Clone ID: PAT_TA_18861.pep
SFCTKKKTEKKKAPTRSLQAAVVVFAEWQPVCDGEVKDGTMHASDQHHYNLLSELSGSDTAPTLQNLPMAYPTISIDGDIVYLFSSTKTRHMEKLELVIAVDLRNKTFRGVAELDVQNNYVVKPAFCTSEICIYLRKSAGTSVELKRTKREAVKPVGKKEGKPTRVHVNELTCRRRPVKKGVLEVVKLLEATW

SEQ ID NO: 124444 - protein, 136 aa, Triticum aestivum
  Clone ID: PAT_TA_18862.pep
ETAKKKKKKALRGGGAINWHQSLVDPWWLWWPAWRWRRQRRRDGFRARWRSSAVRCRWWPATMRCRKMVMVVRRCHKDGVMPLQGGVIHVKSWLRCSARQCDGACVRRGGGSWGTSGRLGAAPCVHEHDNGQSMVK

SEQ ID NO: 124445 - protein, 329 aa, Triticum aestivum
  Clone ID: PAT_TA_18863.pep
MAPGSKAEKIAALDAGAWMFNVVTSVGIIMVNKALMATHGFSFATTLTGMHFATTTLMTLVMKWLGYVQPSHLPLSELVKFVFFANLSIVGMNVSLMWNSVGFYQIAKLSIIPLLCIMEVLFENFRYSRDTKLSIVVVLVGVGVCTVSDVSVNAQGLVAAVIAVCGTALQQHYVNYLQRKYSLNSLKLLGHTAPAQAASLLILGPFVDFWLTRNRIDTFHYTSTVTFFIVLSCVISVGTNLSQFICIGRFTAVTFQVIGHMKTILVLTLGFLLFGKEGLNFHVAFGMILAIVGMIWYSSASSKPGGKERQGLASEKAQKSPQSELDDKV

SEQ ID NO: 124446 - protein, 592 aa, Triticum aestivum
  unsure (1)..(592): unsure at all Xaa locations
  Clone ID: PAT_TA_18864.pep
IGKHCSKKRKNIYKLQGLELNDAHDLFIQKVFDKTMDLDEQYPELVEQTNMILKKCKGLPLAIVTIGGFLANQPKTALEWKKLNEHISAAELQMNPELEAIITVLNKSYDGLPYHLKSCFLYLSIFPEDYNIKLKRLLRRWIAEGYPGVVRNKSTEEVAEGYFMDLISRSMLLPSQRSICDGKRIGXSCQVHDLIREIGISKSMEGNLVLRLEEGCSLNTQGTARHLAVSSNWERDQGAFESIVDMSRVRSITVFGEWEPFFLSDKMRLLRVLDLEDTTGLVNHHLEHIGKLLHLRYLSLRGCESICHLPDTLGNLRQLDTLDIRGTSIVMLPQTIIKLQKLQHLHAGFPTKGNYLCTRHLLHTYGFNQPDACTSLCCGAATPCIMMDKDYGGVVLPGGARKLKSLHTIRGVHVAYGDAVIQEIGRLSGLRKLGVMGINEKNDVKFCSAISNLSHLESLSVQSDKGCLDDITSPPKNLRSLKLEGRLGVLPEWIKKLQNLVKLKLSFTTSSQVEQDAAMEVLGHLPNLSILRLSGCLFKAXELHFQKDAFRSIVVFDVEGLGGIKSVNFDXGAMPELEQLKVTDACKRGGIG

SEQ ID NO: 124447 - protein, 143 aa, Triticum aestivum
  Clone ID: PAT_TA_18865.pep
MAPGSSIVSVTEVPESDCGDRGLSEALSSIRLDGDSTSKPSWAASLVNVGLSSLTGLNDLLECPVCTNSMRPPILQCPNGHTICSSCKHRVDNHCPTCRQELGNIRCLALEKVAESIQLPCKYQSLGCTEIHPYQNKLKHEEL

SEQ ID NO: 124448 - protein, 93 aa, Triticum aestivum
  Clone ID: PAT_TA_18866.pep
FWGQSPATLGAGAPAPRPPPAPPAPKPPPVPPEPPPTPPGPPPTPPGRGAWPSGLGPLRRTLSAGARFLRSLRERIPIFFLWMAQPMHQRSRT

SEQ ID NO: 124449 - protein, 135 aa, Triticum aestivum
  unsure (1)..(135): unsure at all Xaa locations
  Clone ID: PAT_TA_18867.pep
MSGNDSQAAADRIKAQALSNAKGLSRAQAERAAEAAARNVNAYGQKXEGGPSRWQERKEAKRQMYLMSTETAVRLGVRPNAAPASATAGGQCQKCFQPGHWTYECKNERIYISPPSRTDQFEAPYVSDAEATGTL

SEQ ID NO: 124450 - protein, 235 aa, Triticum aestivum
  Clone ID: PAT_TA_18868.pep
INNLPLQSQIKNLTMEDMDIGIVCDDGSPGSTASRTATPAPNENDYLIVIPYAHIFALMLKALKLPPATYYHKICPGAKNRVTVTFISSLELLDGALVPSSLSGAILDSYEDAEDSAAIEAIRYMENAYGKEMRDYHYTHVKKLENQVTDLVKWLVASNKTIKKLRKTCYYAVRYMSSYSAQIENTTTARHLKGRDSTKGVMKTAPASIEGLTQRLRYIAMKFEQRLEATRNSFR

SEQ ID NO: 124451 - protein, 241 aa, Triticum aestivum
  unsure (1)..(241): unsure at all Xaa locations
  Clone ID: PAT_TA_18869.pep
MASSSFKVTRISEGAVKPASETPDHTLPLAWVDRYPTHRGLVESMHIFRSGADAAPAVIREALGKALAFFYPLAGRIVEQPEKGCPAIRCTADGVYFAEAVAECSLEDVRFLERPLLLPKEDLVPYPADDLWRVEPHNTIMMMQITKFTCGGFVMGLRFNHASADGMGAAQFIKAVGDMARGLPEPAVKPVWDREKFPNPSIKPGPLPELPVLALDYIVLDFPXGHIDALKTQYKAHSGKF

SEQ ID NO: 124452 - protein, 404 aa, Triticum aestivum
  unsure (1)..(404): unsure at all Xaa locations
  Clone ID: PAT_TA_18870.pep
MASSSFKVTRISEGAVKPASETPDHTLPLAWVDRYPTHRGLVESMHIFRSGADAAPAVIREALGKALAFFYPLARRIVEQPGGXCPATRWTADGVYFAEAQAECSVADVRFLQRPLLLPKHDRVPCPAFDLWGGEPHIPIMMIHFRMFTCGDFVMRTXWQASSGIGIGRSSLELWLDRGWLGFDILVAKCWFVFVPVFVVFTYFVSTSFEQYVTILRTIKMIHTCIWLLQLKXKTATLCQCRTPALNLEPDATVKLCFFASVRHLLKLDAGYYGNSIFPVKMSRSKKVLESSVMEVIDMIREAKQRMAVEFFQFAKEETRQDPFQMSFDYESIYVSDWSKLGFSDVDYGFGPPMFAGPLVNNDFIASVVILKAPLPLDGARMLASCVTKEHSQEFARGMKEDLP

SEQ ID NO: 124453 - protein, 146 aa, Triticum aestivum
  unsure (1)..(146): unsure at all Xaa locations
  Clone ID: PAT_TA_18871.pep
MWRPFRQLMPKKHSGPSGGLEGRTIDVGNVKVHVREAIAEGGFSCVYLARDLTNPAKQYALKHVIVQDKELLDLVQKEIXVMRALKGHPNVVTLVAHALLAGRRPLCESARRGLLDLRTEGLYRTGAYLRMLNGLPITADPLCYRI

SEQ ID NO: 124454 - protein, 217 aa, Triticum aestivum
  unsure (1)..(217): unsure at all Xaa locations
  Clone ID: PAT_TA_18872.pep
RPKFSKKLESVYTASGEKKINLITHSMGGLLVKCFMSLHGDVFEKYVKSWVAIAAPFQGAPGYINSGLLNGMSFVEGWQSKFFISKWTMQQLLIECPSIYELLASSTYHWEDTPLLQIWRESLDDNGKKSAILESYXQDEAIKMIQKALSKHEIISDGNHIPLPLNEDILIWAKETQDILSQAXLPKSVKFYNIYGIVYDTAHTVCYRSKRDPISKS

SEQ ID NO: 124455 - protein, 200 aa, Triticum aestivum
  Clone ID: PAT_TA_18873.pep
MESFDSFAKTGFSSRKGRKPNGLITVLLKKFWPGLFCPRPDRDPQQRVLAMSWAHYEACSNAEYVTTAKAVITKFWQLYRVVDEHNARADVVLLAAAKKKARQLQYEVRWVAVSQYYHYYLHQKMTKTQAQMLRLTLRKEQFMMVVPRWCYGRHDGWASLVDRCLGVDAEFAARASRPGLTVETTGHTAKETGTTGASRP

SEQ ID NO: 124456 - protein, 408 aa, Triticum aestivum
  unsure (1)..(408): unsure at all Xaa locations
  Clone ID: PAT_TA_18874.pep
MEAPPGPDPMVLDGPPPLAAAVVRARAATEKTRTEGGDPVAGHRIPTTIDGKNGEPRRTICNMAGLLVGTGSFGIVFQAKCLETGATVPIKKVLQDRRYKNRELQLMXPLHHPNVVSLKHCFFSTTSRDELFLNLVMEYVPQTLYRVLKHYSNAIQXKPLIYVKLYMYQLFRXGLAYVHTVPGVCHRDVKPQNVLVDPLTHQVKICDFGSAKVLVPGEPNIAYICSRYYRTPELIXGATQYTTSLAIWSSRFLLAXLLLGRCLFPXETLTVEATRRRVSRIXATPPPVNGNSGAWNPNHAEFRFPQIKAHAWRTRFSTRMMPXNAIDLASCLLXYSPNQRXSALDACAHSVFDELRVPNARPAKGRPFPNLFNFKPELADASPXELINRLVPEHVRRQNGPNFAHAGS

SEQ ID NO: 124457 - protein, 139 aa, Triticum aestivum
  unsure (1)..(139): unsure at all Xaa locations
  Clone ID: PAT_TA_18875.pep
MEPRQWMTTIVLTDDLVVEILSRLPLKSFCRFKCVSTSWLAFSSDLHYRQKLPRTPVGLLYQKKRAWHCHPSCGDFPQVTGILXSTLSFVQCYERPLELKHCSNGLLLCYHGGMPSKGISDAIVCNPATQEWMSLPDTE

SEQ ID NO: 124458 - protein, 65 aa, Triticum aestivum
  Clone ID: PAT_TA_18876.pep
QDSWYSSFLQEAEFNEVMMVPSSEQLHSGKGWACDLMAHSSLLLRRDDRGDSPLEFCVHGKWTRM

SEQ ID NO: 124459 - protein, 312 aa, Triticum aestivum
  Clone ID: PAT_TA_18877.pep
VRFGFSSPSQSTGLSTTVGGSTSQPSPASTIFGSKPPQPQGTMSQPPQSSATQFSSSFPIVASGVAAASSSGPGTVSFGAGASPPGTLLFGAGASSSGPGTVSFGAGAASSGGPGSVSIGGASSSGTGVFSFGAGVSSSGPGTVSFGATPSSSGSGTMTFGGTPSSSGPGTVSFGVTTSSTGPVFGNSPFGSGAAAFSGSGSGFAFSSPSSSTASSLAAASTSMFSSSSTASSSAALSNPFGSASSSPSMFTFGQSASSGGAFSFGAQSAPAFSSQAPPVYSFTSASASMNLSTPQPAFGMTNANTGFGMGS

SEQ ID NO: 124460 - protein, 191 aa, Triticum aestivum
  unsure (1)..(191): unsure at all Xaa locations
  Clone ID: PAT_TA_18878.pep
MKGTQGSQLRKSRSWWWDSHISPENSKWLSENLQEMEMQVKEMLGLVEEEGECSAEKAEVYCQERPVLVAHIKKFYCMYRALAERYDNVTGELRKNIPSSLQPHGSFGAPESDSETQSPPSTEQKPKTRSDCFDVSIGXSGVSSDVWQQHIXAFSSSSESESELDESKKXNGHSMFYALSQRILSLKLTFM

SEQ ID NO: 124461 - protein, 147 aa, Triticum aestivum
  Clone ID: PAT_TA_18879.pep
GRPGRYRRVETEILRSEATPAMRLLDELLNIHDGSDDDKWLKACRKHMIEVFPREDPFTMVFPPGFDMEKHDGQIKLPPQDDDVLLRGEFVREVDELLKEVEAEQEKSKLQTGYDPESVATMLKQQEKLRTIRQVEALLELAATLKW

SEQ ID NO: 124462 - protein, 155 aa, Triticum aestivum
  unsure (1)..(155): unsure at all Xaa locations
  Clone ID: PAT_TA_18880.pep
MTRASTLDFRRKTQGQNNWSGPLRLVNVVRNKFPTYKNGTNGIVIKFADEPETPXLKESVAKGTADLLDRRQRLSVRELAMKFEKGLSTATLLSNETLSYCIGFNSQVKCKQVALLERDILLKDLKSVLESLRGQVAGKYKDEFEGSVSMGDILA

SEQ ID NO: 124463 - protein, 222 aa, Triticum aestivum
  Clone ID: PAT_TA_18881.pep
MDRELEEANCKFAWLKLACAEYELDSCATLLSELKVLLTKFPSMPPSFERTPNAVAELRLARAIYEFAVIFSIRVKDQDAFERNFFQLKVFYMDTRGILPPSPEEYRILGLNLMRLLAENRVAEFHTELELLPPRALDHPCIKYAVELEQSFMEGTYNRLTDGRQAVPHETYLYFMDLLAETVRDEIADCSGQAYDHLPVDDTRKMLMFSSEQKLLEYISEI

SEQ ID NO: 124464 - protein, 529 aa, Triticum aestivum
  unsure (1)..(529): unsure at all Xaa locations
  Clone ID: PAT_TA_18882.pep
RGAKXAYLMKHPLAVERIFYDSVPEVLFWPVFVIATLAAMIASQAMISATFSCIKQAMALGCFPRIKIIHTSKKVMGQIYIPVMNWFLMIMCIIIVATFRSTNDIANAYGIAEVGVMMVSTALVTLVMLLIWQTNLYLVLCFPIFFGAMEFIYLTAVMSKLLEGGWLPLAFSSLFLCIMYTWNYGSVLKYQSEMRGKISLDFILDLGSTLGTVRVPGIGLVYNELVQGIPSIFGHLLITLPAMHSTIVFVCIKYVPVPYVPLEERFLFRRVGQKDYHMFRCVARYGYKDVRKEDHGSFEHLLVESLEKFLRREAQELALEVSTMEAERDDVSEVSEIVPSSPAIAAEDLHTPLLSDQRPGDDSRMLGMEGSVPLLPSSSMSAEEDPSLEYELAALREAMASGFTYLLAHGDVRARKQSFFTKKFIINYFYAFLRRNCRGGTATLKMPHSNIMRVGMTYLGRALPYCACAAKLNLVLAPRLWWNATPPGSLGICTAAVNKVTAASGQLPKILVAELALCLPCCILANLFG

SEQ ID NO: 124465 - protein, 248 aa, Triticum aestivum
  Clone ID: PAT_TA_18883.pep
MAATAAASPSSSLLLSRRHGASSSSSSASRAGASRLRAPRCVLGTAEQLRVVEAGKPVGGADPWAAAWTPKTPAQEARLAALPQEARDSRLKIFSGTANRPLAQEIASYLGVDLGKILIKRFADGEIYVQLQESVRGCDVFLVQPTCSPVNENLMELFIMIDACRRASARSITVVIPYFGYARADRKAQGREAITAKLAANLLTEAGSDRVIVCDMHSAQALGYFDIPVDHIYGQPVILDCLASKTIS

SEQ ID NO: 124466 - protein, 207 aa, Triticum aestivum
  unsure (1)..(207): unsure at all Xaa locations
  Clone ID: PAT_TA_18884.pep
MASRMASKDIITLKGSAAIVSEFFGYAANSILYNRGVYPEESFGKVKKYGLPMLLTQDEAVKTFLTNLTSQLSEWLEGGKLQRIVLVIMSKATGEVLERWNFNIITDGEVVEKGAVKEKSDKEIMREIQAIMRQVNSCISFLPCLDEPCIFDVLAYTDXDTTVPFTWMESDAKLIENPQMVKLHSFDTKIHKVDTLVSYKVDDLDEQ

SEQ ID NO: 124467 - protein, 211 aa, Triticum aestivum
  Clone ID: PAT_TA_18885.pep
MASDRERPRRRPSPDPVAVLRGHRAAVSDACFHHALPLLFSGAADGELRVWDTASHRTVSSIWAHGGAAGVYSIAAGSGLGNTIISQGRDGLCKGWAIEEAGLSRRPIFTIKTSTYHFCKMSLVKVPCSAHGTQTNLSGSNSGTEPQRVPIEDNTGSDGLNPAEGTQEYEQGSSLDGQNILTIAAQESFEVELWDIKNSTKIMCLPKRCSA

SEQ ID NO: 124468 - protein, 160 aa, Triticum aestivum
  Clone ID: PAT_TA_18886.pep
MSVTLHTNLGDIKVEVFCDQVPRTAENFLALCASGYYDGTVFHRNIKGFMVQGGDPTGTGKGGASIWGGKFADEFREALKHGARGTLSMANSGPNTNGSQFFITYAKQPHLNGHYTVFAKVIHGFDVLDLMEKTPTGPADRPLAEIRLNRVTVHANPLAG

SEQ ID NO: 124469 - protein, 496 aa, Triticum aestivum
  Clone ID: PAT_TA_18887.pep
MAMRSSTATSLLSSTATSLLSRTLRLLEPSAHRVPRVESRAASSSTGGGDPSGQEPAPAPMDSPIKVFSDLRGGGARGAAIDAGGSARKPLSLWPGMYHSPVTNALWEARSSIFERKMDAGGNADAGPQTELLTKKPAQSRTSIVYKFAADDILREQYRDPWNEVRVGKLLEDLDALAGTIAVKHCSDGDSTTRPLLLVTASVDKMVLMKPLRLDTEVNIIGAVTYVGRSSIDIQIEVTQVDQDGDVQSDPIALTANFTFVARDSVTGKSAPVNRLSPETEREKQLYAETEAQDKVKKRKREEQKGVLEKGVQKLGAEAERLKALLAEGRVFSDFPALADRDSILMKDTRLETSMICQPQQRNLYGRIFGGFLMHRAFELAFSTAYAFVGQRPCFLEVDHVDFLKPVDVGDFLRFKSCVLFTQLENKWQPLVNVEVVAHVTRPELRKSEISNTFHFTFSVGSDALKNGVNIRNVVPSTEEEARRILDRMDAEGLFD

SEQ ID NO: 124470 - protein, 239 aa, Triticum aestivum
  Clone ID: PAT_TA_18888.pep
TYDGVRLLSMLDEYMIVRQEKEQEKKRQRDQKKLHDQLKAEQEALYGSKPSPSKPQSIKKAPRHSMGGVNRRVSMGGATMQAPKTDILHSKNVRAAKRTEDIAHLSPASRGLDIGDLPIKKLSFNATALRDPQAPPCPVAQIMPPPSSVPSTPARSVTNDTEDENRTPNPKTFGAALNLKTPMTVAAPMQLAMTPAVANKVTAAPVSLVYEKPEPTLPEAIEYSFEERRLAVYLSREVV

SEQ ID NO: 124471 - protein, 110 aa, Triticum aestivum
  Clone ID: PAT_TA_18889.pep
MSASSTPVDASGEPIPTSSVLMAASKHIAVRCRPENVAFLNCKKKDPNPEKCLEKGRQVTRCVFNLLKELHQKCPKEMDAYAGCMYYYTNEFDFCRKEQEAFEGACPISE

SEQ ID NO: 124472 - protein, 154 aa, Triticum aestivum
  Clone ID: PAT_TA_18890.pep
MSKVFARYGDMPLKNDQDFQCFRYSGSVDDGFPIITFHFEGGLPLNIHPHDYLFQNGELYCMGFQTGGLQTKDGKDMVLLGDLAFSNRLVLYDLENQVIGWTDYNCSSSIKIKDDKTGSIYTVNAHDISSGWRFQWHKSLFVLLVTALCSYTMF

SEQ ID NO: 124473 - protein, 232 aa, Triticum aestivum
  unsure (1)..(232): unsure at all Xaa locations
  Clone ID: PAT_TA_18891.pep
TRPERTKXXEKEEAEVKKRQKRQEEEALKEQKRREKEEAEMRKQEKKQQEDALKEQKRREKEEAEMRKQQKKQQEEADKEQKRLEKEAAQLKKQLAIQKQASLMQRLFKSNDSEKPKSGENDSDVHTVDPGTTKKEISAATSIIDSSFSLKESWTLEYLQRLQITGWQKLSSYNRSSRWGIRHKPKEAFKELKLQKTSDDMIDEILSTPNEDACHNSGQENEPDKLGNDIDM

SEQ ID NO: 124474 - protein, 144 aa, Triticum aestivum
  unsure (1)..(144): unsure at all Xaa locations
  Clone ID: PAT_TA_18892.pep
MAGALGVKATPFTYAAHALGAAAAAMVLVWCIHFRGGLALEAVNKNLIFNVHPVLMLIGFIILGSEAIMVYKVFPGLSHDTAKLTHLILHAIAIVLGAVGIYCAFKFHNESGIANLYSLHSWLGIXAICLYGIQWILGFVTVFF

SEQ ID NO: 124475 - protein, 238 aa, Triticum aestivum
  Clone ID: PAT_TA_18893.pep
MAGALGVKATPFTYAAHALGAAAAAMVLVWCIHFRGGLAFEAVNKNLIFNVHPVLMLIGFIILGSEAIMVYKVFPGLSHDTAKLTHLILHAIAIVLGAVGIYCAFKFHNESGIANLYSLHSWLGIGAISLYGIQWIFGFVTFFFPGAAPDVRRGALPWHALFGLFVYVLTLATAELGFLEKMTFLQSSGLDKYGAEALLVNFTALVVVLFGAAVVVAAVAPAAKVEEPEGYAPIPVIG

SEQ ID NO: 124476 - protein, 388 aa, Triticum aestivum
  Clone ID: PAT_TA_18894.pep
MAAAGGEAAAAALAAAKKRAASRSWILFDAAGEERELDADKYAIMHRVDINARDLRILDPLLSYPSTILGRERAIVLNLEHIKAIVTSEEVLLRDPSDENVIPVVEELRRRLAPSSSAQHDGKDNLSGQHDAEAAEEDESPFEFRALEVTLEAICSFLDARTTELETNAYPALDDLTSKISSHNLDKVRKLKSGMTRLTARVQKVRDELEQLLDDDDDMADLYLSRKLAGASSPVSGSGGPNWFPASPTIGSKISRASRASAATIHGNENDVEELEMLLEAYFMQIDGTLNKLTTLREYIDDTEDYINIQLDNHRNQLIQLELFLSSGTVCLSLYSLVAGVFGMNIPYTWNDGHGYVFKWVVIVSGLFCAFMFVTIVAYARHKGLVGS

SEQ ID NO: 124477 - protein, 181 aa, Triticum aestivum
  Clone ID: PAT_TA_18895.pep
EESESQSGRVGGRVGELLRIPPSLPILGGTVFPLLRQYRVYGTHHSLTWSSLQTTGRKQNLNGGRSAQCATSHGGASVSHANGAPKDSPLPDSLLRDARILYCASPAMGHNKEAHPESNKRVPAIVDALEKLELTPKHRGSQVLEIQNFYPASLDDVARVHSRTYITGLEKLSVKVLDRKF

SEQ ID NO: 124478 - protein, 421 aa, Triticum aestivum
  unsure (1)..(421): unsure at all Xaa locations
  Clone ID: PAT_TA_18896.pep
GDGASGDTTIPTDSWRQYRVYGTHHSLTWSSLQTTGRKQNLNGGRSAQCATSHDGASISHANGAPKDSPLPDSLLGDARILYCASPAMGHNKEAHGESNKREAHPESNKRVPAIVDALEKLELTPKHRGSQVLEIQNFYPASLDDVARVHSRTYITGLATAAGSRLSAGAGITLVDSVAASKLGLSPPLGFALIRPPGHHAVPEGPMGXCVFGNIAVAARYAQHQHGLKRVMIIDFDVHHGNGTSDAFYDDPDIFFLSTHQLGSYPGTGKMNLIGQGSGEGTTLNLPLPGGSGDYSMRCAFDEVIAPSAQRFKPDIILVSAGYDAHALDPLAGLQFTTGTFYMLASSIKQLARELCSGRCVFFLEGGYNLQSLSSSVADTFRAFLDEPSLAAQFDDPAMLYEEPTRRIKEAIEKVRHLHSL

SEQ ID NO: 124479 - protein, 154 aa, Triticum aestivum
  Clone ID: PAT_TA_18897.pep
SMGVCWVRGPQVFPADGCPARGAIGLLGPWYGPPFARRVLSTRPGVVPDVLFRWPGRELGRLAARQVLCWCRLVLPVVALLARRIVPGELHSREAVFPAAWVLLCFTPVEWSVCGLVPCAQALPVSGALWCYQWMSLSEHIFLAFSPAPGPRTP

SEQ ID NO: 124480 - protein, 145 aa, Triticum aestivum
  Clone ID: PAT_TA_18898.pep
SGRKHGRETTSSRRKEKLLKFFNKYDTTLDIFIFLRLVVAIQMCSHREVYEPLIPGLRGNYNLEDWCFWRVTPARRFTDHVMMLALATALEVPLRVERVRGGYDPDIYTVPGVLRPRVTLLYSGDHYGIIYPRAPPAENSSHQAS

SEQ ID NO: 124481 - protein, 92 aa, Triticum aestivum
  unsure (1)..(92): unsure at all Xaa locations
  Clone ID: PAT_TA_18899.pep
FRFHPESDLPNFSFTLNGIGRSELRFLLAFAVSTANPFFFQPRHPVSPFSPTAGPLPLVICPSTQVXDPXKVKXPLIPEXTHXNRLXXTPXR

SEQ ID NO: 124482 - protein, 227 aa, Triticum aestivum
  unsure (1)..(227): unsure at all Xaa locations
  Clone ID: PAT_TA_18900.pep
VRLSELCKSENGLVAIPVHGNAYGKGLPYAPENWPSPGDQWQWKVGNRIAAGGHWVDRYLAPPSRFRDATGKKTTFTSRLKVGEFIKSNFPDVDPSTFFSXVIWKIPAAEGGIQRGTLQVERVEPEDGLADPDGPCKARNKACNLGKEGFIESSPAGNCDICCVHPDFCRTCCCILCGKAVNNSFGGYSYIKCEAVVAENYICGHVAHLDCALRIFMAGTVGGSIGL

SEQ ID NO: 124483 - protein, 359 aa, Triticum aestivum
  unsure (1)..(359): unsure at all Xaa locations
  Clone ID: PAT_TA_18901.pep
ELLKVGVIYDDGVNDALDLYAIAVDPRNPYRVAVSGSDEFVRLYDTRKYLHGDFGCPIDYFCPPGLITKNQDGITGLAFSQTGEILASYSCDNIYLFASEHGLHFNDFKVGVLPLFGDGVGAALPLYKDKLPEPRSFVGHRNKQTVXGVNFLGPNCDYVASGSDCGHVFIWRKKDGELMRAMKGDKRIVNCVEQHPSEIVVASSGIATDVKIWAPGDCDPSMIDFDEDDADTFMFSSMSDDDSDISDLMDDFIFAPPGSGSGSSDGDDDVEDTDDDDDEVFTVGYQITGQHQPGNNRGPSAHLLDYLHLNVSNFQFKKLPIDGNNFCKAGTGGKPTIIAICAMQFSTLSINCCTSAATL

SEQ ID NO: 124484 - protein, 129 aa, Triticum aestivum
  Clone ID: PAT_TA_18902.pep
MLIQLSRATRARSAVAAVSRVARPNAVQVRGFIAPTVSRKADFVQELYLKELKAYKVPVVKESDAEGNVQTFSVPKTPASPEETDLAGNLKEYESMAVEIEGQDTSAQSAGAPKVADWLEAEEDEEPHH

SEQ ID NO: 124485 - protein, 112 aa, Triticum aestivum
  Clone ID: PAT_TA_18903.pep
CFSVAFENLSDANYEYAIYVVLPRKLLFNYHKNRYLLHCLLLGNFLRCVPFIHVMTPTNTIKNIMKIPKIVVSSLKRFMDVPLSASVTLEYLDEGVHVITSFHTLCADKMGG

SEQ ID NO: 124486 - protein, 166 aa, Triticum aestivum
  Clone ID: PAT_TA_18904.pep
PPRRGLLLLPPPPAVAGPGSRGGGRRRGVPLRHLLGPWSSDPLFCSGTLPRLWPRWTLSAAPGVAHPPDLGLVVVPEAATCSIRPPRHGPGWRHYACLDWPQLSPSRRIRCSGGCWPLIPAGSGRWDRRRRSYVSRGVFGGFGGEPGGVAGLLAGGGCDAPGWWMP

SEQ ID NO: 124487 - protein, 622 aa, Triticum aestivum
  unsure (1)..(622): unsure at all Xaa locations
  Clone ID: PAT_TA_18905.pep
TFDYNYVRVSGAAPQKCFCGTAKCRGYIGGDISGSGISIQHVAEAEHFEPMVTYKDAEEMLGNACSHGANPSVAELQHETSIQQEDSNSCPPVTPDSEPHQTSPILFDDSELENSWEMWSPQDAEDPTRTPVHVPRTIDSTLQQLPVHDTEPLELLPKAPNTMDGSNAPNVNQSAGSSDLGLNLVVPGFHAKKKNNLKDQRDVKSSSCSINNENTXGVEGRLNNLLDRDGGISRRKDSANAYLKLLIFVTAAARDNAAAAAARDNAAAAAAHDATAMEHENAATPAERDNAGGTSKSARDLSLILDALLKTKSRSVLLDIINTNGLQMLHNILKQNRDTFLRRPIIRKLLKVLEFLALKGILRAEKINEEAPREEMERFRDSMLKLTRHSDKQVQTIARHFCEKWIHPYMDGPVSTSKWCTDSYSNRRKRKSRWDYQPESHYKMVGSLVRKVYGELGLQAGLTRNRSQPVMGSSSTGTDDDVPPGFEPQQGRSVAPGFCHPNLNISYGIPIAHVQHLGTPEVEGGGNRGQKWKVAPGVPFIPFPQLRRGSPCPSTSTQMSCHDAMRQNNSSGHRGRGFDRGGRVQRNGRNGARTRYPYDHQGRRFPSNHHRSERWQPWPRRT

SEQ ID NO: 124488 - protein, 321 aa, Triticum aestivum
  Clone ID: PAT_TA_18906.pep
MRLKLSFPQRNLDSPVTDGNAVPDCGETGSFHRVLQGQELLMGSRAQGAARSRSPDVAKFRPPDHQRFSANAGSYMPQQSPAEFPYHSSGFGESLGFPEVLQGQEMSRALRFYSQGSAFDARAQHGPFGYAQRSAAPGGLSPAAQGYALGQFTPSAAAAAKVSSPSSVLMFNQATVPQFDLEGRTSGYRGAYGGQCPPGIEMVRETEEAWPCAQRRTPSVTGTGCRRFEEWIKASTPASADGGRPRSAAAGDVVGRSSCRLFGFSLTDQKVLGGAGEGAAKEGDADDEAAECADPRVLDLFGRGHPAPAALHAIVAAPLGM

SEQ ID NO: 124489 - protein, 94 aa, Triticum aestivum
  Clone ID: PAT_TA_18907.pep
QLIKGHATETTSSGLQNGGGRTSGNHVLTASQNSLLATRCHCKVAVYTSRNQEFSNSRKAGIQSTPLLCRICESQQAGARELYSPRPRCGDQRT

SEQ ID NO: 124490 - protein, 203 aa, Triticum aestivum
  unsure (1)..(203): unsure at all Xaa locations
  Clone ID: PAT_TA_18908.pep
TXSQNXGNKXWXSQXTPPXPNXDPRIPSPPPLXXEXSTQSFKKKIXGPSSSHPKSIRLRSAAILIELXGAIPDANGGDXFVRSDFPXKPGGRRRRREPRATDPAQAASLDLSVHGGGPGGRRDGRGVAVRCEEQRAAVDGSAARSTSSCTAFWIWIRCFQCSWGRMAVVLIKQTKRSYECTIDIINNCSCTAYAYTNLSSNGA

SEQ ID NO: 124491 - protein, 208 aa, Triticum aestivum
  Clone ID: PAT_TA_18909.pep
MARRSRRRPSSPSTVTPPPLEDDDLLHEILLRLPPQPPYILRASLVSKRWRLLATDPKFLRRFRVRHRRPPLLGVFSSDYKRNISFRSTLDPPYRIPPERFSLPLEPWAMLDCRHGRVLFVEKKRHQLIVWDPITDHCCFVADPPLFKIGVLGGAVLCAAADQGHVHGDCRSSPFKVVVLGYAKHDDQEAGCVASVYYSETGIWGDLI

SEQ ID NO: 124492 - protein, 480 aa, Triticum aestivum
  Clone ID: PAT_TA_18910.pep
MGKKRKLEPKSTLAANSPAAKAPAAAKIAEPAAPPPQPETLAEYYPTSSQTVAQESGSIAGGAAVKQEVGGEEDEWEEVEEEVEEEEEEEEVEEEEQQQAEEGDSDPASIQALLEVFPKEQLVELLRDAAVRHGDVRESVRRAADADPAQRKIFVHGLGWDTTVDILTEAFRPYGEIEDLKLVSDRNTGKCKGYGFILFSRLSGARAALLEPHKKIGNRTTSCQLASLGPVPPGGAANNPMLATDPAPAPAALILPPVSEYTQRKIFVSNVGADIDPQKLLQFFSKYGEIEEGPLGLDKATGKPKGFALFVYRTLESAKKALQEPHKSFEGVMLHCQKAIDGPKPNKGGGYGATTTSGRKGAAGYGASSHSLPGSVGAGYGMASPASLASMPGSVPGGPGMNPALGQALTAFLATQGGGLGLNNILGVGPNSSGVPNSGSSGALGGGGVPGMPGSYMGGYGGGGGYGGPPGGPGRNYMGH

SEQ ID NO: 124493 - protein, 94 aa, Triticum aestivum
  Clone ID: PAT_TA_18911.pep
ETCARVFRSYGAFLIMTIYLTTLDHYHYKMQHGIHNVQLFINVAFTYSPGMIFKHVAYTNLLMIQLLILMYKHAKPLPVWMMHMSMFLSGFGDV

SEQ ID NO: 124494 - protein, 185 aa, Triticum aestivum
  Clone ID: PAT_TA_18912.pep
HTELGARMGLTASLVHCNLSLHASAIGRVVTEQISGRSIRGNGSHNGISFCSFSVACAHGLGASSLALSCIDLQRCCCVMIISVQQVFISVRPVFRGFGVGNPTARNRTRLRSGGISRLGARRATLPLVGHRDAGAHLEPCQTSARASLDPARRRNSGVRRRGPGGGSRAAFPLARLFIHPFFGR

SEQ ID NO: 124495 - protein, 113 aa, Triticum aestivum
  Clone ID: PAT_TA_18913.pep
VRGRVGTHLDPATTNGIAAAGAPGRGKIILLLRLPPDDPACLLRASVLCKTWSHNVSRPGFRRRAHELHRAPPVPGILLQDRRNKRVPRFNPSTAASFSLAVPEVPPDGEKML

SEQ ID NO: 124496 - protein, 638 aa, Triticum aestivum
  unsure (1)..(638): unsure at all Xaa locations
  Clone ID: PAT_TA_18914.pep
RGAAAAAQGGAEAAAAAAVRHEGSARRYGRRKIGRSFFHTRYFVLDNKLLAYYKKQPKDNNMVPLKSLLVDGNCRVEDRGLKTHHGQMVYVLCVYNKKEKDNPITMGARNIEEALVWKKKIELLIDQQQDTMTAKNRKAFASLDFDMDLGGPLSFSDPDSGPEDEEEPRPMLLRRTTIXRAFLILYMTGPKSLILVCQIRTTPIKLILERTGGCLDARMXLRSCAVPGLGHPLATTPGPSGRAVGVVVPSWAALRGLVMSMDVTRYEWDSARRDARFVVGVVRRTASLFLPRLLNWASRVVWPRDLCYVRYWRRNDDGSYVVLFRSTEHPNCGPQPGFARASIESGGFKITPLKPVNGRPRTQVQHLMQIDLKGWGVNYVTSFQYHSVLQMLNCVAGLRVYFSQNDDVHTIPRIPVMNTMASVPTFRKDQKHQKADSKTKQADSANENSDMIDDESEDDDDFQAPESSLEEDGNVDSDAKGSDPIDLSCFSGIIRQDANEKSRNSWSVPDSNIFKVRSKNFSHDKSKVSAPRYLMELVAADWFKDTKRMDHVAKRKGCAAQVAAEKGMFSFVVNIQIPGSTHHSLILYFVTKSLKKGSLLQRFADGDDDFRNSRLKLIPSVPKGXWXMRKXVGSTCPG

SEQ ID NO: 124497 - protein, 204 aa, Triticum aestivum
  unsure (1)..(204): unsure at all Xaa locations
  Clone ID: PAT_TA_18915.pep
KGXSFRXLPSCXGEXSRRKKLGLKLAPYRELQQRCRVCSAAARARCPPPPHLAGGVRAARAQEWARRRRGSQGRGEVSRRASAPPEPRKGARRPGGWPSRLGRGVAAEDDKMEGVLAWENGGRLAGFGRGSTASGCCGWRRGRGGGLTGDTKEVLPWTQRRRLQRNDAGVHILLQTLRAAGPGRCDARARATPVSDLVRCSGSA

SEQ ID NO: 124498 - protein, 228 aa, Triticum aestivum
  unsure (1)..(228): unsure at all Xaa locations
  Clone ID: PAT_TA_18916.pep
MSVEYNMDEALKARNTAESKFHARDLRGARKYAVKAQNLCPSLEGISQMASTLEVHLAAESKIDGESDWYRILSLPAFADEEDVKKQYRKLALQLHPDKNKSVGAEEAFKLISEAWSVLSDTSRKTIYDQKRSDHSVVNVTNGMYTYDKKATKRARKMLLLPPPPPXAAAAAAEATARPAGVDTFWTYCNRCRLQYEYLRMYLNHNPLCPNCHHAVMAEETGFPCTEA

SEQ ID NO: 124499 - protein, 148 aa, Triticum aestivum
  Clone ID: PAT_TA_18917.pep
AAPLLPPSFLLVVRAAAPLLPPLHTPATAHIPPIVRPNSPSHFSSSQNHIPSLRLHGGGLLEVSLVQAGRSSGAADAGGRVLDRSVIVSPLRRMEEGPGSHPHPFWMHLPTDVAPPTAVARVGVGDVYRYFRPRRSQNSLGLISIIIL

SEQ ID NO: 124500 - protein, 496 aa, Triticum aestivum
  unsure (1)..(496): unsure at all Xaa locations
  Clone ID: PAT_TA_18918.pep
MGCKFISPDXIALGLFDLDDPTTNSILKSLGVVPTQLAKQALTRVKGELAKDGREPLGLSSFKLRDKSTAGNGRTAIAKYSNKKKEKSALAQFCIDLTMRASGGFIDPVIGRTKEIERVVQIICRRTKNNPILLGEAGVGKTAIAEGLALKIANGDVPIFLVGKRILSLDVALLMAGAKERGELEARVTSLIREVRKADDVILFIDEVHTLIGSGFAGRANKGAGLDIANLLKPALARGELQCIASTTLDEHRLHFEKDKALARRFQPVYVNEPSQEDAVKILLGLREKYETYHKCKYTLEGINAAVYLSVRYIPDRHLPDKAIDLIDEAGSRARMESFKKKKEEQCSIILKSPDEYWQEIRAVQAMHEVALTNRLKYSLNENDQENEVNVEVLDDSKTSPTATPSASADEPSVVGLEEIARVTSLWSGIPVQQLTADERKLLVGLDDELRKRVIGQDDAVVAISRAVKRSRTGMSDPDRPIATLLFCGPTRVGKT

SEQ ID NO: 124501 - protein, 121 aa, Triticum aestivum
  unsure (1)..(121): unsure at all Xaa locations
  Clone ID: PAT_TA_18919.pep
MALRAASPPCAAGRCLPSSPPPRVGGRQFFRPLPPAAPAPLRKSAVCTKAISNSDGTPGTSDSPHVVCFGELLIDFVPTVSGVSLADAPAFKKAPGGAPPLAAVALXWSLHGKWDDELVII

SEQ ID NO: 124502 - protein, 331 aa, Triticum aestivum
  Clone ID: PAT_TA_18920.pep
MAAASLARLLPLLLSLLLLLLAGAARGKTVKRDVKALNEIKASLGWRVVYSWVGDDPCGHGDLPPWSGVTCTQQGDYRVVTELEVYAVSIVGPFPTAVTNLLDLKKLDLHNNKLTGPIPPQIGRLRHLKILNLRWNKLQDVLPPEIGDLKKLTHLYLSFNNFKGEIPVELANLPELRYLYLHENRFTGRIPPELGTLKNLRHLDVGGNHLIGTLRDVFSIENGFPSLRNLYVNNNQLAGVVPDQIANLTNLEILHLSNNRLIGSISPKLVQIPRLTYLYLDNNNFIGRIPEGLYKHPFLKELYIEGNQFRPGSRSKGMHKVPELPEADLSV

SEQ ID NO: 124503 - protein, 141 aa, Triticum aestivum
  Clone ID: PAT_TA_18921.pep
VRRVERGTSGGGGSYTPSLHSQRHASGSEVPNYMAATESAKARIRSQSAPRQRPATPERDRPQTVYNPAGGSAKKRLSFPVPQDPYGVGYAQSLRSPSFKSATGRFTSEQRSTVSSLSCAESVGGEPVSPSSTTDLRRWLR

SEQ ID NO: 124504 - protein, 436 aa, Triticum aestivum
  Clone ID: PAT_TA_18922.pep
MDILEKIRGGGDKPAAMETPRRPESWVEISESVSRLCSFDAGGGGAVSVKLIQDDRMAHDKLVDSFLNKFFPSGYPYSVNEGYLTYTKFRALQHFSSAMLHVLSTQSLLFAAGLRPTPAQATAVSWILKDGMQHAGKLICSGMGARMDSEPKSWRIFADVLYDFGTALDFISPLCPQLFLEVAGLGNFAKGMAVVAARATRLPIYSSFAKEGNLSDLFAKGEAISTLFNVMGIGAGIGLSSTVCSTTQGKLIIGPLLSAVHIWGVVQEMRATPINTLNPQRTAMVVADFIKSGKVSSPAELRYREDLLFPNRLIEEAGSVKVGQPFRRVLSPRRVEELRSIFPNEKFLLTQKSDKAYMVLEQSATGEDALRGWLVAAFASEMERSGAGPRDTVLNDAYQKMESVFPVFVSEVKSRGWYTGQFLDGNHSRIAYAKSE

SEQ ID NO: 124505 - protein, 153 aa, Triticum aestivum
  Clone ID: PAT_TA_18923.pep
MAPKAEKKPAGKKPAEEEPATEKAEKAPAGKKPKAEKRLPAGKTASKEGGGEKRGRKKGKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 124506 - protein, 79 aa, Triticum aestivum
  Clone ID: PAT_TA_18924.pep
MSVKMRTTCTWTERPYEALLFPGIGFGPFLRSLGGRRRRPPSGGARAISEIPLWKTSDSNLVSDPRAKGQSQVDSFYGA

SEQ ID NO: 124507 - protein, 84 aa, Triticum aestivum
  Clone ID: PAT_TA_18925.pep
ITCTPAKNNTYTSQHIANQQSLPSIQELGAAQQLRPHGPYQVAILLISIAQSPCVIRHRGNSLTPMLLIAGIRMDVVCKRLIVA

SEQ ID NO: 124508 - protein, 270 aa, Triticum aestivum
  Clone ID: PAT_TA_18926.pep
MKDQPQACGSKELQCNADLAVAQQCQSPESGCSIKTVMVDGGADPHGAPERHDSVASLGGLLLDVGMISKPSEPSIGSPLSAEGMSGCVAHAESGLSKVGTPSPLGSPCLEQQRLSPKIPSPSSGAFSGASFLKKRRFSPKKLSPKKGILKRHTMGCRGICMCLDCSVFRLRADRAFEFSRKQMQEADDIIVNLLEEVASLRSMAEKSSGKQEQMEACQRALRVEEVAKERRQQMLAELNSHCKIPGPRVKFAQYVEGKMASSPSSSRRQ

SEQ ID NO: 124509 - protein, 130 aa, Triticum aestivum
  Clone ID: PAT_TA_18927.pep
YRYTQVNVAQLVLHSFGVTVSKVDPRVVTFIFSLTDRVTGISHGYESGKPCENETTRAHIITDNTPTLTCSQSTSRVGFATICHSTANGFVTKSVLLFPRKSMEQLFVATKITRSWEHAFEELFETFIRT

SEQ ID NO: 124510 - protein, 481 aa, Triticum aestivum
  unsure (1)..(481): unsure at all Xaa locations
  Clone ID: PAT_TA_18928.pep
MAAPSGKAAMERHQSIDAQLRLLVPGKVSEDDKLVEYDALLVDRFLDILQDLHGPHLREFVQECYELSAEYETDRDEARIAELGXSKLTSLSPADSIVVSSSFSHMLNLANLAEEVQIAFRRRSKLKRGDFGDEASAPTESDIEETLKRLVSELGKSREEVFDALKNQTVDLVFTAHPTQSVRRSLLQKHGRIRNCLRQLYAKDITADDKQELDEALQREIQAAFRTDEIRRTPPTPQDEMRAGMSYFHETIWKGVPKFLRRIDTALKNIGINERLPYNAPLIQFSSWMGGDRDGNPRVTPEVTRDVCLLARMMAANLYFSQIEDLMFELSMWRCSDELRVRADELHRSSKKSAKHYIEFWKQVPSNEPYRVILGDVRDKLYYTRERSRHILTTGVSDIPEESTFTNVEMFLEPLELCYRSLCACGDKPIADGSLLDFLRQVSTFGLALVKLDIXQESDRHTDVLDTITTHXWIGSYAEWS

SEQ ID NO: 124511 - protein, 93 aa, Triticum aestivum
  unsure (1)..(93): unsure at all Xaa locations
  Clone ID: PAT_TA_18929.pep
RRRSNNACRILEVKRDFGSFGKYVWGFVNQRPLSPGYKYSRKIPVKTSKSESISKDMVRRGFRFVGPXTVLKSRMHAVYEINDHLVSCPMGVV

SEQ ID NO: 124512 - protein, 255 aa, Triticum aestivum
  Clone ID: PAT_TA_18930.pep
GRTSPSRSRPKMKTDTPTPPPTTTTTPWSLPPSRPPSSLARSRTSTSSSSPTTPPSSSSSHHQLLLLLRLPRPPLLLLRSSPRLPLSQRPCPGTAATTPSPAPTLQPPPPRPPLQSTMSPSSRRSPQSRPHHRLPLRRPSCRCRAGMDLLPLALALTLALSSSSRRRPTVTTPAPTPAAPPTTPSRTTTAMPTGTAPHPPPPRRALRASRRWRTTATAARSTTPACSHSTLRPSTAAACRLPRQCSARSRRSRWR

SEQ ID NO: 124513 - protein, 150 aa, Triticum aestivum
  Clone ID: PAT_TA_18931.pep
MARGLKKHLKRLNAPSHWMLDKLGGAFAPKPSSGPHKARECLPLILILRNRLKYALTYREVQSILMQRHIMVDGKVRTDKTYPAGFMYIISIPKTGENYRLLYDTKGSLSASLLSGNEGCLSSKLLARVRVLSKFWAQKGAIPITLQPTL

SEQ ID NO: 124514 - protein, 271 aa, Triticum aestivum
  unsure (1)..(271): unsure at all Xaa locations
  Clone ID: PAT_TA_18932.pep
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTKGRFRLHSVRDEDAKFKLCKVRSVQFGQKGIPYLNTYDGRTIRYPDPLIKANDTIKLDLETNKIVDFIKFDVGNVVMVTGGRNTWRGGXIKNREKHKGTFETIHVEDAQGPQFXHRLGHVFTICKGTKPMVSLPXGQGIKLTIIEDXRKRIAVAQAGARARFLGRK

SEQ ID NO: 124515 - protein, 250 aa, Triticum aestivum
  unsure (1)..(250): unsure at all Xaa locations
  Clone ID: PAT_TA_18933.pep
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTKGRFRLHSVRDEDAKFKLCKVRSVQFGQKGIXYLNTYDGRTIRYPDPLIKANDTIKLDLETNKIVDFIKFDVCNVVMVTGGRNTGRVGVIKNREKHRGTFETIHVEDAQGQXFATPLGQCIPPLARATKPWGDPPQGPGVSNFTI

SEQ ID NO: 124516 - protein, 259 aa, Triticum aestivum
  unsure (1)..(259): unsure at all Xaa locations
  Clone ID: PAT_TA_18934.pep
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTKGRFRLHSVRDEDAKFKLCKVRSVQFGQKGIPYLNTYDGRTIRYPDPLIKANDTIKLDLETNKIVDFIKFDVGNVVMVTGGRNTWRVGVIKNREKLKGTFEXTIHVEDGQGHQVRNPFGNVFTIGKGHKPLGELSQGQGVLSSPSLRNPRKRDA

SEQ ID NO: 124517 - protein, 251 aa, Triticum aestivum
  unsure (1)..(251): unsure at all Xaa locations
  Clone ID: PAT_TA_18935.pep
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTKGRFRLHSVRDEDAKFKLCXVKSVQXGQKGIPYLNTYDGRTIRYPDPLIRANDTIKLDLETNKDCDFIRFDRRNGVMVTGGRHTCRGCGIKTREEPKGNLRDHSTLGIARAHQFAPRLGQRVHHREGAPKPWWSFPRAKGIKANLH

SEQ ID NO: 124518 - protein, 245 aa, Triticum aestivum
  unsure (1)..(245): unsure at all Xaa locations
  Clone ID: PAT_TA_18936.pep
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTKGRFRLHSVRDEDAKFKLCKVRSVQFGQKGIPYLNTYDGRTIRYPDPLIKANDTIKLDLETNKIVDFIKFDVGNVVMVTGGXHTGRVGVIKNREKHKGTSRPSXVEDAXGHQFATRLAIDSPIGRGTKPWVSLPKGKGYQ

SEQ ID NO: 124519 - protein, 265 aa, Triticum aestivum
  Clone ID: PAT_TA_18937.pep
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTKGRFRLHSVKDEDAKFKLCKVRSVQFGQKGIPYLNTYDGRTIRYPDPLIKANDTIKLDLETNKIVDFIKFDVGNVVMVTGGRNTGRVGVIKNREKHKGTFETIHVEDAQGHQFATRLGNVFTIGKGTKPWVSLPKGKGIKLTIIEEQRKRDAAAQAAAKA

SEQ ID NO: 124520 - protein, 266 aa, Triticum aestivum
  Clone ID: PAT_TA_18938.pep
MVSDASKKLARQAQSKEKTLAKMERGGLAEKVVNDRILVFRFTDVGKLPPPVLQFADVTFGYSPDNLIYKNLDFGVDLDSRVALVGPNGAGKSTLLKLMTGDLSPLDGMVRRHNHLRIAQFHQHLTEKLDLDMPALQYMMREYPGNEEEKMRAAIGKFGLSGKAQVMPMKNLSDGQKARVIFAWLAFRQPQMLLLDEPTNHLDIETIDSLAEALKEWDGGLVLVSHDFRLINQVAQEIWVCENQAVTRWEGDIMDFKQHLKKRAGL

SEQ ID NO: 124521 - protein, 543 aa, Triticum aestivum
  Clone ID: PAT_TA_18939.pep
MVSDASKKKAAQKKAAAAAKRGAKSSAAASSSSASSAADKAANGIAALNLSDRTCTGVLASHPLSRDIHIESLSLTFHGHDLIVDSELELNYGRRYGLLGLNGCGKSTLLTAIGCRELPIPEHMDIHHLTREIEASDMSALQAVICCDEERVKLEKEAEILAAQDDGGGEALDLVYERLEAMDASTAEKRAAEILFGLGFDKQMQAKPTRDFSGGWRMRIALARALFMNPTILLLDEPTNHLDLEACVWLEEKLKNFERILVVISHSQDFLNGVCTNIIHMQNKTLKLYTGNYDQYVQTRSELEENQMKQYKWEQEQIANMKEYIARFGHGSAKLARQAQSKEKTLAKMERGGLAEKVVNDRILVFRFTDVGKLPPPVLQFADVTFGYTPDNLIYKNLDFGVDLDSRVALVGPNGAGKSTLLKLMTGDLSPLDGMVRRHNHLRIAQFHQHLTEKLDLDMPALQYMMREYPGNEEEKMRAAIGKFGLSGKAQVMPMKNLSDGQKARVIFAWLAFRQPQILLLDEPTNHLDIETIDSLAEALKEG

SEQ ID NO: 124522 - protein, 593 aa, Triticum aestivum
  unsure (1)..(593): unsure at all Xaa locations
  Clone ID: PAT_TA_18940.pep
MVSDASKKKAAQKKAAAAAKRGAKSSAAASSSSASSAADKAANGIAALNLSDRTCTGVLASHPLSRDIHIESLSLTFHGHDLIVDSELELNYGRRYGLLGLNGCGKSTLLTAIGCRELPIPEHMDIHHLTREIEASDMSALQAVICCDEERVKLEKEAEILAAQDDGGGEALDLVYERLEAMDASTAEKRAAEILFGLGFDKQMQAKPTRDFSGGWRMRIALARALFMNPTILLLDEPTNHLDLEACVWLEEKLKNFERILVVISHSQDFLNGVCTNIIHMQNKTLKLYTGNYDQYVQTRSELEENQMKQYKWEQEQIANMKEYIARFGHGSAKLARQAQSKEKTLAKMERGGLAEKVVNDRILVFRFTDVGKLPPPVLQFADVTFGYTPDNLIYKNLDFGVDLDSRVALVGXPNGAGKSTLLKLMTGDLSPLDGMVRRHNHLRIAQFHQHLTEKLDLDMPALQYMMREYPGNEEEKMRAAIGKFGLSGKAQVMPMKNLSDGQKARVIFAWLAFRQPQMLLLDEPTNHLDIETIDSLAEALKEWDGGLVLVSHDFRLINQVAQEIWVCENQAVTRWEGDIMDFKQHLKKRAGL

SEQ ID NO: 124523 - protein, 593 aa, Triticum aestivum
  unsure (1)..(593): unsure at all Xaa locations
  Clone ID: PAT_TA_18941.pep
MVSDASKKKAAQKKAAAAAKRGAKSSAAASSSSASSAADKAANGVAALNLSDRTCTGVLASHPLSRDIHIESLSLTFHGHDLIVDSELELNYGRRYGLLGLNGCGKSTLLTAIGCRELPIPEHMDIHHLTREIEASDMSALQAVICCDEERVKLEKEAEILAAQDDGGGEALDLVYERLEAMDASTAEKRAAEILFGLGFDKQMQAKPTRDFSGGXWRMRIALARALFMNPTILLLDEPTNHLDLEACVWLEEKLKNFERILVVISHSQDFLNGVCTNIIHMQNKTLKLYTGNYDQYVQTRSELEENQMKQYKWEQEQIANMKEYIARFGHGSAKLARQAQSKEKTLAKMERGGLAEKVVNDRILVFRFTDVGKLPPPVLQFADVTFGYSPDNLIYKNLDFGVDLDSRVALVGPNGAGKSTLLKLMTGDLSPLDGMVRRHNHLRIAQFHQHLTEKLDLDMPALQYMMREYPGNEEEKMRAAIGKFGLSGKAQVMPMKNLSDGQKARVIFAWLAFRQPQMLLLDEPTNHLDIETIDSLAEALKEWDGGLVLVSHDFRLINQVAQEIWVCENQAVTRWEGDIMDFKQHLKKRAGL

SEQ ID NO: 124524 - protein, 265 aa, Triticum aestivum
  Clone ID: PAT_TA_18942.pep
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTKGRFRLHSVRDEDAKFKLCKVRSVQFGQKGIPYLNTYDGRTIRYPDPLIKANDTIKLDLETNKIVDFIKFDVGNVVMVTGGRNTGRVGVIKNREKHKGTFETIHVEDAQGHQFATRLGNVFTIGKGTKPWVSLPKGKGIKLTIIEEQRKRDAAAQAAAKA

SEQ ID NO: 124525 - protein, 265 aa, Triticum aestivum; identical to SEQ ID NO: 124524
  Clone ID: PAT_TA_18943.pep

SEQ ID NO: 124526 - protein, 265 aa, Triticum aestivum; identical to SEQ ID NO: 124524
  Clone ID: PAT_TA_18944.pep

SEQ ID NO: 124527 - protein, 227 aa, Triticum aestivum
  unsure (1)..(227): unsure at all Xaa locations
  Clone ID: PAT_TA_18945.pep
MMDPLGLFPASSSQLPDDLLIEIFLCLPAHPTCLIRTSLVCKRWHCLIKNRQFVSRFRTLHQKLPVLCFFSNSTSIPRFIPTGDPPNCVSTXAFSLPDPCWQVLGCRHSLVLLVSSTWTXLQVWNPMTGNRQYVPATPDADRRFNHGIVPESQATVLCAAGHKDSGDCHSCPFLVVWVFTCTRYAYACRYSSESSSWXKMVSSPTPSDIDSRPSVLVGNILYWPLKS

SEQ ID NO: 124528 - protein, 269 aa, Triticum aestivum
  unsure (1)..(269): unsure at all Xaa locations
  Clone ID: PAT_TA_18946.pep
MALSSRAAAFPHVSLPSPRPRPAAGGDVSDVSALLGEMDCVGLRPGFSLVEKAVALYWDRSERARAVEFVRDVLRRGSVAAGGEYDGERGGPVGYLAWKIMMDGDYRDAVKLVIEFKESGLKPEVYSYLIGLTALVKEQKEFSKALRKLNLSVKDGSIAKLDTESMHNIEKYQSKLLGDGVLLSNWAVQEGSSEVLGLVHERLLSLYTCAGCGLEAERQLWELKLVGREPDTQLYDVVLAICASQXEAAAVRRLLARVESTKCXKKEEV

SEQ ID NO: 124529 - protein, 241 aa, Triticum aestivum
  Clone ID: PAT_TA_18947.pep
MASPAVAMRRPSPTVLASAPRRRPRRHEYSPSNMGSPSSASRLKVTALFGWIKGDRYSRTRELIPSAESYTLTGSASEVDMKPREVSISVVSSIMDIPPAEWDACAVDSVEPEKFNPFLTHAFLSSLEESGSAVKETGWLPLHVVARDENQNILGVVPLYLKSHSRGEFVFDQSWAEAYHSYGLEYYPKLQSCVPFTPVTGQRILLRDTSYRDQGFDALVKALKNLATKLNVSSLHITFPS

SEQ ID NO: 124530 - protein, 160 aa, Triticum aestivum
  unsure (1)..(160): unsure at all Xaa locations
  Clone ID: PAT_TA_18948.pep
RSLCATPRPFTASTQGRLTTQCSSSSPLPPQVVNLRHTGPCDNAAIRPFTSATALHLDVEHGPPVRDRRDKALLPPSSPWIQLLFPVDSRRHEVASGAAGGVKASKGIYLATASSSTTTRSTXRQGXDCMQGTSAPPHRAGFLPLSRSLXVRSEEYEGVE

SEQ ID NO: 124531 - protein, 247 aa, Triticum aestivum
  Clone ID: PAT_TA_18949.pep
LIQGFVKMWQEKLDCYQTQCEAISEAKNLDSAISGGISRDLAMELEVDLVKWIVNFCSWVNAQRSFVKALNGWLALCLNYQQEETPDGAPPYSPGRVGAPLVFVICNTWSQAMDRISEKEVVTAMQALVSSVRNQCGHRASVEQSELIFVTREREKWNRILGRKSVEINREADTLNKKLALVPGRQSLLPTAQTYQAHFLEADRLHVSLSRVLQSLESFACSSLQAFRETLIHAEEEMLSRESAKVS

SEQ ID NO: 124532 - protein, 370 aa, Triticum aestivum
  unsure (1)..(370): unsure at all Xaa locations
  Clone ID: PAT_TA_18950.pep
MASSSSSPPARRSVFDAAYIRAEFDAAGISPTFIPTIWKYVLQNPRCSDLDGVPSLSAAAYALLRNKFRPTTSTLTAAAESKDRTTTKLLIRLQNGESVEAVIMRYDSRLGKYDGKTRPGGVRSTLCVSSQVGCKMGCRFCATGTMGFKSNLSSGEIVEQLVHATRYSQIRNIVFMGMGEPLNNYTAFXLKQTESTVGIIHSINKFNNDLPNINLAVSLHAPDQDIRCQIKPAARDLTLRNATDGLMDALQSHTKXSKQTIFNEYNMLDGVNDQEEHAHKLGKLLENFKAVVNLIPINPIGSASTFKTSSDQSIKKFQKVLRGIYSIRTTVRQEMGQDIAGACGQLVVSLPDERSAGGATLLSDIEDLRI

SEQ ID NO: 124533 - protein, 119 aa, Triticum aestivum
  Clone ID: PAT_TA_18951.pep
MVRLSNTMIGILNAVTFLLSVPILAGGIWLRARADGTECERYLAAPVIVLGVFLMLVSVAGLVGACCRVTCLLWFYLVAMFLLIVVLLGITVFAFVVTHKDTGEAVSGRGFQEYRLGDY

SEQ ID NO: 124534 - protein, 278 aa, Triticum aestivum
  unsure (1)..(278): unsure at all Xaa locations
  Clone ID: PAT_TA_18952.pep
MVRLSNTVIGILNAVTFLLSVPILAGGIWLRARADGTECERYLAAPVIAXGLFLMLGLHRGASSAPCCRVTCLLLEFYXLVRHCSLLNRRSVLGLRPSSAFLVTHKGHRGRPAPPPAVNEHRLGDYSNWLQKXVENDNNWNRIKCXALHAKACKSLEDWAVERIKSCRLPPVHGGLLQNLQSAAAYPTISSAHWSTSSSSTGPEFGLCSSDGALXYGCQSCKAGVVATLKRNWKRSAIINIVFLVFIIIVYSVGCCAFRNNRRDHRNGGGYKQQGAYA

SEQ ID NO: 124535 - protein, 53 aa, Triticum aestivum
  Clone ID: PAT_TA_18953.pep
MCHRNGVIHQDLKLENLHANKKSSPLKAIDFGLSVFFRTGILWNIPLHLTNCF

SEQ ID NO: 124536 - protein, 127 aa, Triticum aestivum
  unsure (1)..(127): unsure at all Xaa locations
  Clone ID: PAT_TA_18954.pep
RPGPRGGEGNPSSRDPVGRRRGRRGDGAAGGPPRPGDEAAPVPRPAPPVLPAPLAAAPALGPPPALAPPRPRLRPPPPRPXPAPPTPPPRPPPTPPPPDPPTPTPMPSPPLSSARDLTSRLSRTRRT

SEQ ID NO: 124537 - protein, 428 aa, Triticum aestivum
  Clone ID: PAT_TA_18955.pep
GMASPRALDISDESEQPAEASVLGRSWVHSMFSRDRSLRASSFNRASDTKAGATAGKTDLAAAQKKTQTNMRILRGHTAAITALHCVTRKEVWDLVGDREDAGFFISGSTDCTVKVWDPSLRGSELRATLRGHTRTVRAISSDRGKIVSGGDDQSVIVWDKQAFKLLEELKGHDAPVTSVRMLSGERVLTASHDGTVKMWDVRTDTCVATVGRCQSAVLCMEYDDSTGILAAAGRDVVAHVWDIRSSKQMFKLQGHTKWIRSMRMTGETIITGSDDWTARVWSLTRGTCDAVLACHAGPILCVEYSPSDKGIITGSSDGLIRFWENEGGIKCVKNLTLHSASVLSISAGDHWLGIGAADNSMSLFHRPQERFGSFSNAGSKVAGWQLYRTPQKTSAVVRCIASDLDRKRICSGGRNGLLRLWDATTSI

SEQ ID NO: 124538 - protein, 356 aa, Triticum aestivum
  unsure (1)..(356): unsure at all Xaa locations
  Clone ID: PAT_TA_18956.pep
FSAADGVASKDLHIDPNSALSLRIFLPTPPPHHPHLLHPRRASDPAAGQAGAPYRGYLPHAVSSPRAAASARRRLPIVVQFHGGGFVTGSNCSASNDAFCRRVAKFCDAIVVAVGYRLAPESRYPAAFDDGVRVLRWIAKQANLAMMSKVGGGVDTFGASTVEPWIAAHGDPARCVLLGVSCGANIADFVTRKAVEDAKQFEPVKAVAQVGTSPFFTGSVPTHSEIRLANSYFYDKSTCLLAWRLLLSEKEFSLDHPAANPLAPGRGGPPLKCMPPTLTIVAEHDCWGDRAIXPYSEELRKVNVDAPVLDYKDTVHEFATLDVFLKTPQAQACAXEDIAIWMKKYISXLRGHEFSY

SEQ ID NO: 124539 - protein, 217 aa, Triticum aestivum
  Clone ID: PAT_TA_18957.pep
MRSPSGARPSSGGGAAADDDFAFYYSFFQDAAAASPLPLALDGAAMPNNRRRKRGGDDDSAAAPIKDGSNNGRKRSIATIITSLAALEAEDHADSAGAADASRRELALLESNADNKSQAMMDYFAKMEGSFDGRRRLRGRCRAPSGALSASAAAVAVVAGQEAAPNTAASASPPRAGHHQRRLWVTRWVAASMRNSPDFPDAEFRAPPSARGSRRRQ

SEQ ID NO: 124540 - protein, 374 aa, Triticum aestivum
  Clone ID: PAT_TA_18958.pep
PPARAAFERVMHEFRCATYSMECPQVSRETVANILLAHAGRGGSSGMTEAAAEIARAAARSWLAPLTETACDRLAFVLQSLFDLAMERSRTDDSRYQNVENMDGYVGFLAALRCSYYKFVKDLSKQCKQIVRHHLDSVTSPYSHICYESDFLGGVGTVANTLHRFNQFSGVASFDLSDRGSLEEGQENLPPRDQQQMTPPAKANEREILKESQLTVPETPSPDLPADIHGGKKKDNGNMNDGGARKRHARMAAYANRGHHNNVTVGGDDLVSRSGSSYSSICSISAQYFAKMREVLIERNVPSALNSGFLTPCRERLFLALGFELFAVNDEKFMDMFVSPGAIDCIQNERQSLLKRQKILLSCLSEFKNISRTL

SEQ ID NO: 124541 - protein, 229 aa, Triticum aestivum
  unsure (1)..(229): unsure at all Xaa locations
  Clone ID: PAT_TA_18959.pep
MTTMIAASSIVKANLPCSSRISSCSDFSSGHSWRPLEAAKHYRAHGVRSLRVTCAATKTAKSPAEEEWKIKRQFLVEKRVRSVDVKEALRLQNENNFVILDVRPEAEFKQAHPPGAVNVQIYRLIKEWTAWDIARRAAFAFFGIFAGTEENPEFIKSVEEKLNKDSKIIVACSAGGTMKPTQNLPDGKQSRSLIAXYLLVLNGYKNVFHLDGGLYTWFKEDLPSEGEED

SEQ ID NO: 124542 - protein, 164 aa, Triticum aestivum
  Clone ID: PAT_TA_18960.pep
RPLVARPFQTHHTVPSQGYVIYSVRRKLKKQYAHLKGSQIVKLKQSGSEITDTILYPEVAFTGDTTSDFILDPRNADALRAKVLITEATFLDDQVDVDHAREHGHMHLSGIMEHSQWFRNEAIILTHFSNRYSLEDIRKAVSRLQPKLISKVVALTEGFKSEYS

SEQ ID NO: 124543 - protein, 105 aa, Triticum aestivum
  Clone ID: PAT_TA_18961.pep
SEATTGSLAGGRDTSEVGRGSLIVAGGGPGAAFWGSVYPTDVVRSKLQVDDFKNPKYSGSMDAFKKILAADGARGLYRGFGPAMARSVPANGACFLAYEVTRSLL

SEQ ID NO: 124544 - protein, 283 aa, Triticum aestivum
  Clone ID: PAT_TA_18962.pep
SVVAAEVSAPPLPLYSRCAAFDPPSPTHQHNRSLISDHLLLSLLRLVCSDRHGDPDGRVRDVPPRRGDDDGGAAQGRLRRAGRGHRLRVRLRVHVGTSSSSDLADDASSSSSSSSSGDHFEMSALMTQLPIKRGLSMFFDGKSQSFASLAAVASLEDLAKPTKKRLKPSRSCEGGLDAHRGRFLSPRRHCPKAAAAEVRRPRGPPSPCSAPRQGRRGWPPTPSSLARFCSTVRCPCSSQREGYLEPPMVIPSAFRPRGNNQIKFKIWFSKTIQRKNWILKNGQ

SEQ ID NO: 124545 - protein, 230 aa, Triticum aestivum
  unsure (1)..(230): unsure at all Xaa locations
  Clone ID: PAT_TA_18963.pep
MSFLFGKRKTPAELLRENKRMLDKSIREIERERQGLQTQEKKLIAEIKKVPKQGQMGAGKVNAKKLILTRHQITNFXSLEVQLHGVSIRVQTLKSTQAMDEAXRGVTKDTTQMNRTMNLPAMKKIMRDFEMQDEKVEMFDEVRGDAIDEALEGVVEEEETEGLVSQVLDEIGIDINSELVKTPATAGRRCRLQRERRVVMLEVRAGWPVRTDDDLEARLDNRDEEVSLHG

SEQ ID NO: 124546 - protein, 240 aa, Triticum aestivum
  unsure (1)..(240): unsure at all Xaa locations
  Clone ID: PAT_TA_18964.pep
VRGRGTLSWIHLDESERDDLAAFLSAGPPQHQDKVVTIPSAGDIQVGSNPTRVRKNISADSSNDSSGSADLSSARAKEDAHRGHRRSVSASADIGSSPMSFPNERDGAAEQSSLGPHRAPLLNIVKACGLPSALKPKPAVKYKKGAVDXASADKQDLEAAIPLTNPQLGQGLDGYSERSIGYLNTCDGVTYNKKLYGWLGALRKKLQRSQYQIRYGRPAQLIVFALAVLIIFVFVFKTIW

SEQ ID NO: 124547 - protein, 621 aa, Triticum aestivum
  unsure (1)..(621): unsure at all Xaa locations
  Clone ID: PAT_TA_18965.pep
GSDPRRRRRRGLLLVLAVLLYGFCCCCEGRFVVEKNSLKVTAPDSLKGSYECAIGNFGVPQYGGTAXGVVATPKSNPKACKSFDDFDISYWAKTGSLPTFLLVDRGDCFFTKKAWNAQIAGVAAILVADDKEEPLITMDTPEESGRADYLXNITIPSALITNSFWDRLSAAVFGVYIRSRDAKPCHLLQYEFWTNSNDECGPKCDSQIDFVKSFKGPAQILEKKGYTQFTPHYITWYCPEAFTLSKQCKSQCINHGRYCAPDPEQDFSKGYDGKDVVVQNLRQVCVYKVAKENKKPWLWWDYVTDFAIRCPMKEKKYTKECADGVIKSLGLDHKAIDKCIGDPNADEENHVLKAEQDAQIGKGARGDVTILPTLVINNRQYRGKLDKGAVLKALCAGFQETTEPAVCLSEDIQTNECLENNGGCWHDKAANISACKDTFRGRVCECPVVKGVKFVGDGYTHCEASGSGRCEINNGGCWKETRNGRTHSACTDGGCKCPDGFKGDGVHKCEDVDECKERTACQCKECKCNNTWGSYECGCGGGFLYMKEHDTCISKDAGARVGWNFLWFLLFGLAAVGIAGYAVYKYRIRSYMDSEIRAIMAQYMPLDNQGEIPNHSHHIEM

SEQ ID NO: 124548 - protein, 76 aa, Triticum aestivum
  Clone ID: PAT_TA_18966.pep
PSSLHPFHIHLCSPHAPGPDCGTWTVALPLLKDTMWPNISNRHGGTWLGTNLPLPPKSKRRRASRAIRVLIDIFGR

SEQ ID NO: 124549 - protein, 456 aa, Triticum aestivum
  unsure (1)..(456): unsure at all Xaa locations
  Clone ID: PAT_TA_18967.pep
CTSLCIARLAGVPPGGLRRELQPRSSGGPLDLRLVQGPCLCILSPLHVLDPYTCTAPHASVVEPSSHPNHAWTWMTCYCWGPPTAFCLLSEFFPLKFFVILFHLLSMQPDSAYTRALXFLYLRYVADPKILWTWYEPYLKDDEEFSPGSNGRMTTMGVYVRDLILGQKLCQXLDKFLSQYYFDSILPRVPVPVVRQVTANLEKMKLPTKLFGVTGDSTRHGSEDTARRPPSVKASLSVSFGRRAPLRASTPVSAPVRRSLSQEVLRXPPSPFRRSVSREGPYNDRSSHDREGNRSSRDRDTDRSSRDRDTDHSSRDRDTGRSSRHRERDRSSHDRKRDYDRDSRDCDYYRSRHSEERRDYRSERDNSRHRRSSSCHRSRSRSRSRSRSRSRSRNEHRSSPFGDTSKEKAAAASSNLAKLKDLYGDVTEKKDDSDARWLHHDSCAEEVIRLGGPRWR

SEQ ID NO: 124550 - protein, 231 aa, Triticum aestivum
  Clone ID: PAT_TA_18968.pep
ELRTRRPPSGSPKSLARLCAAFGAMGRKEIMELGIGGPKEILDLVSGKPTEIIGLGSGKLQDYPLVRRLRNRRLLTYLWLQGFDAAYDSVVHESGVQMSRLHLRQLLIRGQWREAIKYITRVMPRAVDQGVETRDVDTVLCALWFLANGAGSPAGGFADRSVCSILRYYVTDLRRLASLLARITHVCNCASKCSLSCGTLLVDRESDLNQVMLQWCPVFGRVCPFPGHLEI

SEQ ID NO: 124551 - protein, 382 aa, Triticum aestivum
  unsure (1)..(382): unsure at all Xaa locations
  Clone ID: PAT_TA_18969.pep
RLPGVVKXLCKDHAAWPLNNMESSYKFMVRHVQLWKVAFHGTSPRWVHNFYLAALASXYAKKVEAGLKKYKPDIIISVHPLMQHIPLWVLKWQGLQNRVVFATVITDLNTCHPTWFHADVNRCYCPSEEVAKRAELDDLKSSQIRVFGLPGRPSFCRAVLVKDDLRKELELDPDLPAVLLMGGGEGMGPVKKTAXXLGDALFDKELGKPIGQLVVICGRNKTLSSSLQALEWKMPIKIRGFETQMEKWMGACDCIITKAGPGTIAEALIRGLPIILNDFIPGQEVGNVPYVVDNGAGVFSKSPKETAELVARWFGPGAEERKRMSENALKLAQPEAVFDIVRDIHELSQEQGVKAQISSSLTSSFFIPSPEASHCPSPIPLV

SEQ ID NO: 124552 - protein, 148 aa, Triticum aestivum
  unsure (1)..(148): unsure at all Xaa locations
  Clone ID: PAT_TA_18970.pep
KDHASSSTDAIMAEAELTXNAPADVDADLLKDDDDAQLLQQALAMSMDEGASGSAAVADAAMAEAAADDQDLALALQMSVQDAEVAGQSDMSKVFEDRSFVTSILNSLPGVDPNDPSVKDLLASLHGQGEEEKKDKEDKPDKPEDGKN

SEQ ID NO: 124553 - protein, 102 aa, Triticum aestivum
  Clone ID: PAT_TA_18971.pep
MATELTAAQLRAYDGTDASKPIYVAIRGKVFDVSAGRGFYGPGGDYALFAGREAARALAKMSKDAADVSGDLSGLSDKELGVLADWESKFQAKYPVVARLAA

SEQ ID NO: 124554 - protein, 391 aa, Triticum aestivum
  unsure (1)..(391): unsure at all Xaa locations
  Clone ID: PAT_TA_18972.pep
RPPKWGHLRDLHKAIKQAEPALVSGDPTVQRIGNYEKAYVFKSMAGKGVRVLVTPTXSDLGKILACMHGLEVGAEANLAAAIQVAQLALKHRQNKRQQQRIIVFIGSPVTYDKKVLETIGKKLKKNNVALDVVDFGETDDEKPEKLEALIAAVNSSDSSHIVHVPPGDHALSDVLISTPIFTGEEGSGFAASAAAAAATGATGYDFGVDPNVDPELALALRLSMEEERARQEAIAKKAAEDNKDQASSSTDAIMAEAELTLNAPADVDADLLKDDDDAQLLQQALAMSMDEGASGAAAVADAAMAEAAADDQDLALALQMSVQDAEAAGQSDMSKVFEDRSFVTSILNSLPGVDPNDPSVKDLLASLHGQGEQEEKKDKEDKPDISEDGKN

SEQ ID NO: 124555 - protein, 383 aa, Triticum aestivum
  unsure (1)..(383): unsure at all Xaa locations
  Clone ID: PAT_TA_18973.pep
MVLESTMICIDNSEWMRNGDYSPSRFQAQADAVNLICGAKXTQSNPENTVGVMTMAGKGVRVLVTPTSDLXKILACMHGLEVGAEANLAAAIQVAQLALKHRQXNKRATARELLFFIGSPWSTYDYKVXQTIGKKLKKNNVALXDLVDFGETDDEKPEKLVSXLTAAVNSSDSSHIVHVPXGDHALSDVLXRTPMWTRKXGGQAMTFLKMGRTERTEHLFSRKKXAAHEVKKIACVRWIDIMAXDELTLNAPAVXDARSTEVDDDDAPLVQQALAMSMDEGASGAAAVADAAMAEAAADDQDLALALQMSVQDAEAAGQSDMSKVFEDRSFVTSILNSLPGXVDPNDPSVKDLLASLHGXQGEQEEKKDTEGQGQTSLQDGKN

SEQ ID NO: 124556 - protein, 123 aa, Triticum aestivum
  Clone ID: PAT_TA_18974.pep
NELPSAGEVSEHKAPVAKQDADLSSNVMNDAGEVEQKEGNMKKKAAAVKDEAKAPRKKITADVVCKDDGTSESGVTFDTLERHQDVGCVTPSKPESKKKRKWVEARSPDCVASRLRSRSAPKS

SEQ ID NO: 124557 - protein, 343 aa, Triticum aestivum
  Clone ID: PAT_TA_18975.pep
MGQVALTSNNAAHDPNLYWDGTVEGPTTDYTPQLLPGACQSQSVSNDQICNAVEEPSDHIPIDQSALSQNMRGMRRRCLFNEKAGAVNKAAKKTSDRHSANTTTPRCKTNSGDKPVRTPPCALPGIGLHLNALAPISTDKIVPQAAQSSINQASNFPCAVSSSTSESNIANEDSSQAIVVANADESGQGSPKKKRHKFDDGDGTSCKRCSCKKSKCLKLYCECFHAGVFCSEPCSCQGCLNKPSNMEIVLSTREQIESRNPLAFAPKVIRTSEPGQELGEYSNKTPASARHKRGCNCKKSSCLKKYCECYQGGVGCSISCRCEGCKNAFGRREGLGPLSIEGS

SEQ ID NO: 124558 - protein, 329 aa, Triticum aestivum
  Clone ID: PAT_TA_18976.pep
EFGTRPERRPDPRFRPRRWIVLDEVFQSQGKMLLLNTDSGRFLHRELPLLNDHHVVATTRNGYLVLADKSPPHAVNVLNPLTRVVIRFVAPVPPKVGSAAVVFFDDSSPTLTLFCDSSHNVYTADLSDIGFDVLEGPGPEAEYDFFRKTVLAGVYADIEPAFHGVLDDLCSLLMSGDVAKFFPGGLPDATDLKWFPVGLGKHMLLVVNVRGSIFVLKKNIQIGKLVALDSISNYAIFMGLQRCLAVDAEKFPGIEANCVYYIENLGSSAHICKCNIKNRKVERISEAADFVKHGKQFVLVADRPLTIIHLLSSYTINIPDSQMALQQIP

SEQ ID NO: 124559 - protein, 190 aa, Triticum aestivum
  Clone ID: PAT_TA_18977.pep
MAELKSRRVILKDYVEGYPTEAHMELLPAAPVDEAEEGSVLVKNLYLSCDPYMRPKMSRPLHQSYTAAFVPGAAITGYGVSQVVRSSRPGLAAGDLVWGMTGWEDYSVIKAAFTANLEKSQPHHTRAALTPRSMHATNTVFTRGTCNSITIVLVMGGATPTVHVVIVWPWHMSLPLPLPLPEPDCSRSLN

SEQ ID NO: 124560 - protein, 279 aa, Triticum aestivum
  unsure (1)..(279): unsure at all Xaa locations
  Clone ID: PAT_TA_18978.pep
RLVDEIKISSNEETCTTYNLLKVSRNLFRWTKEVKYADHYERLLINGIMGNQRGTQPGVMIYFLPMGPGRSKSISGGPPSGLPPKNPGGWGGPNDTFWCCYGTGIESFSKLGDTIYFLEEGEVPGLYIAQHIPSTFDWKAAGLTVVQQAKPLLSTDSYFEVTISISAKGDAQPAKVSVRIPSWTSTVDATATLNGQKLNLTSAGDFLTLTKLWGDDTLXLQFPINLRMGPMKGDRAGACVDPGEWCSGPTSSPPRHTATRTRPGPELFNEVLTPGLDGG

SEQ ID NO: 124561 - protein, 281 aa, Triticum aestivum
  Clone ID: PAT_TA_18979.pep
MGSTKPLRLIQHKKEALWFYSFISFGYDHVFNPGQYTEDMRDISLEHARLHSRALKVVDVGGGTGFTTLGVVRYVDPENVTLLDQSPHQLDKARKKKALRGIKIMEGDAEDLPFPADTFDRYVSAGSIEYWPDPQRGIKEAYRVLSADGVACMIGPVRPTFWLSRFFADMWMLFPTEEEYIEWFERAGFKDVELTRIGPKWYRGARRHGLVIGCCVTGIKTQSGDSPLQLGPKAEDVSKPHVNPIFVFFRFLIGTICATYFFLVPIYMWIKDKIVPQGRPI

SEQ ID NO: 124562 - protein, 165 aa, Triticum aestivum
  unsure (1)..(165): unsure at all Xaa locations
  Clone ID: PAT_TA_18980.pep
RPQILTLENFRENEQLSKYGRAKSARSIMLIELKKLIEANPLFREKLVFPTLKASRLRTLINQSLNWQHQLCKNPRPNPDIKTLFTDHTCSPPNGARTSPVSVPLAAVPKAGAAYQATHRPCSIPSXPPPAGPSLAGWXQVLLFLHPFSLLPWQHHQCLFHQIKX

SEQ ID NO: 124563 - protein, 63 aa, Triticum aestivum
  Clone ID: PAT_TA_18981.pep
MYWLRLAKKKKKKKKKKKKKKKKKKKKKKKKKKKKKKKKKKKKKKKKKKKKKKKKKKKGGPPF

SEQ ID NO: 124564 - protein, 352 aa, Triticum aestivum
  unsure (1)..(352): unsure at all Xaa locations
  Clone ID: PAT_TA_18982.pep
PRPAIYDPFLXVALEGNWFVQEKSCKILTHLISARPKLQNGMVPNGEASNSKSKLTSIHDVLKGLVDWLCSQLRSPTHPNCSIPTATHCLATLLKETYVRTLFVQADGVKLLIPLISPASTQQSIQLLYETCLCIWLLSFYDAAVDYLSTTRVMPRLVDVVKGSTKEKVVRVVVMSFRNLLAKGAFAAQMIDLGLPHIVQNLKAQAWSDEDLLDALNQLEVGLKENLKRLSSFDKYKQRVLLGHLDWSPMHKDPNFWRENITNFEENDFQILRVLMTVIDTSTDTTALAVACYDLSQFLQYHPSGRLVVADLKAKDRVMKLMNHDNAEVRKNSLLCVQRLFLGAKYASFLQV

SEQ ID NO: 124565 - protein, 447 aa, Triticum aestivum
  unsure (1)..(447): unsure at all Xaa locations
  Clone ID: PAT_TA_18983.pep
MDRAELTTEQVLKRDIPWETYMSTKLITSTCLQLLRRYDHKPESQRGPLLDEDGPSYVRVFLNILRSISKEETVEYVLALIDEMLAANPKRAALFYDNSLSGEDIYDPFLRLLLKGNWFVQEKSCKILTHLISARPKLQNGMVPNGEASNSKSKLTSIHDVLKGLVDWLCSQLRSPTQPNCSIPTATHCLATLLRETYVRTLFVHADGVKLLIPLISXASTQQSIQLLYETSHSIWLLSFYDAAAHYLXSTQRXWPISVGIPKGYGPSHETHEPRTMPKLGRTPGYCVQRLFLGAKYARFRQXVRPRSFVXYEVLDPPNPMPFFQNGETAIENVRPLKFLVQYILLLFDLINGLMYNKYSQLWLARCNKMSMGXFTPTDTTALAVACYDLSQFLQYHPSGRLVVADLKAKDRVMKLMNHDNAEVRKNSLLCVQRLFLGAKYASFLQV

SEQ ID NO: 124566 - protein, 92 aa, Triticum aestivum
  Clone ID: PAT_TA_18984.pep
PRPSDRRLLPAPAAPAEAAALRRRRGRPQRGRPPRPRRGRRLPPPAHRRRPRHRVRAPAPEGRPRQRRRDGRRRRRAEQAGRDRRLAAIVRR

SEQ ID NO: 124567 - protein, 190 aa, Triticum aestivum
  unsure (1)..(190): unsure at all Xaa locations
  Clone ID: PAT_TA_18985.pep
PRVREAVLRHPSLSRLKAPNRAGHRTQHRVRTVPRRPRVPKRRLAAAAALFQDQTNPRTAAASKGGDEEDEEGYGEVDRIVSSRTVKNAVFAEDGSATTVTATEYLVEWKDGHEPTWIPAEAIAADVVAEYETPWWDAAKKADADALGALLADEALRRDPDAEDAQGRTAMHFAAXLGSEECLRLLAEAG

SEQ ID NO: 124568 - protein, 152 aa, Triticum aestivum
  unsure (1)..(152): unsure at all Xaa locations
  Clone ID: PAT_TA_18986.pep
MEGAAAGEPAPAGVHAVPSRRLIAGFISGTLNGLFALAGALTGAVTGALAGRASDSGVLRGARSGAITGAVLSILVLQASRAYWCSDRLGASSMSMTDFIEQLLHARFEQQRLGFSAHTSHQSQVXISGFGQDDVYEIFRDISLRGLSPESL

SEQ ID NO: 124569 - protein, 293 aa, Triticum aestivum
  Clone ID: PAT_TA_18987.pep
MTEKEVGRIFVGGLSWDTTERTLERAFGEFGKVIETQVVTERDTGRSRGFGFVTFLEPRAVDVAIREMHNGELDGRTISVNKAQPRMNSDDGGYGYGGSSYSSGARGGYRGAADIVPAASDDCFKCGRPGHWARECPYSDGGRPGRYSPPSRYGNGAGGRGDRLGGSDRFGNRYVDDRYDGGHYADDRYGGGRDRYPPAADRFSGDRYGGGDRYASAGFARERSYERDGGRTGGSYYRDEPRGTGGYGRGGPRVANGDRYGSGGPARLGASYRDRPAPYDRPTRGARSYDDRY

SEQ ID NO: 124570 - protein, 203 aa, Triticum aestivum
  Clone ID: PAT_TA_18988.pep
LGLIGTTTQGACLLLSDPPKIARHVVEMSFDRQGRGKQLAALHAFGSICGVDRQEDQMKLDDHQAEECLKRLVYSAASNSPKLTPSALLLSILQQDPDVRIAGYRVLSGLVVREWCLREVCSKPEIIGIVTDPKMETTKLGMEARYACCVAINKALSSSHLLHEPSLSELIGKLNEAVRRGPYLSEKRQRVEAQPVVGTMERF

SEQ ID NO: 124571 - protein, 177 aa, Triticum aestivum
  Clone ID: PAT_TA_18989.pep
MFGFGHHGHHGQNPPAHAPAAAGGNQPTFKIFCKADEGYCLSVRDGNVVLAPSNPRDEHQHWFKDMRFSSQIKDEEGNPAFAIVNKATGLAVKHSLGQSHPVKLVPFNPEYLDESVMWTESSDVGKGFRCIRMVNNIRLNFDALNGDKDHGGVHDGTTVVLWEWAKGDNQRWKILPW

SEQ ID NO: 124572 - protein, 121 aa, Triticum aestivum
  Clone ID: PAT_TA_18990.pep
GPPHGEHRPTRPFGRHRAPSLNWPGRVSGIVTLKKLECSKQAIALDTLAWDNLDNLRRLAEQFQKQMPGGEAGGASIGAAQDDDDDVPELVPGETFEEAAEEKKEPEAKKEPEPEEKKESS

SEQ ID NO: 124573 - protein, 164 aa, Triticum aestivum
  unsure (1)..(164): unsure at all Xaa locations
  Clone ID: PAT_TA_18991.pep
GHLMGATIDMAGHTTEATIHIAGDITDAANHIAGDTADATNHIAADANDKMAHTAHAAKDITYDTAHSANDRAAHGKDXTASTLGEITDAANHNAVDTTDAARHNAADAIDAANQNASDTAHYTKDSAVAGKDKIGSVLHHAGDXVVNAVXVGAYDAVANTLGM

SEQ ID NO: 124574 - protein, 197 aa, Triticum aestivum
  Clone ID: PAT_TA_18992.pep
IRHEGRRRRRRLPKMNVDKLKKMAGAVRTGGKGSVRRKKKAVHKTTTTDDKRLQSTLKRVGVNTIPGIEEVNIFKDDVVIQFQNPKVQASIAANTWVVSGTPQTKKLQDLLPTIINQLGNSFLPGPDNLDNLRRLAEQFQKQMPGGEAGGASIGAAQDDDDDVPELVPGETFEEAAEEKKEPEAKKEAEPEEKKESS

SEQ ID NO: 124575 - protein, 211 aa, Triticum aestivum
  Clone ID: PAT_TA_18993.pep
MASNQNQASYMAGETKARTEEKTGQMMDKAGQATEATKQKAGETAEATKQKAGEAKDKTAQTAQAAKDRAAESKDQTGSFLGEKTEAAKQKAAEATEAAKQKTSETAQYAQERSSDAAQYTKESAVAGKDKTSGVLQQASETVVNAVVGAKDAVANTLGMGGDNTNTAKDTTTEKDHQGSLANLLPLLVWSFAGLLHNCRFPSCVISAHLV

SEQ ID NO: 124576 - protein, 117 aa, Triticum aestivum
  unsure (1)..(117): unsure at all Xaa locations
  Clone ID: PAT_TA_18994.pep
RGRGRGSKTTGFPRFDLQLLGMGPDGHIASLFPGHPLVKENKKWVTHILDSPKPPPQRITFTFPVINSSAYVAMVVTGXGKAGAVQKAISGQXTSDLLPVEMAILDDGXNSPGFTDK

SEQ ID NO: 124577 - protein, 131 aa, Triticum aestivum
  Clone ID: PAT_TA_18995.pep
IYLAAGDGLMELEGFTSIYKNMYTKSSLLTHEDFERMHGNTKAALDYYVSVNSDAYVTTFFGNMDKMVTAMRTMQGLQKTLVLSRRAFANYTAAGLAGDQLAKAMWDAHREDYIMGRGLALPEHCFCEFKL

SEQ ID NO: 124578 - protein, 147 aa, Triticum aestivum
  Clone ID: PAT_TA_18996.pep
MFYLLDELQEKTGQMMGATKDKAGQTTEATKQKAGETAEATKQKTGQATEATKQKAGETADATKQKAAEAKDKTAQTAQAAKEKTYETAQSAKERAAQGKDQTASTLGEKTEAAKQKAAETTEAARQKAAEATEAAKQKASETAQYT

SEQ ID NO: 124579 - protein, 166 aa, Triticum aestivum
  unsure (1)..(166): unsure at all Xaa locations
  Clone ID: PAT_TA_18997.pep
RGRGRGTATEHLISASNGMFDSLEFADASMFLPGSFDTAGVVTENQFGYLGDSGSQNQGFQYTSESWTHNQVALNVRNHMNHNHVVFSHASGTANFHTVNEQPHNLSPADSQSWFNSAVSALLDAVPANPALAAENNVLNRTLQRIXSFRSDQAPKKEASXPVYPG

SEQ ID NO: 124580 - protein, 98 aa, Triticum aestivum
  Clone ID: PAT_TA_18998.pep
NRWGVVMSRNAGYSDQVVELDFLYPSEGLHRRWESGYRITSSAGTPDQAAFILSIPKRKPLDETQETLRTSAFPSNHVKEKWAKNLYIASICCGRTAC

SEQ ID NO: 124581 - protein, 208 aa, Triticum aestivum
  unsure (1)..(208): unsure at all Xaa locations
  Clone ID: PAT_TA_18999.pep
MASNQNQASYAAGETKARTEEKTGQMMDKAGQATEATKQKAGEAKDKTAQTAQAAKDRAAESKDQTGSFLGEKTEAAKQKTAEATDAAKQKASETAQYAQERSSDAAQYTKESAVXAGKDKTGSVLQQAGETVVNAVVGAKDAVANTLGMGGDNTNTAKDSTTEKXLGITRRIHASNLANLLPLLVWSFAGPLHICMFPSFVISAHLV

SEQ ID NO: 124582 - protein, 213 aa, Triticum aestivum
  unsure (1)..(213): unsure at all Xaa locations
  Clone ID: PAT_TA_19000.pep
LLTSTSEVYGDPLEHPQTEAYWGNVNPIGXVRSCYXEGKRVPETLMFDYHRQHGIEIRIARIFNTYGPRMNIDDGRVVSNFIAQAIRGEALTVQKPGTQTRSFCYVADMVNGLMKLMNGDNTGPINXLGNPGEXTMLELXQNVKELIXNPEVTMTXMTGNILDDLPKRKPDINKGQGVSXWEPXXSLRXRXVLMEDISXXRLXCPRRPRLFPP

SEQ ID NO: 124583 - protein, 179 aa, Triticum aestivum
  Clone ID: PAT_TA_19001.pep
MASNQNQASYAAGETKARTEEKTGQMVGATKDKAGQATEATKQKAVETAGATKQKAGEAKDKTAQTAQAAKDRAAESKDQTGSFLGEKTEAAKQKAAETAEAAKQKASEAAQYAQERSSDAAQYTKESAVAGKDKTGSVLQQAGETVVGAVVGAKDAVANTLGMGGDNATTKDTTTRNH

SEQ ID NO: 124584 - protein, 150 aa, Triticum aestivum
  Clone ID: PAT_TA_19002.pep
LAGSCFRHRYFEEIRVLIGLDTNFTVTSKAAEDGDFAELYVFKWTTVLIPPTTILVLNLVGVVAGFSDALNSGYESWGPLFGKVFFAMWVIMHLYPFLKGLMGRQNRTPTIVILWSVLLASVFSLLWVKIDPFITGAETVATGACSSIDC

SEQ ID NO: 124585 - protein, 158 aa, Triticum aestivum
  unsure (1)..(158): unsure at all Xaa locations
  Clone ID: PAT_TA_19003.pep
EKNFYITAIAGATNGSSLVVMSKGTPYTQQSYKVSESLXYKWINKKWKEGFHVTXMGTAGNRWGVVMSRNAGYSDQVVELDFLYPSEGLHRRWESGYRITSSAGTPDQAAFILSIPKRKPLDETQETLRTSAFPSNHVKEKWAKNLYIASICYGRTAC

SEQ ID NO: 124586 - protein, 87 aa, Triticum aestivum
  Clone ID: PAT_TA_19004.pep
VLTMISHRDKSRKVCLSSCHVEGFHSPLQNLIAYPVPAAKVHRMAASKTSSENEISPAPLLLTWITGALASSFGACCDLKLEMPQTS

SEQ ID NO: 124587 - protein, 163 aa, Triticum aestivum
  Clone ID: PAT_TA_19005.pep
MASNQNQASYMAGETKARTEEKTGQMMDKAGQATEATKQKAGETAEATKQKAGEAKDKTAQTAQAAKDRAAESKDQTGSFLGEKTEAAKQKASETAQYAQDRSSDAAQYTKESAVAGKDKTGSVLQQAGETVVSAVVGAKDAVANTLGMGGDNTTKDTTTRNH

SEQ ID NO: 124588 - protein, 380 aa, Triticum aestivum
  Clone ID: PAT_TA_19006.pep
AWSRPRYKYGCALLYKSQEETDPLGNVPKSAPDEEPAKSITNKDSGNSKASSSNVKDDDPSSDKGGLEEGQNSNEKDQEDVDGESDKDGDEMAGEEDDSDLDLAWKMLDIARAIVEKNPDNTMEKVKIFSALAEVSMEREDIDNSLGDYFKALAILEHLVEPDHRRIVELHFRICLVYELASKIADAIPYCAKAVSLCKSRLESLKKAKETLLADKGDSASTADGDSKKLSIEDELEVVTGILPDLEKKLEDLEQAIATPSSEIEEIMKSIAAKAGFMQKAGNAVAPRAASLTSSQMGGVNNGFDSPTMSTAATSGSTGSTVTDLGVVGRGIKRANIKPISAEPCSKRLAADDSLSVKCDSSNNSDVHPTVQDGEGSVSK

SEQ ID NO: 124589 - protein, 214 aa, Triticum aestivum
  unsure (1)..(214): unsure at all Xaa locations
  Clone ID: PAT_TA_19007.pep
VVGLPTPIFSPTNPPHSPRCRRRRRRRRLPKMNVDKLKKMAGAVRTGGKGSVRRKKKAVHKTTTTDDKRLQSTLKRVGVNTIPGXIEEVNIFKDDVVIQFQXTPKVQASIAANTWVVQLGTPTRRKSCKIYWPTIINQLGPRITWDNLRXLAEXFPEQMPGGEAGGASIGCCPRTMMTCPRARPRRDLEEPERXGPXQEERXEENLYLYASCRF

SEQ ID NO: 124590 - protein, 355 aa, Triticum aestivum
  unsure (1)..(355): unsure at all Xaa locations
  Clone ID: PAT_TA_19008.pep
MAQKDAANGNGATTRPPPTPSPIRFSKFFQANMRILVTGGAGFIGSHLVDKLMENEKNEVIVADNFFTGSKDNLKKWIGHPRFELIRHDVTEPLLVEVDQIYHLACPASPIFYKHNPVKTIKTNVIGTLNMLGTXQRELGARILLTSXTSEVMGDPLXEHPQDGGVTGGNVNPIXXSRSCYDEGKRFTXTLDVPTTNRQHGLRFRIAXIFNTYGPRMNIDDGRVVSNFIAQAVRGEPLTVQRPGTQTRSFCYVADMVDGLIKLMNGNKTGPINLGNPGEFTMLELAENVKELINPDITVTMTENTPDDPRQRKPDITKAKEXLGWEPKIVLKDGLXVLMEDXFRERLAFPKKTKA

SEQ ID NO: 124591 - protein, 315 aa, Triticum aestivum
  Clone ID: PAT_TA_19009.pep
MSVSVSAAASSSLPPLLARRRSPPASLAPVRSLRSRSRLLSSARTTPVLLPAAAMAAPAPAASSKRDLLIFDAEENLAVALAKYTADLSAKFAAERGAFTVVLSGGSLIYALRKLTEAPYLETVDWSKWHVFWVDERVVPKDHEDSNYKLALDGFLSKVPIPAGQVYAINDALSAEGAAEDYETILKQLVKNGVLAMSKTTGFPRFDLQLLGMGPDGHIASLFPGHPLVKENTKWVTHILDSPKPPPQRITFTFPVINSSAYVAMVVTGAGKAGAVQKAISDKKTSDLLPVEMAILDDGEFTWFTDKEAVSMLQN

SEQ ID NO: 124592 - protein, 521 aa, Triticum aestivum
  Clone ID: PAT_TA_19010.pep
MAAATSPAVAFSGATAAAMPKPARHPLPRHQPVSRRALPARVVRCCAASPAATSAAPPATALRPWGPSEPRKGADILVEALERCGIVDVFAYPGGASMEIHQALTRSPVITNHLFRHEQGEAFAASGYARASGRVGVCVATSGPGATNLVSALADALLDSIPMVAITGQVPRRMIGTDAFQETPIVEVTRSITKHNYLVLDVEDIPRVIQEAFFLASSGRPGPVLVDIPKDIQQQMAVPIWDTPMSLPGYIARLPKPPSTESLEQVLRLVGESRRPILYVGGGCAASGEELRRFVELTGIPVTTTLMGLGNFPSDDPLSLRMLGMHGTVYANYAVDKADLLLAFGVRFDDRVTGKIEAFASRSKIVHIDIDPAEIGKNKQPHVSICADVKLALQGLNALLNGSKAQQGLDFGPWHKELDQQKREFPLGFKTFGEAIPPQYAIQVLDELTKGEAIIATGVGQHQMWAAQYYTYERPLQWLSWSGLGAMGFGLPAAAGAAVAKPGVTEVAIGGDGSCLIHILD

SEQ ID NO: 124593 - protein, 389 aa, Triticum aestivum
  Clone ID: PAT_TA_19011.pep
SAIFNLREIDNYDEYERSMLISQMSFEKSFGLSSVFIESTLMENGGVPESANPSTLIKEAIHVISCGYEEKTEWGKELGWIYGSVTEDILTGFKMHCRGWRSIYCMPIRPAFKGSAPINLSDRLHQVLRWALGSVEIFFSRHCPLWYGYGGGRLRWLQRLSYINTIVYPFTSVPLVAYCCLPAICLLTGKFIIPILSNAATIWFLGLFTSIILTSVLELRWSGIGIEDWWRNEQFWVIGGVSAHLFAVFQGILKMVIGLDTNFTVTSKAAEDGDFAELYVFKWTTVLIPPTTILVLNLVGVVAGFSDALNSGYESWGPLFGKVFFAMWVIMHLYPFLKGLMGRQNRTPTIVILWSVLLASVFSLLWVKIDPFITGAETVATGACSSIDC

SEQ ID NO: 124594 - protein, 516 aa, Triticum aestivum
  unsure (1)..(516): unsure at all Xaa locations
  Clone ID: PAT_TA_19012.pep
CCAASPAFTSVAPPATALRPWGPSEPRKGADILVEALERCGIVDVFAYPGGASMEIHQALTRSPVITNHLFRHEQGEAFAASGYARASGRVGVCVATSGPGATNLVSALADALLDSIPMVAITGQVPRRMIGTDAFQETPIVEVTRSITKHNYLVLDVEDIPRVIQEAFFLASSGRPGPVLVDIPKDIQQQMAVPVWDTPMSLPGYIARLPKPPSTESLEQVLRLVGESRRPILYVGGGCAASGEELRRFVELTGIPVTTTLMGLGNFPSDDPLSLRMLGMHGTVYANYAVDKADLLLAFGVRFDDRVTGKIEAFASRSKIVHIDIDPAEIGKNKQPHVSICADVKLALQGLNALLNGSKAQQGLDFGPWHKELDQQKREFPLGFKTFGEAIPPQYAIQVLDELTKGEAIIATGVGQHQMWAAQYYTYKRPRQWLSSSGLGAMGFGLPAAAGAAXVANPGVTVVDIDGDGSFLMNIQELALIRIENLPVKVMILNNQHLGMVVQWEDRFYKANRAH

SEQ ID NO: 124595 - protein, 154 aa, Triticum aestivum
  Clone ID: PAT_TA_19013.pep
MATAPPRARRPLPPPSASPSSSRPTCGSWSPAELASSARTSSTSSWRTRRTRSLLLELAENVKELINPEVTVTMTENTPDDPRQRKPDITKAKEVLDWEPKVVLRDGLVLMEDDFRERLGSAPRRPRPNSPPYVWRTTSPICQSILIVGWVRQY

SEQ ID NO: 124596 - protein, 321 aa, Triticum aestivum
  Clone ID: PAT_TA_19014.pep
MSTSMSVSVSAAASSSLPPLLARRRSPPASLVPVRSLRSCPRPRLLSSARTTPVLLPAAAMAAPAPAASSKRDLLIFDAEENLAVALAKYTADISAKFAAERGAVTVVLSGGSLIYALRKLTEAPYLETVDWSKWHVFWVDERVVPKDHEDSNYKLALDGFLSKVPIPAGQVYAINDALSAEGAAEDYETILKQLVKNGVLAMSKTTGFPRFDLQLLGMGPDGHIASLFPGHPLVKENKKWVTHILDSPKPPPQRITFTFPVINSSAYVAMVVTGAGKAGAVQKAISDKKTSDLLPVEMAILDDGEFTWFTDKEAVSMLQN

SEQ ID NO: 124597 - protein, 224 aa, Triticum aestivum
  Clone ID: PAT_TA_19015.pep
MASNQNQASYHAGETKARTEEKTGQVMGATKDKAGQTTEATKQKAGETTEATKQKAAETTEAAKQKAGETAEATKQKAAEAKDKTAQTAQAAKEKTYETAQSAKERAAQGKDQTASTLGEKTEAAKQKAAETTEAARQKAAEATEAAKQKASETAQYTKESAVAGKDKTGSVLQQAGETVVNAVVGAKDAVANTLGMGGDNTNTTKDNTTGATTKDTTTTTRNH

SEQ ID NO: 124598 - protein, 221 aa, Triticum aestivum
  unsure (1)..(221): unsure at all Xaa locations
  Clone ID: PAT_TA_19016.pep
MASNQNQASYHAGETKARTEEKXTGQMMGATKDKAGQTTEATKQKAGETAEATKQKTGQATEATKQKAGETADATKQKAAEAKDKTAQTAQAAKEKTYETAQSAKERAAQGKDQTASTLGEKTEAAKQKAAETTEAARQKAAEATEAAKQKASETAQYTKESAVAGKDKTGSVLQQAGETVVNAVVGAKDAVANTLGMGGDNATKDTTTGATTKDTTTRNH

SEQ ID NO: 124599 - protein, 323 aa, Triticum aestivum
  Clone ID: PAT_TA_19017.pep
MSTSMTVSVSAAASSSLPPLFPRRRSPPASLVPVRSLRSRPRPRPRLLSSARTTPVLLPAAAMAAPAPAASSKRDLLIFDAEENLAVALAKYTADISAKFAAERGAVTVVLSGGSLIYALRKLTEAPYLETVDWSKWHVFWVDERVVPKDHEDSNYKLALDGFLSKVPIPAGQVYAINDALSAEGAAEDYETILKQLVKNGVLAMSKTTGFPRFDLQLLGMGPDGHIASLFPGHPLVKENKKWVTHILDSPKPPPQRITFTFPVINSSAYVAMVVTGAGKAGAVQKAISDKKTSDLLPVEMAILDDGEFTWFTDKEAVSMLQN

SEQ ID NO: 124600 - protein, 195 aa, Triticum aestivum
  Clone ID: PAT_TA_19018.pep
SPHSPRRRRRRRRRLPKMNVDKLKKMAGAVRTGGKGSVRRKKKAVHKTTTTYDKGLQSTLKRVGVNTIPGIEEVNIFKDDVVIQFQNPKVQASIAANTWVVSGTPQTKKLQDLLPTIINQLGPDNLDNLRRLAEQFQKQMPGGEAGGASIGAAQDDDDDVPELVPGETFEEAAEEKKEPEAKKEAEPEEKKESSS

SEQ ID NO: 124601 - protein, 212 aa, Triticum aestivum
  Clone ID: PAT_TA_19019.pep
MASNQNQASYHAGETKARTEEKTGQVMGATKDKAGQTTEATKQKAGQTTEATKQKAGETAEATKQKAGQATEATKQKAGETAEATKQKAAEAKDKTAQTAQAAKERAAETKDQTGSYLGEKTEMAKQKAAETTEAAKQKASETAQYTKESAVAGKDKTGSVLQQAGETVVNAVVGAKDAVANTLGMGGDNATKDTTTGATTKDTTTTTTRNH

SEQ ID NO: 124602 - protein, 370 aa, Triticum aestivum
  unsure (1)..(370): unsure at all Xaa locations
  Clone ID: PAT_TA_19020.pep
MFGFGHHGHHGQNPPAHAPAAAGGNQPTFKIFCKADEGYCLSVRDGNVVLAPSNPRDEHQHWFKDMRFSSQIKDEEGNPAFAIVNKATGLAVKHSLGQSHPVKLVPFNPEYLDESVMWTESSDVGKGFRCIRMVNNIRLNFDALNGDKDHGGVHDGTTXVLWEWAKGDNQSWKILPWGEEAYAGGSANAPRGGXQSPTVRIFCKADDGFSGHRPQRALVVLAPTNPRDEXYQHWXRDMRHSNRIKDEXEGYPAFALVNKVTXGEAIKHSQGEGHPXVKLVPYNANYQDESVLWTESRDVGXAFRCIRMVNNIYLNFDALHGDKEHGGXVRDGTFLVLWKXWCEGDNQRWKILSWCKCPLTRSHFLASGEH

SEQ ID NO: 124603 - protein, 214 aa, Triticum aestivum
  Clone ID: PAT_TA_19021.pep
MKSLFAVVGLPTPIFSPTNPPHSPRRRRRRRRRRLPKMNVDKLKKMAGAVRTGGKGSVRRKKKAVHKTTTTDDKRLQSTLKRVGVNTIPDIEEVNIFKDDVVIQFQNPKVQASIAANTWVVSGTPQTKKLQDLLPTIINQLGPDNLDNLRRLAEQFQKQMPGGEAGGASIGAAQDDDDDVPELVPGETFEEAAEEKKEPEVKKEAEPEEKKESS

SEQ ID NO: 124604 - protein, 347 aa, Triticum aestivum
  unsure (1)..(347): unsure at all Xaa locations
  Clone ID: PAT_TA_19022.pep
MFGFGHHGHHGQNPPANAPAAGGGNQPTFKIFCKADEGYCLSVRDGNVVLAPSNPRDEHQHWFKDMRFSTQIKDEEGNPAFAIVNKATGLAVKHSLGQSHPVKLVPFNPEYLDESVMWTESGDVGKGFRCIRMVNNIRLNFDALNGDKDHGGVHDGTTVVLWEWAKGDNQSWKILPWGEEAYAGGSANAPRGGSTEPTVRIFCKADXGFSATVRNGAVVLAPTNPRDEYQHWFKDMRHSNRIKDEEGYPAFALVNKVTGEAIKHSQGEGHPVKLVPYNANYQDESVLWTESRDVGAGFRCIRMVNNIYLNFDALHGDKEHGGVRDGTSLVLWKWCEGDNQRWKILPW

SEQ ID NO: 124605 - protein, 317 aa, Triticum aestivum
  unsure (1)..(317): unsure at all Xaa locations
  Clone ID: PAT_TA_19023.pep
MFGFGHHGHHGQNPPAHAPAAAGGNQPTFKIFCKADEGNPAFAIVNKATGLAVKHSLGQSHPVKLVPFNPEYLDESVMWTESSDVGKGFRCIRMVNNIRLNFDXALNGDKDXHGGVHDGTTVVLWEWAKGDNQSWKILPWGEEAYAGGSANAPRGGSSEPTVRIFCKADDGFSATVRGFSATVRNGAVVLAPTNPRDEYQHWFKDMRHSNRIKDEEGYPAFALVNKVTGEAIKHSQGEGHPVKLVPYNANYQDESVLWTESRDVGAGFRCIRMVNNIYLNFDALHGDKEHGGVRDGTSLVLWKWCEGDNQRWKILPW

SEQ ID NO: 124606 - protein, 349 aa, Triticum aestivum
  unsure (1)..(349): unsure at all Xaa locations
  Clone ID: PAT_TA_19024.pep
MAQKDAANGNGATTRPPPTPSPIRFSKFFQANMRILVTGGAGFIGSHLVDKLMENEKNEVIVADNFFTGSKDNLKKWIGHPRFELIRHDVTEPLLVEVDQIYHLACPASPIFYKHNPVKTIKTNVIGTLNMLGLAKRVGARILLTSTSEVYGDPLEHPQTEAYWGNVNPIGVRSCYDEGKRVAETLMFDYHRQHGIEIRIARIFNTYGPRMNIDDGRVVSNFIAQAIRGEALTVQKPGTQTRSFCYVADMVNGLMKLMNGDNTGPINIGNPGXEFTMLELAENVKELINPEVTVTMTENTPDDPRQRKPDITKAKEVLDWEPKVVLRDGLVLMEDDFRERLAVPKKTKA

SEQ ID NO: 124607 - protein, 455 aa, Triticum aestivum
  Clone ID: PAT_TA_19025.pep
MDSSSDNFVAPVDERQDPPLPNPSEEEAGGEEKERGEEKTLERAEELFDKGSKAIEEGDFVVAVDCLSRALEIRVERYGELASECASTYYKYGCALLYKSQEETDPLGNVPKTKSTTNKDSGNSKASSSNVKDDDPSSDKGGLEGQNSNEKDQEDVDGESDKDGDEMGGEEDDSDLDLAWKMLDIARAIVEKNPDNTMEKVKIFSALAEVSMEREDIDNSLGDYFKALAILEHLVEPDHRRIVELHFRICLVYELASKIADAIPYCAKAVSLCKSRLESLKKAKATLLADKGDSASTADGDSKKLSIEDELEVVTGILPDLEKKLEDLEQAMATPSSEIEEIMKSIAAKAGFMQKAGNAVAPRAASLTSSQMGGVNNGFDSPTMSTAATSGSTGSTVTDLGVVGRGIKRANIKPISAEPCSKRLAADDSPSVKCDSSNISDVHPTGQDGEGSISK

SEQ ID NO: 124608 - protein, 349 aa, Triticum aestivum
  unsure (1)..(349): unsure at all Xaa locations
  Clone ID: PAT_TA_19026.pep
MAQKDAANGNGATTRPPPTPSPIRFSKFFQANMRILVTGGAGFIGSHLVDKLMENEKNEVIVADNFFTGSKDNLKKWIGHPRFELIRHDVTEPLLVEVDQIYHLACPASPIFYKHNPVKTIKTNVIGTLNMLGLAKRVGARILLTSTSEVYGDPLEHPQTEAYWGNVNPIGVRSCYDEGKRVAETLMFDYHRQHGIEIRIARIFNTYGPRMNIDDGRVVSNFIAQAIRGEALTVQKPGTQTRSFCYVADMVNGLMKLMNGDNTGPINIGNPGEFTMLELAENVKELINPEVTVTMTXENTPDDPRQRKPDITKAKEVLDWEPKVVLRDGLVLMEDDFRERLAVPKKTKA

SEQ ID NO: 124609 - protein, 80 aa, Triticum aestivum
  Clone ID: PAT_TA_19027.pep
MAKRLAVALLLLVLLASSDAGAAARAAIGVGEKKALVPGLPVDLPLPGLPGLPGLPGLPGLPGLPGLPPVPKLTATNKSP

SEQ ID NO: 124610 - protein, 80 aa, Triticum aestivum
  Clone ID: PAT_TA_19028.pep
MAKRLAVALLLLVLLASSDAGAAARAASGVGEKKALVPGLPVDLPLPGLPGLPGLPGLPGLPGLPGLPPVPKSTATNKSP

SEQ ID NO: 124611 - protein, 78 aa, Triticum aestivum
  Clone ID: PAT_TA_19029.pep
MAKRLAVALLLLVLLASSDAGAAARAASGVGEKKALVPGVDLPLPGLPGLPGLPGLPGLPGLPGLPPVPKSTATNKSP

SEQ ID NO: 124612 - protein, 97 aa, Triticum aestivum
  Clone ID: PAT_TA_19030.pep
TIDDHGDLLALDLRTGRGVTPGTPPPITDDAVPTTGGSTPATTGAGNPGSGNGAFISPTALPAPCFPFSSPASLDASRTSSRSATARRFAIANWEFL

SEQ ID NO: 124613 - protein, 78 aa, Triticum aestivum
  Clone ID: PAT_TA_19031.pep
MAKRLAVALLLLVLLASSDAGAAARPANGVGEKKAVVPGLPVDLPGLPGLPGLPGLPGLPGLPGLPPLPKSTATNKSP

SEQ ID NO: 124614 - protein, 199 aa, Triticum aestivum
  Clone ID: PAT_TA_19032.pep
PQSAACPKSQPHPNRPTLLPPRPPPPPSTFRCGRPPFATPSIPPQCLPDYCRQPPFASSSQTICTRTGREGDPMGGGGRSRCPHRGSAAGMREERTRLRGPRIRRRTCARGGQRGAGHNSRSGRPEQSVKLGSGHMLWVAPFRATRRHRWAVLAAGGGAPPLPPLPVTRTRPQRPESAASLRGSLGCRLRRRATTTPAA

SEQ ID NO: 124615 - protein, 304 aa, Triticum aestivum
  Clone ID: PAT_TA_19033.pep
ATYGLQKMKSLEHLDLILSRVTDGAIEYVANIGTKLRYLSLKNTGITSQAPCILAGTVPNLASLSLAYTKVDDSALVYISMMPSLKVIDLSHTSIKGFTRVEANSEKILSLPLLEHLIYLESLSLEDAPLSDEVIPPMASFRALKYLYLKSDFLSDPALQALSSASNLIHLGFCGSVLSNSGLLQFVPPAQLHVLDLSGCWVLTEYAISSFRSHHPVIEVRHELIQELQPSHIGTSQVRKSRHLPRGKTNFFNSSADSSRHSGIFFVDQRIKYSREKMLEIQDLTQSNSVLHDVQLPPELRRME

SEQ ID NO: 124616 - protein, 139 aa, Triticum aestivum
  Clone ID: PAT_TA_19034.pep
MATFATSSPAVMVSARPGRVARARRCVVARASATMAAPATVAAGRTHYEVLGLGAGAGRGEIKAAYRRLAREVHPDAVGGGGDEGFIRLHEAYATLTDPEERARYDRDVTCRAAGMMMRRAAAAGHTFKRRTWETDQCW

SEQ ID NO: 124617 - protein, 140 aa, Triticum aestivum
  unsure (1)..(140): unsure at all Xaa locations
  Clone ID: PAT_TA_19035.pep
MATFATSSPAVMWSARPGRVAGARRCVVARASATMAAPAALATGRTHYDVLGVGAGASRGEIKAAYRRLAREVHPDAAGGGGDEGFIRLHAAYATLADPDERARYDRXRGLPRRREMMMRRAAAAGPAFRRRTWETDQCW

SEQ ID NO: 124618 - protein, 218 aa, Triticum aestivum
  Clone ID: PAT_TA_19036.pep
CGRLALGGWQGLGGAWWRVASAAMAAPAAVATGRTQGGYEVLGAGAPGPARGPTSRAAATRRLGHGEVHPDRRAEGGGDEGFIPAAALPTPRSPIPTSALATTGTSPAAPRGVMMQPGGRGRAGVPAEDVGDRPVLVGEADSRGCTPGTIGRFDQGRRIMEAALVGEKIPPTALDRQRPVRNGRLRSGVRTRELSTRRQESFFQRSLVRPNSQMQICK

SEQ ID NO: 124619 - protein, 198 aa, Triticum aestivum
  Clone ID: PAT_TA_19037.pep
MGLTSAKGIALTVSLFGLLAFLLGVIAENKKPPYGTPIKGKDVVICKFPSDPTIAMGSLSIVALVLAAFIGHVAIFYPYKGKSVPRGALFQSTSLSVFFVIAELVSALAFAMLLWATITEGHHRTSNVHHDMDTLCPTAKTGLFGGAAFLALDAALFWLVCQMLALNARADYLDEDEDEDDKGEYGQVYAADADGTKV

SEQ ID NO: 124620 - protein, 161 aa, Triticum aestivum
  Clone ID: PAT_TA_19038.pep
RPAPLHSLLGSCLSRRMPPHRGPVWSSTLLSQRRDQALCRCAHPGTPILLALHPLVTSPLYAQAPPTAAAVSLSASRWKRKARLRRPVQNLALLTMADLPRTKKANQRKGNGRSRSTEGGRAARGTQAPRRPTPSRHPAFPRLAHASRAAVAGDEVGATRR

SEQ ID NO: 124621 - protein, 450 aa, Triticum aestivum
  unsure (1)..(450): unsure at all Xaa locations
  Clone ID: PAT_TA_19039.pep
MAPLTPRLVVPIDVKKKPWEQKVCLHNRWHPDIPPVADVTEGELFRVEMVDWTGGRVRDDDSADDIKFLDLTITHYLSGPLRIVDAEGVPASPGDLLAVEICNLGPLPGDEWGYTGIFEKDNGGGFLTDHLPSARKAIWYFEGIYAYSPQIPGVLFPGLTHPGIVRTAPSVELLNIWNERERKIIETGDALLKRDVVLHQPLATLPTSANCLLGRKTQEGTAEWKKIANEAARTIPGRENGGNCDIKNLGRGSKVYLPVFVEGANLSTGDMHFXSQGDGEVSFCGAIEMSGFLELKCEIIRGGMKEYLTPVGPTALHVNPIFEIGPVEPRFSEWLVFEGISVDESGKQHFLDASVAYKRAVLNAIEYLSRFGYSKEQVYLLLSCCPCEGRISGIVDAPNAVATLAIPTAIFDQDIKPKRLGHGPKLRRLPDVLRXRCSRHLPVTQGQYHV

SEQ ID NO: 124622 - protein, 113 aa, Triticum aestivum
  Clone ID: PAT_TA_19040.pep
LPRVRPRVRRSKIPAGPWFPSFFLAHWKVLPAIWVPGDWRKRAWGFGNSSINPIISLVHCLLGRNCIRCSVHGPGVLIGWDPSACNGFVQGSPASRQSEKASLGFFPITISGP

SEQ ID NO: 124623 - protein, 314 aa, Triticum aestivum
  unsure (1)..(314): unsure at all Xaa locations
  Clone ID: PAT_TA_19041.pep
MARLPGLRCCDLAARGSLPPLGLACRPRRSPRASALRYSSLQAGDSLGKDVLRMFLEDRQTNGDLVSKVADMVLRRNDTGLDVLEATTDQENAADVGQPEDFRDDVMSEGVVGFEAIGDFVSAEGSLTARRRLSALAGQKESDKRKEFNLLRYEAIKDELLLLTIGIGSXCTIYCVLVLSVEAXISYAFGVAFSWLYLQLLYRHPDNLSKEDVPEVFLKKKVKKPRPPSVDGQDAIGWTLGAPPWVLPSPWLLFPPVILGLSTWSRPSQPSFFNFELVPGMMGFFAYKAAALVQVYRDNDDLRLILPEDDPDYT

SEQ ID NO: 124624 - protein, 186 aa, Triticum aestivum
  unsure (1)..(186): unsure at all Xaa locations
  Clone ID: PAT_TA_19042.pep
MAADEAPTTEAACQDLVEILDEGSGRLDMGRYVDHVRDLSAGAIATFEGTTRDHLDGRRVVELRYEAYGAMARDDWQPPDRDHRAAHALCRLAVAHRXGREPPARHTCNILTLXLHRADAMDACRYVIDEIKASVPIWKKEVYDDGEVWKENREFLDRTDAEKKGKPAAAAGRGGGGCYGSKVRVS

SEQ ID NO: 124625 - protein, 303 aa, Triticum aestivum
  Clone ID: PAT_TA_19043.pep
LTPAVGTSSRSSSSGIATKRSRSSSSGIAAKQRPWRGAMASTTTAAGELGRCYRRFETELVDKRWCCNAATCPRQPGCDAQLSPRPWRCVQPQLRCNATSCSGGTTVMDRLSPTSKLPWSAHHPRRSCNGAPVTCGGAAMERSSSGPGPVLLCSTRAMGPGAASQCLPAARCSVAVGSWESSALLPRLESMPLPRPATMLCCSRLVYCRRELPWPGGCCKGKAPGVLQGAATCRGVLPSLVLRASFHMAAVAACESQARLSDLCGEILRSLRGEEDEATAGVVLLENNVVKLANPTFVGALIG

SEQ ID NO: 124626 - protein, 208 aa, Triticum aestivum
  Clone ID: PAT_TA_19044.pep
MGEASPESSGAAAGGPSIPGPPRKGKSCKGCLYYSSVLKSRGYNPICVGIPRSIPQVPGFVVEEPREEAAAQGHDLRQFKYACAGYSMFVDDRDAKSGENDAKALLPYCQGLELLVDSRMVERKSPAVEHASTRNPKPKEAAAAAATTQPQEQGQRPQLATRGRTRGFRRSAGLVASGVAKNLNKTGSYIKQNVEDIFSPDRRPPPKQ

SEQ ID NO: 124627 - protein, 206 aa, Triticum aestivum
  Clone ID: PAT_TA_19045.pep
MGEASPESSGAAAGGPSMPGPPRKGKSCKGCLYYSSVLKSRGYNPICVGIPRSIPQVPGFVVEEPREEAAAQGHDLRQFKYACAGYSMFVDDRDAKSGENDAKALLPYCQGLELLVDSRMVERKSQAVEHASARNPKPKEAAAAATQPQEQGQRPQLARQEFMARFRRSAGLVASGVAKNLNKTGTYIKQNVEDIFSPDRRPPPKQ

SEQ ID NO: 124628 - protein, 183 aa, Triticum aestivum
  Clone ID: PAT_TA_19046.pep
MEEQGERGLQLLLPAAAARVLREAPVSAATDHQQLDLDLSMSIGPRQQQLLQLQLPRPAPPTPPANESRRAAATVAASAATARQLQQQQVTVDVRSVKQQTAEQARMASAERAYAERVRELAKRELELAEREFARARMIWERAREEVERVERMKQIAARRLGSAASAAALEITCHACMQRFHP

SEQ ID NO: 124629 - protein, 186 aa, Triticum aestivum
  unsure (1)..(186): unsure at all Xaa locations
  Clone ID: PAT_TA_19047.pep
TRPAAEIRREIGAEVAVLSSAHSIVPGLAVVIVGSRKDSQTYVHMKRKACAEVGIRSFDVDLPEDISEAALVAEVHRLNADPAVHGILVQLPLPKHINEENILNQISIEKDVDGFHPLNIGKLAMKGRDPLFVPCTPKGCMELLSRSGVTVKGKHAVVVGRSXIVGLPVSLLLLKADATVSIVHSR

SEQ ID NO: 124630 - protein, 320 aa, Triticum aestivum
  unsure (1)..(320): unsure at all Xaa locations
  Clone ID: PAT_TA_19048.pep
SSSLRGRKSSRSERGEDHLRRQGRRRSTAARAPPRGGRAPVRAQPRARSSAPSCGAGLGVAIVGERKDSQTCGRRKRQARGEAAIRSFDVDPREAIAPPALLADVPRITAAPSIDGIFVQLPLPKPINEENMIKISFALRNDVDGLYNLDIRKLEMKGREPVFGPCKAKGGTELLKRSGVTGKGQHAVVGXPSIMVGLXLSLLLLKAEPTVSIVHSRNPNPETIVXRQADIXVIAGXGQAMMVNGRLDQTRRGGSSDVGTNSIXTTPTRKPGYRLVGDVDFSEASKVAGHLTPVPGGVGPMTVAMLLKNTVDGAKRGIVS

SEQ ID NO: 124631 - protein, 304 aa, Triticum aestivum
  unsure (1)..(304): unsure at all Xaa locations
  Clone ID: PAT_TA_19049.pep
MASTAQLLGHLAGSTATASLSFTPVSGGGSSSKVRFLPATAQRRRVVARPRAAVSGAEKEKAKPAESGGKEDERVVQVHSAEGVXDARSRTAKNRLVVVEFAAXHSVNSKRIYPCMVDLSRTCGDVDFLLVMGDESEATRELCQREGITQVPHFSFYKGTEKVHEEEGIGPDQLAGDVLYYGDNHAGVVQLHSRTDVEALMAEHSGEGGKLLVLDVGLKHCGPCVKVYPTVVKLSRSMADTAVFARMNGDENDACMQFLKDMEVVEVPTFLFIRDAKIVGRYVGSGKGELIGEILRYQGVRVTY

SEQ ID NO: 124632 - protein, 170 aa, Triticum aestivum
  Clone ID: PAT_TA_19050.pep
MAAAAISLCGSRCVGPSRKPEPRLASQAAAAPCARPSSSRRKLVVAAAKSSGKKADEKVPSWARPGSDEPPPWARDEGGASGQEGDAVQVPFYAYLLASAVTAIAAIGSIFEYTNGRAVFGVVGTDSPLYAPILGFFAVTGIPTSGYLWYKAVQTANKDAEEQDRRDGFL

SEQ ID NO: 124633 - protein, 125 aa, Triticum aestivum
  Clone ID: PAT_TA_19051.pep
PRVRPRVRGRVGAAALLRAARASRHLALPRSIASSPSQLSSSSSCTASAAETPSPAAAAPAIPADVEDAVVVVAEEDDLRSHIFRLRLAKRSATEALEKWAGKGRAAPAPELRRIHGPRGLQRNS

SEQ ID NO: 124634 - protein, 147 aa, Triticum aestivum
  Clone ID: PAT_TA_19052.pep
MSKPVKIGPWGGDGGEPRDIEYTPFALVGVAVRSGDAINGVRFTYVDTSGNLHEEEWGGSEAEKFEQLLLQELEYVLEISGTYGSPPESYVTSLELVTNKGRTIRGGTAGSGGSFNVPLVSTRIIGFFGAAGTTYIDSFGMYAGFAA

SEQ ID NO: 124635 - protein, 148 aa, Triticum aestivum
  unsure (1)..(148): unsure at all Xaa locations
  Clone ID: PAT_TA_19053.pep
MSSLALFSPSSSSSSLFLTKQAHPTKARAPAVVRCGSGPTLSGPHQEEEREGVMVALVGRRNALASAAAACGVSVLGFAGDGLAAAKQGPLAGRIPGLSGPDQNGWKTYRRPDEKSGGHGVGWSPIIPYSFKVPDGXEETPVSIADLG

SEQ ID NO: 124636 - protein, 167 aa, Triticum aestivum
  Clone ID: PAT_TA_19054.pep
HASGIYIAAGEIYGGDKYISKLRSYFPNLVSKEVLATKEELEKFKNHASQVAALDYIISVESDVFIPSHSGNMARAVEGHRRFLGHRKTLTPDRRGLVELFGLLEKGELMEGPKLSSLVTKMHKYRQGTPRKRYASLPGSKGRARLRTEESFYENPFPECICLTGKH

SEQ ID NO: 124637 - protein, 97 aa, Triticum aestivum
  Clone ID: PAT_TA_19055.pep
AVGSVVCITSIFAGPVSGGSMNPARTLAPAVASGVYTGLWIYFLGPVIGTLSGAWVYTYIRFEEEPSVKDGPQKLSSFKLRRLQSQRSMAVDEFDHV

SEQ ID NO: 124638 - protein, 144 aa, Triticum aestivum
  unsure (1)..(144): unsure at all Xaa locations
  Clone ID: PAT_TA_19056.pep
VDGTLENQRAHWDDFVKFKDSELAKEWSRINKKNAEKKDKFHKLGPGGYAVAVPKWDKSDKEMEDAGATPVTKSWPPRGRTWFYAHGGSXDPKTGNVSTKACLNGADDALLVAIEEARSGVFQPNRENDELTRALGNPEHPGRT

SEQ ID NO: 124639 - protein, 231 aa, Triticum aestivum
  unsure (1)..(231): unsure at all Xaa locations
  Clone ID: PAT_TA_19057.pep
MEPGRKATIMMVPRSASALLAVVAPLLPAPAPAGGPHYLQHVCCVAHHKSDLKVNGFPCKANATADDFFTGVLAKPGATNTTGGSVXTGSQRGRSVPGPHSTLGVSLSLHRLRPPGGLNTPHTDPRATEVVFALXGELDGLHIHRTHTLLPDTIPRGDVCLFARPLAHFQKKYSDTPAAHISPLHPAXPGTPSVAMTLFGAPQVPDDVLAKAFQIGTXEVDKIKAKFAPKK

SEQ ID NO: 124640 - protein, 242 aa, Triticum aestivum
  Clone ID: PAT_TA_19058.pep
MTHVADAVPCFSGLLNTLPPWLTPAPRAPRRPAGFAPGAPSRAMMSIVSTAADLLQDFRTGYVTLSSPESMFVSQLIGTALGCVIAPLTFGLYWSAFDVGNPDGMFKAPYAVIFREMAILGVEGFSALPQHCLAICSFFFFAAIAINLLRDVTPDSVSKFIPLPMAMAVPFYIGAYFAIDMFVGTVILFVWEKINRKESEDFAGAVASGLICGDGIWSVPSAILSIMRIDPPMCMYFKPSLA

SEQ ID NO: 124641 - protein, 108 aa, Triticum aestivum
  Clone ID: PAT_TA_19059.pep
HYKQEHGKAIDEVLEGNRNDKLSAMLKTAVWCLTSPEKHFAEVIRSSIIGLGTDEESLTRAIVSRAEVDMKKVKEEYKVRYKTTVTKDVVGDTSGYYQGILLTLIGAE

SEQ ID NO: 124642 - protein, 296 aa, Triticum aestivum
  Clone ID: PAT_TA_19060.pep
MASISVPDPAPSPTEDAESIRKAVQGWGTDENALIEILGHRTAAQRAEIAVAYEGLYDKPLLRTLQDELSSHFKGAMTLWAMDPAARDAKLAYKALRKKGGDRHAWVLIEVACASSPDHLVAVRKAYCSAYDSSLEEDVAACPLYKDPLKQFLVRLVSSYRHGGEHVDGELARAEAAELHGAVAAKKQPLHGDVVRIVSSRSKPQLKATFQHYKREHGKAIDEVLEGNRNDKLSAMLKTAVWCLTSPEKHFAEVIRSSIIGLGTDEESLTRAIVSRAEVDMKKVKGGIQGEVQRRR

SEQ ID NO: 124643 - protein, 149 aa, Triticum aestivum
  Clone ID: PAT_TA_19061.pep
PTRPICLFTLLFLERPPTAVLLSRAEPPTPAARPQVPLAAAALLPPGPRTRPMEFSRRGRATDDAGDGQRFPDPPPHGDPMLVMRDALLSQLQKDRLRQEIIVAELAKIERAMALRAATGGQQATPAPAGECLKTYDGNAARQNAASDE

SEQ ID NO: 124644 - protein, 132 aa, Triticum aestivum
  Clone ID: PAT_TA_19062.pep
TAPAAAAPISSACSLQTVFWSGGPAGLSPSVSAYCSERRASISGHRKSPVAVQVGGEHDALGTRNWPRMADRRCRSPDVQIVLQVAVGSGSRPGMARTMDGLMAAGSGCSPRHVAGSEEGGRDPDGVDRWRR

SEQ ID NO: 124645 - protein, 312 aa, Triticum aestivum
  Clone ID: PAT_TA_19063.pep
MRHSRKIITPGRLSTAKGIPAAMAAAAARSGSRRLFSISALVPPKPPSPPPKADPFASLFVPGLSKRTVADGLRGAFAKSGEVVHGSLLTNLPASSVKKSRWYMINANRSGPLTVRKEYRKVLPSFIRPSASYSTQASEKRPKQERTDLTTVEDPFNAPTYNIPEKPVTFVEGASYSVVILAGLGVAALAGYAVFKELIFEPKEYKIFGKALARVQSDSQVTAKIGYPITGYGTESRNRAARQRIQNRVWTDEDGVEHVEVGFHIRGPHGAGKVFAEMFKDSSDRTWKFTFLLVEITSPRPAQIMLESYLPA

SEQ ID NO: 124646 - protein, 495 aa, Triticum aestivum
  unsure (1)..(495): unsure at all Xaa locations
  Clone ID: PAT_TA_19064.pep
PLLPRGRGGHPLPPPWERWRRRTSAASPRGGATRGRIQELLVEVHGGEGPGDAIDNAVRSLVAGLGEDDRREGLRQSPKRAAMNFRSGTRRYRXRVKDIMQGALFPDFGVDEGTGSAGGTGEQVVVRDIDLYSYCKSCLLPFSIQCHVGYVPSGGRVVGLSKLSRVADVFAKRFQNPQRLANEVCGALHASIQPAGVAVAMQCWHIPLPENFKCKNSGALIRTSHSSRSGVFEGENSSFWNDFVALLKLRGIDMEMDSRSASLTWCPLRPHEVPLCNGHAKKITTNGASSAKSASIPSNMVSAVSSMLLSLGEDPLRKELLGSPQRYVQWLMRFRACNLDVKLNGFTLNSASVYERPGEDATDHRAISSELHLPFCAQCEHHLLPFYGVVHIGYFGSGDGEGINRSHFQALVHFYGCKLQVQERMTRQIAEAVYSVSHRGAIVVVEANHICMISRGIEKIRSSTATVAVLGQFSTDFSAKASFLQNILDTANQEV

SEQ ID NO: 124647 - protein, 221 aa, Triticum aestivum
  Clone ID: PAT_TA_19065.pep
MAAPAAAGSGAVVPAGDGEGWTPSFGDMVWGKVKSHPWWPGHVYSLTLSDDPEVHRGHRHGLVLVAFFGDGSYGWFEPHELVRFEDHFVEKTSQGGSRTFPAAVAESLDEISRRSALALLCPCRGPDTFRPHNEDRRFLLVNVPGFDSNAEYLPEQVTAARERFVPQKMYDFLQNAAVQQRDAAETAARTLPGIEMAAMLMAYRRSRYERYDLTYAESFGV

SEQ ID NO: 124648 - protein, 446 aa, Triticum aestivum
  Clone ID: PAT_TA_19066.pep
PRVRPVLFSHASNPATAERLAASASLLPSAASPSSSTRRATVASGLRLRPSPSRFSQAASRGRGGAGAAGVVPRLRVVRCMAASEAAQLKSAREDIKEILKTTYCHPILVRLGWHDSGTYDKNIEEWPQRGGADGSLRFDPELSHGANAGLTSALKLIQPIKDKYPGIQIARYYLCGFVTVRRELHQLKLPMKYGRVDITAPEQCPPEGRLPDAGPRLPAEHLREVFYRMGLDDKEIVALSGAHTLGRSRPDRSGWGKPETKYTKDGPGEPGGQSWTAEWLKFDNSYFKDIKEQRDQELLVLPTDAALFDDPSFKVYAEKYAEDQEAFFKDYAEAHAKLSNLGAKFDPPEGFSLDDDKGAVATEEKAVADPAPTSDTNGTGPQPEPFVAAKYSYKKRELSDTMKQKIRAEYEGLGGSPNKPMKSNYFLNIMIVIAGLAFLTSLAGN

SEQ ID NO: 124649 - protein, 187 aa, Triticum aestivum
  Clone ID: PAT_TA_19067.pep
MGDVAKDLAAGTVGGAAQLVVGHPFDTIKVKLQSQPTPPPGQPPKFAGAMDAVKQTISAEGPRGLYKGMGAPLATVAAFNAVLFTVRGQMEALLRSEPGAALTVGQQVVAGAGAGVAVSFLACPTELIKCRLQAQSALATAAPAAAAAAAPAGGAAATVTATANAAAVKYGGPLDVARHVLRSEGGV

SEQ ID NO: 124650 - protein, 202 aa, Triticum aestivum
  Clone ID: PAT_TA_19068.pep
MSMRDRGASTVSPSLRFLGFIKQPDDAGAADQELELDERDVVWSSSPSFSSASTASSPSPTPSPSGGSHRWPLSSRAFPSGGAGLSSLIADEDNHSPSAAIPAAARREKQPRSQPYHQSAPVAVPAWSKATADRRRREAEQEAADEEEELEDDELMVPPHEMAARRAAAAASVMEGAGRTLKGRDLRRMRNAVWRTTGFLDL

SEQ ID NO: 124651 - protein, 127 aa, Triticum aestivum
  Clone ID: PAT_TA_19069.pep
LKLPGQMCGKLLYRCHLWWIQNMCYMYILFRHFCNAKVHQILASHAGACEQIGVTVGRIVSRWQSHVGTTARRRSSVVAVLLGLCAPAAIAAAAELLVALVRRVVLRAAGRRKAHLLLFAVAILLAL

SEQ ID NO: 124652 - protein, 401 aa, Triticum aestivum
  Clone ID: PAT_TA_19070.pep
MAKPGILGRSSMPRSNEGMRLVFSAVIGIMLGYLFGISFPTVNITKLHFPSSIVSYIEDRNSGITTQTLLNHAWTSANSHKKNNSDSKSDEIPKIYVTSNPKGAERLPPGIVVSETDLYLRRLWGEPSEDLTIQPKYLVTFTVGIAQKANIDAAVKKFSENFTIMLFHYDGRTTEWDEFEWSKRAIHVSVSKQTKWWYAKRFLHPDVVARYDYIFIWDEDLGVQHFNAEEYITLGTKHGLEISQPGLEPDRGLTWQMTKRRGDREVHKVTEERPGWCSDPHLPPCAAFVEIMATVFSRDAWRCVWHMIQNDLIHGWGLDFALRKCVEPAHEKIGVVDAQWIVHQGVPSLGNQGKSENGRAPWEGVRGRCRKEWGIFQARLADAEKKYYLDQGITPPNSTSV

SEQ ID NO: 124653 - protein, 94 aa, Triticum aestivum
  Clone ID: PAT_TA_19071.pep
MACPAQSMLSASSCVLLRSSKPQQATIPRGGGGINGGNRFLTLSCNASSSPDDSECNDVECAPEKEVGSLSVEWLAEDRTKVVGTFPPKKKGWT

SEQ ID NO: 124654 - protein, 185 aa, Triticum aestivum
  unsure (1)..(185): unsure at all Xaa locations
  Clone ID: PAT_TA_19072.pep
MPPPAPDASECDDVECAPEAEVGSLSVEWLPEERTKVVGTFPPKKKGWTGLVEKDTXGQTNIYSIEPAVYVAESAISSGTAGXSSDGSENTAALGAGXALIFVAGAASILIQVSKNQPPXRPQYSGPASQAYYVAQVPSRACRGHCSVPVEAPPVVEADGAPGGDLLIQPPSRLNLRQPRGSRSR

SEQ ID NO: 124655 - protein, 126 aa, Triticum aestivum
  Clone ID: PAT_TA_19073.pep
HRFIFATAEAGSVLDYRPSTVAAAAILAASYGALLTKEALESKMDNLSPPCPIEKEHVHACYSMMVGDLRNRKSNGKRSLPCSDSNEVATSTYDSVLVDDVADTAAFMAAVSEMNKRIRLEPPGIH

SEQ ID NO: 124656 - protein, 151 aa, Triticum aestivum
  unsure (1)..(151): unsure at all Xaa locations
  Clone ID: PAT_TA_19074.pep
MNADYGAPTELAGPLQQRRALYQPRLPPCLQGATVRVEYGDATTTIDPTGAHAVAQAFPRTYGQRLVTFLAPDDTAGAGKAVDERPPIRVGVVFSGRQSPGGHNVVWGLHDALKAYNPQSILYGFIGGTEGLFANKDIGDXTDDVLASFKN

SEQ ID NO: 124657 - protein, 231 aa, Triticum aestivum
  Clone ID: PAT_TA_19075.pep
MDILPCPSTRVGPGVLLTLKVSGSLTSERSARSTFPELEGFRVAALRGFRRVFSHAAPIFFERGIAIEATKEFSSLSVEHCEGEMIVVTVFEIKEEEVPAFIERELEFRFLAVVPEGLDGVPFPNPAVVCARYSDEEYFQVRCKGSKEIYNQHYGRYNIDKIWRDDILPCRLYLRHCVLAAKNLGEPAYSNFLDHTYLGDRRTTIREYLATTGAGIMEEEPPETLRSRYGG

SEQ ID NO: 124658 - protein, 81 aa, Triticum aestivum
  Clone ID: PAT_TA_19076.pep
YDRLHKFMSSLIVHALPCKYSNSEEKKVTKKQLCTVKNKARDKFSMHVNISTHNFAAVDIPSGLLLLVNHPIVYGCLRLTF

SEQ ID NO: 124659 - protein, 161 aa, Triticum aestivum
  unsure (1)..(161): unsure at all Xaa locations
  Clone ID: PAT_TA_19077.pep
IIRQCPQXDKPDDGSIMDEKAEHDKSLDDKAEDEKGSSVENNLHGGCQNLLSNCNFARAPTRPRSIPAHRNGASAHRDTALAKQVDLAPLMVIDEAANDSSLTNVQGDNKDDLVCLEHTDPSLACNQMVEHMRLQEEAAQTEIRDVQEQNSTAQHYTVQEN

SEQ ID NO: 124660 - protein, 131 aa, Triticum aestivum
  Clone ID: PAT_TA_19078.pep
FLTTKTGKGTPQWMAPEVLRNEPSNEKSDVYSYGVVLWELVTQKIPWDTLNTMQVIGAVGFMDHRLEIPSDIDPQWVSMIESCWDSDPQRRPSFQELLERLRELQKKYALQVQMQRSAAGKGAEKMSVDDG

SEQ ID NO: 124661 - protein, 346 aa, Triticum aestivum
  unsure (1)..(346): unsure at all Xaa locations
  Clone ID: PAT_TA_19079.pep
YRPAAIDQLTVLGEQVGVPVYSEGTAAKPAEITKNAVEEAKRNNIDAIVVDTAGRLQIDKTMMVELKEVKKAVNPTEILLVVDAMTGQEAAALVTTFNIEIGISGAILTKLDGDSXGGAALSVKEXSGKPIKFVGRGERMEDLELFYPDRMAQRVLGMGDVLSFVEKAQEVVRQEDTMELQKKIMSAKFDFNDFLKQTQNVAKMGSMSRVIGMIPGMNKVTPAQIREAEKRLAFVESMINAMTAEEREKPELLAESRERRIRVAEESDKTEQEASQLVAQLFQMRAQMKKLMGMMQGQEAIAGMGDLMDSLNADEKAPPGTARRRRRRSEPPRQRELDAVGGASRP

SEQ ID NO: 124662 - protein, 442 aa, Triticum aestivum
  unsure (1)..(442): unsure at all Xaa locations
  Clone ID: PAT_TA_19080.pep
IDQAASYAKTVACVQAILSNKGPRTAAEIEWVALIGQSVAIASAQSGSVGSENSLETAWRAEAESLKSILTTAPQNKLGRIALVDTIAKQIRKRMKVRLPNLLTGLQGKSQVVKDELARLGESMVQSPEGTRAVALELCREFEDKFLAHVTSGEGSGWKIVASFEGKFPDRIKQLPLDRHFDLNNVKRIVLEADGYQPYLISPEKGLKSLIKGVLEMAKEPSRLCVEEVHRVLLDIVNATANGTPGXLGRYPPFKREIITIASNALDTFKSDAKKMVVALVDMERAFVPPQHFIRLVQRRMERQRREDEVKTKSSKKAQDAEQAMMNKGSEQAKSSKDKSNQQDKDTKEGPNLQVAGPGGEITAGYLLKKSAKNNEWSKRWFVLNEKSGKLGYTKKQEERHFRGVIVLEECNXEEIEEEELSKTSKDSKKANGPEKGPSLVF

SEQ ID NO: 124663 - protein, 392 aa, Triticum aestivum
  Clone ID: PAT_TA_19081.pep
MAGSSPKVSEIRCGQRAEGSAAMLAIGTANPANKVSQEEYPDYYFRVTKSEHLTDHKDTFKIICGLTGTENRFFYHTDELLNSHPVLLDNTSPSREARHDIVAKAAPELAAAAAKKAIAKWGRPASDITHLIVSTNSDAGAPSADVRLVSLLGLRADVCRTMLHLNGCFCSALRLANNLAAYNRGARVLVACVELAISGFCSPGEGDCLDTLITHALFGDGAGAVIVSADPMHPIENPLFEMVSVSQTLVPSTENALTLNLGSNGTHGKVYTKLPTLVADTMEPCLLEAFGPLEMDFQWNDLFWAVHPGSRGILDQLDKTLQLEPTKLAASRTVVQKFGNMFSATVIFVLDELQRRMEEEGEQAEWGAMVGFGPGFTIETMVLHATGALKKK

SEQ ID NO: 124664 - protein, 471 aa, Triticum aestivum
  unsure (1)..(471): unsure at all Xaa locations
  Clone ID: PAT_TA_19082.pep
MAAATAMAMLAALAILAPSARGLDRAEFPPGFLFGAATSSYQIEGAYLEDGKGLSNWDVFTHTQSREINDGRNGDVADDHYHRYMEDVEIMHDLGVNSYRFSISWARVLPRGRLGGVNSAAIAFYDRLIAALLEKGIEPFVTLHHFDLPHELETRYGGWLGAGIREEFDYYADVCFKAFGDRVKFWTTLNEPNLFTKFAYMLGMYPPTHWSPPFGNWHSGNSRREPYVAAHNMLLSHAAAVDNYKKNXQATQGGSIGIVIAMKWYEPLTNSTEDILAARRALSFEVDWFLDPIFFGDYPREMCEMLSSNLPKFTSEEKRLLRKNNADFIGLNHYTSIYAKDCISSPCDLEDSXTEMRWMQAVGERDAVTIGKPTAIHGYYDVPEGMELIVKYVXRRYKNTPVYVTENGYSQFSDNSMEDLINDIGRVNYLQGYLTSIPAAVRRGSNLSGYCAWSRXGNYQWLWSTYGWMDR

SEQ ID NO: 124665 - protein, 375 aa, Triticum aestivum
  Clone ID: PAT_TA_19083.pep
MAETVTNVSEYQAIAKQKLPKMAYDYYASGAEDEWTLKENREAFSRILFRPRILIDVSTIDMTTSVLGMKISMPIMISPTAFQEDGSPRKGEYATGTGHASAAGTVDDAVIRGLPRGVGREVGLELGPGIRFFQLYVYKDRKVVEQLVRRAEKAGFKAIALTVDTPRLGRREADIKNRFVLPPGLTLKNFEGLNLGTMDQANDSGLASYVAGQIDRTLSWKDVKWLQSITTMPILVKGVITAEDARLAVHSGAAGIIVSNHGARQLDYVPATISALEEVVTAAQGRIPVYLDGGVRRGTDVFKALALGASGVFIGRPVVFALAAEGEAGVRNVLRMMREEFELTMALGGCTKLSDITRNHIFTEGDRLGRPLPRM

SEQ ID NO: 124666 - protein, 225 aa, Triticum aestivum
  unsure (1)..(225): unsure at all Xaa locations
  Clone ID: PAT_TA_19084.pep
MEAATGEAAPPRPLASAAAEQDAPRPSATCPGSGGRRASSRVAGRLTGGVTGALAGRAADXGVLWGAGLGAFAGAVLSIEVLDAARAYWRAYRSTPQSTSPVGDFLDELLHARFVGEQYEPSVYMSYRWQVGIAEFGNDDPYDITGEVSSDGLSQDNLKKLPYHVVIDQKQEPAGENLSCPICLQDIVTGEMARRLPKCCHTFHQPCVDKWLIGHGSCPVCRQDV

SEQ ID NO: 124667 - protein, 254 aa, Triticum aestivum
  Clone ID: PAT_TA_19085.pep
MQVVRRDQELQGRGAQETHGASTVAAPAYASRVAPPLLPAVPPSLSLSSPPSLCSFLPSKRQSRTPGSSNQAMSLAPSIPSIKVKVGRIAPPPPYRACRSFAVIRSSKAEGPRRPAAPPLSPPPPMPPKTPALSTPPSLSQPPTPVKPAQPSPPPPETKPAVATAAATPPVGGVVTFEYQRKVAKELQEYFKKKKLEETNQGPFFGWLAKNEIANGRWAMFGFAVGMLTEYATGSDFVEQMKILLSNFGIVDLD

SEQ ID NO: 124668 - protein, 628 aa, Triticum aestivum
  Clone ID: PAT_TA_19086.pep
ESRYSLHNKVKDLYNLMEHEFLPLDLASKVQPLLSKISTIGGKLSAASSVPEIRLSQYQSALEKLTALRVLQQASRIFQSMKIDMLSRMIPFFEFNVVEKIAVDAVKHNFVAMKVNHLAGAVHFGNMDIESDVLSSHLSVLADSLNKALSLIHPPVQKPSKPSENLTSLAGVVEKEHRRLLARKSIIEKRKEDHERQILEKEKIEETKRLTIQKKSADEERERLLKEQRLREQQRIRKEIEEKEAREAAKMIEDLTGRGKNKKKIHIEGDMTKQHAMEVVLNQQVKERQEMEKKLAKLAKTMDHLERAKRQEEAPLIEEAFQKRLEEEKILHEQEQLREIELSKQHHAGDLQEKNRLSRLLEHKNAFQERIVQRRESEFSSLRKEREERINQLLSSRKRERETVRKLMYFLNMEEQRIQREREEQEARKREEEERRKKEEAVRKLKLDAIAAKQLQRERELEEREKQRREALLRGAEPVRAADAPAAAAVAPPAREPAAAAPAAAAAATGAAPSKYVPKWKREGDSSSQRPTAAAEPDRWVRDDRPRPALRQDAPPVRDARPIRQEAPPARDARPFRQEAPPAARQEAPPAARQPDGAAPAASTERWRPGSRTSANSSSTSSSTGWRR

SEQ ID NO: 124669 - protein, 139 aa, Triticum aestivum
  unsure (1)..(139): unsure at all Xaa locations
  Clone ID: PAT_TA_19087.pep
TLALNSXXXMXREHQNVLDAFQLLKEDASVQKMVMALSTDKAVWDAVMNNEVVQEFKKSFQDAKETDNKGSSSAPPGMMQWVLENTQAKIKEFLEKILQLVHTLFQAQSMDYDLSDDVVRMSFMLSVFVFIVVTIARIK

SEQ ID NO: 124670 - protein, 369 aa, Triticum aestivum
  Clone ID: PAT_TA_19088.pep
MPATASPPPLLLAAALLLSAALLCSACPVPLPKQTADNSPRLQRAYVALQALKRAITDDPKNLTGNWCGPDVCAYFGVFCAPSLDDPCARAVAGVDLNHGDLAGTLPFELGHLTDLAVLHLNSNRFAGGLPDSLPKLSLLHELDVSNNLLSGGFPQHILCLPNVKYVDIRFNNLCGPVPPAIFDKKIDALFINDNHFDFELPENFGNSPASVIVLANLRLRGCIPASVGRMGATLNELVMLNSGIRSCIPPEIGWLRELTVLDVSFNQLQGTLPESMAGMHALEQLDVAHNELAGHIPEGICALPRLANFTYSYNYFCGEPERCMALRRNDDRQNCIAGRPDQRPADQCLAFLHRPPVHCDGHGCLAQH

SEQ ID NO: 124671 - protein, 550 aa, Triticum aestivum
  unsure (1)..(550): unsure at all Xaa locations
  Clone ID: PAT_TA_19089.pep
VCTRRFPLCSSPDARGRSGTGCGRSSPTPGRILISASGNTPDQTVSTDAIIGGDPKVVDDETYVKPKXRSRGGEPPPPTAPTGPGPACRRPPPAAAKGGAARRSWGAALGGERKDVVEEGERDEEKHAKVTLPTVSNYTIHDAEDADNAKQEGSSLSPNGLALLGSKPLCDFSNFRANVCEMRGDVRXHPKAASVLXFMEPEGSRRDQVWXIKPYPRKGXDEFCLXHNHGSLTVKSTKVAASVHPGIGVHAAGLSSRASXAGSLSHDFPDVIVPLFTTARQFDGPVQFLSPPMQPVRPISRREQPHRPFPEALIDFSKDHQVHCYKHAIVGTHAYMEFTIDATKSPNGVTMVDFNRFMRSAYSLPKAAAAALGESPRVKPRLLIIKRDRTXRMFLNLEEIIGMAEELGFEVVIDEANVSSDINGFAKLVNSVDVMMGVHGAGLTNCVFLPQNATLIQIVPFGGLDWISRTDFGNPSEMMGLRYKQYAITVDESSLTDHYPRDHKIFKDPISFHKRGFEFIRRTFMDKQNVRLDCKRFRPVLLEALDNLNQ

SEQ ID NO: 124672 - protein, 314 aa, Triticum aestivum
  unsure (1)..(314): unsure at all Xaa locations
  Clone ID: PAT_TA_19090.pep
MAAASRGLLARLRHLSLAGPRLPPCRLFSAEPLVSHPDDDDACAGGEGGGRIIEARPGVMGPDSRRTGVIGVKCGMSAMWDKWGAKVPITVLWVDDNVVCQVKTAEKEGFYALQLGAGQKKEKHLTKPEVGHFRSQGVLLKRKLKEFPVTEDALLPVGDNXISVRHFVPGQFVDGIGITKGKGFAGGMKRHGFSGMPASHGASLSHRSIGSTGQRDAPGRVFKNRKMPGRMGGVQRTVKNVWVYQIDPARNLLYLKGQVPGPQGSFLFVKDSIYKKPDRALLPFPTYFSQEGELEDMEPLIADLGDVDPFMAAD

SEQ ID NO: 124673 - protein, 80 aa, Triticum aestivum
  unsure (1)..(80): unsure at all Xaa locations
  Clone ID: PAT_TA_19091.pep
IXHRSPTPPLPPSSPHLTPHTDPEASNQATPPSLLGKTRSTEVYIATSLQRLSLHLWFPLASGPDEENEEEARRNTFCWG

SEQ ID NO: 124674 - protein, 367 aa, Triticum aestivum
  Clone ID: PAT_TA_19092.pep
NVVISFCKAGKANTRLMMTRLPIIHVFLHQAYLPIEKNKQKRCAYGKGLILPSQIRYVKYFERILIYFNGENQPPRRCMLRGFRLHRCPYWIRPSITVSNHNGVLFSTKKHPRTKELMPEDFWFSAPKKGIMVFALPGEPGLAEVAGDFKIQFHDRQGDFYCWLNTTMMENRVTLNPTDFDDFDKRKLPSPGFQVEIVLVDYSGSQPPKQKPADGSADKKSDADSSTSSSAKDSNAAPVESKKETGSDDKDDVFSDNEAEDGSSKGRKEVSSSGQGGANGAKASETSVAQQEPSAVASGIEKITISGDQGIARAADAISLKTEASSKSGSTKAHPPAVESSSLSEFKAIAADASVFSFGDEDDYESE

SEQ ID NO: 124675 - protein, 446 aa, Triticum aestivum
  Clone ID: PAT_TA_19093.pep
AAAKIHPIRTLQFLPSEGKKKKKREASGDAAILIHTRAREGTNRLPLPDAAAATVGDLQRLIEARATVPVAAQRLSLDPALLLPAPQPPLLADPAAPLASLPLANGSFVYLSYPPGARPAQPPPPRALTAAGSFGKKMTMDDLIARQIRVTRQEAPFCSAASFDRDSANAFQLHVSESLAFAVKRAGFLYGRVDAETKEVLVDFIYEPPQQGSSDVVHLMRDADEEARVDAIADGLGMRRVGFVFTQAVGRKASETGEYTLSNSEVVQAAQLQAEGGIPEWVTAVVKLEVGEDGSADVHFEAFQMSEVCVKLFKDGVLETEIQDSDDPRLSKMRKEVIAGGKDTMEVDNDFFLVPVKISDHQGPLSMGFPIENRGIPLPANALRSHMDRAKHLPFVKRISDFHLLLQIAAFLDVKADVPTLAACVGHQAEVPEGYRLLIDALAGQT

SEQ ID NO: 124676 - protein, 124 aa, Triticum aestivum
  unsure (1)..(124): unsure at all Xaa locations
  Clone ID: PAT_TA_19094.pep
RSRLRRHAAPEPRARPTVAPAGPGRLADGLPAAXGRSRRPSTSPGCRAGASGRRSRSTRRASTPPSASRRRPPARXPPPPRQDPHRPRRRREPRVGRAPAPPPSRRRLAGVRAGSRGEKEGRAR

SEQ ID NO: 124677 - protein, 381 aa, Triticum aestivum
  Clone ID: PAT_TA_19095.pep
RQDDGSGSSSRAQGGDEGPSADGFDPGAPPPFGLADIRAAIPKHCWVKDPWRSMGYVVRDVVVVLALAATAARLDSWLAWPVYWAAQGTMFWALFVLGHDCGHGSFSNNAKLNSVVGHILHSSILVPYNGWRISHRTHHQNHGHVENDESWHPLPEKLYRSLDSSTRKLRFALPFPMLAYPFYLWSRSPGKSGSHFHPSSDLFQPNEKKDILTSTTCWLAMAGLLAGLTVVMGPLQILKLYAVPYWIFVMWLDFVTYLHHHGHNDKLPWYRGKAWSYLRGGLTTLDRDYGWLNNIHHDIGTHVIHHLFPQIPHYHLVEATEAAKPVLGKYYREPDKSGPFPFHLFGALARSMKSDHYVSDTGDIIYYQTDPKLAAGAHTSD

SEQ ID NO: 124678 - protein, 121 aa, Triticum aestivum
  Clone ID: PAT_TA_19096.pep
SSGPVDGAAPGSPQIRTGLCRRWGRPPPGAAAPSPRRHGRTTCRRQRGDVVARARRDISPAPGARPATPLNMPPPRPSGSSCAGRRSGRGLIYEERSEEEKAQEKRLSRRRSDPGEEEASG

SEQ ID NO: 124679 - protein, 292 aa, Triticum aestivum
  Clone ID: PAT_TA_19097.pep
RPPPPQVFRNSFGSNPSPNKARTRTSQEEQLPSVSGEQRLIPSRLSRYKKKGFCSAMAFPAPAAVFLDENLPIHRGKRTDGLNARPLKPSAKPSAKPSARKALRDVSNTSKPQAPSIQKGHPLKDRSVLKDKSALRSQEAIKKNPLSKTTIYADEATKKCHEWAKGGVEGTHFTGNDAQRLDSDKIDKRVKKKVEKITSALHDWSDVIFDPLLFPAKAVAPFYEEVNVLELEPEILPDISGRLSISGDKAKLTEDSFDEVELDSYSFLEDKPVEFQLRDEMSLYPWSLESVN

SEQ ID NO: 124680 - protein, 412 aa, Triticum aestivum
  Clone ID: PAT_TA_19098.pep
MGKVVVAEATARQVASFVLGAAAALTVVMLVQYRAPAAGLSRARTPAHFSGLRLSSDDQHHRRNATTTARPVVHHQAPPVAGSAARDDDRRRPANATTITKPNSTTTSHLPSTRRHEEKGGKEESAEFRGLAAAVARAATDDRTVIITCVNQAWAAQGSLLDLFLESFRIGDGTARLLPHVLVVAMDPGAHARCLAVHQHCYHYTIPGLNIDFAAHKYFLSKDYLELVWSKLKLQRRILELGYGFLFTDVDIVWLRDPFKHVTAYADMTVSSDVYFGDPDNLGNFPNTGFFHVKPNARTIAMTKLWHGGRGKYPGANEQPVFNMMKKQMVAELGLRVQYLNPAYVGGFCSYGKDLGKIVTMHANCCVGIGNKIRDLKGVLGDWRNYTRMPPWERHRAKWTVPGACIRAEKQV

SEQ ID NO: 124681 - protein, 215 aa, Triticum aestivum
  Clone ID: PAT_TA_19099.pep
MLNKLIQSHEFNRYDLVDLTRQALAKYANQIFLKIIQGYKSNNINQVTTLCDHFLNLVNDLDMLLASHEGFLLGPWLESAKGLARDHEQEIQYEWNARTQITMWFDNTETKASLLRDYANKYWSGLLRDYYGPRAAIYFKHLISSLKKNEPFALEEWRREWIGLTNNWQSDRKVFATTATGDALNISRSLYIKYLRNADSLGLDGMDSFGKPASL

SEQ ID NO: 124682 - protein, 214 aa, Triticum aestivum
  unsure (1)..(214): unsure at all Xaa locations
  Clone ID: PAT_TA_19100.pep
MVKETTEAHGGEVTIMSATTVEPALPLQQHRLPLSNLDLLLPPIDVGVFFCYLHPAPTAAALKEALAKVLVAYYPLAGEVVANGDGEPELLCNCRGVDFTEASAGDTELRELRLGIVDEGVDKLVPSKKAGVISVQVTKFKCGGAVVGCTFDHRVCDAYSFNMFLVAWAATSRGGSVPPAPTXRRSLVSPRDPSPRTYATNALIDXLFSPLSSA

SEQ ID NO: 124683 - protein, 337 aa, Triticum aestivum
  unsure (1)..(337): unsure at all Xaa locations
  Clone ID: PAT_TA_19101.pep
KDERTKNVEGMEEALKELQKDQRKLEDEEAEFRKKKEAITDRVRIEKKKREDLQRRVDLRRRTLEDISKEEDVESSTRKLTDRLAKLNDDRFRALLKLKNLLVEAVALKWSYTEKNMASIELDTKIWEMEKDVKKHEKDVLSASRDYENCKRITQEHKQLVLKAKQHAESVSMITDNLAKEFEKMPTTIEELELAIQDTESEANSMLFLNQNVLQEYQNRQREIESISTKLEDDKAECERCCSEIETTKGKWLPTLQSLVLKINDTFSRNFQEMAVAGEVSLDEHGLDFSQYGILIKXVKFRQTGELQVLSAHHQSGXGERSVSTILYLVSLQDLTN

SEQ ID NO: 124684 - protein, 276 aa, Triticum aestivum
  unsure (1)..(276): unsure at all Xaa locations
  Clone ID: PAT_TA_19102.pep
RRLLHLLHPRTPPPSPSPPAIRLGRNGAHGRYSVLPYRFLSVAKDDSDKEVALEEDGGATRSADCDAVTLTGCTSKAARSGPEGEAKGTRLRGGDAGRAASAGLLQSVHLMXPPSGPENRPIGTALLEPPQASAGVLDGGFKKIDAGYDDGSETVKYXTDGERACRVHDAEMMMGDVAEFHAQDDGRGYVVHDDDDDSQDKSDAPLDSSSSKGRGSGAPCQCWLKKHMSCLYDQAKETNHLWGAVVVAALVGLVILWRKDKLHMSCLKWRSRSAVS

SEQ ID NO: 124685 - protein, 159 aa, Triticum aestivum
  Clone ID: PAT_TA_19103.pep
MLGLCVLCGAPPATVSAPPPRARCSAPEKSGRAFLLGVPAAVSLSLALWSTPVSAGILSGSTGLESVPAPPMPRLEFLDKWNAENQRKYAENDSRFKSSKVLKELLEKSKQNKQKNEREIQDKYCLRGAEWGVGDCSTVGMTDQEKEDFITELRKRVGE

SEQ ID NO: 124686 - protein, 108 aa, Triticum aestivum
  unsure (1)..(108): unsure at all Xaa locations
  Clone ID: PAT_TA_19104.pep
MKDVFPSQVMKMAYLYFLTQVLIGVGIGLYKLGFPAVDKCVEIGLPELILMVAFSQMIISSSVXILESVFGRFFXLFTVSIVXLYTCILTISGAYKNGRPTCSFSYVK

SEQ ID NO: 124687 - protein, 250 aa, Triticum aestivum
  unsure (1)..(250): unsure at all Xaa locations
  Clone ID: PAT_TA_19105.pep
GSDQVLFNARTRHGPVPAQGTEARWIHEDQLYSVKFSKSGSCKWLLHTLSRSSSDVLRKEQGPGPGRRPSLVELCGAGVREDISRFSDFSMVPMDLSXQIYNEWVRCSYINDELLGAFRDCALQDICLDEYPGVKDAWMEVIASQGQSLLSVDISCSDVTDSGLNLLKDCSNMQSLACNYCDRISEHGLKTGPGPPNLTPLSLKKCAAVTAEGAKAFAKLVNLVNLDLERCPKIHGGLVHLKGLRKLETL

SEQ ID NO: 124688 - protein, 130 aa, Triticum aestivum
  Clone ID: PAT_TA_19106.pep
PSTTARLLARTLTLGRPAAPGSSLQPHRALSDKVELIEIDLSEESASSTSSGDSAEEPMGMGRLNDAIRGVLVRRAAPEWLPFVPGGSYWVPPMRRPLGVADLVGTVVYSARGAVDTAEMARATMVKEPR

SEQ ID NO: 124689 - protein, 120 aa, Triticum aestivum
  unsure (1)..(120): unsure at all Xaa locations
  Clone ID: PAT_TA_19107.pep
MEPPGAARRRPPAMAAPALLTLLLLLLTLALSSASGAPVGEDYVRPPARPRAGQRKALLGLFPWSKKKASASASDPQQVHISLSGEKHMRITWVTDDNSVPSVVDYGTKSNAYTXSSNGE

SEQ ID NO: 124690 - protein, 315 aa, Triticum aestivum
  Clone ID: PAT_TA_19108.pep
HWHRWCYWWCRLRLCIGVWFCGWIRVGISLWFRVWLGVWFGRCIIGRFGCSFWWRILCWVRCRLGLRWSLWLWCWFRLRWSLWLWCWFRLRWSLWRSFWLWRWFRCRLRLRWSLWRWCWFRLRWSLWWSIWLRCRFKPPVEAMARLRALGPGRARVEALAQVLVRGPVMVRGREKAKARAKDLDMARVPARAMDKVRALVRVMVRDMVKVMAKDVVRDQDTVRAMAKVMVKEVVSGKDPDTVRAMAKVMDKEVVSGKDLDMAKVMAKDLVQALAMVKALVVVMEMGLARATVKVTDMGMDLDMANDFRRRLLNNV

SEQ ID NO: 124691 - protein, 498 aa, Triticum aestivum
  Clone ID: PAT_TA_19109.pep
MPPALTSNPPSFRPLSSPLRRRAPSFLCRVGAGKPGADEEAKKNPFFVDFSGKFEDAKSLIPAFPSPGTGSLFAGGRGKKDQQTVFVAGATGQTGVRIAQTLLRQGFAVRAGVPDLVSAQELARLAAAYRLISPAEARRLNAVESDFDDTEAIAKSIGPAAKVVITVGPVEKGLEGGPVTTEDALRVVQAADLAGVAHVVVVYDEGAGGVNGASTNSVLNGFTSFFSNLFSRVQTLPLSEFLAKVVETDVNYTLVKASLTEDYDPESSYGLVLAKEGSSSTTTSSTDTGKVSKLQIASLVADVFSNIEIAENKVVEVSTSSLGTSKPTVEALTAIPEDIRRKEYQEAAANARAQEEALASQRAADAEEPTSKLKTEGKDTTSEEAGASTVNEAQASLENLLTRAKGLKLNTDFSWDKFSTQLAAVGATARSSDEEEPRAQIATVRGQAKAKKLAPQRAVVKPVAQKVKQATMQPAPKKEVRPVFGGLFKQETIFVDED

SEQ ID NO: 124692 - protein, 257 aa, Triticum aestivum
  Clone ID: PAT_TA_19110.pep
MDREHSALKKMRLEDAEDSAISQVPATASSMHQQLFWSQWQLLDSILPTGGFAHSYGLEAAMQSRIVNNQEDLRLFLIQVLDNIGSLLLPFVYCASRSPEAAAWVKLDQLLDATLTNEVGRKASTSQGSALLRVAASVFTEIQPLQDLRRTFLGSMSVSLHHAPVFGLICGLVGFDSETTQRAYMFVAMRDVISAATRLNLIGPLAASVLQHQVAPDAEKMLQKWKDRDVSEASQTAPLLDALQGCHAYMFSRLFCS

SEQ ID NO: 124693 - protein, 316 aa, Triticum aestivum
  unsure (1)..(316): unsure at all Xaa locations
  Clone ID: PAT_TA_19111.pep
SGRDVRLTVXFEALMTANVAEVESPEDKMLIDETDEFGNEIPLGKIVQILKSRGAKNTGGKQKAASVPVNTGKDDDVLGLLREINLDNQDNLGESVKSKPKKPQMDMKESNEKPVDFSAPKRKRSVSKSRPHSGKGSKDGDELLVHSASKGKPSDSLENKLKEKRRADSNDKDLVASPTSTKTPVSKGKKDAKSHTEVSRSSAKKSADEDSTMRAAELASLNGSFKRQKPRLVSGLAKCSTHDSSSKDLVGRRIKVWWPLDKEFYPGVVESYDSAKKLHTVLYDDGDMEQLNMAKEKWKMIESNGFTNGSSKRRIM

SEQ ID NO: 124694 - protein, 207 aa, Triticum aestivum
  Clone ID: PAT_TA_19112.pep
REPVRLHRCSWITKNSDEAYVQFHDESWGVPVYSDDRLFELLTLSGMLIDHNWTEILKRRDMYMEAFAGFDPNVVAKMNEDDIAVISANKELKLAECRVQCIVENAKCIRKVAKEFGSFSGYIWGHMNHRPMVGKYKHHKYIPLRTPKSEGMSKDLIRRGFRLVGPVIVYSFMQASGMVIDHLVGCFRFSECVHLAERSWGITNVAT

SEQ ID NO: 124695 - protein, 139 aa, Triticum aestivum
  Clone ID: PAT_TA_19113.pep
SSARTFSSFSLTSSSCNLFNCSCISDSSVKRGVETWFPLEDDLTLDLKENIFSGQEPCWCWQPRIKQLCHRSGERLWWLSLEAKRLFFMAKLQNRAEKQRSKTASCALSVGGLSWASSPSDEGAPLVGSVQHCVVELLR

SEQ ID NO: 124696 - protein, 153 aa, Triticum aestivum
  unsure (1)..(153): unsure at all Xaa locations
  Clone ID: PAT_TA_19114.pep
IRTRQGRVEQWSKVAYETWTNLQPDYVMDNGKPRPINQSISQGSIMLEPKFMQGHQQNCAERNVHEADGHQGTSGSHPKQCTLKRLGSIRVTPNEEDASFDISVYLGSGSEQYHGSTAANDXTRFSHAPLPGYRCRRIFRIRVIKASILDNGR

SEQ ID NO: 124697 - protein, 150 aa, Triticum aestivum
  unsure (1)..(150): unsure at all Xaa locations
  Clone ID: PAT_TA_19115.pep
MGQEQSQPDPAVGEPSPPAADPAPAQSPAPAPSSLEELAAEAMSFSEDDESIDVKVQKALDCPCVADLKTGPCGSGFVDAFSCFLRSTEVEKGSDCVQPFIALQNCIKENPAAFSKEILEEEEKDEEAXKSNLQVRAPAWSXESKSKPKL

SEQ ID NO: 124698 - protein, 255 aa, Triticum aestivum
  Clone ID: PAT_TA_19116.pep
PPPPGTLKPRDRKAAVPNQRLTAAGRGAASQRARRESGPGEMLGKRAAEHADAPDDQPGVHAVGAQAGAPGQRRRRRRRRRQGQAGARAAVLLRIGRRGGDGRRRRRWLPLSRAGRLRRADDHRGVPVRLRLLRQAPRPRRGHLHLQGARWHSAARSAGSIRSRRTSSWNRTAPSHPSGRPRRTSLAAAAAPAAPGTPSPPHSRAAISLLHILASDVPHIYGTVVACLPRAAVYTGCPGYRGIDGFRDVPAVAGE

SEQ ID NO: 124699 - protein, 65 aa, Triticum aestivum
  Clone ID: PAT_TA_19117.pep
LCSSSIFFIIDATVHNPKIEFGCSQNHHICFCICICKIQLIPTQFGAAIVIMEFVKKQDKQISCV

SEQ ID NO: 124700 - protein, 290 aa, Triticum aestivum
  unsure (1)..(290): unsure at all Xaa locations
  Clone ID: PAT_TA_19118.pep
GRAGQGAAAFSAIAAVEGINQIVTGDMIPLSEQELVDCDTXYNEGCNGGLMDYAFEFIINNGGIDSEEDYPYKERDNRCDANKKNAKVVTIDGYEDVPVNSEKSLQKAVANQPISVAIEAGGRAFQLYKSVSFFNIILCNLQLLLLNYXTWTLHDYIKASSGKCGIAVEPSYPTKTGENPPNPGPTPXSPAPPSSVCDSYNECPASTTCCCIYEYGKECFAWGCCPLEGATCCDDHYSCCPHNYPICNTQQGTCLAAKDSPLSVKAQRRTLAKPIGAFSGIATDGKKSSA

SEQ ID NO: 124701 - protein, 392 aa, Triticum aestivum
  Clone ID: PAT_TA_19119.pep
MRSSMALLAAALLLLVSLAAAADMSIVSYGERSEEEVRRMYAEWMSEHRRTYNAIGEEERRFEVFRDNLRYIDQHNAAADAGLHSFRLGLNRFADLTNEEYRSTYLGARTKPDRERKLSARYQADDNEELPETVDWRKKGAVAAIKDQGGCGSCWAFSAIAAVEGINQIVTGDMIPLSEQELVDCDTSYNEGCNGGLMDYAFEFIINNGGIDSEEDYPYKERDNRCDANKKNAKVVTIDGYEDVPVNSEKSLQKAVANQPISVAIEAGGRAFQLYKSGIFTGTCGTALDHGVAAVGYGTENGKDYWLVRNSWGTVWGEDGYIRMERNIKASSGKCGIAVEPSYPTKTGENPPNPGPTPPSPAPPVFGAVTTYNVFPHPSHGILHSRARKGLC

SEQ ID NO: 124702 - protein, 354 aa, Triticum aestivum
  Clone ID: PAT_TA_19120.pep
MAGDVARKQLQARVGALPWAVRLQLRALEAAVDATQRRDGTVNRFLFSLLVDRQAPANPARPDAGGVRSVDVTVDASTGVRARVYFTTGEAGAEADASPRPVIVYFHAGVRTVFSAATRPYDALCRTMCREAGAVVVSVTYRLAPEHRYPAAYDDGEAALRYLAATGLPAEVPVRVDLSRCFLAGDSAGANIAHHVAQRWTAAPATTPPAVHLAGLLLLSAYFGGEDRTESEQALEGVAPIVNLRRSDFWWKAFLPEGADRNHPAAHVTGEAGTEPELPEAFPRAMVVVGGLDPLQDWGRRYAAMLRRKGKEVRVVEFTEAVHAFYFFPALPETGKLVAEIRAFVESVAPNQTT

SEQ ID NO: 124703 - protein, 158 aa, Triticum aestivum
  unsure (1)..(158): unsure at all Xaa locations
  Clone ID: PAT_TA_19121.pep
KLKVPADGSQWRKIERKYRNDFAGDARNVWFGLSADGINPFGEQSSNHSTWPVTLCMYNLPPWLCMKRKFIMLPVLIQGSKQPGNDIDVYLRPLVEELLQLWNGTGVRAXDEHRQEEFDLKAFLFMTINDWPALSNLSXXTNKGIRGCTHCLDDTDSI

SEQ ID NO: 124704 - protein, 329 aa, Triticum aestivum
  unsure (1)..(329): unsure at all Xaa locations
  Clone ID: PAT_TA_19122.pep
MASGSGSGEGKAGRAGAGYQQYASYGTGTGYDERQWWPWLVPTVLGACVSVFAVEMYLNDCPRHGSPLGXGDARCVAGFLRQFSFQPLRENPLLGPSSATLEKMGALDWAKVVHQHQWWRLFSCIWLHAGLIHLIVNMMSLLFIGIRLEQQFGFVRIGIIYLLSGFGGSVLSALFLRNHYISVGASGALFGLLGSMLSELIMNWTIYSNKAAAITTLLFIIAINLAIGILPHADNFAHIGGFVSGFLFGFVLLARPQFGWMERHELPQTDQPPKYKTYQYALWGAALLLLLVGYVVGLAMLFKGKNGNDGCHWCRYLNCVPSSRWKCST

SEQ ID NO: 124705 - protein, 196 aa, Triticum aestivum
  Clone ID: PAT_TA_19123.pep
MAATLQFISLLGTSSAHHPAPSCSSSNEKQHRSVHLPQQQQGRRKSGRSLRAVRAVETGAEPATADSETTVEPPSVDFAFVSPRLLPDGTPDVHYRTACGGQKLRDIMLQGYIDLYGPYDKLLLNCSGGGECGTCIVEVVEGGEMLSPKNEVEKEKLKRKPKSWRLACQATVGNPDSTGQMVIQQLPEWKVHKWEK

SEQ ID NO: 124706 - protein, 98 aa, Triticum aestivum
  Clone ID: PAT_TA_19124.pep
MSYYGQQQPPVGAPPPQGYPGKEEYPPAGYPPAGYPPPGQGQGYPPQGYPPQQGGYPQQGYPPQYAQQPPRQQQSSGPSFMEGCLAALCCCCLLDACF

SEQ ID NO: 124707 - protein, 136 aa, Triticum aestivum
  Clone ID: PAT_TA_19125.pep
MAYGGGRRGSSRWGLPMVRSDALGKLGPSFGIGAGCGVGVGVGLIGGAGIGAGFPGLQLGFGAGAGCGIGIGFGYGFGKGIAYDENGKYSNIRRSFQNTRSLPYDQEFDILFDEVMESTRKLIKATTKELDKWRRM

SEQ ID NO: 124708 - protein, 128 aa, Triticum aestivum
  Clone ID: PAT_TA_19126.pep
PRVRRTLLKDYKNEFDEILVADKQLQKELLYDMQKFEAGKGKSSRDGEAAGPSRSSPAAPDPGDAAAKATARSVLKEMNRNVPTPPLHTMSVPKVKSVLGTGALSGSRRPAILESVRRLEPFGSDDEN

SEQ ID NO: 124709 - protein, 106 aa, Triticum aestivum
  unsure (1)..(106): unsure at all Xaa locations
  Clone ID: PAT_TA_19127.pep
AFDIDYGNQVLTLRLADLGTYGCKQAKPPTGQIRPSSPVCGPARVVGGAAAAGWGFWRPAGSLSRLPEKEXVSLCGTPADLSFRDGIGPRRLAKSNGAYYISREST

SEQ ID NO: 124710 - protein, 257 aa, Triticum aestivum
  unsure (1)..(257): unsure at all Xaa locations
  Clone ID: PAT_TA_19128.pep
MAFGMAFRTALLCLLGMLIASPAIAVSDSGIYYQIGLMWPGAYCAQTTGGCCMPKSPVVPAADFYVSGFTVFNATTDAPETSCSGTPFNSGEILEISGLRQFWSNIKCPSNNGQSSWKSAWKTSGVCSGLDDKAYFQAAXALRSKINPLXSRLVSKGIKPDFGLYSLEKIKKVIQAGTGVTPXIQCSKGPFDKFQLYQIFICVAGDAKTLIECPKPQKFTCSDEILFHPFKKWMLKQAASSVSYAEAFEYNNCSMGY

SEQ ID NO: 124711 - protein, 187 aa, Triticum aestivum
  Clone ID: PAT_TA_19129.pep
MEATLVEMVHTLAAILILWLISRSLWHLVWRPYAVAGWFERQGIRGPPYRFVLGSLWEMKQMLVAERTKAPLDIGSHDYTSRVNPFFHKWAADYGKTFLYWLGPTPTIYSTDLELVKQVLEDKTELFQKDYLNPILERIFGKGLVTTNGDDWKRHRRVVYPSSTTRAQVCVSMTREGHKRCCAMVNK

SEQ ID NO: 124712 - protein, 347 aa, Triticum aestivum
  Clone ID: PAT_TA_19130.pep
LDAKRIHNLTNYLEKLHDRGLASKDHTTLLLNCYTKLKDVEKLNHFIKDEDGVGEIKFDVETAIRVCRAAGYHEHAMFVAKKAGRHELYLKILLEDLARYDEALQYISGLEANQAGLTVKEYGKILVDHRPAETVKILLRLCTDGGDPTARRGSNSMRLLMIPSPMDFVNIFVHSPQYLMEFLENYIKAVKDSPAQTEIHNTLLELYISKDLSFPSMSQENGFDHHNSKERKGKGITNGYKSGTREKAKLGKEENKTAKDIVDRQRKGLALLKSAWTPEMEEPLYSVDLALIICNANAFKDGLLFLYEILKLYKEVIRCYKQAHDHEGLIACCKKLGDSTQGGDPSL

SEQ ID NO: 124713 - protein, 254 aa, Triticum aestivum
  unsure (1)..(254): unsure at all Xaa locations
  Clone ID: PAT_TA_19131.pep
PRVRKAEKQRRKEAKYMAKKLQEEEAARAAEEERKRKEEEAKIAAAAADIRKKLKEKEKKLLRKEKNRLRALVGQVVGESHFSLSKEDVETVCTSHDFEQLKKLCDIMEDKDTAERARLLRAALSKEENSSNTSQEEKIHANGVADSTPKSTVPQGTPKSTAPQVITLGNYEKKEKEWGKEEVELLRKAIHKYPKGTNKRWEVISRXMVLGKXAXEILXGTKXNPLQKXNSXAKALDPFLEKPKSNSILWRLLS

SEQ ID NO: 124714 - protein, 242 aa, Triticum aestivum
  Clone ID: PAT_TA_19132.pep
HASEQARAVAGSDVRASSATTSARVQGKLLLQSSVDSPDGRLRLSVQLVSATVAGSDGRGMRGEAAALDAVIASGETELDVELPWDDEALGAPGAVLVTNHSDLPVYLKLLSLTSPAVHFVCDGWVYPVGKHPYRLFFTNDAYVKENTPAALLKDREDELRQLRGEGVPADEPLQKWDRVYDYALYNDLGNPDLRKDLARPVLGGSEEYPYPRRTRTSRPPTKTDPESEARVPVEQEVYIPC

SEQ ID NO: 124715 - protein, 536 aa, Triticum aestivum
  Clone ID: PAT_TA_19133.pep
NSARAHGSRRAAPAGRTRTSATAHAHAPPPRLRRPDLPQDLGRGALGWSGTVPLPAAELEPAGRPARQPPPSETRASLEEGVHIPCPERTGAVATAPTLPTLERPFASVAEARGLCGTHAQPTAFPVPQVISANRTAWRTDEEFARQTLAGTNPLSIELVTGLPLTSKLDRALYGDQDSKITKEHIEKNLGNMTVAQAIEKDRLYVVDHHDWVMPYLKRINELPGDVEKGEISERKSYATRTLFFLQDDSTLKPLAIELSSPHPEDERLGATSTVYTPPDQLKAGDAASDTFTAWDLAKAHAASNDACKNNYVLHWLRTHATMEPVVIAANRQLSVLHPIHKLLKPHFRNTLDTNSTARHIVIGSGDERQGGAFYAWRTDEEFARQTLAGANPLSIELVTALTLTSKLDRAVYGDQDSKITKEHIEKNLGNMTVAQAIEKDRLYVVDHHDWVMPYLKRINELPGAEEKGEISQRKSYATRTLFFLQDDSTLKPLAIELSSPHPKDERLGATSTVCTPPDELKAGDAASDTFTAWDL

SEQ ID NO: 124716 - protein, 167 aa, Triticum aestivum
  Clone ID: PAT_TA_19134.pep
TGLWKIDMDGKVNGAVETCFGSFHRYWQYMNFSHPLIKAKFNPNACGWAYGMNFFDLNSWRREKSTEQYHYWQTQNENRLLWKLGTLPPGLITFYSTTKPLDKSWHVLGLGYNPSISMEEIRNAAVVHFNGNMKPWLDIGMNQFRQLWTKYVDYDDSFIRQCNFAPP

SEQ ID NO: 124717 - protein, 214 aa, Triticum aestivum
  unsure (1)..(214): unsure at all Xaa locations
  Clone ID: PAT_TA_19135.pep
LGARGSPTGSCLFWPAPPPLFSPASPVPALGLPPPLSRRVARRAERDPIPPSHHSDDYEPEPSRSERGAGGGGEDPRRPLPLRQPLVGPCRAGDRLRPRLTLHVSCSAAENRFISHRSQHFEVSEVGVLARCLCVLLVFPTLXNVDRHPPLNRPTXSRGVLSLRLLPPSCIRLAFFGALAGPLYLAPLRDGLQSSHVGLAIAAARHAHRHCSTV

SEQ ID NO: 124718 - protein, 413 aa, Triticum aestivum
  unsure (1)..(413): unsure at all Xaa locations
  Clone ID: PAT_TA_19136.pep
MASSALSGTHHRLLPCFLRRLPRPRTRSCSRLRLAACHADTLLSSSGTQRPPAPAACSSASSAGGFSDWLLTNGLPPGKVAILERPVPCSRGGKDRPLHFVAAGQDLEAGDVAFEVPMSLVVTLERVLGDESVAELLTTNKLSELACLALYLMYEKKQGRDSLWYPYIKELDRQRGRGQLAVESPLLWTESELDYLNGSPMRDEVVVRDEGIRREYNELDTLWFMAGSLFKQYPFDVPTEAFPFEIFKQAFVAVXSCVVTCRRLXLARRFALVPWATLLTYKTTANMLTXVDGSVRSLADRPYKAGEPIIVWCGQQIKLLQIIFIRTIDQHKQSARTASQAPKNPPNPHCQEQSLDAQSKRNLAASQGPVSRGEEKETISEMLPYLRLGYISDPDEMQCILSSXXDTCPVSPX

SEQ ID NO: 124719 - protein, 114 aa, Triticum aestivum
  Clone ID: PAT_TA_19137.pep
FFFFFLAGRLLERRSWGVTAEPCCRKLNFVELPSTKKERKQSSPREWLARPTVAATHGREHRTACAALPHYMRCPAILHPPPANASSLTTGANCMGCRGGGERWRSSDQEASIE

SEQ ID NO: 124720 - protein, 342 aa, Triticum aestivum
  Clone ID: PAT_TA_19138.pep
MPPSLLLPASAAASSSSSGISMGRLSPRPLLVCFPARRSRLHADVGLRLAAAGPNGVNGAASPGPDSGSGSGGANHLPKNRRDILLEYVKGVQPEFMELFVKRAPTQVVDAMRHTVTNMIGTLPPQFFAVTVTTVAENLAQLMYSVLMTGYMFRNAQYRLELQQSLEQIALPEPKGEKGSEDYAPGTQKKVSGEVIRWNKTTGPEKIDAVKYIELLEAEIDELSRQVARKSSQGSNELLEYLKTLEPQNLKELASSAGEDVVFAMNAFIKRLLAVSDPAQMKTAVSETSGAQLANLLFWLMIVGYSMRNIEVRFDMERVLGAAPKMGGELPPGPGDNTQTQL

SEQ ID NO: 124721 - protein, 371 aa, Triticum aestivum
  unsure (1)..(371): unsure at all Xaa locations
  Clone ID: PAT_TA_19139.pep
VFNVTDKEGLKLKDKAAIAEIEGYIRKSLGADSRYMPAKRRSVGVAASTDHNVIELTGSDRPGLLSEVSAVLASLKCNVVSAEIWTHNTRVAAVMRVTDEDTMLAVTDTVRLEMIKERLSYLLRGNNLSRGAAMAEASGTSATHTDRRLHQMMLSDGDXEEFHGHVPAQPQRPKVTVRNWKDKDYSVVTIRCKDRPKLLFDTVCTLTDLRYVVYHANIDASNNQAYQEFYVRHVNGSPMNTEAERLRVIQCLESAIERRVSEGVKLELCSNDKVGLLSEVTRIFRENSLTVTRAEVSTKGRTAVNTFYVRSSAGEAVDQKTIDSIREAIGHNIQVKGHPEAAPQKKESPTWFLFANLFRPRSLPSLGLFVR

SEQ ID NO: 124722 - protein, 132 aa, Triticum aestivum
  Clone ID: PAT_TA_19140.pep
GTRVNKDAPAANKSLQNRYSRLAAPLPSRAAALSPCPAVLSPCHAALIWSRRSPTPGTRRQPPPESRRLRRRPDLQPHSAGSSPLAARHRSKPSTSTSPQVHELFANDCSEFVRPLICYCCSDSTFCSELCG

SEQ ID NO: 124723 - protein, 191 aa, Triticum aestivum
  Clone ID: PAT_TA_19141.pep
MEHLPVEVIGNILAHLSAARDVMVSSAVCRKWREACRKHLHSLSFNSDDFPRDMTTRQLEIIITQTIFQTMGLQCLSIHIDNTHEFSAAPVIAWLMYTRETLRCLYYNIQTNPNVNILEKCGRQKLEVLDLDHNTITGVEPSYQRFTCLKSLYLRHVSISALDLSLLVAACPKIESLALDVLEIVTSDWQS

SEQ ID NO: 124724 - protein, 115 aa, Triticum aestivum
  Clone ID: PAT_TA_19142.pep
AISLQPSLWTPSKKVSAPRLKPAPQAKASSLRLFLCFSTILSSARRNSGPKPKRSKSASAGAGAREETRTRWTAAGIFCFSLAAMVRSAIAIPSTNPSRSGRRRLGFPSLDLQHA

SEQ ID NO: 124725 - protein, 148 aa, Triticum aestivum
  Clone ID: PAT_TA_19143.pep
VRPRVRPGAHAGDREKETLAAAVQICLGWWRYGYGAAHHGREADAEDPRRCPAGSRLFSCSGTGFCRPRPLRPRVSPGTGEDCRETQEEAQERGLGLWCWLQSWSTHLFAWGPSASLKGDGSMVNDWNIYPAPHVLLSTTVPASSTIY

SEQ ID NO: 124726 - protein, 156 aa, Triticum aestivum
  Clone ID: PAT_TA_19144.pep
RPLGASGRERSARGWRSRRRKPNPPPSSICLGWWRGGYGAARANHGRQAQSSPTAVHLVRVRFSSRAPAPADADLDRFGPEFRRALDKIVEKQRKRRKDEALACGAGFSLVSAHLFSWGPSAWLREMAQMVNDWNIYPAPYMFYYLLLHTQVLLIH

SEQ ID NO: 124727 - protein, 273 aa, Triticum aestivum
  Clone ID: PAT_TA_19145.pep
MLLKPQAIWAASLPLFLGRRLLPKSSPPPSGRRLPFRPICKRRMSAQAEPRFAPLPTAQSEPDAGADGYQFRLVSYNILAQVYVKSAFFPHSPSASLKWKARSKAVLTELKSFNADLMCIQELDEYETFYRKNMESTGYSSIYVQRSGDKRDGCGIFYKPKSVELLQKEVIHYNDLVETCHLNDNVISAPSNNSSPSEESSGKEDNKKRGDPNDPRVRLKRDCVGLLAAFKLGDPCEHILIVANTHIYWDPEWIDVKLAQAKYLLSKVSEFEK

SEQ ID NO: 124728 - protein, 237 aa, Triticum aestivum
  unsure (1)..(237): unsure at all Xaa locations
  Clone ID: PAT_TA_19146.pep
MAALQPSFSSLMAMNNSCNTMKFPKTALLPGFGGISRPQDVQDRNASLTCSRPKAVSVTDQSVAEPAKPRQTKHTVDPAAPEFLPLPAFEDCFPRSTKECSEVVHEETGHALKVPFRRVHLTGDSGHFDTYDTSGPQNISPRLGLPKIRKEWIDRREKLGSPRYTQMYYAKQGIITEEILYCAKRENLAPEFVRSEVARGRAIIPSNKXRHLELEPMIVGRNFLVKVNANIGEPRLL

SEQ ID NO: 124729 - protein, 479 aa, Triticum aestivum
  unsure (1)..(479): unsure at all Xaa locations
  Clone ID: PAT_TA_19147.pep
MGRAFVYVVLGGGVAAGYAALEFARRGGYSRGELCIISEEAVAPYERPALSKGYLLPEDPSRLPKFHTCVGANDELLTTKWYKEQGIELVLGTRVISADVRRKTLLTATGETISYKTLIIATGARALKLEEFGISGSDAANICYLRNLEDADKLVNAMSSCSGGNAVVIGGGYIGMECAAALVTNKIKVTMVFPEKHCMGRLFTEKIADYYESYYTLKGVTFTKGTVLTSFEKDSTXEXGLSVILXKMGNHXLPADMGVVGIGIRANTSLFEGQLLMEKGGIKVNGQMQTSDSSVYAVGDVAAFPIKLFDGDIRRLEHVDSARRTARHAVAAILEPSKSRDVDYLPFFYSRVFTLSWQFYGDNVGEVIHYGDFTSNSPRFGAYWVSKGQITGAFLEGGDRDDYEALSVVVWRKTKVSDMPELERQGLAFAIQESKKDVPDSGVTLGEKPTFVWYATAGVVAAVSISAFGYWYGRKRRRW

SEQ ID NO: 124730 - protein, 326 aa, Triticum aestivum
  unsure (1)..(326): unsure at all Xaa locations
  Clone ID: PAT_TA_19148.pep
MALAHQITNQPLLSSPPCLARTNGSNARTARTAFLGHSCCLKLRDTARRCVVVRASSSAQAEPKSGGGDGDGGQEPYEEYEVEILKPYGLKFAKGRDGGTYIEAIFPGSSAEQIGKFTVGDKVIATSAVFGEEIWPAAGYGQTMYCIRQRVGPLYMKMQKKFGKWDGAAELSDKEVIRAERNTGNVSTKLREIQMQNYQKKMEEKIQREXDLRMGLKLHKDGRPKQALEKCESVLGSKPEIDEASVASYNVAWPNSKLDRIQAGLSALEAPMSGPAGSPSATRLLPPLPSLERKSGRRPLLNKYDESFINEIAIYAIKSIFGFGKK

SEQ ID NO: 124731 - protein, 495 aa, Triticum aestivum
  Clone ID: PAT_TA_19149.pep
MLLLAPTPPPSPATAHRRPGGSAASCIRCSSVRELDRSPSRPPLPALAEAKRVVLVRHGQSTWNADGRIQGSSDFSVLTPKGESQAETSRLMLLADSFDACFTSPLARSRRTAEIIWDSRDKDLIPDYDLREIDLYSFQGLLKHEGKEKYGALFQQWQKSPSDCSIDGHYPVRELWDRAQGCWERILTHEGKSVLVVAHNAVNQALVATSLGLGTEYFRTLLQSNCGASVLDFTPQPGGRPPSVCLNRLNQTPNSPISAESSAGRKSSKRIILVCQGATQSSSEGSLGGVGYAPLNMLGVIQAQKTAELLLDLKVNSIICSPQVAAVDTATAICEVQEAADCLGADCVPRYVEMKNLFGLEIDDAFLTKQKSLEQIVQSGWMGGMEHQKLKTLWAQSEDAWQALVNELPEDDGAESDRVVVAIGHPAIHLGLLCRCLNLTMDYMPSFHLDDGSISVIDFPDGPKGGGIVRCTNYTAHLGRWSVPITKSTENNDEF

SEQ ID NO: 124732 - protein, 285 aa, Triticum aestivum
  Clone ID: PAT_TA_19150.pep
MQPDQNQQRRKGSSEMDFFSEYGDANRYKIQEVIGKGSYGVVCSAIDQHTGDKVAIKKIHNIFEHLSDAARILREIKLLRLLRHPDIVEIRHIMLPPSRRDFKDIYVVFELMDTDLHQVIKANDDLTKEHHQFFLYQMLRALKYIHTANVYHRDLKPKNILANANCKLKICDFGLARVAFNDTPTTVFWTDYVATRWYRAPELCGSFFTKYSPAIDIWSIGCIFAEILTGKPLFPGKNVVHQLDLMTDLLGTPSLDTVSRIRNEKARRYLSSMRKKQPVCFSERF

SEQ ID NO: 124733 - protein, 278 aa, Triticum aestivum
  unsure (1)..(278): unsure at all Xaa locations
  Clone ID: PAT_TA_19151.pep
MSSPPAPGGAFDRYVQRGGAVAVPASSGNTVFKSGHLFISSKGLGWKSWKKRWFILTRTSLVFFKSDPNTLPQRSGEVSATLGGIDLNNSGSVVVREDKKLLTVLFPDGRDGRAFTLKAETSEDLFEWKAALEEALAQAPNAALVMGHNGIFRNDTCDAYETTAPNWREKRPVKSLVVGRPILLALEDIDGRPSFLEKALRYLEKHXIRVEGILRQAADVEEVDRRLCEYEQGRTEFAPGEDAHIVGDCVKHVLRELPSSPVPASCCTALLEAFRLET

SEQ ID NO: 124734 - protein, 234 aa, Triticum aestivum
  unsure (1)..(234): unsure at all Xaa locations
  Clone ID: PAT_TA_19152.pep
RGGDAAEKKPYITSIGVYIFKKEIVVNLXRWRFPTTNDFGSEINPAKTREINVKAYLFNDYXEDIGTIKSFFEANLALAEQPSKFSFYDASKPMYTSRRNLPPSMISGSKITDSIISHGCFLDKCRVEHSVVGIRSRIGSNVHLKDTVMLGADFYETDMERGDQLAEGKVPIGIGENTSIQNCIIDKNARIGKNVTIANAEGVQEADRASEGFHIRSGITVVLKNSVIADGLVI

SEQ ID NO: 124735 - protein, 166 aa, Triticum aestivum
  unsure (1)..(166): unsure at all Xaa locations
  Clone ID: PAT_TA_19153.pep
CRXFGTRPTRPRVRGRVGSHARSRPWLGFRAGQGSVFAAGAAPVDSDGSSPSPPSPPRAVPLPAGHEGQPGRIGLGLLCFRSVMDEEPLGRKGVYQPRSGARCAWSAATTFGPTTHGHFRDKLLHQNFAWRTSGTLGYIRSRRVIDYFANDNDTEARRTISFSLYT

SEQ ID NO: 124736 - protein, 652 aa, Triticum aestivum
  unsure (1)..(652): unsure at all Xaa locations
  Clone ID: PAT_TA_19154.pep
MLASLFCAVSSSCQLSSLSCPKRVFETLASPTKTIKNMLTVPSSPSSPANGGSVKVVHMTPVTSAMTTAKWLRGVISLLPEKPSSKLEKFLSSCDTDLTSDVTKRVSIILEAIFPTKPSGHWGGSMGLNCTNAFDIPWAEARKMEASKLYYRVLEAICRAXSLNTNVNNLTRVLSNERFHRCLIACSAELVLATHKTVIMMFPAVLESTGLTAFDLSKIIENFVRHEESLPRELKRHLNSLEEQLLESMAWEKGSSLYNSLVVARPSLASEINRLGLLAESMPSLDDIVARQNFHAEDLPATPSKKRAAYSDENGDSRSPKRLCIEPRSTLVDQISQTPPAKQSYTLKAKWRPLQSTFASPTVSNPVGGNEKCAEVGVHIFFSKILKLAAIRIRNLCERLRHVEQTERVYNIFKQILDQQTTLFFNRHIDQLILCSLYGVAKVSQLTLTFKEIVNNYRREQQCIPEVFRSVFVVNTNHNAXLGSRHVDIIVFYNEVFVPAVKPFLVALIPSGGAHPDNKKNPNSQIPGSPKPPPFSNLPDMSPKKVSSSHNVYISPLRQTKKDALLSPSSRSFYACIGESTHAYQSPSEDLAAINNCLNYTSGRINTRINFDMVSDSVVAGSLAQPHGVPASSDPAGSFSFLSRKDNPGPDS

SEQ ID NO: 124737 - protein, 207 aa, Triticum aestivum
  Clone ID: PAT_TA_19155.pep
KGNARPRHTISNLQADSPVQSEDDHEELLASANSALRSAYGSAFWRQVDPFFGFVTTEDIAYLSEQIHLLDDSAASRSVEGDESRKYKGSLEYISEPSTPAGSNKDDHSALPNGYALNGMVNDSGAWGTSCIEPILDQLVQGIDVREVGSVGQRLIQAWIDEDKVDDIANDVYRSEGYPFDTHEIHFDEGGWKSHSESYKLEPLLNF

SEQ ID NO: 124738 - protein, 162 aa, Triticum aestivum
  unsure (1)..(162): unsure at all Xaa locations
  Clone ID: PAT_TA_19156.pep
MESTRVLPSANHRMPCSLQTFPRRNVLRALHRRKDARQPRRISISCEATGGGRVDRREVLLGLGGAAAAGLATDQGRGAIAAPIQAPDLRNCQTPDLPNTPSDTNCWPTPGTGITYFELSPRFSPLRVRTAAHLVDAEYLAKYXRAVALIEQLPADDPLNFE

SEQ ID NO: 124739 - protein, 188 aa, Triticum aestivum
  unsure (1)..(188): unsure at all Xaa locations
  Clone ID: PAT_TA_19157.pep
MATSTSLAAALPSRLTSPGRRAALSWATSCARPHPARAVSSGCRLVVTCNAQAAAPISIGQGTPVRPTSVLVVGATGTLGRQVVRRALDEGYDVRCLVRPRPAPADFLRDWGATVVNADLSKPETIPATLVGVHTVIDCATGRPEEPIRTVDWEGKVALIHXAKAMGIQQYVSYPILQPRHRLVPFMG

SEQ ID NO: 124740 - protein, 211 aa, Triticum aestivum
  unsure (1)..(211): unsure at all Xaa locations
  Clone ID: PAT_TA_19158.pep
MLSSSLMLTCGHAPLPAFRKPRRRIPAVPQTNASLSTFLPGRGGGAAAPRRGWAQICRDSSRPGADAAEQDREIKNDLATATVPKIGGGGGGGGQLSDWITSVLLFGIWAGLMYYVLQLAPNQTPYRDTYFLQKLLNLKVDDGFRMNNVLVSLWYIMGIWPLVYSMLLLPTGRSSKSKIPVWPFLVLSCIGGAYALIPYFVLWKPPXPAID

SEQ ID NO: 124741 - protein, 322 aa, Triticum aestivum
  unsure (1)..(322): unsure at all Xaa locations
  Clone ID: PAT_TA_19159.pep
MSEDKGRSRSGARVKVREAVCNAVAGGSAGAISATVLCPLDVLKTRLXQVYGLPSNLSPGTRAAXGRIILSGIATTYCKTEGLPGLYRGLSPTIVALYPTWAVTFSVYNYVRGLLRSQDTKNGELSIQENILAASCAGIATAVATNPLWVVKTRLQTQGMRPGVVPYTSVLSALRRIAAEEGLRGLYSGLLPSLAGVTHVAIQFPVYEKAKLYLAKRDNTTVDKLGPGQVAICSSGSKIAASLITYPHEVVRSKLQEQGRVPHGAIRYIGVTDCIKQVLQKEGIAGFYRGCATNLLRTTPNAVITFTSYEMINRLMHQLLSS

SEQ ID NO: 124742 - protein, 759 aa, Triticum aestivum
  Clone ID: PAT_TA_19160.pep
PTFGYEGDPMRLLFSKSASPHHGFAAYYTFVEKIFKADAVLHFGTHGSLEFMPGKQVGMSDACFPDSLIGNIPNIYYYAANNPSEATVAKRRSYANTISYLTPPAENAGLYKGLKQLSELIASYQSLKDTGRGNQIVSSIISTAKQCNLDKDVDLPDEGEELPANERDLVVGKVYGKLMEIESRLLPCGLHVIGEPPTAVEAVATLVNIAALDRPEENIFSLPGILAATVGRTIEDVYRGSDKGILADVELLKQITEASRGAVRAFVEKTTNSKGQVVDVTNKLSSILGFSLSEPWVEYLSQTKFIRADRDKLRTLFGFLGECLKLIVADNELGALKTALEGSYVEPGPGGDPIRNPKVLPTGKNIHALDPQSIPTAAAMKSAKIVVERLLERQKADNGGKYPETIALVLWGTDNIKTYGESLAQVMWMLGVEPVTDGLGRVNRVEPVSIEELGRPRIDVVVNCSGVFRDLFINQMNLLDRAVKMVAELDEPIEMNYVRKHAQEQAEELGVSVREAATRIFSNASGSYSSNVNLAVENASWTDEKQLQDMYLSRKSFAFDSDAPGVGMLEKRKTFELALATADATFQNLDSSEISLTDVSHYFDSDPTKLVQGLRKDGRAPSSYIADTTTANAQVRTLSETVRLDARTKLLNPRWYEGMMKSGYEGVREIEKRLTNTVGWSATSGQVDNWVYEEANTTFIEDEEMRKRLMDTNPNSFRKLLQTFLEANGRGYWETSEDNLERLRELYSEVEDKIEGIDR

SEQ ID NO: 124743 - protein, 167 aa, Triticum aestivum
  Clone ID: PAT_TA_19161.pep
GCVLTAPISSTEENMENVQLSDPQFHLGPGESSSGDLSRGGEVWESGILDGLYISQEKVKFDSEHPSEALEELREVSILKDGSHDIPVNEHESLHVSVNEGQTCVALTNALDVSVNNDDAYQPLTNEDKTCDIPLVQSNCAALTNEDEVQSVPPRSENNGLDYQPLV

SEQ ID NO: 124744 - protein, 167 aa, Triticum aestivum
  unsure (1)..(167): unsure at all Xaa locations
  Clone ID: PAT_TA_19162.pep
MTGGGQRDQRFHDAAQARIPHHANQADTLKLVVADARLQRDVPVRRPQRKDLYEVLEVGRSATDEEIKKAFHRMALKYHPDKNGDDPVAFDIFLEIQFAHTILSDPSKRRQYDKSGFEAIESDRQKSDLDLSNLSPARTMCVALFXSKLGVPIKTTVPSSRFEGGFG

SEQ ID NO: 124745 - protein, 246 aa, Triticum aestivum
  Clone ID: PAT_TA_19163.pep
MDAGGGEQLRLAEVRDQLIREEDSIVFALIERAKRPRNTPAYSAAAAAAGSLAEFFVREAEVLHAKAGHYQKPEDVPFFSQDLPPPVFPTKGRPKVLHPFASLVCVNDAIWKMYFNELLPLFTADGDDGNYAETVALDFACLQALSRRIHCGKYVAEVKFKDAPQDYSPPIRAKDTNALMNLLTFTAVEEKVKKRVEKKPRIFGQNVTLEDSVGKQDGDACDSHCKVDPNAPSKLCGLSGLPVNQD

SEQ ID NO: 124746 - protein, 183 aa, Triticum aestivum
  unsure (1)..(183): unsure at all Xaa locations
  Clone ID: PAT_TA_19164.pep
FFFFFSINRELXFYSLPMHSQRHXPPFYLVXAWNSVVTXHKPTXVSRXFVGDFTSSTSPSYCQTFQEMRPXSRRRPFIQGGDEAREDLMVGNTXLLTSDYTNPAIFSLSLLSENAYISAVILQIKQFIMICTVHVHALSRHDLQRHLVELVTVWQDREASVPAVQVSHGPQFIEVRTSMMLSD

SEQ ID NO: 124747 - protein, 305 aa, Triticum aestivum
  unsure (1)..(305): unsure at all Xaa locations
  Clone ID: PAT_TA_19165.pep
DMGVKDIPVNAGIKDFDVIEQGDVVVLPAFGAAVDEMYTLNEKNVQIVDTTCPWVSKVWNMVEKHKKGDYTSIIHGKYAHEETVATASFAGKYIIVKNMAEATYVCDYILGGQLDGSSSTREEFLEKFKKAVSPGFDPDVDLXKVGIANQTTMLKGETEQIGKLVEKTMMRKYGVENANEHFVAFNTICDATQERQDAMYHLVKEKVDLILVIGGWNSSNTSHLQEIGELSGIPSYWIDSEQRIGPGNRISYKLNHGELIEAENWLPEGPITIGVTSGASTPDKVVEDTLHKVFDIKRQEVLQVA

SEQ ID NO: 124748 - protein, 60 aa, Triticum aestivum
  Clone ID: PAT_TA_19166.pep
PGNKISYKLNHGELIEAENWLPEGPITIGVTSGASTPDKVVEDTLHKVFDIKRQEVLQVA

SEQ ID NO: 124749 - protein, 292 aa, Triticum aestivum
  unsure (1)..(292): unsure at all Xaa locations
  Clone ID: PAT_TA_19167.pep
MRSGDKMITSGGSPFQTQRTYPHSVPRRGTRRRPPRSSAPHARPLPPPQAMATITTQLRSALLSPAASSSSSSSPRRGGRRAPSSVRCDASPPAASASASLDPDFDKKAFRAAXHNLTRDNYNRKGFGHKKETLELMSQEYTSDVIKTLKDNGNEYTWGPVTAENWLQKEAYGFCWGVERAVQIAYEARKQFPEERIWITNEIIHNPTVNKKLEDMGVKDIPVNAGIKDFDVIEQGDVVVLPAFGAAVDEMYTLNEKNVQIVDTTCPWVSKVWNMVEKHTTIHSRNAHCTFP

SEQ ID NO: 124750 - protein, 218 aa, Triticum aestivum
  Clone ID: PAT_TA_19168.pep
MAALCLTAPAIARWSPPPSPRRWQHPLCQDCARRRRGLARRRASGDDGPEEAEAPPVRTLLVDNYDSYTYNLFQELSVVNGVPPVVVRNDEWAWGDVYYWVYKKRAFDNIVISPGPGSPACPGDIGLCLRIVSECGDIPILCVCLGHQAWGLVHGAKIVHAPEAIHGRLSEIEHNGSYLFNHIPSGINSGFKVVRYHSLVIEATSLPEDLVSIAWCAS

SEQ ID NO: 124751 - protein, 471 aa, Triticum aestivum
  Clone ID: PAT_TA_19169.pep
VAEYHPGALRAEFSRDDHRYGVIPHAENSSEPTEDKHASADDHPAKAPRHVHFSVTEKAKSLDEEQDQEGKWKDLTEEEEDELESLWEHQDLIEQLKLELKKVRSAGLPTILEESESPKAPMEDLKPWRIDAKFLREDPMDELNKFFKSYRERMRKFDILCFQKMYAIDFLQLRGPQQSANSLKALSPTALSILSHNFRSARWRSPEDPSDRLLKDLRCDLETVYVGQMCLSWEFLRWQYEQACDLPESDPYHSHHYNQVAGEFQQFQVMVQRFVEDEPFKGPRLPDYVKERCPFRNFLQVPVIREDSLKDRMEDQRKGNYVITSEELEVVMEESMHILWEFIKADKEPQTSVLKGLSTAHVELQDPRDEALVKAIHATLQKKEKRLKDLLRTGNCIVKKFKKPKEDRSDQNLFFSQVDMRLVARVLRMPRITGDQLQWCKAKLDKIMLVDNRRIHREASFLLFPCLEYKT

SEQ ID NO: 124752 - protein, 144 aa, Triticum aestivum
  Clone ID: PAT_TA_19170.pep
MELLKAINGNLNDLKKLQQKLEQQKKKQQQQKKQQQKQQRPQKQPEDHIQALNALGAEIKHKLSILGLMPPSPLAEVLKQLKDKALKRAGLTEESLQEQIEQRIAARNNKQFDVSDQIRKELAGKGIALMDEPTGTVWRPCERE

SEQ ID NO: 124753 - protein, 240 aa, Triticum aestivum
  unsure (1)..(240): unsure at all Xaa locations
  Clone ID: PAT_TA_19171.pep
AVIFIRLLRSSRAAEMDKSGNLARSGNLQGSFRIDAALNVAAGAAKEKDRGQQDHYGIFGIQDSMVRDIGPYKNLVRFTSSAFDLRGFSGSPLLTKLREMLEALQQVDLRVLTHQQKLAFWLNIYNTCIMHGILQHGLPSNSEKLLALKNKATINLSGQKFTPLVIENFILRQPSSVKEEFWKCDVDAEEQQARGLYGLNIQDPXLFAMCCGNXLSSTRIYKRSRDGGLEKRTGLLQLLW

SEQ ID NO: 124754 - protein, 265 aa, Triticum aestivum
  unsure (1)..(265): unsure at all Xaa locations
  Clone ID: PAT_TA_19172.pep
PTRPTSAIQQSSFAGQTALKPSNELLRKVGVSGGGRVTMRRTVKSTPQSIWYGPNRPKYLGPFSENTPSYLTGEYPGDYGWDTAGLSADPETFAKNRELEVIHSRWAMLGALGCTFPEILSKNGVKFGEAVWFKAGSQIFSEGGLDYLGNPNLIHAQSILAIWAVQVVLMGFIEGYRIGGGPLGEGLDPLYPGGAFDPLNLAEDPEAFSELKVKELKNGRLAMFSMFGFFVQAIVTGKGPIENLFDHLADPVANNAXSYATNFAP

SEQ ID NO: 124755 - protein, 156 aa, Triticum aestivum
  Clone ID: PAT_TA_19173.pep
SQVAGAEIWSASPDLSSAPLPAASGSASLLAVSPRQAHRPVRVAHSRSPCARAPPGEDEPLAPAPTTSPIGTVPRPEPSGPSGCSGPEAARLAATTSPHTQTPPRSLPRPHTRPVPAATGNGPSSTRGCGPHVSPRLEAIACGTSRSSPRQAASSA

SEQ ID NO: 124756 - protein, 275 aa, Triticum aestivum
  Clone ID: PAT_TA_19174.pep
FRPAGRNLKAHLTVEESCSCSKDETNSLGSPSKGSPYQSSKNNDIFSASRKDDEIVEPLLEHKLGTSERCQKQQDLEEVVFYEPALDREYQMKSVDASSIGKGIDMDINGLGVTFPNLLQGEQQYRKVDSAVNFTEISKLLDKIEKAPVMKSKGEALACRKPPRQKLTNSKQKGSCLFEMLTVPSKSHLTCSKDPTYSVNSRSNTSRCSLETQKQFSTKTDTLYSDTHDASKSIAGLASTSTQKDSGYPDSEKTERVVSSSTKRVSSCCEGNETI

SEQ ID NO: 124757 - protein, 317 aa, Triticum aestivum
  unsure (1)..(317): unsure at all Xaa locations
  Clone ID: PAT_TA_19175.pep
MATATASTSLRPPPSPFPPRLAGSLRQWCWGMPTHSSRRRAFHAHPRKRNTLLCAAVKGPEESFKKTIEMDRLIDMLRDANPRXAFSEGFWVRLAARIDLCKSDDDQKDYEELAENVMNIVDRVVHKTDEKIEQSTDVLKAIISPVMNEGEDGMWPPRNPEALKLMEKEISNREKEGQLDESFLSEVNAQLRQAKDEVDKPGLQVMLQKVLQLYASNFLRKRSYAYKGGEVVVPEKFLESIIEAPENDWNRLLLDGLTVGKGDVSPEEFYAVTKKRIERILIRTEGGSYQQRVLVEYIKEIQARAEEIVNRLQGPAV

SEQ ID NO: 124758 - protein, 144 aa, Triticum aestivum
  Clone ID: PAT_TA_19176.pep
VGSPVPPPPLPPSPPLVSARRSPPHNLLLLGRLSYPHGIQLALRWDLPGRRRLARLAAKMDARQTAQVNQASGAVGDAAAAKPDAGRVGPIPIHSQFVMMRGNAREKIFEYIGRKPSSADWRRRLPHLARRLEEILFRKYPSKQ

SEQ ID NO: 124759 - protein, 299 aa, Triticum aestivum
  unsure (1)..(299): unsure at all Xaa locations
  Clone ID: PAT_TA_19177.pep
MAGPAASLRFTVXRRKAAELVTPAGPTPRELKRLSDIDDQXDGLRFHIPVIQFYRRDASMXGGRDPAAVVPGPPLARRLVELLALRRPAEGTXGGVLPIEAAADASLEHGGPALPPTFPGPEDRLPGVHGSSQVLGTPLLLSQVTPLACGGFILAVRLMHTMADAQGLVQFLAAVAELARGAAAPSVRPVWDRELLEARNPPRPGFAHREYDEVPDTKGTIVPLDDMAHRSFFFGAREVAAIRXHLAPGLRKRATLQVSRELWNAAPCAGPTHSDAMIDLPRGNKRAAHPAVHKLRFRG

SEQ ID NO: 124760 - protein, 229 aa, Triticum aestivum
  Clone ID: PAT_TA_19178.pep
PSPPPPPPASPPATAPPGTSPRSPRLPRTSPSPPARQPPPSPWAAAPPAPPALPAAGPPPPTRPSSPPPPAGTPPPCPPPSPSAPGPPSASAPPGSSPATPSPAARPPPPPAPGTAASPAARAPPAPPAPASGAPPAPTAPSSPRRPTRASGSRRRSCSTGASRPRASRPTGSCTSTASQPPTTGPPSAVDPPPGRMTGCCVGSTRSAATCPTSPPLTRNRSMSRRAPP

SEQ ID NO: 124761 - protein, 199 aa, Triticum aestivum
  Clone ID: PAT_TA_19179.pep
SEGIVVPAVIAAVMGRTCRSFPLSGSVGALVASRLLQERGELLPPDDALDIARRVKETYCYTPSDIVKEFKKHDSKPSKYIKQWSAIKPKTGVPYTIDVGYERFLGPEIFFHPEMYSADFSTPLPELIDSCVQSAPIDTRRALYKNIVLSGGTTMFKDFHKRLQNNIKKIVDERVAETNAHHRVEVKPVEVNVVTHPIQ

SEQ ID NO: 124762 - protein, 312 aa, Triticum aestivum
  Clone ID: PAT_TA_19180.pep
GGAKREQQSGVTQPDPLPLPSAPPAGVGMGEALGILLYILMVGFLLLWWYSALCWSGVMPMECWPPSLARSVRWLSTSSSASSPWWRQKGGGGSDASSPNKRVAASVRAALVFSRLASSRHGGGKGRGGMARRGSSLWWVFSLDLSFQRDCPALICWRASSVPPAAASIAVMERWRWSQGKLDVADGVRELTRRWIWRNCGALAGRCPVDSDKPPYPQVEGRPFAFLPAMEPKGRQDCFTVESMAWSHGGLAGPSGAVPGAGEAGSSGEQNRTRSQSSSFVRGLFCNLQGLVCNCPCLWGPVAKCTPCLSNE

SEQ ID NO: 124763 - protein, 140 aa, Triticum aestivum
  unsure (1)..(140): unsure at all Xaa locations
  Clone ID: PAT_TA_19181.pep
VLEXXXAPXXPTPSPAPSPSPPPXEVEPDPEADADPEPDPMPGIDPERETDAEPDPEPELEPPPPPIPTPTPSPRPRPPDPDPEPDPEPDPEPEPDPDPEPDPEPEPELXPEPPAPTPAPKPIPIPSPPRPRLRPRSFRA

SEQ ID NO: 124764 - protein, 167 aa, Triticum aestivum
  Clone ID: PAT_TA_19182.pep
RNVVADGTTVNLGLWDTAGQEDYNRLRPLSYRGADVFVLAFSLVSRASYENIMKKWIPELQHYAPGVPVVLVGTKLDLREDKHYLLDHPGMIPVTTAQGEELCKQVGALYYIECSSKTQQNVKAVFDAAIKVVIQPPTKQREKKKKKQRRGCSMMNFGGRKMLCFKS

SEQ ID NO: 124765 - protein, 60 aa, Triticum aestivum
  Clone ID: PAT_TA_19183.pep
RWSGGSWRRRPLRARRTGVTHARQASWMGSQVLDVRLGCDVCLVLGPGYLRPFINWIEFA

SEQ ID NO: 124766 - protein, 230 aa, Triticum aestivum
  unsure (1)..(230): unsure at all Xaa locations
  Clone ID: PAT_TA_19184.pep
MASSASRFIKCVTVGDGAVGKTCMLICYTSNKFPTDYIPTVFDNFSSNVVADGTTVNLGLWDTAGQEDYNRLRPLSYRGADVFVLAFSLVSRASYENIMKKWIPELQHYAPGVPVVLVGTKXDLREDKHYLLDHPGMIPVTTAQGEELRKQVGALYYIEXKLNNTKEGETCVLRMYLEKTQQNVKAVFDAAIKVVMQAXQKQSRGERKKKKARQGCASLGVLSIRKLACF

SEQ ID NO: 124767 - protein, 392 aa, Triticum aestivum
  unsure (1)..(392): unsure at all Xaa locations
  Clone ID: PAT_TA_19185.pep
PVRNFRVDHIDRIVTMIKQIXDNGCAYVVSGDVYFSVDNFPEYGKLSGRKLDDNRAGERVAVDERKKNPADFALWKAAKDGEPWWDSPWGPGRPGWHIECSAMSAQYLGNSFDIHGGGEDLIFPHHENEIAQSRAACCDSSINYWVHNGFVNVNGQKMSKSLGNFITIRKVIELYHPLALRMFLLGTHYRSPINYTVEQLNVASDRLYYTYQTLRDCEESTQQDQSSSGGSLPFTTTHCIEKLPAVCAPAGAGDLHTSVALAAISDPLKVLNDLLHTRKGKKQEKRLESLAVLEEKVRMVLSVLGLMPSSYHEALQQLXEKALRRAGVTEEQVLQKIXERTAARKAKQFGRSDEIRDELAALGVALMDGPDGTAWRPSVPASEQPVAAKSSK

SEQ ID NO: 124768 - protein, 180 aa, Triticum aestivum
  Clone ID: PAT_TA_19186.pep
MDPADTPGGVDPFSKTSCMDGKMQRHSQFPPPLEAADSVSRVLDDDDLLIEIIVRLGLPTSLIRAILVCKRWFFIVSNKAFLRRFRSLHPPRLLGFYVSTRSTDELLPVLLRPCFVSWPPRPPVPAPPVPLAPLVSLRAGVGRRAGLLDSQNDTILLHGFQGRKILWGVHWPLCPERGVV

SEQ ID NO: 124769 - protein, 152 aa, Triticum aestivum
  Clone ID: PAT_TA_19187.pep
ANFPTTPPHPFNYTGTPPNNTFVAHGTRVVPLKFNTSVELVMQGTAIQGAESHPLHMHGFNFFVVGQGFGNYDPINDPAKYNLVDPVERNTVSVPTAGWVAVRFLADNPGVWLMHCHFDVHLSWGLSMAWMVDDGPLPNQKMLPPPSDLPKC

SEQ ID NO: 124770 - protein, 90 aa, Triticum aestivum
  unsure (1)..(90): unsure at all Xaa locations
  Clone ID: PAT_TA_19188.pep
EARQRHKILRYNLLTLXEHHNMTNCEINYXNSIYAFPTCFKCLESFPEKEDVLNLRGHYITCLAIPDCPDLQNQSVDGQSLTTCSLIVPA

SEQ ID NO: 124771 - protein, 201 aa, Triticum aestivum
  Clone ID: PAT_TA_19189.pep
SLLPSAALVTPRAGGPCPLVTFGHRGRSQPPVMRGRWGERADSRGAGRPPPRHPSRWPRCGRPAPGAPMPSPWGPYIQCVATSHAGPLWHARRGRDLPLRLPRQRASRQCPPAWGAASAGQAGPGVLGAFPLLPPGGRASVPRRWPVASPGAFLAGSHNGRARGRVSHGPRRRFRLPCACPALAGAPLRPRRYPPLGFNLR

SEQ ID NO: 124772 - protein, 104 aa, Triticum aestivum
  Clone ID: PAT_TA_19190.pep
LSAFWERGSPDLPVCDPRRGYASRPVWPIFINKSYKTLARDHASRGGRHRTSSGAASPGRLARSGGIKAGQTSRGSRDVSHDDQDQAGARRAPARAASLFPLWF

SEQ ID NO: 124773 - protein, 216 aa, Triticum aestivum
  Clone ID: PAT_TA_19191.pep
MAGHRQSLAAASLKLPALLLLWIFSLNWGHAVAHFDPANMTELQKHVSFFDRNKDGFITPVETIQGFVAIGCEYAFATAASASIHGALAPQTTPAGTPLPHLTIYVENIHKAMHGSDSGVYDPKGRFLPQKFEELFKTYAILRPDALTLAEMHAMLFAKRDLDPISWAPPEIEWGLLFTLASDWLGFLHKDSVRGIYDGSVFTKLEKKWHPSQSDI

SEQ ID NO: 124774 - protein, 106 aa, Triticum aestivum
  unsure (1)..(106): unsure at all Xaa locations
  Clone ID: PAT_TA_19192.pep
RPXSGWAVRVGEGQSLVLXKTSILKIKESGGKRGELPVPXGSPVTGFPXGTTRILRMGFXQLSTFCFEILRRVALWRAQYDESCKLCSGGSYCLSLASMVEPVGEA

SEQ ID NO: 124775 - protein, 107 aa, Triticum aestivum
  Clone ID: PAT_TA_19193.pep
TLRNRRGVVPCPADYAWVSAEGLSPVLGRLYHRRPSVRRPSIGFTLLGAREPGHPGALGATFPFFSLSFISIDQTFYFMEEKQMEEKQKDLVHIHEALDFWFGPSWI

SEQ ID NO: 124776 - protein, 405 aa, Triticum aestivum
  unsure (1)..(405): unsure at all Xaa locations
  Clone ID: PAT_TA_19194.pep
MPPARSPAXGLRRRKVFLPLVLLLPLILLTLILIFPSRSIPALRDAALRSQQTCDYAAGGWVPDSSAESHLRYDHTCKEIFKGWNCIANGKRNGHALLRWRWKPAGCELLPRLDPLRFLERHRNTNIGFVGDSLNRNMFVSLXCMLRGVNGEVRKWRPAGADRGFTFLRYNLTLAYHRTNLLVRYGSWSASPNGGPLESLGYKQGHRIDVDIADQTWAEAPSFHDILIFNTGHWWWSSSKFDPIQSPMLFFEKGKPIIPPLLPPQGLDLTLKHMITFANKAMRPNGLTFFSTQSPRHFEGGDWNEGGSCQRDQPLSSEEVKEFFSLDNNGTNIEVRLVNQHLMKALELSTTFRVLNVTHMSEFRADAHPATTGGKKHDDCMHWCLPGPTDAWNDLLAASLAAIQC

SEQ ID NO: 124777 - protein, 127 aa, Triticum aestivum
  Clone ID: PAT_TA_19195.pep
RVRGRGTNWTISFGVSGSRTRTHLLHGHFNVFKTYLNSSLYLRSVCIIPSDVINLQHVLTSFAVFQSFTDLFRELNDGEIENHCKMNSEDVGTWHGIMISPAQHVQKSREGHGENWTHLVYLGGGHA

SEQ ID NO: 124778 - protein, 119 aa, Triticum aestivum
  unsure (1)..(119): unsure at all Xaa locations
  Clone ID: PAT_TA_19196.pep
MSRYRGPRLKKIRRLGALPGLTRKTPKSGSNLKKXKFNSGKKEQYRIRLQEKQKLRFHYGLTERQLLRYVHIAGKAXRSTGQVLLXLLXMXWDKILFXXXMXAXTIPGARQLGRPYTVV

SEQ ID NO: 124779 - protein, 81 aa, Triticum aestivum
  unsure (1)..(81): unsure at all Xaa locations
  Clone ID: PAT_TA_19197.pep
MEFADKLLLVLRSYSLPVWATIISGLFVAVSLSLSIYLLLNHLSAYKNPEEQKFLVGVVLMVPIYAIESYISLVNPTIGXX

SEQ ID NO: 124780 - protein, 177 aa, Triticum aestivum
  unsure (1)..(177): unsure at all Xaa locations
  Clone ID: PAT_TA_19198.pep
MDARGGDASAIALLLCACFLTALACDSXGAKFAYSGPLGPDHWGGLDPNFTRCAMGTYQSPVDIKTSDVVYNPMLGPLHREYTAANATLVDNIFNIALRCEDAAGTVQIDGVKYKLDNIHWHSPSEHTINGERFAVEQHMVHFSDDGNISVVSILYRLGRPDPFLMQLQDKLSELYV

SEQ ID NO: 124781 - protein, 95 aa, Triticum aestivum
  Clone ID: PAT_TA_19199.pep
HPYRLVKNINSCFYATFIKKKRQQLKPQHHSFDEMQGGLGSSRRLGAPGGGPLGMVLAPQDGAVRRVRAASLPGQRLAAAVALLSVVAFLQLRGL

SEQ ID NO: 124782 - protein, 580 aa, Triticum aestivum
  Clone ID: PAT_TA_19200.pep
LVSDITVRLGNTKFYLHKFPLLSKCARFQKLIPTTGDENIDIHIHDIPGGPKAFEICAKFCYGMVVTLNAYNVVAARCAAEYLEMNETVDKGNLIYKIDVFLSSSIFRSWKDSIIVLGTTKAHLPWSEDLKLVRHGIGSIASKANVDTSKVEWSYTYNRKKLPAESGRVGQWNGVKKQPSVPKDWWVEDLTDLDIDSYKQVISAIKTMGMVPKDAVGEAIKAYTYKKLPSLSKVSMIHGDGKVRAMLVTITCLLPSEKGSVSCSFLLKLLRATNLLKCGEMCRKELVKRIGRQLDEASVSDLLIPTVDGETTGYDIDMILSIVEEYVRQDSKNAQKHNAEVNGHVQAPSASMITVAKIVDGYLTEVAKDPNTPVLKFINLAEAISGNSRPFHDGIYRAIDMYMKEHPSLSKSDKKKLCCLMDCKKLSPEACAHAVQNERLPLRTVVQVLYHEQTRASAAATVRADSICIGSYESSRSGATTNTEDEWDGVIAVEDLSLSSKTTKLEKCHSAEKSHGSSKSTTNGKAKGGATPKKVLGKMLSSKALTGERSSSDSSDSAILRSQDHPKRTPSRSTKPSAAA

SEQ ID NO: 124783 - protein, 255 aa, Triticum aestivum
  unsure (1)..(255): unsure at all Xaa locations
  Clone ID: PAT_TA_19201.pep
SANQKAAFTEILDXLRAICHAHMLPLALTWVPSSNGSDGGYVGHDSVLDSQSGKAILRIHESACYVNDAKMQGFFHACTETHLEKGQGIAGRALKSNLPFFSPNIREYGIKDYPLAHHARKFGLHAAVAIRLRSTYTGDDDYILEXFLPINCTGSXEQQMLLXNNLSITXKRICKSLRTFPEAKVDKLTLVLHNNHGIASYGHGILTWPAQKRINFNNKGHSNRTSNHCGENHREMEGVNTFGAKVLKTCLNVPK

SEQ ID NO: 124784 - protein, 163 aa, Triticum aestivum
  Clone ID: PAT_TA_19202.pep
SVVAAEVLHLAQIKRAKRFQMYDYGSAAANMEAYGTPKPLDLGAHYSLIDIPMDLVAGQRDRVISPTMVKKHYKLMRKAGVEVSYNEFEYAHLDFTFSHREELLSYVMSRLALAADAGKGRIKQTTVRLRKPKRVQSEMEKDRAMEYRGADEEIPGEPNGHSK

SEQ ID NO: 124785 - protein, 218 aa, Triticum aestivum
  Clone ID: PAT_TA_19203.pep
GRVGRGVLRENFDPVEIAQAYEKNGAACLSVLTDSKFFQGSFDYLEAIRNAGVKCPLLCKEFIIDAWQLYYARSKGADAVLLIAAILPDRDISYMLKICKILGMAALVEVHDEREIDRVIGIDGIQLIGINNRNLETFEVDISNTKNLLEGERGQLIAQKDIIVVGESGLFTPDHVSFVQDAGVKAILVGESLIKQEDPGKAIAGLFGKDISPVSSAV

SEQ ID NO: 124786 - protein, 336 aa, Triticum aestivum
  unsure (1)..(336): unsure at all Xaa locations
  Clone ID: PAT_TA_19204.pep
MDGARAAPLRCTPAETDAAATTSDQTETAVEATEQGNNGAPAADAPASSIEGLDGIKIRRRPVTGPSVHHVGPFQFRLENVGNTPRNILEKIVWNKDVEIWQMKEKMPLYRLKGPLDNAPPARDFVAALKASYDRTALPALIAQAKSASPRRGXRLRGGFDPGXSELAYEKNGISLFMWVILATNGLREGMLFFWLPPAYLIVVSGYVLKTCIIGRDGSKKLRCMDEREXSTVLIGIAGIQLIGIXNRNLETFEVDISNHEKASWRVERGQLITQKDIIVXVGESXGLFTPDHVSFVXDPGVKAILVGESLIKQEDPGKAIAGLFGKDISPVSSAV

SEQ ID NO: 124787 - protein, 261 aa, Triticum aestivum
  unsure (1)..(261): unsure at all Xaa locations
  Clone ID: PAT_TA_19205.pep
MGGWGCFCCGDLFGAGGEAAVRLPEPFQLPAPLLAWPQGRDFAKGVICIGELDIANITQFRNIWSYSGATFYEPEXVPDGFHCLGHYAQQNDRLLQGSLVVAREAASCQLINSRPALEKPLDYTLVWTNAGVYEDDNSECGCFWLPSPPEGYEALGYVVTRGPKKPSLEAVRCVRQDLTDPCENFRSVVNVERTCQVWKTRPCHRGTAGRGIPVGTFFCETNSVNSQESGIPCLKTXDPNLRAMPDLEQIHALIKHYGPTV

SEQ ID NO: 124788 - protein, 249 aa, Triticum aestivum
  Clone ID: PAT_TA_19206.pep
SSCLVSSYIQSNRPTAFPSCTHCVFDVDTVSIDVFISSLPAALDLCALSWNNHANSNEAITRHSSHSGSSGLEINCGESCNISKQANFTEDTNYPAERDLCYFTEIISLLELFGNYMSCEWTYKNVVVRLLKILESCTCEEYSAALLVLVSQLGRFFIDDVGYETEAVVELRNKLAVLIGTSFTRSRSIPVQFSAIGALLSLFPLTFDKIVSSQTGPLSGPCVLQASQISEWFGQLSKENQSFARSFFS

SEQ ID NO: 124789 - protein, 186 aa, Triticum aestivum
  Clone ID: PAT_TA_19207.pep
MSAQIAPPEHVCYVHCNFCNTILAVSVPSNSMLNIVTVRCGHCTSLLSVNLRGLIQSPPVQDHSQENFKAHNISFRGNYPDYGTSSKYRMPMMFSTKSDQEHMLHMRPAPEKRQRVPSAYNRFIKEEIRRIKTNNPDISHREAFSTAAKNWAHFPNIHFGLGSNESSKKLDEAIAAPIPQKFQRVY

SEQ ID NO: 124790 - protein, 324 aa, Triticum aestivum
  unsure (1)..(324): unsure at all Xaa locations
  Clone ID: PAT_TA_19208.pep
RALANLQELDISYAEPPLLTSVLRSASNILVAKISHCDFEPAMINFPFLKKLSLFRLTISADLFPGLLSCCHALESLSMTKVRAVGCLRLSSPTIRTIIFRHSYGETAELVIEDAPRPARPLVPYCERDDSVTVRVIRAPNLEILGPFFVVVSKLLLFQGISLVSSTNSMRTLKVLALKSSGQKLNAVLNILRGFPCLEKLCVIFHTNRERNDENEPQYDPLHPVECLETRLKKVVFKSFEGYGKQVDFAKFFVLNAKVLDKIEFEVRNQYSSETVAYEHRLLQVENRASREARVEFRTTSYXTEYHVNKRIHDLSVTGPFRQP

SEQ ID NO: 124791 - protein, 245 aa, Triticum aestivum
  Clone ID: PAT_TA_19209.pep
RPAKKTESLLSASIKPKQKDAKPTATSGSAVLCPSTNSAKEEAAVIAPATVAEVVEVQSSQCMEIDAPSTDEGFDKTSNALDTVPSEVPKVVPRGRAIGAPSTDEGLDKTSDALDTASSQVQKVVSSGMEEEDHSSSGLDAASSCTMDLGETCSPNIPDAFVEKTPVKTHLSTPKISVKLREISNSLKLLNARPLSVMAQKVAMEKTQEEGMEKTQKVAMEKTQEVAMETTQEEGMEMIQGVGME

SEQ ID NO: 124792 - protein, 154 aa, Triticum aestivum
  Clone ID: PAT_TA_19210.pep
MDATDLENPTSRNSSQKSSRRSSSRRSQKSAGQQSSPTVFPEKRGKSRSLRQKHVAVDNKDAKKGKNHERRTDTVDERSNFVGFEVYSGKLFYDRKNKSIGADGHLSSNKKADTTDARLTSKALIWGSTVLSLEDVISVSYNSGLQHFTLHAYP

SEQ ID NO: 124793 - protein, 242 aa, Triticum aestivum
  unsure (1)..(242): unsure at all Xaa locations
  Clone ID: PAT_TA_19211.pep
PTRPVGGPVSSSSAIAVPNAPSFHASNPTSPLSAMNTIGSPTQSGIDQPVGANVSPMKAAEFSTLGQPGTTSRGDQSRRGAQVSYLHHLSCRIILAGLESNLKPATHAAIFHHMVNWLVNWDQRPHGVDEADTVQTSRIGRPVHEWMHLCLDVIWILVDEEKCRIPFYELVRSNLQFLENIPDDDAVICIIMEXHRRRDMVCMHMQMLDNTSLPTFGLIGSVTSIKHTGESLQFRPNTIHVW

SEQ ID NO: 124794 - protein, 79 aa, Triticum aestivum
  Clone ID: PAT_TA_19212.pep
PGSTHASGAPPRAPRPPPPPAERPGGDAGCQSDCASSASVVDDGGDEAASAAVRPRAPFVFDLNLPPPSDELCTELRLF

SEQ ID NO: 124795 - protein, 290 aa, Triticum aestivum
  Clone ID: PAT_TA_19213.pep
MAPASLEELHCAPAPEKPPPSAPEGELRWLRRCAGDGDDLRWLRRCVGAATKGFAIGAGLKGGLALFSLLVRLRSRRSPRSRKAGAMTNDEAALLALKETLRYGMFLGTFAGAYVSVDECIAALWGRKRTARWRSLLSGLIAGPSMLLTGPGTQHTSLAIYILMRAAVLASRCGIKSKRFGKICKPLTWSHGDVFLMCLSSAQILSAYILQQDSLPSSYKSFLKMHGGKDQSILQGLKEVVNHTAFSNLEAIEKYYKSVGVDIKLDPDMKVPCSIVHGNQSCAGHFISFL

SEQ ID NO: 124796 - protein, 246 aa, Triticum aestivum
  unsure (1)..(246): unsure at all Xaa locations
  Clone ID: PAT_TA_19214.pep
LRWRLLRLLSPRELAGDAAAALRRAIRRVPPPAVASVVLGALLLAARLTLPKNPAQEVAYADLLAGLRAGAVTAVAFEEDSRRIYFSKAEDVGSGEDEHETGRXPAVPKWPYYARRVPHDEGFLLGLMREGGVDYRSAPRPAGRLLVDMLTTLLTLWFSLLPMMWFLQRQMSSGGSADKRRRPRKQQVGFDDVQGVDEAKEELVEIVSCLRGSLNYKKRGARLPTGVLLAGPPGTGKTLLANAVAG

SEQ ID NO: 124797 - protein, 184 aa, Triticum aestivum
  Clone ID: PAT_TA_19215.pep
MLAPLFSRNPSLLFLPAVVRIARGAMSASPAAKATVSVEYAKSGRSSCKGCSAAIAKGALRLGASARDPRGYDSTKWYHVACFPASSLPLGPVEEVQGFDSIKDDDREELRELEKNNKSDQTAVSPLEVPSPKKAKVSPKAEVAEKGSVSVEYAKSARSTCKACNASIAKGALRIGVSAHDPRG

SEQ ID NO: 124798 - protein, 154 aa, Triticum aestivum
  Clone ID: PAT_TA_19216.pep
MNSRVDPELITLVESDPFHGYETETVVAHLTKLNDIATLFTHDEKTRYYFILKLFPFSLKGDAKAWYNTLAPGCVRSPQDMIYYFSEKYFPAHKKQAALQEIFNFVQTKEESLPQAWGRLCQLLNALPDHPLKKNEILDIFYNGLTDASRDFLD

SEQ ID NO: 124799 - protein, 164 aa, Triticum aestivum
  Clone ID: PAT_TA_19217.pep
MSLVRFFDTLALDSWNPFGSIFCTTASSGTDAWLASDTTAFADTYIESRETAEAYVFSARLPAGVTKEEVKVEVEEDGKVLVIAGERCLRREAKSEMRHHVERSSATFFGRFYLPDDAALGQVRASMDDGGAQLTVTVPRVGAPVPVSMPEPAVAIEVVEACPC

SEQ ID NO: 124800 - protein, 165 aa, Triticum aestivum
  Clone ID: PAT_TA_19218.pep
MSLVRFFDTLALDSWNPFGSIFGTTASSGTDAWLASDTTAFADTYIESRETAEAYVFSARLPAGVTKEEVKVEVEEEGKVLVIAGERNLRREAKSETRHHVERSVATFFGRFHLPDDAALGQVRAAMDDGGAQLIVTVPRAGVAVAAVTMPEPAVAIEVGEASPC

SEQ ID NO: 124801 - protein, 165 aa, Triticum aestivum
  Clone ID: PAT_TA_19219.pep
MAAVSKKALVTMAVLALAVLAPPVAGLVPYGVSSGLWDLLDDPFRVLEQTPLAVQRPASAGGPGASIPSAVALARCDWKETPDAHVISLDVPGVRRDDVKVEVEENRVLRVSGERKADEEKEGERWHRAERAAGRFWRRFRMPAGARVDRVTARLEDGVLTVTVP

SEQ ID NO: 124802 - protein, 77 aa, Triticum aestivum
  Clone ID: PAT_TA_19220.pep
IDTSSCRAPIADPDVLSSFRETASRLAHMRLVALTSHHSPAARKAANAGRRLSGCTSTARATCCHARRSGCKPAASP

SEQ ID NO: 124803 - protein, 71 aa, Triticum aestivum
  Clone ID: PAT_TA_19221.pep
GDQQHFVRRDELRAAWEIFTPLLHDIDGGKLRSVPYKPGTRGPQEADELSRRMGYVQTHGYVWVPPTLSKV

SEQ ID NO: 124804 - protein, 145 aa, Triticum aestivum
  Clone ID: PAT_TA_19222.pep
GLLTLLYYVNYSCIQKSWIQQFHFIALYGYLVLLFDFQGLHLSEIIVESEKRGITFDKLLTVPENDSWVYEDGQSASCIAFVLMMYKEAGLFDPITSSVEVTEFTVSAPESLCSNLCPYIGIFVGAKESGGDICFVNACISILII

SEQ ID NO: 124805 - protein, 68 aa, Triticum aestivum
  Clone ID: PAT_TA_19223.pep
KAVDWSENVAPFWPAVIKSALTWKGLTSLLTSGWKTIRGAMVMPLMIQGYKKGLIKFTIITCRKPGAA

SEQ ID NO: 124806 - protein, 321 aa, Triticum aestivum
  Clone ID: PAT_TA_19224.pep
AQWATNLKWAPVLALLLVAAMVGSTSAGNIAVYWGQNGNEGTLADTCNSGLYAYVILAFLTTFGNGQTPVLNLAGHCDPGSGGCTGLSSDIQTCQSQGIKVLLSIGGATGSYGLSSTDDANSVADYLWNSYLGGSDGSTRPLGAAVLDGVDFDIENGQSAHYDDLATALKGKGSVLLSAAPQCPYPDASLGAALQTGQFDNVWIQFYNNPGCAYANGDDTNLVNAWSTWTSSVTAGSFYLGLPASTQAAGSGYIEPGTLTGAVLPPPKGVGLRGGIGVGPRFYVLQTYHRAQGPLSVCPAYLASIATLPYSGGASLLLLSD

SEQ ID NO: 124807 - protein, 40 aa, Triticum aestivum
  Clone ID: PAT_TA_19225.pep
SPKDCSVVLAITSLSIPSVCGRKPQELPLSCQLKISLLGV

SEQ ID NO: 124808 - protein, 161 aa, Triticum aestivum
  Clone ID: PAT_TA_19226.pep
MSDSEEHHFESKADAGASKTYPQQAGTIRKNGHIVIKNRPCKVVEVSTSKTGKHGHAKCHFVAIDIFNGKKLEDIVPSSHNCDVPHVNRTDYQLIDISEDGFVSLLTESGGTNDDLRLPSDEALLTQIKDGFAEGKDLIVTVMSAMGEEQICALKDIGPKN

SEQ ID NO: 124809 - protein, 125 aa, Triticum aestivum
  unsure (1)..(125): unsure at all Xaa locations
  Clone ID: PAT_TA_19227.pep
MAYYSESGYCAEEARRPYAEPGFCHGEGGGERYAVVRKEYEEVXLDELARAGRGHHYGHGHSGSGHQHRHVVHAEHEGSCHGGYLGLGEEHREQHQVHGHGHGGRRLYDACESKRYDSCTGQYYA

SEQ ID NO: 124810 - protein, 122 aa, Triticum aestivum
  unsure (1)..(122): unsure at all Xaa locations
  Clone ID: PAT_TA_19228.pep
MAKTSSFKLEHPLEKRQSEANRIREKYPDRIPVIVEKAERSDIPDIDKKKYLRPCXDLRLGQFVYVVRKRIKLSAEKAIFIFVKNTXLPPTAALMSSIYEENKDEDGFLYMTYSGENTFGLL

SEQ ID NO: 124811 - protein, 241 aa, Triticum aestivum
  Clone ID: PAT_TA_19229.pep
VHEMMLNGVLQVHKPPINFAAYGEGILLTPANRSDACVKYSDVDENGIVHMMLCRVIMGNVEIVHPGSNQHRPSSDHFDSGVDDLKNPQHYIVWDMNMNRHIYSEFVVIVKLPSKTKDSFVSQEECQNSSDLSLVLNSSSPDCISEEMNLEAPPALGGGCAAPMLGDSMEKAPSSPWMPFSMLFAAISTKVSPENMDVVIGCYEEFKGCKKISRGELVKKLRHVVGDRVLISTIMRLQDKV

SEQ ID NO: 124812 - protein, 199 aa, Triticum aestivum
  unsure (1)..(199): unsure at all Xaa locations
  Clone ID: PAT_TA_19230.pep
MSSFSDTPTADGLHSLHAHRASNMYVAGDSITKDDIKVFAAVPSKPGAEFPNAARWYETVSAAVASRFPGXAVGVNLPAGXAPAAPAPADEAEDDDDLDLFGXDETEEDKXKAADERAAAAKASSKKKESGKSSVLMDVKPCDDETDMKKREEAVHMGSLVGSIKACPWCVPDGYDYYNGLSCRQSSTILCHSHLNQDK

SEQ ID NO: 124813 - protein, 193 aa, Triticum aestivum
  Clone ID: PAT_TA_19231.pep
VAYVIIAACYLPVALVGYWAFGNDVDENILITLNRPRWLIAAANMMVVVHVVGSYQVYAMPVFDMIETVLVRKYWFRPGLRLRLISRTVYVALTMFVAITFPFFSELLSFFGGFAYAPTSYFLPCIMWLIIYKPRRFSLSWFTNWICIVIGVLLMVLSPIGGLRQIILKIKTYKFYQDYPSLSQAPSSAKTSF

SEQ ID NO: 124814 - protein, 141 aa, Triticum aestivum
  Clone ID: PAT_TA_19232.pep
MASGSIVKKEVGENHDVLRFGVNNSVKGDLAPQHPIQATVHKEARFWADKKRFGAEAIYGSAFNIRKDLNAQILSKFQRPPGALPSSMLGYEALTGSLDDFGFEDYLNLPQDSDSFHAPDMHHGMEVRLGLSKGPICPSFN

SEQ ID NO: 124815 - protein, 91 aa, Triticum aestivum
  Clone ID: PAT_TA_19233.pep
ARGNELQYCNEVASELKSRGLRVEVCHGERLPKLIRNAETQKVPLMAVVGPKEVQARTLTIRSRHNGEIGTMPVDEFITRLQLAVANKSSL

SEQ ID NO: 124816 - protein, 76 aa, Triticum aestivum
  Clone ID: PAT_TA_19234.pep
FLFFIHRNPTVQFGSAKTILGELIGPEVAYFSSRGPSSLSPSVLKPDIAAPGVNILAAWTPAAAISSAIGSVNFKI

SEQ ID NO: 124817 - protein, 117 aa, Triticum aestivum
  Clone ID: PAT_TA_19235.pep
VSPLDTSEIYHIVEIQLNRVKNRLKQQKIHLQYTTAAVELLGSLGFDPNYGARPVKRVIQQMVENEIALGVLKGDFKEDDTVLVDVSSAAIAKGLAPQKKLVLQRVENRNEELVAND

SEQ ID NO: 124818 - protein, 247 aa, Triticum aestivum
  Clone ID: PAT_TA_19236.pep
SHSGGNSPSSAGIPLLPEKRCGSFPETCGAAGGSAGPEGVPVVTSADNSPAHASIPLPCDSADKPCEAAAGSTAPLEAQICTGFSNSISLEVKKGLQKCATFPPTSGQAKQEDGSCCYADDGLKAAPAYERSVSLPQPTLKLIPAMKGGREKNGIASPTENRHVKWAPDVYDPPVTSVCHSVTNSYQRRSKHRKKEKNKQKKKQKGKSKKNQQSSTQNPSAPHVPDLGLKGVSTTGGQSSVDDLSKH

SEQ ID NO: 124819 - protein, 144 aa, Triticum aestivum
  Clone ID: PAT_TA_19237.pep
EAKDVLVLYSVGIYTDDELGAMVDRMESAKLRTVNLTDNDLAKDHLRYFIGGRSEIKDELVYRFIFPERPGALMKFLDAFSPRWNISLFHYRAQGEAGANVLVGIQVPPAEFDEFKSHAENLGYEYMSEHNNEIYRLLLRDPKV

SEQ ID NO: 124820 - protein, 105 aa, Triticum aestivum
  unsure (1)..(105): unsure at all Xaa locations
  Clone ID: PAT_TA_19238.pep
TYTRSCHFQPEFRPQYXEKHPNTKGVAAVTKAAGEKWRAMSDEEKAQYGGKKPDGESKPAAASKKKESTSSKKAKTDGAEQEGEGSDKSKSDVEDDENDGSGEDE

SEQ ID NO: 124821 - protein, 230 aa, Triticum aestivum
  unsure (1)..(230): unsure at all Xaa locations
  Clone ID: PAT_TA_19239.pep
MKARNLEPALSWAAKNHDQLLQNGSMLEFKLYQLQFVEILSKGSRGEAKDEALLYARTHLVPFAAVHKEEFQKLMACLLWVGXLDQSPYSELMSSAHWEKLAEELTHQFCSLLGQSRESPLSVAVSAGFQGLPTLLKLTQVMAAKKQEWQVMKQLPVPLDLAPVFQPPSVPGRPVLREPPRGAFPPTPLPCGHVVSKQSIMKLSKSSSRPFKCPYCPSEAVASHCKQLHF

SEQ ID NO: 124822 - protein, 106 aa, Triticum aestivum
  Clone ID: PAT_TA_19240.pep
LDDLTSQVNQLKDQNKQLSMALSITSQNLVAVQAQNSVLQTQKMELDSRLGALTEILWYINSSTSPSTAPADPAMVNSFTTWSSASDILGANAWNQQQPIDLYQCF

SEQ ID NO: 124823 - protein, 99 aa, Triticum aestivum
  Clone ID: PAT_TA_19241.pep
NTGEKEILRIIPTCRHNFHLACLDLWLQKQTTCPICRVSLKELQAAMPSARSGPQLPADPENSDNPAPQCFLPARQDRRGQNHSHEARGSVEVVIEIRR

SEQ ID NO: 124824 - protein, 165 aa, Triticum aestivum
  Clone ID: PAT_TA_19242.pep
SPCIRADAPLPPALPPSASLHQCRRPADSPPRPRPPPRRSPPGAAPPPPSPAPAPPPTRRARVSRGRRREAAGEERRPGPARARAGTGRSGAATGRAQGAAAISAPGLGKEQNEVGRPPEDSGGERVTRTRPYSALNGGRGCHLAGGAQPRGDATRPNAAGRGRA

SEQ ID NO: 124825 - protein, 238 aa, Triticum aestivum
  Clone ID: PAT_TA_19243.pep
GRSRPDRSGWGKPETKYTKDGPGEPGGQSWTVEWLKFDNSYFKDMKFLSQLPSEEQKEQDLLVLPTDAALFEDPSFKVYAEKYAEDQEAFFKDYAEAHAKLSDLGSKFDPPEGFSLDDDMSTAPADEKTEEDISFAVAPSPVAPEPEPAAEPTPEPVAAAITTATADDNNGAAPQPEPFVAAKYSYGKRELSESMKQKIRAEYEGFGGSPDKPMQSNYFLNIMILIAGLAFLTSLGGN

SEQ ID NO: 124826 - protein, 154 aa, Triticum aestivum
  unsure (1)..(154): unsure at all Xaa locations
  Clone ID: PAT_TA_19244.pep
MAATSSAALFSVLPLPTASPAYARAGSSHYRPTRSTAALSPIRCSAASPDLSPGAPAPAPPKPQIELEFLGPKPGADGSYPVDRAAAVSGDKLLRDVMVENKIELYAAYGKLMNCGGGXSCGTCIVELSTGRSFNAQKTPEPFLRKTDHVTSKH

SEQ ID NO: 124827 - protein, 187 aa, Triticum aestivum
  Clone ID: PAT_TA_19245.pep
TDASQDGGSKENPENNPDCTTVYVGNLGHEVNRDELHRHFYSLGVGAIEEIRVQQDKGFGFVRYSTHGEAALAIQMGNGLVVRGKPIKCSWGNKPTPPGTTSKPLPPPVAPYQPAVAMPGVPQGFTAAELLAYQRQLALSQAAAGQIAGQHGLAGQVSAGLLAAAGSQGPLRWLPEPSSAQQLMYYN

SEQ ID NO: 124828 - protein, 157 aa, Triticum aestivum
  Clone ID: PAT_TA_19246.pep
HEALIKEKNRSIKCFLMDPPGSGLFNKVTRGVMYTKEEAEGKRLKNPFDTITEGIGINRVTKNFMMAELDGAYRGSDREAVEMSRFLLKNDGLFVGSSSAMNCVGAVRVAQDLGPGHTIVTILCDSGMRHLSKFFNEQYLADHGLTPAATALEFLDK

SEQ ID NO: 124829 - protein, 294 aa, Triticum aestivum
  Clone ID: PAT_TA_19247.pep
FVKLLRSVKRETLKLIETFVDKAEDLPHIGKQFVPPMMDPILADYARNVPDARESEVLSLFATIINKYKGEMLEDVPRIFEAVFQCTLEMITKNFEDYPEHRLKFFSLLRAIGTHCFQALIQLSSQQLKLVIDSINWAFRHTERIIAETGLSLLLEILKNFQASGFQNQFYKTYFLNIEQEIFAVLTDTFHKPGFKLHVLVLQHLFCVVDGLTEPLWDASSVPYQYTDNAMFVRDYTIKLLGSSFPNMTPTEVTKFVDGLLSSKHDLPSFKNHIRDFLVQSKEFSAQDNKDLYA

SEQ ID NO: 124830 - protein, 62 aa, Triticum aestivum
  Clone ID: PAT_TA_19248.pep
GYVKQNIFKLHSFSRTVHSEFFCSLSVNLLFFFISLTCKNLKLLVRLPPSTFLFFLYNERIL

SEQ ID NO: 124831 - protein, 165 aa, Triticum aestivum
  Clone ID: PAT_TA_19249.pep
ARSIPHLFEGKDVMGAAKTGSGKTLAFLIPAIELLYHLRFSSRNGTGVIVVCPTRELAIQTHNVAKELMKYHSQTLGYVIGGNNRRSEADQLAKGVNLLVATPGRLLDHLQNTKSFIYKRLKCLVIDEADRILEQNFGEDMKQIFKRLPQNRQTVLFSATQTPEV

SEQ ID NO: 124832 - protein, 315 aa, Triticum aestivum
  unsure (1)..(315): unsure at all Xaa locations
  Clone ID: PAT_TA_19250.pep
EKDLLQEEQSILWDLNVGLEPLWQELSDCISATEAKFVHNSSLASHAPLMDALEVGASSSGSSSLPPGTQRLLPFIESFFVLCEKLQTNQPVTLSDYSVTAPEVKESAGSSSSPSLKTSGICNVTFIRVAEKHRRLLNVFIRQNPSLLEKSLSMMLKVPRLIDFDNKRAYFRSRIRQQHDQHLSAPLRISVRRAYVLEDSYNQLRLRRTQDLKGRLTVQFQGEEGIDAGGLTREWYQLLSRVIFDKGALLFTTVGNNATFQPNPNSVFQTEHLSYFKFVGRVVAKALFDGQLLDVHFTRSFYXHILGAKVTYHDI

SEQ ID NO: 124833 - protein, 170 aa, Triticum aestivum
  Clone ID: PAT_TA_19251.pep
MKALVASIPDGAGAAFTAMQLQELEQQSRVYQYMAARVPVPTHLVFPVWKSVTGASSEGAQKYPTLMGLATLCLDFGKNPEPEPGRCRRTDGKKWRCWRSTIPNEKYCERHMHRGRKRPVQVVVEDDEPDSASGSKSTPGKATDGAKKADDKSPSSKKLAVAAPAAVQST

SEQ ID NO: 124834 - protein, 234 aa, Triticum aestivum
  unsure (1)..(234): unsure at all Xaa locations
  Clone ID: PAT_TA_19252.pep
MMMNFRDWISYRLGSSLLSARPFAISGSGAGASQGDGEGTTQSEFVETVSANRFPSNDSRALEVVTSNPQDAVSSGLLQPDHDHNKSDPLKQVEALQIKFLRLVHRTGVPPSTNVVAQVLYRLQLANLIKAGESDAKTTNLAINKARVIAAEQEAPGGPDLDLPLRILLLGKTGVGKSATINSMFDETKVATNALXPGTXRIRGFLEXXXGVRVPVRLFCTHTAAENRQAAAAS

SEQ ID NO: 124835 - protein, 74 aa, Triticum aestivum
  Clone ID: PAT_TA_19253.pep
CLFCFLEGRGAVGFHEAPIFHVLAPYDTTNFIHAPFLFFSLFHSYHVRPLLSFFHASTTRIASSSAMPFLGHHQ

SEQ ID NO: 124836 - protein, 213 aa, Triticum aestivum
  Clone ID: PAT_TA_19254.pep
GTRADLNVAIAEKAGEKSNDEVKSQLSHFLPTSRRIMQFSNGQAPSPGARVVYVDGAFDLFHAGHVEFLRSARQLGDFLLVGVYDDQSIRDRRGCRPIMHLHERTLSVLSCRYVDEVIIGAPWEVSKDMITTFNISLVVHGTVAEGNSAGEIDPYAVPKSMGIFQTIRSPKSITTLSVATRIVDNHEAYKKRNLKKKASEDRYYTQKKFVSGD

SEQ ID NO: 124837 - protein, 126 aa, Triticum aestivum
  unsure (1)..(126): unsure at all Xaa locations
  Clone ID: PAT_TA_19255.pep
TSASATFLPFLXECFVCAFGGLLLLAGLGMLCWIDQDDGRHSFGHSGGFICPFVPLLPVMCILINTYLLINLGGGPGVRVAVWLGMGVFVYIFYGRTHSSLTDVVYVPVAEANEIYGSPSSSGFVA

SEQ ID NO: 124838 - protein, 148 aa, Triticum aestivum
  unsure (1)..(148): unsure at all Xaa locations
  Clone ID: PAT_TA_19256.pep
MATLTVPSSVPAVAEDAEQLHKAFEGWGTNEKLIISILAHRNAAQRRAIRRAYAEAYGKELLRALGDEIHGKFERAVILWTLDPAERDAVLANEEAKKCHPGGRALVEIQGARAPAQLFAVKQAYHDRFKRSLXXDVAAHVNGDFRKL

SEQ ID NO: 124839 - protein, 239 aa, Triticum aestivum
  Clone ID: PAT_TA_19257.pep
TRPAPPAFYGAYYDRAEQALPARDELRTLFIAGLPADAKPREVYNLFRDFPGYVSSHLRTGKSSQAYAFAVFADQQSALTALSGTNGMVFDLEKNCSLHVDLAKSNSRSKRLRSDDTSPYSPEKRTRKPRGFPDSGAGSNIYISGMGSSSHSLSGYPSAQSYTSLESSASLSKDPSTFAPQINPPCPTLFVANLGPACSEQELIDVFSSCAGFVKLKMQNKLGAPGAFVDFRDSIRSTE

SEQ ID NO: 124840 - protein, 197 aa, Triticum aestivum
  Clone ID: PAT_TA_19258.pep
RLKFGNPVVPVKGAVVVMPADVDALVTVVVVAVAAAADDDDGATAKLKLLVEEAAGNSDPDVAEAAAADGTVEAPVADMEAKVGVEAAEDEPKENPGVVADELPAALVLENNEGAGAACEVAEEKPVEGEDDGVVTVVVDVLLAKAKAGLEEADENKEGAVFAVVALPAGGVKPNDGAEAVVAGEEENPKDGVVVAL

SEQ ID NO: 124841 - protein, 217 aa, Triticum aestivum
  unsure (1)..(217): unsure at all Xaa locations
  Clone ID: PAT_TA_19259.pep
DHVHRSIKYNVWASTASGNRKLDSAYRAAREKEEHCPICGFFSVNGSGQFCGVAEMIGPVDFDRSVDYWQQDKWSGQFPVKWHIIKDVPNNLLRHIILENNDNKPVTNSRDTQEVKLEQGLQXMLTIFKSHEAETTILEDFDFYEQREKALQENRRQQQPASTDPQKLVDTKAQGPVADISDAFAKAVQLKDTENSGTTPTAEGASAENGSAATAKG

SEQ ID NO: 124842 - protein, 34 aa, Triticum aestivum
  Clone ID: PAT_TA_19260.pep
FFFPTFFKVLDKIIKNKLKGKNIIPKFINELGEN

SEQ ID NO: 124843 - protein, 48 aa, Triticum aestivum
  Clone ID: PAT_TA_19261.pep
DFYSYFILISNSFLYKSNLDLSNIFFISFIFIIVYQTLVCHVLHTLIS

SEQ ID NO: 124844 - protein, 170 aa, Triticum aestivum
  Clone ID: PAT_TA_19262.pep
RHEVTVALSDIVVLRNLLKPLHNLHDASSLCKYLESFYTLRKPVASTINTLAGALYKVFSASPDQARNEMRQACFDYLSLGGVFSNGPIALLSGLNPRPLSLVAHFFAVAIYGVGRLMLPLPSPKRMWIGARLISGACGIILPIIKAEGVRQMFFPATVPAYYRAAPMGE

SEQ ID NO: 124845 - protein, 210 aa, Triticum aestivum
  unsure (1)..(210): unsure at all Xaa locations
  Clone ID: PAT_TA_19263.pep
MAECPAEKFIRSILGDVRESEGLVAIRSSPERSSAQPGLSGHHLRGNSFGPPGEPHGGAVVADQNGWGALPPGGLRHVRLGPHEGGSTWPARTVPPACAAVCSAWREICKDIVQEPGXCGETHFPVSLKQPGPPRXGLIQCFIKKGQTTLTYYLYLCLSPAVLNGERKXLLTXKRNRRTTYTETISVGFQRISPSNNGMLENPIPPDELS

SEQ ID NO: 124846 - protein, 136 aa, Triticum aestivum
  Clone ID: PAT_TA_19264.pep
GTRLGSVKGLHVGLNLAVAIALHNIPEGVAVALPICFPTFRGLLASVVAPASGLARPLGVVAVACLVPCSPTPDPRVGRLGAGGGVMAFLTLHEMLPLAFDYCGQKQAVKAVFVGMPCMSASLYFLEVSLPKEISL

SEQ ID NO: 124847 - protein, 206 aa, Triticum aestivum
  unsure (1)..(206): unsure at all Xaa locations
  Clone ID: PAT_TA_19265.pep
MANPRVFFDMTVGGAPAGRIVMELYANEVPKTAENFRALCTGEKGVGKSGKPLHYKGSTFHRVIPEFMCQGGDFTRGNGTGGESIYGEKFPDEKFVRKHTAPGVLSXMANAGPNTNGSQFFICTVAXPWLDGKHSSSASRRGMDVSRHRKGGTAHLTQSGQGLPRYLPPAALRPWPRPRSFPVSHCVLGGVVHSPCVPPRGRSASI

SEQ ID NO: 124848 - protein, 148 aa, Triticum aestivum
  unsure (1)..(148): unsure at all Xaa locations
  Clone ID: PAT_TA_19266.pep
MSAASKKLFQAASSPALPASLRAVLAAEGRTAALATLTNFGRKALPTAYFSYHRQGSHHAASGWGAIAAAVPAAVYMLQDQEAHAAEMERTFIAISPAGVQRGLISEIMSRFERKXYKLVAIKLIVPSKEXAEKHYHDLKERLSQWVV

SEQ ID NO: 124849 - protein, 61 aa, Triticum aestivum
  Clone ID: PAT_TA_19267.pep
LASEGLNEIDFKLLTAQTRACIYVCCCNLFPVRVGRLPSFLFGSLWSFGFLFSATLLTCGT

SEQ ID NO: 124850 - protein, 58 aa, Triticum aestivum
  Clone ID: PAT_TA_19268.pep
IKLGHHLLLLRPLRKYVAGVAVLDKRVHPRDVWLGGGGHGRRGLPAERERRRLAELVQ

SEQ ID NO: 124851 - protein, 100 aa, Triticum aestivum
  Clone ID: PAT_TA_19269.pep
VFAAPLPPSLFKHSNFSSFVRQLNTYLDGTRYWMKYQDQIGFRKVDPDRWEFANEGFLRGQRHLLKMIKRRKPPSAVPPLRQQQAPASAGGGSWIRKDDS

SEQ ID NO: 124852 - protein, 103 aa, Triticum aestivum
  Clone ID: PAT_TA_19270.pep
PPKLCHRCRSEKSHQRSPLQAKGRLLQPWLTGCLVAPTGSTFTERYKHYYTCHSSIVYSHPKKMCLTALPAIYSLLVPKEMDRTSCLLFSLPKDILYQLTLVL

SEQ ID NO: 124853 - protein, 263 aa, Triticum aestivum
  unsure (1)..(263): unsure at all Xaa locations
  Clone ID: PAT_TA_19271.pep
MAPKRGGRAPVPAKKKTDKVTNPLFEKRPKQFGIGGALPPKKDLHRFVKWPKVVRIQRQRRILKXRLKVPPALNQFNRTLDKNLATNLFKILLXKYRPEDRLPKRARAGSGPKPVEXKKPIVEKYGLNXVTYLIEPNXAQLVVIAHHADPIELVVWLPALRGKMVGPFCIVRGNPRLGSIGHKTNAPVLCLTTVKNEDKLEFSKILEAIKGXTFNDNFDEVRKXWGGGIMGSSRRQDKARENSPKEAAQDDLDVIVYCRVACR

SEQ ID NO: 124854 - protein, 201 aa, Triticum aestivum
  Clone ID: PAT_TA_19272.pep
HEAAVSEVVKRGVAHPDKIAVGGHSYGAFMTANLLAHAPHLFSCGIARSGAYNRTLTPFGFQNEDRTLWEATSTYVEMSPFMSANKIKKPILLIHGEQDNNSGTLTMQSDRFFNALKGHGALSRLVILPFESHGYSARESIMHVLWETDRWLQNYCVNGTSKVDSVSEADSENKTLSASGGSAAREGLNPEELSSLPRSLL

SEQ ID NO: 124855 - protein, 90 aa, Triticum aestivum
  Clone ID: PAT_TA_19273.pep
TKKEDHKTMSRHGNSSVKQNLIVLIVQRSTEKTRPLRAAFEKLSIESMRLLAQVDTSLHGRSTGTESAAATTAKARSATPKSWLELRWSL

SEQ ID NO: 124856 - protein, 213 aa, Triticum aestivum
  Clone ID: PAT_TA_19274.pep
NESAPRDPSDAYPVDYFSKREYPSGSPMFTSNAPSAPYERYAAATRFPTRELPSAFGPGVDHMSHRSYRDHVPADSYSSRGTQQLGITRDGNSDAYDYTETAGQIHGREDYRGLTSATGKFLNTIELRIPNSSLESIVGVGGVNLAEIRQISGARLRLHEAHAGSSESLVEIQGTLEQAKAAQSLLQGFISANSRSMQQQPQSSRMPLYPSWG

SEQ ID NO: 124857 - protein, 177 aa, Triticum aestivum
  unsure (1)..(177): unsure at all Xaa locations
  Clone ID: PAT_TA_19275.pep
RATWKGMLMNRLSVSDVSPLCAIRGLGPWGPGLVQRYTSARFGTRSTGDLLTDQESALLTDYMYHTLAAKASXELCLKYIFSFGAFARKPLLQCASDWKVPTTFIYGQQVWMNYQAPRQARKDMKVPCEIIRVPQSGHFVFIDNPSGFHSAVFYACRNLLSQNGEEGFTFPDGLISA

SEQ ID NO: 124858 - protein, 82 aa, Triticum aestivum
  unsure (1)..(82): unsure at all Xaa locations
  Clone ID: PAT_TA_19276.pep
INDNLHIKDXLEMLGTATTEHIVSSVDETSPERSQDGMAGYHPGSVNPLEQLGLFIKADDEEDDEEPSSVPSIKEPEEGEIN

SEQ ID NO: 124859 - protein, 120 aa, Triticum aestivum
  Clone ID: PAT_TA_19277.pep
DTQHWIKDMKYSTRVKDEEGYPAIVLVNKATGEALKHSLGQSHPVPLTRYDPDKLDESVLWTESRDVGDGFRCIRMVNNIYLNFDALHGDKDHGGVHDGTTLVLWEWCEGDNQRWKIVPW

SEQ ID NO: 124860 - protein, 101 aa, Triticum aestivum
  Clone ID: PAT_TA_19278.pep
MAHHFLGSKHHGGEASKVTDWRKEEKHHKHMEQLGQLGAVAAGAYAVHEKHKAKKDPEHAHSHKIKEGVAAAVAVGSAGFAFHEHHQKKDAKKHRRHGHHH

SEQ ID NO: 124861 - protein, 157 aa, Triticum aestivum
  Clone ID: PAT_TA_19279.pep
LDGKRIKLQIWDTAGQERFRSLTTAYYRGAMGILLVYDVTDESSFNNIRNWIRNIEQHASDNVNKILVGNKADMDESKRAVPTAKGQALADEYGIKFFETSAKTNLNVEQVFFSIARDIKQRLAETDSKPEDKAIKINKPDQGSEAPAAQRSACCGS

SEQ ID NO: 124862 - protein, 160 aa, Triticum aestivum
  Clone ID: PAT_TA_19280.pep
CCNSCEEVLPAYKKKGWALTNPDLIDQCAREDFVERVKTQQDEGCNVHGFLDVSKVAGNFHFAPGKGFYESNIDVPELSVLEGGFNITHKINKLSFGTEFPGVVNPLDGAQWIQPASDGTYQYFIKVVPTIYTDIRGHNIHSNQFSVTEHFRDGNILPKP

SEQ ID NO: 124863 - protein, 83 aa, Triticum aestivum
  Clone ID: PAT_TA_19281.pep
HRHCHRMFSTQVERLYSSRAPQIMYCFHQELLFRGKTNLRRTEVDLGAVLSVAAVVTSLQCVGTKPMWRRGRRWFRRGMVAGR

SEQ ID NO: 124864 - protein, 174 aa, Triticum aestivum
  Clone ID: PAT_TA_19282.pep
MKEGRGVRMVTGNGENSYAANSRLQEKAILETSPVLHKAIEELCKSLSARRSTMVVADLGCSSGPNTLRVVCEVIGAVQFYTRKSEEERRAVEVQFFLNDLPGNDFNIVFRSLEELEDLGGRETQPYYVAGLPGSYYRKLFPFRSVHLFHSSYSLMWRSKVCMHHIVCNVIIMS

SEQ ID NO: 124865 - protein, 122 aa, Triticum aestivum
  Clone ID: PAT_TA_19283.pep
YLFICCCGDDDGGGGGDLLLLFYFYFLAATFVVVLAAVVFFAGSAVFFAGSDVFLVVFFATFGLDAFNAINALTRLSRVLNDFIAGAFFGNSIPRFLAIAISRACCLFCAFKIAALFVTAAL

SEQ ID NO: 124866 - protein, 149 aa, Triticum aestivum
  Clone ID: PAT_TA_19284.pep
DAVDRLKTGFDQFKTEVYDKKPELFEPLKAGQAPRDMVFACADSRVCPSVTLGLLPGEAFTVRNIAALVPAYDKTKYTGIGSAIEYAVCALKVQVLVVIGHSCCGGIRALLSLQDGAPDTFHFVEDWVRIGFPAKIKVKKEHASVPFDD

SEQ ID NO: 124867 - protein, 69 aa, Triticum aestivum
  Clone ID: PAT_TA_19285.pep
RIGYRAPPSCISLFKDIINRHTANIAICLHQVDYSYVFEQFHWNLHLMGFTFEVGFKYQIHIFFLCQGL

SEQ ID NO: 124868 - protein, 122 aa, Triticum aestivum
  Clone ID: PAT_TA_19286.pep
RRTLRDKHAKNEVLHEEEEKPVRRRGRPRKVRDVPDVPDLRSGRDVRGKKLFRDDGHNSSGEESISASDHQGHGEDDDSDGDADQPLINTIRSSAAKLRSLKIAQQGTSSHKGVSGPSGSNS

SEQ ID NO: 124869 - protein, 168 aa, Triticum aestivum
  Clone ID: PAT_TA_19287.pep
TRPLITFHGIDNYKTIFWALRFHGRLLFREIGLDVSRIWQLTETSIVVRWELWGTPRVPWESYGCFSGTSRYKVDRNGKIYEHKVDNLALDFPRSVAKVGSIADMVVATPSPNLTFWNVVGPGDGCSWTKLYEAVVEAVEREEHGSTGIGVGGLPVPCSFGCGCGCSF

SEQ ID NO: 124870 - protein, 238 aa, Triticum aestivum
  Clone ID: PAT_TA_19288.pep
AITSLPECETLVALQHLNLSHTRIRILPERLWLLKELRHLDLSVTAELEDTLNNCSKLLKLRVLNLFRSHYGISDVNDLNLDSLNALIFLGITIYAEDVLKKLNKTSPLAKSTYRLNLKYCRKMHSLKISDLNHLVHLEELYVESCYNLSTLVADADAELTTSGLEVLTLSVLPVLENVIVAPMPHHFRRIRKLAISSCPKLKNITWVLKLEMLERLVITSCDGLLKVVEEDSGDEAE

SEQ ID NO: 124871 - protein, 208 aa, Triticum aestivum
  Clone ID: PAT_TA_19289.pep
ARGLIQVYEGERARTKDNNLLGKFELSGIPPAPRGVPQITVTFDIDANGILNVSAEDKTTGQKNKITITNDKGRLSKEEIEKMVQEAEKYKAEDEEVKKKVDAKNTLENYAYNMRNTIKDDKIASKLPAEDKKKIEDAVDSAISWLDSNQLAEVDEFEDKMKELEGICNPIIAKMYQGAGAGMGDAAGMDEDAPSGGSGAGPKIEEVD

SEQ ID NO: 124872 - protein, 231 aa, Triticum aestivum
  Clone ID: PAT_TA_19290.pep
MTVAPEEPVQPPPVPPPHVEEPVGEPVKKTYASILKTAKAPPAFPVAQQVPVSKPSHPTTESIQTQHSVMASSTGAEKPRSDVYGEGAAHDDEESKSVYVGNVPANVNEADLESEFKKFGRLIPDGVAIRSRKETGGYYAFVEFEELSGVHNALKASPIEINGRQIYVEERKPNSGIRGGRRGGRGRFSGGGRGYARGGGDEYNGNRSRSNGYGRVPHQERGILGSHTARN

SEQ ID NO: 124873 - protein, 254 aa, Triticum aestivum
  Clone ID: PAT_TA_19291.pep
GREGPVLYLDLTSYQLHDLSEVEIPPTLEEVDLTANRLSSVDPRIGQLPRLRKLSFRQNLLEDDAVAPLSSWETIAGLQELVLRDNKLTRIPDAGIFKGLLGFDVSFNEISSLTGMSKVSSKLKELYGSQNELAKMEELEHLHALEILELGSNRLRVMENLETLTNLQELWLGRNRIRAVNLCGLKLIKKISLQSNRLTSMDGFQECTALEELYLSHNGIQKMEGLSTLQNLRILDVSSNKLTTIENIETLTRL

SEQ ID NO: 124874 - protein, 467 aa, Triticum aestivum
  Clone ID: PAT_TA_19292.pep
MEQLRTIGRELAMGSQGGWGQSKEFLDLVKSIGEARSKAEEDRIISRELEHLKRRLADPDVPRRKMKELLLRLVYAEMLGHDASFGHIHAVKMTHDESLPLKRTGYLAVALFIDERHDLVILVVNTIQKDLRSDNYLVVCAALTAASRLIGEEAIPAVLPQVVDLLAHPKEAVRKKAVMALHRFYQRSPSSVSHLVSNFRKRLCDNDPGVMGATLCPLYDLILEDPNAYKDLVVSFVNILKQVAERRLPTSYDYHQMPAPFIQIKLLKILAVLGSGDKSASGHMYTVLGDIFRKGDTASNIGNAILYECICCVSCIFPNSKMLDAAAETTSKFLKSDSHNLKYMGIDALGRLIKINPDIAEQHQLAVIDCLEDPDDTLKRKTFELLYKMTKSTNVEVIVDRMIEYMISITDHHYKAEIASRCVELAEQFAPSNQWFIQTMNKVFEHAGDLVNIRVAHNLMRLIAEGF

SEQ ID NO: 124875 - protein, 266 aa, Triticum aestivum
  Clone ID: PAT_TA_19293.pep
MALFAAARRAASSSVPVLLRASASSGSHRSAVLLRPLAAAVAPPKPRAMPFSSAPATRPSSDAELLSVIDSEIKYAEDCDDHDRVEEIPENFPFKISDEKGTNVVTLKRTYQGEQIEVVAHMPSLVTGDEPDHDRDGEDEGEDKEGDDDAEDEGQKPEQSSVPLTVTITKGDGPVLEFTCTAYPDEVLIDTLSVTQPSGDDEHDMIAYEGPDFNDLDENLQRAFHKYLELRGISPMTTNFLHEYMINKDSREYLLWLRKLKDYFKQ

SEQ ID NO: 124876 - protein, 97 aa, Triticum aestivum
  Clone ID: PAT_TA_19294.pep
FLRVTPTLPNTFINLASPIVDVPYHTFLLGTLIGLIPAAYVTVRAGIALGELTSLSDLYDTQSIALLFLIGVVSVTPALLGKDEAQEKPSEMVVGAS

SEQ ID NO: 124877 - protein, 154 aa, Triticum aestivum
  Clone ID: PAT_TA_19295.pep
MINLFKIKGQKKEEAASAAGKAPVKKQSAGELRLHKDISELNLPKTTSISFPNGKDDLMNFETTIRPDEGYYMGGTFVFTFQVSPSYPHDPPKVKCKTKVYHPNIDWGRYAGLCRLRGGCKPVRYFAALIYGLNLLFTQSNDEDPLNHEAAVVL

SEQ ID NO: 124878 - protein, 138 aa, Triticum aestivum
  Clone ID: PAT_TA_19296.pep
DLHPEMMESETPPHASPPHEAGDPEVSSQRISPDPPRPEGNPSASRSPKYSAPKGSSRKSLELSGARPDVLMSLLEQAAISEAHRTLMGMVVERISSAESGLHEAFMSLLRGFEVHKVIYIFLTVPHMLGVPYTDSSP

SEQ ID NO: 124879 - protein, 67 aa, Triticum aestivum
  Clone ID: PAT_TA_19297.pep
ILKNFCSFLLTAFRYFIFIFIMILKRGHSLLILLSRPGGGMLGQECRVSKTKCFYLSGHLEHMEGAR

SEQ ID NO: 124880 - protein, 275 aa, Triticum aestivum
  Clone ID: PAT_TA_19298.pep
MLMLHETVPFVRPSSCRDLKLSEKSASAFHCKLGCSAVCSSAEGHHVQKPHIVHSHKVNFTRTSHLLCKSLNKRTTRHWLHRFHVNASPDDEFRSSRNIAISLFKRYKKIIDRGGGGENLKEFVSAGVTAYALGCTDEGLRKELMDLEDSGLEIEGLGSLGGTSSKFKVHSFEIRECIMWLSIVFITILCTPQLTVTRWSTNPPVSADVLHQWKGFCAIIANAYYVKGMAWLPVKTLQLEQMAVTGNSEEPSVVASRMQLVFSTLEVVSPQWPRV

SEQ ID NO: 124881 - protein, 239 aa, Triticum aestivum
  unsure (1)..(239): unsure at all Xaa locations
  Clone ID: PAT_TA_19299.pep
ERNCQNSPRNLRRERSYSRSPSPRRGRGRSRSYSRSRSYSRSRSPSGSPRGGRRDRDERRSRSLSYSRSASPRRSVSPGRRXKERSRTPDGSRSPRSPSPRDDVSPPPKXDNGAHNGPDRVDSPXGXREISKRTRPPSGGLPRPAAGAPRPCPSPDPTPGPTRPPGDHGRPRSPRGRRSPRPVTLPTIPGRSAPLRGHLLFFQFESANWICAFPGLAPFTLENLCKNLLPSGYAWFVIW

SEQ ID NO: 124882 - protein, 65 aa, Triticum aestivum
  Clone ID: PAT_TA_19300.pep
VALDMRAPPFHHLSAGQKGDSSDRLTAETNLYTRSLNGIAATAAGVAATTHRKVGVVPFGMSSMY

SEQ ID NO: 124883 - protein, 109 aa, Triticum aestivum
  Clone ID: PAT_TA_19301.pep
GFVQFVTRPSAEQALLMLQGALIGAQNVRLSWGRSLSNKQAQPQQESNQWGAAAAAGAGGYYGGYGQGYEAYGSGYAQPQDPNMYGYGAYAGYPNYQQQQAAQQPQQQQ

SEQ ID NO: 124884 - protein, 118 aa, Triticum aestivum
  Clone ID: PAT_TA_19302.pep
MELQARCLCVVAMLLVAGLAGLETAHGAGECGRVPVDQVALKLAPCAAATQNPRAAVPPSCCAQVRAIGRSPKCLCAVMLSDTARKARGKPAVAMTIPKRCAIANRPVGYKCGPYTLP

SEQ ID NO: 124885 - protein, 57 aa, Triticum aestivum
  Clone ID: PAT_TA_19303.pep
KWSEYKVIGEPTKQVQMVTTYLDKIAGKKTSNLSSFLVGLLDESTRCSEGSFRLLFN

SEQ ID NO: 124886 - protein, 208 aa, Triticum aestivum
  Clone ID: PAT_TA_19304.pep
EAVIINVESLREQLVAEISRVLKAGGRVLVQSPALSSSQKPNTDIERKLLMGGFAEVQSSAADAQDSVQSVTVKAKKASWSMGSSFPLKKATRALPKIQIDDDSDLIDEDSLLTEEDLKKPQLPVVGDCEVGAAKKACKNCTCGRAEAEEKVGKLELTAEQINNPQSACGSCGLGDAFRCGTCPYRGLPPFKPGEKVSLSGNFLAADI

SEQ ID NO: 124887 - protein, 177 aa, Triticum aestivum
  Clone ID: PAT_TA_19305.pep
RGGFGVNGQAGEVISLFRSMEEDGVVPNEVTFLAVLNACSHGGLVSEGKKFMESMVLQYGIFPNTEHYGCIIDLLGRAGRLDEAYELIASLSSQSDATAWRALLAACRVHGNANLGRMVQARLDNMDDYHPSDAILLSNTYALESRWDEIAHVRDSEDQKIVKDKKEPGCSSIEVSW

SEQ ID NO: 124888 - protein, 57 aa, Triticum aestivum
  Clone ID: PAT_TA_19306.pep
TRLLVFLTYSLSLIFLLLFSCTHVSCLIHTLICLQWSFDLASCMYCFPDILIFFGTG

SEQ ID NO: 124889 - protein, 266 aa, Triticum aestivum
  Clone ID: PAT_TA_19307.pep
ARAIVDSNTDLHVTMKRLAVGKWGCNNGQACIAPDYVITTKSFAPELVDSLKRVLKRFYGEDPLQSEDLSRIVNSNHFRRLTNLIEDKKVAQKIVYGGQTDEKQLKIAPTVLLDVPLDTTLMAEEIFGPLLPIVTVDKIEDSIQFINSRTKPLAAYLFTKDKKLQEEFVSNVPAGGMLVNDVALHLANPHLPFGGVGDSGIGSYHGKFSFDCFTHKKAVLIRGFGGEATARYPPYTIEKQKILRGLINGSFFALILALLGFPKERR

SEQ ID NO: 124890 - protein, 83 aa, Triticum aestivum
  Clone ID: PAT_TA_19308.pep
EMLGTTDENQPLQAMMKDQFGNYVVQKVLETCDDQQRELILSRGGVHLNALKKYTYGKHIVARVEKLVAAGERRIALQPQNPS

SEQ ID NO: 124891 - protein, 252 aa, Triticum aestivum
  unsure (1)..(252): unsure at all Xaa locations
  Clone ID: PAT_TA_19309.pep
VKKKTDLPVREKIFLLLDATQTSLGGAKAKFPQYYEAYYELVSAGVQFSNRPNVLVTRAEVPVPEPRTEPNNESLATRLTEAQQEVHTQPAPDASIVQKASSVMEVLRDVLNSMDPRHPEGATDEFVLDLVEQCTFQXKQRIMHLVMTSRDETXVSQAIELNEELHKVLVRHDALLSVHPTTAVPSNIKEEEEEEDPESLRRARREGLPRPQVLALVPLPSFRARPVDHLRRPRAIQSPHPDKRLGALNIRS

SEQ ID NO: 124892 - protein, 157 aa, Triticum aestivum
  unsure (1)..(157): unsure at all Xaa locations
  Clone ID: PAT_TA_19310.pep
GHNGFPVVDEPPLSEAPELVGLVLRSHLLVLLKGKGFMKEKMKTSGSFVLQRFGAFDFAKPGSGKGLKIEDLDFTDEEMDLYVDLHPITNTSPYTVVETMSLAKAAVLFRALGTQGTCSVVPKTPGETXPLLXILTRHDFMPEHIHGXLFPNIHKSH

SEQ ID NO: 124893 - protein, 77 aa, Triticum aestivum
  Clone ID: PAT_TA_19311.pep
MAEIEIKTAPADFRFPTTNQTRHCFTRYVEYHRCVNAKGDDAGDCEKFAKYYRSLCPGEWVEKWNEQRESGTFPGPL

SEQ ID NO: 124894 - protein, 81 aa, Triticum aestivum
  Clone ID: PAT_TA_19312.pep
RFVIEAGQHTKPKGYPIASFPPPPNHHRYNNIIIALFFSSPPSSLPPMTFLFFSFFLANAFLPPPPQGHGWYNCQEQRDNE

SEQ ID NO: 124895 - protein, 64 aa, Triticum aestivum
  Clone ID: PAT_TA_19313.pep
MENNGNRQQAPPPPPGYPTAAAGAEEQGGRKGRRGKTTSRGEKGFIEGCIAALCCCWICEMCCD

SEQ ID NO: 124896 - protein, 124 aa, Triticum aestivum
  Clone ID: PAT_TA_19314.pep
MASTLTNVGLSTPAAAASSLVRPVAGAGRVVFPRVGRGGFAAVRASGPATPPDISDKMSESIDKAKEACAEDTASGKCAAAWDEVEELSAAASHARDKLKETSDPLEAYCKDNPETDECRTYDN

SEQ ID NO: 124897 - protein, 214 aa, Triticum aestivum
  unsure (1)..(214): unsure at all Xaa locations
  Clone ID: PAT_TA_19315.pep
MAAVEVCVKAAAGKPDTLGDCPVSQRVLLTLEEKKVPYEVKLVDLGNKPEWFLEINPXGKVPVLKGDDGKCIADSDVITQVIEEKFPTPSLVTPPEYASVGSKIFPAFVKFLKSKDASDGSEKALLDELQALDEHLKAHGPYINGARAAAADLSLAPKLFHLQVALEHFKGWKIPENLTNVHAYAKALFSRESFVKTKPSEEHVIAGWAPKVNA

SEQ ID NO: 124898 - protein, 144 aa, Triticum aestivum
  unsure (1)..(144): unsure at all Xaa locations
  Clone ID: PAT_TA_19316.pep
MIMSDPAMLPPGFRFHPTDEELILHYLRNRAAESPCPVSIIADVDIYKFDPWALPSKASYGDREWYFFTPRDRKYPNGVRPNRAAGSGYWEATGTXDKPIRCSATAESVGVKKALXFTRPPPRHQDNWIMXEYAGARRDAHTTP

SEQ ID NO: 124899 - protein, 155 aa, Triticum aestivum
  unsure (1)..(155): unsure at all Xaa locations
  Clone ID: PAT_TA_19317.pep
WHYSEEGVDLVVKDPNGGQVRDSRDKTSDKFEFIVQKRGVHRFCFTXTKSPYHETIDFDVHVGHFSYFEQHAKDEHFAPLFEQIGKLDEALYNIQFEQHWXLEAQTDRQAILNENMSRRAVHKALFESAALIAASVIQVYLLRRLFERKLGTSRV

SEQ ID NO: 124900 - protein, 156 aa, Triticum aestivum
  unsure (1)..(156): unsure at all Xaa locations
  Clone ID: PAT_TA_19318.pep
MGQGLSQPAQAVEEPSPPAVEAAPSSSPSPAPAPSSLEALAAEAMSFDEDGNEXLCIQSIDVKVQKALDCPCVAELKNGPCGSQFVDAFSCFLKSTEEEKGSDCVKPFIALQDCIKINPEAFSKEILEEEENDEEAEKSNLKVRAPAWSRESKPKL

SEQ ID NO: 124901 - protein, 119 aa, Triticum aestivum
  Clone ID: PAT_TA_19319.pep
MVQRLTYRKRHSYATKSNQTRVVKTPGGKLVYQYTKKRASGPKCPVTGKKIQGIPHLRPAEYKRSRLSRNRRTVNRPYGGVLSGIAVRERIIRAFLVEEQKIVKKVLKIQKTKDKTAAK

SEQ ID NO: 124902 - protein, 129 aa, Triticum aestivum
  Clone ID: PAT_TA_19320.pep
MEKYHSNSRFAPFRDAPFALRGALGSSGSSFSSIDSLRRSSTLEQARGYTSRPLGAVRPKMLPSGCRPLHTSHPLSAPVANRPLSPHLPLKKPQLSATFSISHRIFGAALGAAIISIPLATKFSLMFDV

SEQ ID NO: 124903 - protein, 235 aa, Triticum aestivum
  Clone ID: PAT_TA_19321.pep
LGKSSPSALRAAVLVVPALAGPLFGAGLSAKHELQEMIQYPVEYPDKFLKFGMTPSRGVLFYGPPGCGKTLLAKAIANECQANFISIKGPELLTMWFGESEANVRDVFDKARAAAPCVLFFDELDSIAKARGGSVGDAGGAADRVINQILTEMDGMGSKKNVFIIGATNRPDIIDPAILRPGRLDQLIYIPLPDEKSRESILKANLRKSPIAKDVDLTYVAKVTHGFSGADLTEI

SEQ ID NO: 124904 - protein, 119 aa, Triticum aestivum
  Clone ID: PAT_TA_19322.pep
IVFTTNHVGKLDPALIRTGRMDKKVEMSYCDYESFKFLARMHLRDDDVVEAHEAQCRRVRALLEEVNMVPVDVGEHLTPRSPGEFEDAGPCLDRLVTALEKAKEEEGARLPPTGATGTT

SEQ ID NO: 124905 - protein, 279 aa, Triticum aestivum
  unsure (1)..(279): unsure at all Xaa locations
  Clone ID: PAT_TA_19323.pep
TEAIMYPEINALVDELHRRHISTFLVTNAQFPEKIKALKPITQLYVSVDAATKESLKAVDRPLFSDFWERFLDSLKSLHEKDQRTVYRLTLVKGWNAEEIDAYAKLLDLGQPDFIEIKGGVTYCGSSATSKLTMENVPWHADVKEFSEVLASKSGGIYELACEHVHSCCVLLAKVDKFKINGKWHTWIDYDRFNELVTSGKPFKSSDYMAVTPSWAVXAADARGLDPLQARRMDARRPACLLPPQVDPSHDASPTRRWLGSGCFPLLSVMSNGIPRGEN

SEQ ID NO: 124906 - protein, 150 aa, Triticum aestivum
  unsure (1)..(150): unsure at all Xaa locations
  Clone ID: PAT_TA_19324.pep
MADQLTDDQIAEFKEAFSLFDKDGDGCITTKELGTVMRSLGQNPTEAELQDMINEVDADGNGTIDFPEFLNLMARKMKDTDSEEELKEAFRVFDKDQNGFISGRXELRHVMTNLGEKLTDEEXDEISVEADVDGDGQFNYEXFVKVMMAK

SEQ ID NO: 124907 - protein, 112 aa, Triticum aestivum
  Clone ID: PAT_TA_19325.pep
MSPVPSPHQSQLLGHESRKEKRMRKVDTFAPHNDGHQWRKYGEKKINNCNFPRYYYRCTYKDNMNCPATKQIQQKDHSDPPLYQVTYYNEHSCNSAFLALTPTEFQLQTASG

SEQ ID NO: 124908 - protein, 165 aa, Triticum aestivum
  Clone ID: PAT_TA_19326.pep
MASEHAAAGEGKHEKQSLMDKAKEFVADKIAHIPKPEATLDAVTFKGLSRECITLHSSVNVSNPYDHRLPICEVTYTLRCAGREVASGTMPDPGWIAASGTTSLEIPAKVPYDFIVSIVRDVGRDWDLDYELQVGLTVDLPIVGNFTIPLSTSGEFKLPTLKDLF

SEQ ID NO: 124909 - protein, 73 aa, Triticum aestivum
  Clone ID: PAT_TA_19327.pep
YRDLVNFVESSYKANRWMHLSHVRIEKSTSTYYYCKNFCKLKLANKIFLNKLVSLYHSDGHSSGLSLLKKKKK

SEQ ID NO: 124910 - protein, 145 aa, Triticum aestivum
  Clone ID: PAT_TA_19328.pep
SLKLVAFRSAMALRSLLLLRIQGVVLPSTKGPRTGLLSGLSPAAATTRFMGTKSQCEHRFPTTIAEAEQRMTQLRDSIKAMQQETIKDQQKLREELTEFDKNIRREFAEVSSSADKARKVGSAFVAAVLGTPLLLIFMSKYQPTD

SEQ ID NO: 124911 - protein, 214 aa, Triticum aestivum
  Clone ID: PAT_TA_19329.pep
TEVCRKEHQALGISLVTSSRAIALALAPALARSLALPPAKYPNIFPKESIFGRFPYFLPCFVISILATGSCIACIWLPETLHFHNDQKVKAIDELEAEVGDSNLEGGKVKESSDTSTKNLLKNWQLMSAVIIYCIFCLHDTAYLETFSLWAVSSKKFRGLSLTSQDVGIVLAVSGLGVLAYQLDLYPFIAKSFGPIRPLRPAAVLSVLLLTTYP

SEQ ID NO: 124912 - protein, 265 aa, Triticum aestivum
  Clone ID: PAT_TA_19330.pep
MAATAAAPDDSTVRETTKASEEVLPPTLGSGSQPPNLFDGTTRLYISYICPYVQRVWIARNFKGLQEKIQLVAIDLQDKPAWFLEKVYPPGKVPVLEHNGNIIAESLDLLSYLDANFEGPKLFPGDQDPAKQAFADELIANSDSIIIALFRAGRAYAEGQGDDDISKLLAPALDKVEESLGRFSDGPFLLGQSMSAVDMVYAPFIERFKDFFAAVKHYDMTQERPKLKEWIEELNKIDAYTATWGDRRLQLAALMNKFGIQSPVA

SEQ ID NO: 124913 - protein, 139 aa, Triticum aestivum
  unsure (1)..(139): unsure at all Xaa locations
  Clone ID: PAT_TA_19331.pep
MAAPPARARADYDYLIKLLLIGDSGVGKSCLLLRFSDGSFTTSFITTIGIDFTIRTVELDGKRIQFQIWDTAGQERFRTITTAXYYRGAMGILLVYDVTDESSFNNIRNWIRNIEQHASDNVNKILVRNKADMDESKRA

SEQ ID NO: 124914 - protein, 115 aa, Triticum aestivum
  Clone ID: PAT_TA_19332.pep
KEVGAPVVEQIKVLSQICKKNRKRCECREWRNEDLAPWKQEAQLSLLDPLFASEEEGGQAHLICRRSSQWSPIQRKEAAAVVGDTPRYRKLAGGSTNCYEGRRGTRCVPSSPHPL

SEQ ID NO: 124915 - protein, 275 aa, Triticum aestivum
  Clone ID: PAT_TA_19333.pep
LMSSGKRWVCHQCRSFYICDKCYSAEQHLEDRERHPSNSRDTHKLHPVDIVGVPEETKDRDDILESEFFDTRQAFLSLCQGNHYQYDTLRRAKHSSMMVLYHLHNPTAPAFVTTCNVCSHDIETGQGWRCEICPDFDVCNGCYQKGAVNHPHKLTNHPSVADRDAQNKEARQMRVQQLRKMLDLLVHASTCRSGSCQYPNCRKVKGLFRHGMQCKTRASGGCALCKKMWYMLQLHARACRDSGCSVPRCRDLKEHLRRLQQQSDSRRRAAVNEMM

SEQ ID NO: 124916 - protein, 152 aa, Triticum aestivum
  unsure (1)..(152): unsure at all Xaa locations
  Clone ID: PAT_TA_19334.pep
MSLVRRSNVFDPFSLXDLWDPLDNMFRSIVPSASGDSETAAFANARIDWKETPEAHVFKADLPGVKKEEVKVEVEDGNVLVISGQRSREKEDKNDKWHRVERSSGQFTRRFRLPENAKTEEVKAGLENGVLTVTVPKAEVKKPEVKSIQISG

SEQ ID NO: 124917 - protein, 154 aa, Triticum aestivum
  Clone ID: PAT_TA_19335.pep
RVPLKLEQLFILRTPDMSAMHHDTSHDLKHLGAKLKDILGVPDTSLEARYITLHVCDLVAERGARLAAAGIYGILKKLGKDKLLSDFSQQRTVVAIDGGLYEHYKKFSACLEATLTDLLGEEVASSVVVKLANDGSGIGAALLAASHSQYAEVA

SEQ ID NO: 124918 - protein, 159 aa, Triticum aestivum
  Clone ID: PAT_TA_19336.pep
HLARYDVATVLKKFYSIEIDNLSAPSGVEIIDFLEASPSPLPWISEEELGQYAEKFQKSGFTAPLNYYRMWETNWRLLAPWNGAKITVPVKFIGGDKDIGVQSFGTEKYINSGAFKSIVPDLEVTVIEGHHFLQQEQAERVNSEMISYLVKFTSQEASS

SEQ ID NO: 124919 - protein, 218 aa, Triticum aestivum
  Clone ID: PAT_TA_19337.pep
ATSSHCFENPPALEPASGGGEVVDDFGGQKAYITGSAGSKAAVVLISDAFGFEAPNLRKIADQVASSGYFVVVPDFLHGDPYDLSSSNPGMWIQAHNPQNAFEEAKPVIAAIKEKGVSRIGAAGYCWGAKVVVELAKVHEIQAAVLLHPSLLTDDDIKEVKCPISILGAEIDRSSPPELLKQVGQILSANSEIDHFGKIFPGVPHGWAVRYSHDDASA

SEQ ID NO: 124920 - protein, 66 aa, Triticum aestivum
  Clone ID: PAT_TA_19338.pep
YCDYIYHLVISKKITIILVNRLSQMNIINCRITIKLPLNHIGYLNITSTVDIRKLAVPNIDQVTKI

SEQ ID NO: 124921 - protein, 187 aa, Triticum aestivum
  Clone ID: PAT_TA_19339.pep
IQQEMDSFKQKLSFIDKRGPELEAEKKVAAAARNFKEAGRIAAEAKALNSEKDELHCKLEKASTDLEIIEKDIVATTDKIQECEGLIVLKEKDSALTSYKRLRVDCAAARAELTAATETDDNEEGEILRKEAEAAESKAIELKTCYDLQVEDDEFMFQPVVPIAFITNSTGQHLSEIASSFGLSPQK

SEQ ID NO: 124922 - protein, 76 aa, Triticum aestivum
  Clone ID: PAT_TA_19340.pep
MQRSMFICVHYRNEFKLIKAHNSRMPEKCQQEFIFPIHLPSHCVLCHRNCCFTCVGRLMKCRQDLCIFHIQKKKKK

SEQ ID NO: 124923 - protein, 151 aa, Triticum aestivum
  Clone ID: PAT_TA_19341.pep
MAPKAEKKPAAKKPVEEESAAPAEKPPAGKKPKAEKRLPAGKSASKEGGEKRGRKKGKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 124924 - protein, 135 aa, Triticum aestivum
  Clone ID: PAT_TA_19342.pep
MRQVGVLCAAAHVAIRDTVGKLADDHRKAKVLAEGLKKIEQLTVDSASVQTNMVFFDIMDPRISPDKLCAVLEQHNVLAMPASSKRIRFVIHYQISDSDVQYALTCVEKAVEELLKGSTEFEHLTNGTTKSSYGH

SEQ ID NO: 124925 - protein, 89 aa, Triticum aestivum
  Clone ID: PAT_TA_19343.pep
RLTHSMALKYLASHLNHFWRCSEGIAFMLLSGIIRLLIWKWAVNQNTGEPRKQIWQISFLKLVTCRWVSATPWQTYYDCIVAMRIARNN

SEQ ID NO: 124926 - protein, 194 aa, Triticum aestivum
  Clone ID: PAT_TA_19344.pep
PAEDEELPSAYIEEFRCALDVELSKYVVEAYPKGACAIYCTSGKDIEGPGSDFSFTAVISAAKRSPQNFCNGSWRSIWTMEFNYELQFVNIKGNIQVDAHYFEEGNVQLDTNIDRKDSTIMQSPDDCAVSITNIIRHHESEYLSSLEESYLNLSDATFKDLRRKLPVTRTLFPWHNTLAFSLTRDLAKELALGK

SEQ ID NO: 124927 - protein, 176 aa, Triticum aestivum
  Clone ID: PAT_TA_19345.pep
SSHSRASHHPNHSPLSPGSPQPLSPPPSLLHASPPPPPTIPPPPPLLLIHHASPSTSASFSSLSARVSEAWLQIWRGLGELGGGMNGQGRWATEGRQQSARRDVVKLQGRGGRSAIGVQRARHTTGAAVKAKGAAGELHTRRVTATASAANIEWPDIETWRPSGTTPLLQPVRVML

SEQ ID NO: 124928 - protein, 226 aa, Triticum aestivum
  Clone ID: PAT_TA_19346.pep
GRVAAASVLVLLQLPTCSCSTLSRLFPSSRRSSGTPPPRSAPLLPVPSAAWGPPSWPSPPRPRSWTPSCRPSRRALGPPAAAAPSPPPPRSCASRCRGPPRPPAPPTCRRRGLPRGPLLWRGRAGACPWRPCRVPSAWGRARGAVCGRCAPGQGLFFNLGVVSSNCRRPWDSTRRCAGCVRVGAAVRALELLIPAGVGLWDVVTNEEAVAMAKPILDSEQAAKTLL

SEQ ID NO: 124929 - protein, 334 aa, Triticum aestivum
  Clone ID: PAT_TA_19347.pep
MQRGRGGRGGLFGFGDPFPAFGGFVPPGNLMSSFFRGSSPFDDPFFTNPSGSLIGPSLFEQSIFGSSMFGPHTALNGGGFQQQGPEPSRPKGPVIEELSSDDEDGADANEHDEKKKTNSMKHPRICKEPYVEDSGDEVQDNKRSRHEKFGKEYVRAGTSYQQPQTYMFQSSTVTYGGPNGACYMSSTTRRSGGDGVTMEESKEADTTSGKATHRIARGIGNKGHALTRKLNCDGKVNTMQTLQNLSEDELAGFEESWQRNAGPCLPGWDPRLNTLNSDKAGTLSTGIQEDNGMSVLPTPNDMFALPAPEQYRGFISSDMFALPAPEQYRGSISS

SEQ ID NO: 124930 - protein, 219 aa, Triticum aestivum
  Clone ID: PAT_TA_19348.pep
MKRTNSMKHPRISKEPYVEDSGDEVQASKPPILRNFGRQDFRPGTSDLPHHTHWVQSSTVTYGGSHGACYMSSTTRRSGGDGVVTMEESKEADTTSGKATHRIARGIGNKGHALTRKLNCDGKVNTMQTLQNLSEDELAGFEESWQRNAGPCLPGWDPRLNMLNSGTLSPGIQEDNGMSALPTPNEMFALPAPEQYRGSISSRMKRRPLNGSSQGSPRP

SEQ ID NO: 124931 - protein, 85 aa, Triticum aestivum
  Clone ID: PAT_TA_19349.pep
FFFFFFCKLKLLVGFYFIRDIYTCRYRCRPYLGRTNCSTCSQIVMQLQIPNVSKVQVKRNNLKRCAMQCFEQPTRHAEIPRRIKC

SEQ ID NO: 124932 - protein, 192 aa, Triticum aestivum
  unsure (1)..(192): unsure at all Xaa locations
  Clone ID: PAT_TA_19350.pep
AKRLLLLDPFSSTCNNRSSINLLEHFGRTHEPSQRRKRQATRRIDDGRRPATKERRRRRLGRRWRRLYGSRERTGEGANERGGLGGPIYSLGSKRSDPSRKKSLREKQNSVLEINSKTSLIRIKYPTICSDSWGXKIEEDERIKTRQKSGRNGVGLERIGGGKGRGAPGSGSVSSRLEVRDDTVAEGGKTDF

SEQ ID NO: 124933 - protein, 101 aa, Triticum aestivum
  Clone ID: PAT_TA_19351.pep
KESRRRDLLFCHCFALILGSCCCVWCNGPVQASRSRFVELRKVRVVGLQLQSVTVRERTREKGRRVRTRIGALLHLAFSFQLRVSACACLLSVSIAGDPLQ

SEQ ID NO: 124934 - protein, 74 aa, Triticum aestivum
  Clone ID: PAT_TA_19352.pep
NNINKIKLTKMTAGKPKNMYSHRRQSLSPWSKPRCLVDHNTINLQQILVSYGSPGDRFSSQAGRSHQVIYSVPT

SEQ ID NO: 124935 - protein, 163 aa, Triticum aestivum
  Clone ID: PAT_TA_19353.pep
LLLGSLPFQGGSLEAVFEAIKTVELDFNSGPWESMSVLGRDLISRMLDRDVSSRITADQVLCHPWVLFYTECTLKAVTPNVTNKIVAPKITWDRIRSHCESSASDSSSQRSEDQDECGIVAALTAAITHVRISEPKRTRRCSPGIPIQQECSSSIKSNLGTAF

SEQ ID NO: 124936 - protein, 188 aa, Triticum aestivum
  Clone ID: PAT_TA_19354.pep
NRYNPTQNKREPPAKLAHAKQNHRRYKEERTSAEESQASSSRPASSERATRAPAKAATAKATRQRASQPPRWSRRTAGDMRDQAGARDEAPKEARDVRRPRAPDPADLRIPSGGRAEGRSRSTSTMTLPRHQRYAPATRAPEKAGAGNPAGEEPQPPRRRCRHPPVSQSLPAPKKTGARISPGDDHLQ

SEQ ID NO: 124937 - protein, 74 aa, Triticum aestivum
  Clone ID: PAT_TA_19355.pep
LVPDRCPSYTTDDDAILLATSDHIIVQRYHEEPKKLRATKSLAAISLATSSRSIDHHRHHRSFKAEKLSHHSSH

SEQ ID NO: 124938 - protein, 105 aa, Triticum aestivum
  Clone ID: PAT_TA_19356.pep
VNLPKTLFEISQDKVFGLTINPVVLQAIRKTRAKALGFADGQSNYAEMDHVRQELLHANQIFAQNPMWPVIAVTGKAIEETAAVVVRIYLDRKQKYSMPRISKRY

SEQ ID NO: 124939 - protein, 96 aa, Triticum aestivum
  Clone ID: PAT_TA_19357.pep
ISDLVARVTPGLVGADLANIVNEAALLAARRGRNTVSREDIMDAIEREKYGVNGRQETDDSERQGLTKLFPWLPKSGNKPSSPDDFRGLMGYHTLS

SEQ ID NO: 124940 - protein, 65 aa, Triticum aestivum
  Clone ID: PAT_TA_19358.pep
TEELVNQVLDEIGIDVNSELVKAPATAVAKPVAAGKVAAQAEAAGGPDGGIDDDLQARRASLRKM

SEQ ID NO: 124941 - protein, 36 aa, Triticum aestivum
  Clone ID: PAT_TA_19359.pep
STCFVVQDITLLIWIVESPRYTLLNCCLHKKKKKKK

SEQ ID NO: 124942 - protein, 201 aa, Triticum aestivum
  unsure (1)..(201): unsure at all Xaa locations
  Clone ID: PAT_TA_19360.pep
GLAIEATNKNLIFNVHPVLMLIGYIIIGGEAIMVYRVLPTTNHDTTKLIHLILHGIALVLGAVGIYFAFKNHNESGIANLYSLHSWIGIGTITLYGIQWIIGFVTFFVPGAAPNVKKGVLPWHLLFGLFVYILALANAELGFLEKLTFLESSGLDKYGTEAFLXNFTALVVRVIWVPLLWWAAIAPVRLKNHRVMLQSQEN

SEQ ID NO: 124943 - protein, 63 aa, Triticum aestivum
  Clone ID: PAT_TA_19361.pep
RWHDRRQREKRGEGCDGNEKVVFEILFFNDLTAFARMSLYGKWVQTLERNTQNSQPAKEKVLA

SEQ ID NO: 124944 - protein, 134 aa, Triticum aestivum
  Clone ID: PAT_TA_19362.pep
TRVACLEVLSCTGCPNIKKVVIPSIANFLHLSKISLNLSTNLKEVDLTCSNLFMLNLSNCSSLEVLKLDCPRLTNLQLLACTMLQEEELESAISRCSALEILNVHSCPKINALDFGRLRLVCPSLKRIQSSLIS

SEQ ID NO: 124945 - protein, 163 aa, Triticum aestivum
  unsure (1)..(163): unsure at all Xaa locations
  Clone ID: PAT_TA_19363.pep
MTTPTATAAPLTGMDKYEEVRDIGSGNFGVARLMRHRENDGLVAVKLIERGHRIDENVYREIVNHRSLRHPNIIQFIEVILTPTHLAIVMEYAAGGELFDRIVDRGRFSEDEARYFFQQLICGVSYCHHMQICHRDLKLENVLLDGSPAPRLKICDFGYSKSX

SEQ ID NO: 124946 - protein, 93 aa, Triticum aestivum
  Clone ID: PAT_TA_19364.pep
ARKGCMSLPDVSSFYVKSAKPSQERVYGNRTVRFMLSRMEKQAQRPWPKDRIWVFKSDPRFFGSPMMDAVLNNSPLDKEMVHWLKTRPNVFLG

SEQ ID NO: 124947 - protein, 251 aa, Triticum aestivum
  Clone ID: PAT_TA_19365.pep
INIATKTCIGENTNLVPGFLGSLIGIRPGETRTFPIQFPESFEQETLQGVRAQFTVVCKELFFRELPELDDSLAAKLLPGCNTIDEVKERILERCKEVEKTAIEQATDNAILDQLGKLVDVDVPRSLFQEQGQQLYGAKLLQLQAERKLDKDQLASLSSEKSVQEYLKGERENITRIIKQMLVVGEIFKAENLQYSTDQLVKEVENSIEEFKRYNQDYDEGNIKQQVQDVLEAAKVLEWLKENCTIEYIKK

SEQ ID NO: 124948 - protein, 76 aa, Triticum aestivum
  Clone ID: PAT_TA_19366.pep
QSRRCTPEDLGYYMHPKGLPMMSSLQSPVRTATSFQKFICLDINFSSIVLSPFFFSFAGSRWLKPYVLEPDAVFAF

SEQ ID NO: 124949 - protein, 86 aa, Triticum aestivum
  Clone ID: PAT_TA_19367.pep
SSPNLLTFLCRWHRGNFVQRPTKCGKLVRTHFNVGYYPQAPILTSLCGSSAFTSPEPGKPASTFHPSSQSATSAVHARIHSLPSKA

SEQ ID NO: 124950 - protein, 60 aa, Triticum aestivum
  Clone ID: PAT_TA_19368.pep
QQVGASGLIDFDFWSKEGVNLLTPVVYTLYIRGHNEDKMIAILTTGSWHEVEAVATSCCL

SEQ ID NO: 124951 - protein, 139 aa, Triticum aestivum
  Clone ID: PAT_TA_19369.pep
MEAASLPLATSRFLSPPAAAASCSRTRSLPFVRAANQALEARKVPKAQRPSPRRNAVAEVKAAPDPVAALTRLEDVLQTQDCNIILRHYGEIRRWDVLSKVFGWMQEHDMLNIASYSSYFKYLGLSPNAAKALQVYGSI

SEQ ID NO: 124952 - protein, 185 aa, Triticum aestivum
  Clone ID: PAT_TA_19370.pep
LQLLRRGPPVLVHPGAGGPVGPRLRPRDPPPSGLRAARPRGRVRLRPRATGGHPLGLNAGVEPKSRQRGPSRGAVSGGVVRCAVEAAATAVAGAVMAVAATAVAAATVAAAATVVVAAATAVATVAAATATPTGTGGTERWGPRGQVILFATVMFTLVQRVYLRSCRVCCCPSVFLIARSLCVSC

SEQ ID NO: 124953 - protein, 190 aa, Triticum aestivum
  Clone ID: PAT_TA_19371.pep
TRVRSTEAVAFPKLETLFIKDMPNWEEWSFVDEEEQEATAAGLEGAEDETDANQKGAAPPPRMQLLPRLKQLELDHCPKLRALPQQLGQQATSLKVLHLRHVHSLKVVENLCFLSEHLSIQDCEGLDRISSLPHVRDLRVARCPNLRRVEELGSLEQLWLDVDMQDLSSLWIPGLKYGCQDLEVFTWPRK

SEQ ID NO: 124954 - protein, 114 aa, Triticum aestivum
  Clone ID: PAT_TA_19372.pep
SSNARDDAEANDLTPDSLLTLVEEFSVTSQAVEHSFPALLVTNGEVNTESLSAEYINDDESETSIAGNEEGQLEQSPDLCGDEHFELDMLERLESSVPLGSLPIDGMIEQLNSE

SEQ ID NO: 124955 - protein, 81 aa, Triticum aestivum
  Clone ID: PAT_TA_19373.pep
LLVLMTIIDTSSDTTALAVACYDLSQFLQYHPSGRIVVADLKAKDRVMKLMNHENTEVRKNALLCVQRLFLGAKYASFLQA

SEQ ID NO: 124956 - protein, 52 aa, Triticum aestivum
  Clone ID: PAT_TA_19374.pep
ARSQCLNLHNKPNTEKSHQDTITSSCSMWVLRDAYCLLKYMYANKDISSNRA

SEQ ID NO: 124957 - protein, 118 aa, Triticum aestivum
  Clone ID: PAT_TA_19375.pep
MGRRPARCYRQIKNKPYPKSRYCRGVPDPKIRIYDVGMKRKGVDEFPYCVHLVSWVVGECLLLNQFCDGQDAFHHQGPGFSTYRFLPTSTSWFHLFGAHRFQNRDSLLPLGMHQRQVW

SEQ ID NO: 124958 - protein, 225 aa, Triticum aestivum
  Clone ID: PAT_TA_19376.pep
TFGGWFATLTVAGYTVLAVRNLVKTELIPDTEPVSKPSPFSTSEIWSWTAIFVASFGVAYFNPTALGTTAKTCLPFLLAANVLGYMVGSGLPAGVKKVLHPVISCALSADLAAAAYGYLSGSGFDAVLGDYLTKAASNPGAGDILMGFLGSVIISFAFSIFKQRKLVKRHAAEIFTSVAIGATFSLYSTAIIGRLVGLEPSLTISMLPRCITLALALSIVSFFEG

SEQ ID NO: 124959 - protein, 224 aa, Triticum aestivum
  Clone ID: PAT_TA_19377.pep
QICMAGGLSTGWIEWDGERFEFENAPSYSEKNWGGGFPRKWYWIQCNVFSGASGEVSLTAAGGLRKIGLGDTYESPSLIGIHYEGQFFEFVPWTGTVSWDIALWGRWKMSGENKTHLVEIEATTTEPGTALRAPTIEAGLVPACKDTCYGDLRLQLWEKKYDGSKGAMILDATSNMAALEVGGGPWFNGWKGTTVTNEAVNNIVGTPIDVESLFPIPFLKPPGL

SEQ ID NO: 124960 - protein, 260 aa, Triticum aestivum
  unsure (1)..(260): unsure at all Xaa locations
  Clone ID: PAT_TA_19378.pep
MAAGTGRVLPLLAVAAALAAALLYTAPFSKSLGGEGCSLLPHGHFWIASQRVVALGRVGPAAVEVKEGLINAIAVGDYRSFVLRRPLVDYGDAVIMPGLIDVHAHLDEPGRAEWEGFSTGTRAAAAGGITTLVDMPLNSFPSTVSEETLKLKVDAARDKLYVDVGFWGGLVPENALNPSKLESLLNAGVLGLKSFMCPSGINDFPMTNSSHIEEGLVTLAKYKRPLXLIHAERIPDVVSDEELDGYLKSRSYATYLKFRT

SEQ ID NO: 124961 - protein, 157 aa, Triticum aestivum
  unsure (1)..(157): unsure at all Xaa locations
  Clone ID: PAT_TA_19379.pep
GPLPPDAPSWCQAPFDPEGLLSSVMAIVTCLIGLQFGHIIIHFEKHRXRITNWLIPSFSMLALAFLMDFSGMRMNKPLYTMSYTLATAGAAGLLFAGIYALVDLYGFRKPTSPMEWMGNHALMIYVLVACNILPMFIRGFYWRDPNNSLLKVIGIGA

SEQ ID NO: 124962 - protein, 43 aa, Triticum aestivum
  Clone ID: PAT_TA_19380.pep
ANNDKSKEKSPKSGGSVPCKSCTKTFNSEMALQAHSKAKHGAK

SEQ ID NO: 124963 - protein, 125 aa, Triticum aestivum
  Clone ID: PAT_TA_19381.pep
MDILLGSGRFLARRLPPLALVPRCSRGSPDKSGSDKGETSTDWDKAWASFKNKGKRTLFSDFSPNKYVTWNPRRSEYPLSEEVDPIKRTERSNLMLWTSPQFTLVGAIIIVLTLLIYTLVVPPPK

SEQ ID NO: 124964 - protein, 91 aa, Triticum aestivum
  Clone ID: PAT_TA_19382.pep
MVMRTALTSLPARLRAPAAPSSAAATGGGLRLLSDGKGRVLSEEERAKETVYIQKMEKERQEKLKKQLEQEKPGADKAKPADADKKAEGST

SEQ ID NO: 124965 - protein, 253 aa, Triticum aestivum
  unsure (1)..(253): unsure at all Xaa locations
  Clone ID: PAT_TA_19383.pep
FDGDDEVRDRATLDPQLLGGEATVGETEKDVNEFLFGSLDVPLANLETSLRNYEPSDVPFDISSVSRETKSQPLAEKKSTGKKSAGPASAVSGPVSTVDAPYEKLLSSIPESADLGKLFKSSAPVELTEAETEYSVNVVKHIFDRHVVLQYNCTNTIPEQLLEQVGVVVAPSRPVELLELASRPXAPVPLGSPGQALAPCPMPEAGSATARFSISLYLFVNLRDPATREAEDDGVEDEYQLEDLEIVSADYML

SEQ ID NO: 124966 - protein, 59 aa, Triticum aestivum
  Clone ID: PAT_TA_19384.pep
SPHLESRDLFYPIFHKNLDSASNFCIPDRLEMVPRAPVLLFFQMVSHSISYVVFVIQLR

SEQ ID NO: 124967 - protein, 236 aa, Triticum aestivum
  unsure (1)..(236): unsure at all Xaa locations
  Clone ID: PAT_TA_19385.pep
MKGLFKSKPRTPADVVRQTRELLIYVDLHAGSRGXDPKRGGGERWHELSKNIRDLKCILYGNGEQEPVTEACVQLTQEFFRENTLRLLIMCVPKVNLETRKDPTQVVANLQRQQVNSRILASEYLEANKDLLDTLIPGHEATGVALRFGAMLRECIRHQSIARYVLESDHMKKFFDYIQIPNFDIASDASATFKELLTRHKATVAEFLSKNYDWFFAEFNSXLLSSSNYITKRQAI

SEQ ID NO: 124968 - protein, 269 aa, Triticum aestivum
  unsure (1)..(269): unsure at all Xaa locations
  Clone ID: PAT_TA_19386.pep
RALPPPHRPPPSRRIMWAPPGVFSPPPPPLPPPPPPPHLSHNSSPIAQPEDPQIDPPPXSGRSPPPPPAQLXDLGIYQWRHPRRGLSIPAGTGPPGWPPTSSPPAARPPPPAXGARRARSVPSSPDRKLGPSAAAAAAPSASPDMCRPSLSHAGRSISSRTMSGSGSSIHGSKPASKPDLARAKSDKVTANSQRPHALAGPLSSSFKDMANTVPASNSPSTLLKNKLSPRPAPGKGVAPPKPSIERAPSPGPLRGGKPLPAFARAPGTE

SEQ ID NO: 124969 - protein, 172 aa, Triticum aestivum
  Clone ID: PAT_TA_19387.pep
FLQIPSGRQSNILDTRVQFHQDQMHFLVVHETQIAIYETTKLEPVKQWPVRENSPPITHATFSCDSQLIYASFMDATVGIFNASSLRLQCRILPASYLPPNISPSVHPVVVAAHPSEASQFALGLTDGGVFVLEPLESERKWGNPPPVENGSASNLSTPPPNGASSSDQPER

SEQ ID NO: 124970 - protein, 132 aa, Triticum aestivum
  unsure (1)..(132): unsure at all Xaa locations
  Clone ID: PAT_TA_19388.pep
LKSDGIAGLYRGFNISCVGIIVYRGLYYGLSECLKXASFALGWLITNGAGLASYPIDTVRRRMMMTSGEAVKYKSSLDAFQQILKKEGPKSLFKGAGANILRAIAGAXGVLSGYDXSCQIFFFGKKYGPGGA

SEQ ID NO: 124971 - protein, 151 aa, Triticum aestivum
  Clone ID: PAT_TA_19389.pep
PKPHQALLLSPTVSFLAPSPSSAPRARALSSSTATATAASNNAFPYLASRLQCKTGASVSHVSLAKKMPVVVHASAEAGPTDAAEQPEKPKPVASIEDMPFESKQRMILEQRARMKVAKKLRQRRKRLVQKRRLRKKGRWPPSKMKKLKNV

SEQ ID NO: 124972 - protein, 148 aa, Triticum aestivum
  unsure (1)..(148): unsure at all Xaa locations
  Clone ID: PAT_TA_19390.pep
KLIFLKNAICNNATYPLPKFPPTGGKTRVKGXPKXXPYXGXXXYKXNWAXXFKXXXELGKTLXVXPTXIXXXXXXPXXPXXXXXXKKAXPDXPFQXLXXXXXXRXTXFXGXXGXXXXXXXXXFKXXXPGXXXPXXXXXXXXXXXPIXX

SEQ ID NO: 124973 - protein, 68 aa, Triticum aestivum
  unsure (1)..(68): unsure at all Xaa locations
  Clone ID: PAT_TA_19391.pep
MTTSRRLVDRKTAKFRKNITRXGSVPETTVKKGNDYPVGPLVLGFFIFVVIGSSLFQIIRTATSGGVA

SEQ ID NO: 124974 - protein, 212 aa, Triticum aestivum
  unsure (1)..(212): unsure at all Xaa locations
  Clone ID: PAT_TA_19392.pep
MAPEPEPEDGRELYALLHLSPESSDEEIRRAYRQFAQIYHPDKYQDAQMKDVATENFQRIRDAYEILSDENKRQIYDIYGMEGLNSGLELGPKLNKPEEIKRQLEELRRRKEEEKLFVHARSTGSILANISVPQYLDGDGIMGGMGXMSSEIELPVSKQNTVTVGGNLVVNGTTGSGAATAVLRHQLSSVSSIDFMATAGLRSLIGVQTFRQ

SEQ ID NO: 124975 - protein, 123 aa, Triticum aestivum
  Clone ID: PAT_TA_19393.pep
DKEGIPPDQQRLIFAGKQLEDGRTLSDYNIQKESTLHLVLRLRGGMQIFVKTLTGKTITLEVEPSDTIENVKAKIQDKEGIPPDQQRLIFAGKQLEDGRTLSDYNIQKESTLHLVLRLRGGQL

SEQ ID NO: 124976 - protein, 59 aa, Triticum aestivum
  Clone ID: PAT_TA_19394.pep
PSRPNKLPFRAQLYLRKPNVVICCKCSSRAHYFVMLLIIWLYLNGCFQALSSGCGLINI

SEQ ID NO: 124977 - protein, 57 aa, Triticum aestivum
  Clone ID: PAT_TA_19395.pep
RNVLCEAVERHRAEMLVVGSHGYGAIKRAVLGSVSDYCAHHAHCTVMIVKKPKQHKH

SEQ ID NO: 124978 - protein, 46 aa, Triticum aestivum
  Clone ID: PAT_TA_19396.pep
MIYDGNSPLFRSFLSQKGGADKRKMEEHKPKEQRPKASENKPVMNE

SEQ ID NO: 124979 - protein, 110 aa, Triticum aestivum
  Clone ID: PAT_TA_19397.pep
QGVNKGISVDKIIQTMVSKGDVPDLLMCIGNDRSDEDMFESINKATSLSEPAIPEVFACSVGPKASKANYYVDGCSEVIRLLKGVTAISPQKDTVSHSHAVFKDTLEVIS

SEQ ID NO: 124980 - protein, 157 aa, Triticum aestivum
  Clone ID: PAT_TA_19398.pep
QGPLINEAAVQKVEKFINDATSKGANIMLGGKRHSLGMTFYEPTVVGNVSNDMLLFREEVFGPVAPLIPFKTEEEAVHMANDTNAGLAAYIFTKSIPRSWRVSESLEYGLVGVNEGIISTEVAPFGGVKQSGLGREGSKYGIDEYLELKYICMGNLG

SEQ ID NO: 124981 - protein, 157 aa, Triticum aestivum
  Clone ID: PAT_TA_19399.pep
MLAKRLKRCSILLFAFLLADASGSLLESSGGQAEAIGPQISPATEGEGKRRSLATGMFCVALPNADPTALQEGLNWACGQGHANCAAIQPGGPCYKANNLPALASYAYNDYYQRNSGAGATCSFNGTATTTATDPSSGQCVFSGSSMAGGTTPAANA

SEQ ID NO: 124982 - protein, 221 aa, Triticum aestivum
  Clone ID: PAT_TA_19400.pep
HEAFQNVLPFCTGFAAGCMIWIVIAEVLPDAFKEATPSQVASAGTLAVAFMETLSTVLLGFTDGNNSEDASGFLVSLVFGLGPLIGGIILVTFSLGFSMPHPLLTGVASGIAFRLAAWRPVQLLMSSKMGLFTTLFLLIGGSLVYHAATSSILRVFNRKRSSANVITSSSGLSLSVLTIQSLLACGAVFLHAYAEGLALGVAARKAYGLGRYMDLPASLHG

SEQ ID NO: 124983 - protein, 148 aa, Triticum aestivum
  Clone ID: PAT_TA_19401.pep
TLTGNTITLEVESSDSIENVKAKIQDKEGIPPDQQRLIFAGKQLEDGRTLSDYNIQKESTLHLVLRLRGGMQIFVKTLTGKTITLEVESSDSIENVKAKIQDKEGIPPDQQRLIFAGKQLEDGRTLSDYNIQKESTLHLVLRLRGGSQ

SEQ ID NO: 124984 - protein, 81 aa, Triticum aestivum
  Clone ID: PAT_TA_19402.pep
CVYRDLAALAILAPVAFLRERRLRPPVTPQLVACFALLGFTGLFVNPLLFLVGLRYTNASYAAAFEPSVPVFAFLLAVIAG

SEQ ID NO: 124985 - protein, 65 aa, Triticum aestivum
  Clone ID: PAT_TA_19403.pep
VLSYGELDAVFECFWTTICVLVCGLESLLVDDDLARLCIQLIYACLYIGLMAHDYICTHLIWMYE

SEQ ID NO: 124986 - protein, 200 aa, Triticum aestivum
  unsure (1)..(200): unsure at all Xaa locations
  Clone ID: PAT_TA_19404.pep
MSQPAKPTGNDIKVPEALYGGTGNYASALFLTAAKANSLDKVESEIKTVVEASKKSPLFSLFIKDLSVPKETRVKAVTEIFADAGFSDVTKNFLAVLADNRAPXYIERIAERFVDLTMAHKGEVKVVVRTVIPLPAEEEKELKDTLQDILGKNKTILVEQKIDYSIMGGLVIEFGQKVLDISIRTRAKQMEAFLRQPLDF

SEQ ID NO: 124987 - protein, 124 aa, Triticum aestivum
  Clone ID: PAT_TA_19405.pep
GQSQSLFHSHKHFCLSSLCEMEKKQQKEKSEEPWVGRRILGVAAAGAVAVAAGAFFLLSSVGDSSADKGDQAEDDTAARPMRKTMKGPGSGGELISRDKFNEDAANYFRTGRQKGSKAAVDEFQ

SEQ ID NO: 124988 - protein, 60 aa, Triticum aestivum
  Clone ID: PAT_TA_19406.pep
RPEGTVIIRDNVEVLVKVQAITGGMRWKSQIMDHESGPFNPDKILVAVKTYWTGKPMEKQ

SEQ ID NO: 124989 - protein, 132 aa, Triticum aestivum
  Clone ID: PAT_TA_19407.pep
ANLIGGVFRRANTDIHFKDYVIPKGCKIFASFRAVHLNLEHYENARTFDPWRWQSKNKLQNAEGASLFTPFGGGPRLCPGYELARVVVSVFLHHLVTCSSWEVAEEDRIVFFPTTRTLKGYPINLRRRPDYA

SEQ ID NO: 124990 - protein, 289 aa, Triticum aestivum
  unsure (1)..(289): unsure at all Xaa locations
  Clone ID: PAT_TA_19408.pep
MGLLSNRIGKESLKAGDHIYSWRAAWVYAHHGIYVGDDKVIHFTRGRDQEVGNXATVIDFLLVSSGPNRSTTPAXGCTRGEATTTAETNGVTSSCLRCFLAGGALYRFEYDVNPAVFLAXERGGTSTLAATDPGEAVVRRAXKYLLTHGFRCYSLFKNNCEYLAIYCKTXLLVAVAGRRWASGQSGQAESVVGXPLAAVVSTLLLLLXTNINGEEVMTVGEYCLSVYAQDIGRRREVLQLEAENGSAGPASGRIRPPNISHEHPSGGSPGSGSDHSRYCLKLSIEIVKY

SEQ ID NO: 124991 - protein, 188 aa, Triticum aestivum
  Clone ID: PAT_TA_19409.pep
CINKKECELHGLQRTLYFPDNEPDANVLWEDKNVRVDYIKLVLELSELCAEQNLEVWYLEDELISPCLFEELQSQGDQTDDLKLLFDCICEALTEIQERYFRLSSWLTFLKHDIRTPPIGENLITEVDRYVYGYIQYSLPSTLEQTMKRDLEVQTWMNIRSKTEGIVMEIWEFVLDELIDETVFDLWM

SEQ ID NO: 124992 - protein, 325 aa, Triticum aestivum
  unsure (1)..(325): unsure at all Xaa locations
  Clone ID: PAT_TA_19410.pep
MASPPSPPPPSPPPRADEPRSGGGRAPIPPYVKAAAGSLGGVMEACCLQPIDVVKTRLQLDRAGVYRGIAHCGTTVARAEGVPALWKGLTPFATHLTLKYALRLGSNAMLQSAFKDPVTGKVSAQGRLASGFGAGVLEALIIVTPFEVVKIRLQQQKGLSTDLLKYKGPIHCAKTIVREXEGFFGLWSGASPTVMRNGTNQAAMFTAKNTIDILLWKKHEGDGKVLQPWQSMVSGFLAGTAGPICTGPFDVVKTRLMAQGRTGDIKYKGMFHAIRTIHAEEGLRALWKGLLPRLMRIPPGQAIMWTVADQVMGLYERTYLQSAQV

SEQ ID NO: 124993 - protein, 156 aa, Triticum aestivum
  unsure (1)..(156): unsure at all Xaa locations
  Clone ID: PAT_TA_19411.pep
MTTRFSPAAMTTRFKKNRKKRGHVSAGHGRIGKHRKHPGGRGNAGGMHHHRILFDKYHPGYFGKVGMRYFHKLRNKFYCPAVNIERLWSXVPAEKAAEASGDKPPQIDVTQFGYFNVLGKGLLPPKPIVVKXKLISKAADKSLIAAGAPFLRIISI

SEQ ID NO: 124994 - protein, 99 aa, Triticum aestivum
  Clone ID: PAT_TA_19412.pep
TIAMLGYADEDKTTVLELTYNYGVTEYSKGNAYAQVAIGTNDVYKSAEAVELATKELGGKILRQPGPLPGINTKIASFVDPDGWKVVLVDNTDFLRELH

SEQ ID NO: 124995 - protein, 63 aa, Triticum aestivum
  Clone ID: PAT_TA_19413.pep
FVKKISQKHSKALIQLYNIELTIMSCIERLLSFDDDRHLIYLKFIKEQLRIEKNTDCKRKHLK

SEQ ID NO: 124996 - protein, 243 aa, Triticum aestivum
  unsure (1)..(243): unsure at all Xaa locations
  Clone ID: PAT_TA_19414.pep
EEKFPTXLKKYSDKAPPSDKLASHEVKVDYEYKSVVEPDKIVPPDQRIKGYLYGPQVIPVSNAEWEAVKFKPEKGVKLLGFTDRSNVPRHHFMKDVCLFIPEPGNIKATLAVSAIARAMHQMNKAAIVRCVWRQGQGNVALGVLTPNISAVDNVQDSFYFNVLPFAEDIREFQFRSFSSLPSSSQPTEEQQEAADNLVKMLDLAPPGREVLKPEFTPNPMLERFYSYLDLKSKQPDANVPPLD

SEQ ID NO: 124997 - protein, 235 aa, Triticum aestivum
  Clone ID: PAT_TA_19415.pep
WRGCGVDANRERPYFVLDDLWEAYKEWSAYGAGVPLVLDGCDGVVQYYVPYLSAIELYGDSSEGFSRDVGESGVTHGRLLFQYLEFDSPFCREPLTDKISSLSARFSGLRTLRSCDLSARSWMSIAWYPIYRIPTGPTLKDLDACFLTFHQLSNCPQGDNLWAPDNLWAPDSTPNIPLPVFGLASYKFSNSVWSSTDGDWKLASCLRQAAADWLRDSRAGHPDYQFFVSRGAYNR

SEQ ID NO: 124998 - protein, 114 aa, Triticum aestivum
  unsure (1)..(114): unsure at all Xaa locations
  Clone ID: PAT_TA_19416.pep
MATATRRLLPALLRTLAPAGARGLSTEKAVGAAAVVGSHTAKWMQDTSKKSPMELINEVPPIKVDGRIAVCEGASEGVGLGHPIXEYICLESGXAPNVCKYCGLRYVQVHHRLN

SEQ ID NO: 124999 - protein, 130 aa, Triticum aestivum
  Clone ID: PAT_TA_19417.pep
MATSMITSPLVAPARAKGLPSISRRGSSFAIVCSGGKKIKTDKPYGIGGGMSVDIDASGRKSTGKGVYQFVDKYGANVDGYSPIYSPEEWSPTGDTYVGGTTGLLIWAVTLAGLLGGGALLGYNTSALAG

SEQ ID NO: 125000 - protein, 145 aa, Triticum aestivum
  Clone ID: PAT_TA_19418.pep
GKHITPVDENTIPTGEIMPVNGTSFDFTTEHKIGERINDVPGGYDHNYMLDCGDEKNGLKHAAKLRDPSSLRTLELWTDAPGMQVYTANYVNDITGQGGAVYEKHAGVCLETHGFPNAINQPNFPSVVVRPGEKYKHTMLFEFSN

SEQ ID NO: 125001 - protein, 184 aa, Triticum aestivum
  Clone ID: PAT_TA_19419.pep
RPSSQPANPVQAAQTAQAVVPSSGPNANPLDLFPQSLPNASANAGAGNLDVLRNNAQFQNLLGLVQANPQILQPLLQELGKQNPQVMQLIQENQAEFMRLINEPLEGDEENEMMLDQMADAAETIAVTPEENEAILRLEGMGFDRALVLEVFFACNKNEQLAANYLLDHMHEFDNDDGLGGPPL

SEQ ID NO: 125002 - protein, 176 aa, Triticum aestivum
  Clone ID: PAT_TA_19420.pep
MSASPRLRTRVRERARIDGSSGTPRPDATMSGALRRAGPAGPGEQAPDEARQVLRQRDTDQRHTDGQHERRRPDGDRQPRTKKASRRQPHRAAWEDRAGAAMRGQSECGRVRPRGPPASAPQEGRAERWTSPPPRSRSGTTGGARARRTRMKHTGRDDRHRGGPRRAGGGGPALQA

SEQ ID NO: 125003 - protein, 89 aa, Triticum aestivum
  Clone ID: PAT_TA_19421.pep
FFFFFFFFFFFFRTIIMRQNNKVVSATEPESSKTLQISLIQVGLQSLHTKLIGSTLHTTDTTAATIAGMYSSLMSGKRMSTAVKGRDFN

SEQ ID NO: 125004 - protein, 189 aa, Triticum aestivum
  Clone ID: PAT_TA_19422.pep
MVDFDLNANQYHEETDYHPKSSANNSVNLSTPIAVAASRGSLVFPARLQFEGALGWKGSAATSAFRPASVPRTPDREKSMSASSQKTRNVMFDLNVDESENTIAGESLSTAFWLRSSDIAPKDISGADGASTGLELDLNNPCEEEEAATTSPAVPSFWSHEQCHGRWSQPSSSSSSRQPTAKNFDLNDN

SEQ ID NO: 125005 - protein, 208 aa, Triticum aestivum
  Clone ID: PAT_TA_19423.pep
MVSLKLQKRLAASVLKCGKGKVWLDPNEVSEISMANSRQNIRKLVKDGFIIKKPQKIHSRSRARRAHEAKQKGRHSGYGKRRGTREARLPTKILWMRRMRVLRRLLRKYREAKKIDKHMYHAMYMKVKGNMFKNKRVLMESIHKTKAEKTREKTLSDQFEAKRAKSKASRERKIARREERLAQGPREPTAAPAAAPAPAAAAPKKAKK

SEQ ID NO: 125006 - protein, 246 aa, Triticum aestivum
  Clone ID: PAT_TA_19424.pep
MANNSSAEKQRARVLVCVTGAGGFIGSRVVKELLLRGYRVRGTARDPADRKNVHLQTLEGANERLSLHRADVLDCDSLRAAFDGCHGVFHVASPVSNDVELMPVAVKGTRNVVNAAADMGVHRLVFTSSYGAVHMNPNRSPDTVLDETCWSDYEFCKQTGNYYCCAKMMADKAATEEAARRGLQLAVVVPPMTIGPMLQRSLNGSNYYVARYLMGTKKAYPNAVAIYADIRDVVRAHLLVYEHHRA

SEQ ID NO: 125007 - protein, 258 aa, Triticum aestivum
  unsure (1)..(258): unsure at all Xaa locations
  Clone ID: PAT_TA_19425.pep
MEVVGGVSLRPARLRHLTPGEASAGSFLPRRLQLARTAARPARRALVVEARGGRGWSDRQSQQQRRMPQLPKIEDDGNPRFVIFIRTANVYFWYPLNIVTGGTTAKIMLAAKDNFLGKYIYKDTLARNLRHRHLQRRGRHNRTWRKSSSACSKGETEFRYGYMIVXEKGNLRSALATSNVLELPKKEELKSVVDKVRDFFGEVTSGAKESFAQITGSASAAEAEAEAKAEDKRPRSKRRGSKRKGKQQKPKQGFKPES

SEQ ID NO: 125008 - protein, 243 aa, Triticum aestivum
  Clone ID: PAT_TA_19426.pep
RWRYRLNVEKPEGIIYVTDVGQQQHFDMFFSAAKMAGWLPDPSEKKFPKTSHVGFGLVLGSDGKRFRTRSTEVVRLVELLDEAKSRSKSELQQRLTENGKIVDWTDEELEQTSEAVGYGAVKYADLKNNRLTNYTFSFEQMLSDKGNTAVYLQYAHARICSIIRKSNKDVEELKMSGAISLDHPDERVLGLYLIRFAEVVEEACTNLLPNVVCEYLYNLSEMFTKFYTNCQVVGSPEETSRLL

SEQ ID NO: 125009 - protein, 81 aa, Triticum aestivum
  Clone ID: PAT_TA_19427.pep
QFALWNIVWKHSITNSLAACQISSHPSHHQDELRCLIRRSFPEVNITLVSTAHNIAALRGSPTPRRHPSPSMHCRSSQQAT

SEQ ID NO: 125010 - protein, 175 aa, Triticum aestivum
  unsure (1)..(175): unsure at all Xaa locations
  Clone ID: PAT_TA_19428.pep
MAASTARTVKDVNPHEFVKAYSAHLKRSGKMELPEWVDIVKTARFKELPPYDPDWYYIRAASVARKIYLRQGIGVGGFQKIYGGRQXRNGSRPPHFCKSSGAISRNILQQLQEMGIIDLAPKGGRLITSQGSRGPVPGAAGVPAAAWALAASVSGWSRLALGLASLYFQVSAWSS

SEQ ID NO: 125011 - protein, 149 aa, Triticum aestivum
  Clone ID: PAT_TA_19429.pep
YWTRRDVDHLWRGQMGLSEEEQRKALESKHVTNGVTEDGAHESPEETTNGSACNPVAAGGCCQGNGGFTCCQSDLPKEDKSITAEQNQKSSEKGADKECAAGSKKRHMKMCSMPTWFETWETADTYAALGIVAAAASVFVAFRIYKNLN

SEQ ID NO: 125012 - protein, 275 aa, Triticum aestivum
  unsure (1)..(275): unsure at all Xaa locations
  Clone ID: PAT_TA_19430.pep
MEKLGANPANSCPLTPLGFLERAATVYGDCPSVVYGGTVFTWSQTHRRCLRLASALASLGVSRRDVVSVLLPNVPAMYEAHFGVPMSGAVLNSINTRLDARTVSVLLRHSGSRLILVDPALLPVLDEALRLLPPGHPAPRVVLVEDPQEKDFPPAPAAALTYERLLQNGRPGFKWXRPASELGPXILNYTXGTTXXPKGFLNGNAGLXXHNGSLVSWSXXTTDYFDLHFKPTVDFPWDGLLADKLLDPQKNNPAAGNTLGNVCKSGTPRLEPSGR

SEQ ID NO: 125013 - protein, 68 aa, Triticum aestivum
  Clone ID: PAT_TA_19431.pep
IGGARRINNLLLQSNLRIQFRCVTQGISQSGALNVYLMTPKQNEIYMFSCLERKQSYRDYFTQNCFRA

SEQ ID NO: 125014 - protein, 264 aa, Triticum aestivum
  unsure (1)..(264): unsure at all Xaa locations
  Clone ID: PAT_TA_19432.pep
LCEGVIAGGAAGVVVETALYPIDTIKTRLQAARAGSQIQWKGLYSGLGGNLVGVLPASALFVGIYEPTKRKLLDMFPENLSAVAHLTAGAVGGLGASLIRVPTEVVKQRMQTGQFRTAPDAVRLIVAKEGFRGLFAGYGSFLLRDLPFDAIQFCIYEQLRIGYKLMAKRELKDPENALIGAFAGAITGAITTPLDVLKTRLMIQGQTKQYSGIVSCAKTILREEGPGAFLKGIEPRVLWIGIGGSIFFGVLEKTKSXLAERSSR

SEQ ID NO: 125015 - protein, 292 aa, Triticum aestivum
  unsure (1)..(292): unsure at all Xaa locations
  Clone ID: PAT_TA_19433.pep
MGGGGGREGEVKPFNFLQILCAGVMAGGAVELVVATATYPIDTIKPRHLAAKAGSQVXSKDLVAVLAGNLLVVLPAXAIIGKLHERSHRNLLDICLLNLSAVGVLGAGGIRVPGEFAQXWTQTGRFTTDPDAVRLVVAXDVRLIVAKEGFRGLFAGYGSFLLRDLPFDAIQFCIYEQLRIGYKLMAKRELKDPENALIGAFAGAITGAITTPLDVLKTRLMVQGQTKQYSGIVSCAKTILREEGPGAFLKGIEPRVLWIGIGGSIFFGVLEKTKSVLAERSSRKAALAEKDE

SEQ ID NO: 125016 - protein, 208 aa, Triticum aestivum
  Clone ID: PAT_TA_19434.pep
HEATFYYPLAYYGCPYEADKHEKFYNQDPFVETYDIYRTSYSPPPHVYSVLRRDGERDLAFVSYGNLSQLQRYKNGDYYSNADIPRSHLIYYDGRDHALHTTTHVYSISHLYKSPFSVLIQNFKELFEFMFLRILVLLETEIVSIGRIILKLLKFTLNFILTDVVFAIFGEEFYTYFILFVSVYIYYRDILIAVCFISFVFWFFYVLS

SEQ ID NO: 125017 - protein, 154 aa, Triticum aestivum
  unsure (1)..(154): unsure at all Xaa locations
  Clone ID: PAT_TA_19435.pep
MVHVNFYRNYGKTFKKPRRPYEKERLDAEXLKLVGEYGLRCKRELWRVAVCXLCRIRNAARELLXTLYEKNPRRTFEGEALLRRMNRYGLPGEGXNKLDYVLXLAVDRFLHRRXLRTLVSKNAMALSLHHPLRRGNPRRGGEEQNHFPALASEQ

SEQ ID NO: 125018 - protein, 249 aa, Triticum aestivum
  Clone ID: PAT_TA_19436.pep
ISDLQEQETILKQCISQLESVDVARISLLNQLKEALIEQESKSEILRIQLQVARAEAEHAIQLRQRFGGAVVANGTGSSSSLLMITPTEQTAGMIKGSGVRLMSPQLQSLNPAISLAPTVSAVGDEPKRTAAAMADKLASLSAPVQVLSSIFSSFVAEHGASLSSMNSESPSGELSGGPPGFKIEKRPRLENTAHGSDMGAPPFPVQVPQMQQQIGAVPTQLPAQINQAPGPFAPPPPPFLPPLLQQFG

SEQ ID NO: 125019 - protein, 78 aa, Triticum aestivum
  Clone ID: PAT_TA_19437.pep
EGRGRMPLSRSNAAALCSSRSNVAPLSRSNAAALCSSTSNTAASSLSSAMVSLRSKPDLQAAMLSYTATGFINLFLYL

SEQ ID NO: 125020 - protein, 62 aa, Triticum aestivum
  Clone ID: PAT_TA_19438.pep
KVFLFTNEKSVNKRMSLFNKMNNKLFRNLKSFNKTKQFNKIDLFNYLDSQKNTQTNIAELVS

SEQ ID NO: 125021 - protein, 322 aa, Triticum aestivum
  Clone ID: PAT_TA_19439.pep
ILKFFLLIGICCEIAHDDSDKRRRGRRWENHWGSKSGLAPDADQKAKLQYLTSPEGRDDLYWYNQKENRTVLEVLQEFSSVHMPFEWLVQLTPPLKRRAFSISSSPLVHPNQIHLTVSIVSWRTPLKRTRHGLCSTWLAGLSPNEESIIPCWIYRGSLPHPKPSVPLVLIGPGTGCAPFRAFVEERAAQSVTEPTAPVLFFFGCRNQDNDFLYKDFWLNHAQDQGVLSLEKGGGLFVAFSRDQPQKVYVQDKIREQGARVLNMLCSSEATIYVAGSSTRMPADVTAALEEVLCQQGGVPKNDVSQWVTGLKKNGKFIIETWS

SEQ ID NO: 125022 - protein, 177 aa, Triticum aestivum
  Clone ID: PAT_TA_19440.pep
WLLLFYTPLSKGQFVLESVMQDVVHSLDGALRAGKVNCDNEKTLCKRSGVSIGKLARLFIYSYATTEKGSLHEYSGEHDANSLNTFCQEHLPRFSKRVDIGQFSFPLNVLPNLPQVLLLSSKKDTPAMWRAISGMFRNRLIFYDAEVHDVSHPLLKSLGVKNLPAVIGRTVNGEELL

SEQ ID NO: 125023 - protein, 183 aa, Triticum aestivum
  Clone ID: PAT_TA_19441.pep
FERPPGQVPSSVYKSRGIDHLLIPTRDYMFAPSLVDISRAVDFIHRNASRGRMTYIHCKAGRGRSTSAASSLLVKYKNMTPSTAFEHVRSKRARVLLTRSQWRVVQDFSKKNAEAELPTVTSHSAAASPAGNVVSVTEADLESSEVTAANIPDITEHASLSSHKTTPTKPMTNMLSCLIPSLK

SEQ ID NO: 125024 - protein, 200 aa, Triticum aestivum
  Clone ID: PAT_TA_19442.pep
TFESPPSVAYDGMPQTPAAAEWRMVDSIEADRCSDPLKMPKQLDATQVDPVPEKCSQVSRGTQCKSQGGSTRSCKKVHKQGIALGRSVDLTKFNGYTELIAELDEMFDFNGELKGSNKEWMVVYTDNEGDMMLVGDDPWNEFCNMVHKIFIYTREEVQRMNPGTLNSRSEDSLANSMERGSTARETPGSLSASSLDSENC

SEQ ID NO: 125025 - protein, 149 aa, Triticum aestivum
  Clone ID: PAT_TA_19443.pep
MAAAPPRWWPLLLQLAIALGILLAAAEAWTGEIRGRVVCDVCGDAAIGPEDHALEGAEVAVLCITKSGEVINYQAFTNSKGVYTVAETMPESDRWDSCLARPISSFHLHCTRRGDAHSGVKFTYNKPSGNSHTVKPFLYKPATAPLYCS

SEQ ID NO: 125026 - protein, 130 aa, Triticum aestivum
  unsure (1)..(130): unsure at all Xaa locations
  Clone ID: PAT_TA_19444.pep
LNSWKXAXXXPPRSPSHRRFVGSSGSLLSGKLSVTAPVVISGEAAALMEESNRKKKRNLCGTADSYDSRKKRFPNQNASRAGARRTTMDFNARRREIQRALLQIFELRSGPPRISLGRTQDSSATGLAAG

SEQ ID NO: 125027 - protein, 181 aa, Triticum aestivum
  unsure (1)..(181): unsure at all Xaa locations
  Clone ID: PAT_TA_19445.pep
RLDREERITDLPLDNGVRALLRGCTKLRRFALYLRPGGLSDTGLGYIGQYSGIIQYMLLGNVGETDDGLIRFALGCEHLRKLXLRSCCFSERALALAILRMPSLRYVWVQGYKASQTGRDLMLMARPFWNIEFTPPSSENAGRLMEDGEPCVDSHAQILAYHSLAGKRLDCPQSVVPLYPA

SEQ ID NO: 125028 - protein, 86 aa, Triticum aestivum
  Clone ID: PAT_TA_19446.pep
MVLQNDIDLLNPPAELEKLKHKKKRLVQSPNSFFMDVKCQGCFSITTVFSHSQTVVVCPGCQTVLCQPTGGKARLTEGCSFRRKGD

SEQ ID NO: 125029 - protein, 199 aa, Triticum aestivum
  Clone ID: PAT_TA_19447.pep
MDFEADGRFGNKRVHNRLGPAPGAASSSSSTKVCIHWRAGRCNRFPCPFLHSELPEAATTKRPNQRDGPGGHVWRNPNSGGGGRGGGGGFNKWGRGPGGADGGVRHKVPDRPCKFFLAGDCTYGEKCRYPHTYCMSNSITLLTPLQGHEKVVTGIALPTGSDKLYSGSKDGTVRLWDCQTGQCAGVLPVGGEVGCMISE

SEQ ID NO: 125030 - protein, 209 aa, Triticum aestivum
  unsure (1)..(209): unsure at all Xaa locations
  Clone ID: PAT_TA_19448.pep
MASTIMAPTSRVLAAKTPFLGHPRPSNAPVRDIAAAATGRITMSKELWYGPDRVKYLGPFSAQTPSYLRGEFPGDYGWDTAGXSADPEAFARNRALEVIHGRWAXLGALGCITPEVLREWVRVDFKTPVGFSAAALIVAARGLDPPGCPHPAPALGPRPLRRFQVRPTRPVGGGRSTGPPGPGAGTVLAPGGQYFDPLGLADDPRHLRR

SEQ ID NO: 125031 - protein, 78 aa, Triticum aestivum
  Clone ID: PAT_TA_19449.pep
SRSRTIAIAVREAADAIMLSGETAHGKYPLKAVKVMHTVALRTESSLYDPAKAPSLVARPKALLNDDFCKSQLSKMFG

SEQ ID NO: 125032 - protein, 95 aa, Triticum aestivum
  Clone ID: PAT_TA_19450.pep
MALALSGSAAARALAQRLAPATARGYAAAASSGAMRRGAAATADGKAAREAEKAAADASWVPDPVTGHYRPANRAAGADPADLRAAHLGQTYARA

SEQ ID NO: 125033 - protein, 134 aa, Triticum aestivum
  Clone ID: PAT_TA_19451.pep
LQDAIRKAGLQWEGRLHCGLDDALNTAHLLVELMRRGTLLKITGSLEPKRSPPRPEPKAALSCVGPRSVVPTLPPQPQVPLPCAVPTGMDTVPCCFCGVASKLGVVATPGQMQGHYFYGCGWWTPTCSFFMWAI

SEQ ID NO: 125034 - protein, 156 aa, Triticum aestivum
  Clone ID: PAT_TA_19452.pep
EAISLSLSHQTHPQINWHNTGEVGRYMAPSRRRNNSSLFESATIITANLIMASSSFLLSRIAPRVATASPPPPPTMVATSRAPTWSSAATSTRSVEPMAGCKTILMKPVDGQDGKVDQRAEMFIRSFRERTLSETAHFETANAGARPQPQARRCPR

SEQ ID NO: 125035 - protein, 73 aa, Triticum aestivum
  unsure (1)..(73): unsure at all Xaa locations
  Clone ID: PAT_TA_19453.pep
LAPPPSAPPPSRGGRPPVPXPPPSSPXPPRTPPPRPPPPPPPPAASPAPPGGPPPXGGRPAASPRPAPAGSAT

SEQ ID NO: 125036 - protein, 220 aa, Triticum aestivum
  Clone ID: PAT_TA_19454.pep
ICRGRKPAAATAKKGQKRPRQPRFAFMTKSEIDHLEDGYRWRKYGQKAVKNSPFPRSYYRCTNSKCTVKKRVERSSTDPSVVITTYEGQHCHHIGPFQRGGGGGGGGAATARYHSAAAVALAEQMSSSSSFIPARQLYSLPPLHPPQSSLSSEAVVSSAATTSFHQHVNDGDELRQASYSSRVSMAQSPSTPSSVPPAISVEKAGLLDDMVPHGVRHGTP

SEQ ID NO: 125037 - protein, 61 aa, Triticum aestivum
  Clone ID: PAT_TA_19455.pep
MALPASSSGLFRFVSPRSRPQSTDIVAAASWGVFAGTAGLYLVQPFDWIKKTFFEKPEPEA

SEQ ID NO: 125038 - protein, 151 aa, Triticum aestivum
  unsure (1)..(151): unsure at all Xaa locations
  Clone ID: PAT_TA_19456.pep
MAAKEPMRVLVTGAAGQIGYALVPMIARGVMLGXADQPVILHMLDIEFAAEALKGVKMELIDAAFPLLKGVVATTDXVEACTGVNVAVMVGGXSPRKEGMERKDVMTKNVSIYKAQASALEAHAAPNCKVLVVANPANXNALILKELPNLP

SEQ ID NO: 125039 - protein, 116 aa, Triticum aestivum
  unsure (1)..(116): unsure at all Xaa locations
  Clone ID: PAT_TA_19457.pep
MAFTMRAVKVPPNSASLEEARHRVFDFFKQACRSIPTVMEIYNLDDVVTPSQLRSTIAKEIXVKNQNVTNPKVIDMLLFQRQXRSLNNIVXHAKXRHXLIGHMLFXQKGLVQQLGK

SEQ ID NO: 125040 - protein, 197 aa, Triticum aestivum
  Clone ID: PAT_TA_19458.pep
RVFEVCLADLQGDEDQAYRKIRLRAEDVQGRNVLTNFWGMSFTTDKLRSLVKKWQTLIEAHVDVKTTDNYMLRLFCIGFTKRRPNQVKRTCYAQASQIRQIRRKVVEIMANQASTCDLKELVSKFIPEVIGKEIEKSTSSIFPLQNVFIRKVKILKAPKFDLGKLMEVHGDYKEDVGVKLERPVEGDEAMQEVAAAE

SEQ ID NO: 125041 - protein, 211 aa, Triticum aestivum
  unsure (1)..(211): unsure at all Xaa locations
  Clone ID: PAT_TA_19459.pep
MECVLGLVGRDFAVVAADTSAVQSILVHKTDEDKVMVLDSHKLLGASGEPGDRVQFTEFIQKNLHLYQFRNTIPLSTAAAANFTRGELATALRKNPYMVNVILGGYDKDVGXASLYYIDYIATLHKIDKGAFGYGSYFCLSLMDKLYRPDMTVEEAVDLVDKCIKESPLRLGRPPLGFVVTRAGRVPAREYARRELVGDNAPVDAAITVAA

SEQ ID NO: 125042 - protein, 114 aa, Triticum aestivum
  Clone ID: PAT_TA_19460.pep
SGCTTTSTTSWAATAPAAAPQPPPPQAPARRSKPQAALLHRRHSTRPGSPLRLPSSPLPRPAPQASTSTAPPPRRPPSSPPTTRTTPPTELHRRSPLKLLEKRGNGEWREKHVA

SEQ ID NO: 125043 - protein, 118 aa, Triticum aestivum
  Clone ID: PAT_TA_19461.pep
FAALIIEGPQLVQHGFKDAIAKVGLAKLVSNIFLAGLFYHLYNQVATNTLQRVAPLTHAVGNVLKRVFVIGFSIIIFGNKITTQTGIGTAIAISGVALYSVIKAKIEEKKEGVAAAAP

SEQ ID NO: 125044 - protein, 113 aa, Triticum aestivum
  Clone ID: PAT_TA_19462.pep
MSLKEIMHSTDRSGERTVERPRTSSRTGSASRRAVASSSRPASSVEPSEQYNRTSRLFSSNSGSRPSSTQRVNPSPGESRATSLSRAAVARGSRDEPLHRSLELLSLGGGKRK

SEQ ID NO: 125045 - protein, 62 aa, Triticum aestivum
  Clone ID: PAT_TA_19463.pep
LNQNNCTLLFRLQNGISPCKSFYCKSNKQNTPKFPIVYLPKYKKALLFSLLSPALSFKDNLL

SEQ ID NO: 125046 - protein, 70 aa, Triticum aestivum
  Clone ID: PAT_TA_19464.pep
LRLQRLQLLLLNTILLVFAFLCFLLISTFELCNLTEALSHLSLGPHVVHFASMVHLGHHDIDQPTTLRHI

SEQ ID NO: 125047 - protein, 118 aa, Triticum aestivum
  Clone ID: PAT_TA_19465.pep
MRHKLHTFFCSMFAEPLFFSLAQSRDSYSDMLEGGNFSNQETLYEVLSVRKDATYDEIRAAYKSAVLNTHPDKAQMALNPLVSSSERNEFLSVQKAWEILRYPKSRAEYDKQLQSSRQ

SEQ ID NO: 125048 - protein, 111 aa, Triticum aestivum
  unsure (1)..(111): unsure at all Xaa locations
  Clone ID: PAT_TA_19466.pep
LVPNSAEGRLFIHLYPRRRESFACDRRRWPPSRRPWRRRRATASSACAPPGXNPGAATVAVPKPSXRPSPSPPWGSRRRRRPPRRARPLPRTPTLRAQQRGPSKEEHIHGV

SEQ ID NO: 125049 - protein, 200 aa, Triticum aestivum
  Clone ID: PAT_TA_19467.pep
PRVRKHRDEEGKAKDKLKRRTDEKATEADSVAEKGKQEAVVGVAEEKEGHKRKKGNRRSEETKSKENVPVVSGSIENGVGEEHAKKSGSMALKPCSEGAMNKDNVKKDKKRRKEEKKKEKEADMTEQKQSFDTTVGKEQAETSGLMAVMPCLERAQGDMSKDKVKKVKKKKKEEKEAEKTGQQKQTFDTTENAEYAEGDK

SEQ ID NO: 125050 - protein, 162 aa, Triticum aestivum
  unsure (1)..(162): unsure at all Xaa locations
  Clone ID: PAT_TA_19468.pep
MKVIAAYLLAVLGGNTSPTADDVKSILESVGAEADEEKLESCSQNSKDKDITEVIAAGRERYLCAFRWVVQFDMGTPSTVAGXVGATPAEEPKKEEKVXEKEEPDEDMVSTCSIKTPLPVYISPREWPHNIGRCPQNNTVNTPFIRLPCYVQCTPKHLIQEP

SEQ ID NO: 125051 - protein, 139 aa, Triticum aestivum
  Clone ID: PAT_TA_19469.pep
YTGTVQKLPTKSNTDSNIMRCSQVPRFKYLPISAPAISSRSHKSSLQSPSSDSTSKSPWKSYSNGDRSTTPEFDDNASLVGAAPLLKSFVTQVGSKFGENTSRWGSMLSDGQVGKLSDILPGPAAGFFSSFTSGTRYDS

SEQ ID NO: 125052 - protein, 96 aa, Triticum aestivum
  Clone ID: PAT_TA_19470.pep
ESMEWSQGSQQGKILSDAQTPPVPSGLPLVGKGEKSDVTSLCIIAFRFTLWSSVGNLLVVFHYDGSSKDTTLYIKLNHHTGDSHGKVTPGSSNIDE

SEQ ID NO: 125053 - protein, 255 aa, Triticum aestivum
  unsure (1)..(255): unsure at all Xaa locations
  Clone ID: PAT_TA_19471.pep
MEWSQGSQQGKILSDAQTPPVPSGLPLVGKGEKSDVTSLCIIAFRFTLLSSVGNLLVVFHYDGTSKDTSELLTGTIEVAAYFYYLSTLAPSNVRPNARNFIDTGALVIMSYLLLLDINLSFFWLAILPTMAIVFITALYIKLNHHTGDSHGKVTPGSSNIDEKTIKTPMELRIIVVATFGALLVMDQLDDDTAGGFTISQFLLXLSXTVAALTCIXRKLPADRXLGSXPVSELLQKTXLXXXLVTVHTXAAELLG

SEQ ID NO: 125054 - protein, 163 aa, Triticum aestivum
  Clone ID: PAT_TA_19472.pep
MPRGGFSGSLRSPKIDVVIDMGNPFLNRTVDGFLKIGAVGACKVAAEETFECLHRGDVSKHKVEHALKKMCQEGPYWGTVAGVYVGMVYGVERVRGRSDWKNAMIGGPVPRPLSAAASHSRRHQGPIAPSTPGPAATALDFPAGLSFLRYRNCICCALVVLYD

SEQ ID NO: 125055 - protein, 64 aa, Triticum aestivum
  Clone ID: PAT_TA_19473.pep
VGHSKSIVKSWLGIISTNTTLVGLLAEIICTDETTNHLSPVPFKQSIHYTDLTKLTQISWIGRT

SEQ ID NO: 125056 - protein, 105 aa, Triticum aestivum
  Clone ID: PAT_TA_19474.pep
MKPPLERNPSRKRHSWWWHSHISPKNSKWLAENLEEMEKPVTERVELIQEDADSFAKKAQMYYQRRPVLGTRVGYFFRGGRAVPPRQRKANLIKRGPIAQTTNVL

SEQ ID NO: 125057 - protein, 206 aa, Triticum aestivum
  Clone ID: PAT_TA_19475.pep
AQVLVLAAAVYAYAKQGAGPLRPGVDHVEGTVKAVVGPVYDRFHAVPLDLLKFIDRKVGESVEEIDRRVPPVVKEAPTLARSAAKEVREAGLVGTATGLAKSAIARAEPKARELYTRYEPVAERRAAEAWVALNRLPLVPSVTRAVLPTAAQLSARYNSAVRDGAKRGNAVATYLPLVPTERLARVFRYPVADVAAAPEMQPIPSQ

SEQ ID NO: 125058 - protein, 162 aa, Triticum aestivum
  Clone ID: PAT_TA_19476.pep
MAPIAVGDALPDGQLGWFDENDQLQQVSVHALAAGKKVILFGVPGAFTPTCSNQHVPGFITQAEQLKAKGVDEILLISVNDPFVMKAWAKTYPENKHVKFLADGSGAYTKALDLELDMTEKGVGVRSKRFALLADDLKVTVANIEEGGQFTISGAEEILKAL

SEQ ID NO: 125059 - protein, 127 aa, Triticum aestivum
  Clone ID: PAT_TA_19477.pep
VSNVIDLGTVAHAALSTVSVIVYFCCFVMGFGPIPNILCAEIFPTRVRGLCIAICALTFWIGDIIVTYSLPVMLNAIGLAGVFGIYAVVCLIAFVFVFLKVPETKGMPLEVITEFFAVGAKQAAAKA

SEQ ID NO: 125060 - protein, 292 aa, Triticum aestivum
  unsure (1)..(292): unsure at all Xaa locations
  Clone ID: PAT_TA_19478.pep
GGQGTNQVLNSPWDVCYDPTEETVYIAMAGQHQIWKHIVRDGVTKVISGDGYERNLNGSSATSTSFAQPSGISLASEMQELFVVDSESSSIRVVNLKTGGSRLLAGGDPVFPENLFRFGDYDGTGSDVLLQHPLGVAYASDNQVYIADSYNHKIKKLDPVTRKVTTIAGTGPAGYRDGPGLAAQLSEPAGLVDVGDGRLLVADTNNNAIRYITLSDKGAEVKTLELIGVQPPSPKPKALKRLRRRLSADTDVINVDGXSSKEGXLSPAVTVPDGYISPXEARSKIXGGTRLS

SEQ ID NO: 125061 - protein, 358 aa, Triticum aestivum
  Clone ID: PAT_TA_19479.pep
EIAAPHGSIMGGVGRSSTMVGGEAVSSMGIGGGWQLAWKWTEREGADGQKEGGFQRIYLHEEGVSGDRRGSILSMPGGDIPPGGEYIQAAALVSQPALYSKDLIEQQLAGPAMVHPSEAVAKGTKWAELFEPGVKHALFVGIGLQILQQFAGINGVLYYTPQILEQAGVGVLLSNIGLSSSSASILISALTTLLMLPSIGIAMRLMDMSGRRFLLLSTIPVLIVALAVLVLVNVLDVGTMVHAALSTISVIVYFCFFVMGFGPIPNILCAEIFPTSVRGICIAICALTFWIGDIIVTYTLPVMLNAIGLAGVFGIYAVVCILAFVFVYMKVPETKGMPLEVITEFFSVGAKQGKEATD

SEQ ID NO: 125062 - protein, 94 aa, Triticum aestivum
  Clone ID: PAT_TA_19480.pep
SCIQFQTGAEGSKLRRDVSAQGNVGAGPSTRRPVASLPGLGAGFPCLGAISRLVEMQTPLYLERVQHVHSSALQQQQGTPVLAKQSTVSQSAPL

SEQ ID NO: 125063 - protein, 168 aa, Triticum aestivum
  Clone ID: PAT_TA_19481.pep
HEAEALVILASASDLLLRATDGMLVDGEACTLPQLELLEVTARAVHLIVEWGDSGVSVADGLSNLLKCRLSTTIRCLSHPSAHVRALSMSVLRDILNSGQVSSSKPLRGERPIGRRRPASRCFAPTSILAQPVVGSRMGCVARARPPAARSLAFLTAAAKELGCPLPC

SEQ ID NO: 125064 - protein, 188 aa, Triticum aestivum
  unsure (1)..(188): unsure at all Xaa locations
  Clone ID: PAT_TA_19482.pep
MVGRKPMRRRRADHPPPPPPQSFGAAARPTSPRSSTSASAVADLDELLHTPSASEPRSFPHAVKQQCWEKAEKVPGRDPERWRRDALGNIVFRKLVGCPGCLCHDYDHIVPYSXKGGKSTLENCQVLQATVNRSKGNNTEISKSELTQRSAYCRVSGRVLDLLELSAHGNARRGPNSGGYTGRCTTYP

SEQ ID NO: 125065 - protein, 143 aa, Triticum aestivum
  unsure (1)..(143): unsure at all Xaa locations
  Clone ID: PAT_TA_19483.pep
IGLATTTPAGLHRADHSVPLSTMFFPPSTRSSLLEAIHHHHTGVGLSPTTNPPHHTKVGYCTTSVARTSINSCLSFMAYHRARPRLWRESDQPRGCRLPTRQWSQVRCSYFLDIRHYCNCSHLTSLPNVCTLIPASSIPXXRX

SEQ ID NO: 125066 - protein, 60 aa, Triticum aestivum
  Clone ID: PAT_TA_19484.pep
EASLNCCTVHDSWLLPCVIMFLVSLYVSSGGNASRMRNSTVGVHDKLYYHQDGFECLLRE

SEQ ID NO: 125067 - protein, 199 aa, Triticum aestivum
  Clone ID: PAT_TA_19485.pep
MAGGSGGAGGGTGGGDSLARRAWRQYLLQLQRHPLRTKMITAGCLAGVSDSVAQKLSGYQKIEKRRLLLKMIFGFAYGGPFGHFLHKVLDYIFKGKKDTKTVAKKVLLEQITSSPWNNLLFLFYYGYVVEKRPFKEVKTRVKKQYLSVQLSAWMFWPVVGWINHQYVPLQFRVIVHSFVACCWGIFLNLRARAMSLKQS

SEQ ID NO: 125068 - protein, 275 aa, Triticum aestivum
  Clone ID: PAT_TA_19486.pep
MESLLSVLAYASFFFLVLAVFRRICRVPARVIPQPIIEISDAAVTRRALVEYADAFSNRPMSMFRIPIVKGHRRRRSDNIISVPYGPLWRTLRCNLAAETIHPTRYASYAPLRRAAIDDIVASVQSAASKGRAVVVRDGLYAAVFSMIARMCFGEGLVDEADVRVMQCEFREFILAAVESTSSPPSKPPPRARRRPWDPGAVRRPLPAPCPPRCRGAPPLSSRFCDGHARSYVDSLIRLRVPDEDDDNDEHLRRALTEDEMVSLVLEFLGAGTET

SEQ ID NO: 125069 - protein, 57 aa, Triticum aestivum
  Clone ID: PAT_TA_19487.pep
GMLESNHAGSRELPDLAFKRHKNSNLRLHDLTDHITDIQMHMSQEHVKTTLNIFDEF

SEQ ID NO: 125070 - protein, 141 aa, Triticum aestivum
  Clone ID: PAT_TA_19488.pep
TQSFAHTPEYSVFSYPSQPAMPFPPAFFAPGGSPYLVDAKGAPVIPPLSGLSLGISHPSFSTRATPPSSNELSYFHPSMDFSYGVPSEGARREAGSYWPVSYQGQTMFVDERMRNVSQGGSSGLVLKRKEPESGWDMYSRR

SEQ ID NO: 125071 - protein, 161 aa, Triticum aestivum
  unsure (1)..(161): unsure at all Xaa locations
  Clone ID: PAT_TA_19489.pep
MAKEPMRVLVTGAAGQIGYALVPMIARGVMLGADQPVILHMLDIPPAAEALNGVKMELVDAAFPLLKGVVATTDVVEACTGVNVAVMVGGFPRKEGMERKDVMSKNVXIYKSQASALEAXTPNCKVLVVPTSKHKLLPERIAHLSREQVTAYRLDQGLGKF

SEQ ID NO: 125072 - protein, 121 aa, Triticum aestivum
  Clone ID: PAT_TA_19490.pep
MGIVDVVSEYCSLPRSRRHMKRRKQFQTVEMKVRIDCEGCERKVKKALDDMKGVSSVEVIPKQNKVTVTGYVDPAKVMRRVAYKTGKRVEPWPYVPYDVVAHPYAPGAYDKRAPAGYVRNV

SEQ ID NO: 125073 - protein, 155 aa, Triticum aestivum
  Clone ID: PAT_TA_19491.pep
MGIVDVVSEYCSLPRSRRHMKRRKQFQTVEMKVRIDCEGCERKVKKALDDMKGVSSVEVIPKQNKVTVTGYVDPAKVMRRVAYKTGKRVEPWPYVPYDVVAHPYAPGAYDKRAPAGYVRNVMSDPSAAPLARASSTEARYTAAFSDENPNACSVM

SEQ ID NO: 125074 - protein, 155 aa, Triticum aestivum
  Clone ID: PAT_TA_19492.pep
MGIVDVVSEYCSLPRGRRHMKKRKQFQTVEMKVRIDCEGCERKVKKALDDMKGVSSVEVTPKQNKVTVTGYVDPAKVMRRVAYKTGKRVEPWPYVPYDVVAHPYAPGAYDKRAPAGYVRNVMSDPSAAPLARASSTEARYTAAFSDENPNACSVM

SEQ ID NO: 125075 - protein, 155 aa, Triticum aestivum; identical to SEQ ID NO: 125073
  Clone ID: PAT_TA_19493.pep

SEQ ID NO: 125076 - protein, 87 aa, Triticum aestivum
  unsure (1)..(87): unsure at all Xaa locations
  Clone ID: PAT_TA_19494.pep
LKQWVAKRWSSGGENSHTWVSIYNLRTLYKPSGRPLLSYTKXYKTSTVPHLPRLXEPKWVRSVRTVPKTWPDQGFFAFGRVLKLWGY

SEQ ID NO: 125077 - protein, 151 aa, Triticum aestivum
  Clone ID: PAT_TA_19495.pep
MDPALRRRSRLPIHLLLVAVTLLAALAARSGAEVITLTEETFSDKIKEKDTVWFVQFCVPWCKHCKSLGTLWEDLGKVIEGTDEIEIGKVDCGASKPVCSKVDIHSYPTFKVFYDGEEVAKYKGPRDVEALKTFVLKEAEKAGEVRLEDEL

SEQ ID NO: 125078 - protein, 662 aa, Triticum aestivum
  Clone ID: PAT_TA_19496.pep
YFRPASIVPPTRIASREPRIIGNFSPVTYVDLTLNFCSSARRGRRRDADYRPELCRGTVEFIATKEFLVREPMPAVYFFLVDVSMNAIQTGATAAACSAISQSLSDLPEGPRTMVGIATFDSTIHFYSLKRAQQQPLMLIVPDIQDVYTPLQMDLILPVSECRDSLEQLLESIPSMFENNRVADSAFGAAMKAGFLAMKPTGGKLLVFQSVLPSVGTGSLSARETEARSNISTGDKEAHKLLQPVDKTLKTMALEFAEYQVCVDVFLATQSYTDIASISVVPSTTGGRVYYYFPFSAVSDPAKLFNDLRWNITKPQGFEAVMRVRCSQGLQVQDYSGNFCKRVPTDIDLPAIDSDKTIMVTFKHDDKFQENTECGFQCALLYTTVYGQRRIRVINISLPCTSTLNNLFRYADQEAQFTYVVKQAANGIPSSSLSQVRDQVISTCINILQSYRKHCASVSSSGQLILPEALKLLPLYTLALIKSIGLRNDGRVDDRSYWVSIVSSVSVLLAIPLVFPRMIALHDLTSRDDEDSLIPNPLTLNSENIQDDGIYLLENGEDGFIYVGNAVNPATLEQIFGFSSLAGAPNLLALEQFDNALSRKVNEVVNEIRRQRCSYLRLRLCRKGDPSGDFFRSLLVEDKTPGGLSYVEFLVHVHRQIQSKMT

SEQ ID NO: 125079 - protein, 267 aa, Triticum aestivum
  Clone ID: PAT_TA_19497.pep
SQMSIDRTRAVVKDLYSRICVAIQRIDMISKNIEDLRDKELQPQLEELIGSLTRMWETMLECHRHQHEIIKLVSNSGGIKVLIRSESQFQATLLLQVELKSLFSNFQRWIVSHRSYLNSLQSWLLKCVKSLRTKKKSRKKKDTNFQITNFAVAPIFTICEQWIQLLDELPIEDLEGGIKGLLADINHCMPRQEKRRGGSRSTFAIANGGLNDEMRGIHRNAAHTDLQSSLESFLGKLEFFSDVSVHKYGELKKKVNTAKEKYEQQNK

SEQ ID NO: 125080 - protein, 189 aa, Triticum aestivum
  unsure (1)..(189): unsure at all Xaa locations
  Clone ID: PAT_TA_19498.pep
MSDEGEDAPVAAVAAGFGLPEELAAVLPADPFEQLDVARKITSIALASRVGRLEAEAAGLRAQLARRDDAAEDLRERVEQLESALALATDRLSRAEDDKETLLKEKATLSNTVNKLNRDVAXLEIFKKTLMQSLQEDDDKPNIPKAKLTETSNFSRAPSVGDEDSALTTSKSSQWSQTARSATLLARID

SEQ ID NO: 125081 - protein, 168 aa, Triticum aestivum
  Clone ID: PAT_TA_19499.pep
MASSTMALSSPAFAGKAVKPAASDVLGSGRVTMRKTVAKPKGPSGSPWYGSDRVKYLGPFSGEPPSYLTGEFPGDYGWDTAGLSADPETFARNRELEVIHSRWAMLGALGCVFPELLARNGVKFGEAGWFKAGSQIFSDGGLDYLGNPSLVHAQSILAIWATQVILMG

SEQ ID NO: 125082 - protein, 205 aa, Triticum aestivum
  unsure (1)..(205): unsure at all Xaa locations
  Clone ID: PAT_TA_19500.pep
LVANVESMIKADRKITPLKQLQGHIWRTGFQKKELQGVVFEDVPVALKNWHXSGIKVYIYSSGSKRSTKAXLLGNTTYGDLRKFLCGYFDTTXGNKRETRSYFEISQSLGXVDSPSQILFITDVFQEAVAAKNTGFXXIISIRPGNAPLPDNHGSRTIISLREVGAGCGSAHVGSHGLTPAFLGYNISPRTSSCSGNSITPQHGM

SEQ ID NO: 125083 - protein, 144 aa, Triticum aestivum
  Clone ID: PAT_TA_19501.pep
VLITLAVSLKPLHPQCTAGGDCAPATRQQVAFLYAALYTMAIGAGGTKPNISTFGADQFDDLDAREREIKASFFNWWLFSSFAGGLVAVLVLVYVQEEVGWGVGYTIPTVGLALSLVLFYVGTPFYRHKPVTRSTAAGPARLIG

SEQ ID NO: 125084 - protein, 359 aa, Triticum aestivum
  unsure (1)..(359): unsure at all Xaa locations
  Clone ID: PAT_TA_19502.pep
MEKASLEEALLPRSPVCKELGEDESLGLGVGDEVKRQLWLAGPLIAGCLMQNLIQMISVMFVGHLGELPLAGASMASSFAAVTGFSLLLGMASALDTLCGQAFGARQYHLLGVYKQRAMVILTLVSIPLAVVWFYTGEILLLFGQDPDIAAEAGTYARWMIPAIFAYGLLQCHVRFLQTQNIVFPVMASAGAAAAFHLLVCWLLVYVAGMGSKGAALSNAISYWVYVIVLAVYVRVSSSCKETWTGFSAEAFRDVLSWPRLMVCLEMWSFELIVLLSGLLPNPKLETSVLSISLNTAAFVWMIPFGLGSAISTRVSNELGAGRPDAARLAVRVVVFLAMAEGXSMGLVLICIRYVWGHA

SEQ ID NO: 125085 - protein, 152 aa, Triticum aestivum
  Clone ID: PAT_TA_19503.pep
TKSDIVAKADGTFVPRERRKRVDEKPEKKQKREHHHDASQIGMGVNAYPGVYGAPQLTQIPIAGGQRVIMPEIIVPNNILFVQNLPHETTPMMLQMLFCQYPGFKEVRMVEAKPGIAFGEYGDEGQATAAMNNLQSFKITKENQMVITYAKK

SEQ ID NO: 125086 - protein, 192 aa, Triticum aestivum
  Clone ID: PAT_TA_19504.pep
PFRLADLVGFGVAVATGKQYYKSYPERCYKSRLTEIMLEENRTGESSHRGFYLYNDKRQASPDPDIKKYVEKSRNMAGVAQDPKLMKLTDKDIVEMVFFPVVNEACRVLDEGIALKASDLDVASIMGMGFPSFRGGVMFWADSLGAEYVYRRLDAWSKDYGEFFRPCEYLAARASRGTSLAATTADGTKSRL

SEQ ID NO: 125087 - protein, 86 aa, Triticum aestivum
  Clone ID: PAT_TA_19505.pep
ENSGTWKSRAPEAFRGQTNRQGAPKADAATTRKTMNEAAREAVGQGPRGQAWEGLAGAPGLSGEQRQRLTIAVELVANPSIIFMDE

SEQ ID NO: 125088 - protein, 198 aa, Triticum aestivum
  unsure (1)..(198): unsure at all Xaa locations
  Clone ID: PAT_TA_19506.pep
ELPEDIIHRIHPRVPIQDAARAACVSRRFLHSWRSYSSLILSDRTLGLDDTDFEERKTHLIDKVDRILKNHYGNGVKVKTLKLELGLCSDIKASYLDRWAPESLNLGFQRIQLGCCLXLMNKTYNFPCSVLSXNEAAASSIQSLSPFGCAFHPTSILGCLRRLKSLHLCHVNVTEDGLGLLRSSPAPLERLVWDARSA

SEQ ID NO: 125089 - protein, 131 aa, Triticum aestivum
  Clone ID: PAT_TA_19507.pep
MLCNWLNHIYVCLTCVCATYLQLVGAARRDHSLGIIQKDIIQTVNNHPNAGWTAGHNPYLANYTIEQFKHMLGVKPTPPGLRAAVRTKTHSRSEQLPKVFDARSKWSGCSTIGKILDQGHCGSCWAFGAVD

SEQ ID NO: 125090 - protein, 138 aa, Triticum aestivum
  unsure (1)..(138): unsure at all Xaa locations
  Clone ID: PAT_TA_19508.pep
EKKAATPGRIKPIVYKYVRFKTVAGSGVAARTPSRGADLKAEKGADRRIAAPAPASPSPGNHFCSLAPVPCDSLQLLPCLKGGVGEXGEASPPAAATPAACFPPVAGRRRWGGYSRWRCSSSSLPPPLPPRFGSSRLI

SEQ ID NO: 125091 - protein, 353 aa, Triticum aestivum
  unsure (1)..(353): unsure at all Xaa locations
  Clone ID: PAT_TA_19509.pep
MGGVGVSLALLVAVVLSAVAAAPQLAGTAKAEHSLGIIQKDIIQTVNKHPNAGWTAGHNPYFANYTIEQFKHILGVKPTPPGLLAGVPIKIHPEMDLPKEFDARTQWSSCSTIGNILDQGHCGACWAFAAVEALQDRFCIHLNMSVSLSVNDLLACCGFLCGSGCNGGYPISAWRYFRRSGVVTEECDPYFDQTGCQHPGCEPAYPTPKCQRKCKVENQAWKENKHFSVNAYRVHSNPHDIMAEVYKNGPVEVAFTYCQILDFAHYKSGVYKHITGGVMGGHAVKLIGWGTSDAGEDYWLLANQWNRGWGDDGYLXIIRGENECGIEGDVTAGMPSTKNTARNNDVAFGTAIL

SEQ ID NO: 125092 - protein, 343 aa, Triticum aestivum
  Clone ID: PAT_TA_19510.pep
MGSLLPLALLVVLSAAAAAPQLVGAARRDHSLGIIQKDIIQTVNNHPNAGWTAGHNPYLANYTIEQFKHMLGVKPTPPGLRAAVRTKTHSRSEQLPKVFDARSKWSGCSTIGKILDQGHCGSCWAFGAVECLQDRFCIHHNMNITLSANDLVACCGFMCGDGCDGGYPISAWQYFVQNGVVTDECDPYFDQVGCKHPGCEPAYPTPVCEKKCKVQNQVWEEKKHFSINAYQVNSDPHEIMAEVYNNGPVEVAFTVYEDFAHYKSGVYKHITGGVMGGHAVKLIGWGTSDAGEDYWLLANQWNRGWGDDGYFKIIRGKNECGIEEDVTAGMPSTKNIAGSAFAI

SEQ ID NO: 125093 - protein, 97 aa, Triticum aestivum
  unsure (1)..(97): unsure at all Xaa locations
  Clone ID: PAT_TA_19511.pep
MKQTLKDYDINVKNVPLFCDNETAIKIAHNPVEHSKTKHIQIRHHFLRDHVLKGDISIEHVKTEEQLADIFTKPLXDEKRFSKLRCELNILESSNVL

SEQ ID NO: 125094 - protein, 177 aa, Triticum aestivum
  Clone ID: PAT_TA_19512.pep
HASAVKQCDVFRESSGAFDSTAHAPGDEGNGKRLGIFDARARLGDEICRKQEEGHDLTLVEEISSRNVVAGLAGSGEVSAKAFSATQSDCDGGSSAVIPVFTVHVVDSDDVCSGVREHQKKPEECNKQGEKGKLADKIRVFEKAATSGEGKSVKALCSVNKYPSKLHEKLAALEGRV

SEQ ID NO: 125095 - protein, 70 aa, Triticum aestivum
  Clone ID: PAT_TA_19513.pep
CLLDSITSPYSSCRTYFLCTINRSNICNLVEKRSPTRRRDQAGGGGGGRGGGRFLLSPPQLIFPFNSGRV

SEQ ID NO: 125096 - protein, 216 aa, Triticum aestivum
  Clone ID: PAT_TA_19514.pep
MDQKGQSTDSDSCVLEMDQLAHELESKLATLNSSKAQVLDRRRPCSIIVGKVRDLTRNVDSSEYDPDHVDIGPYNYPRPQSKSPHLALEHDKLASLDLVLSAAKAARPAMTVEVYVKELACLERDTRNCYANTFDDMTSEQFVRMLLLDACYILSRLVGLRAHHLDLDDVGTAEAAVSSANRAEALAVVRDVFYLAENQIPFFVLEKIGELTTLGR

SEQ ID NO: 125097 - protein, 95 aa, Triticum aestivum
  Clone ID: PAT_TA_19515.pep
ALLRDPAILVLDEATSALDAESEHYVKSVITEVSTDPKARRTVIIIAHRLSTIQAADRIIVMENGSIVEDGKHSDLVKQNGLYSRLAQRQNDALP

SEQ ID NO: 125098 - protein, 367 aa, Triticum aestivum
  unsure (1)..(367): unsure at all Xaa locations
  Clone ID: PAT_TA_19516.pep
MAGRREPPLMRTGLGSGQPPSRGSRIAAAVAVGVTLGCVCAFFYPDGLISRSTDSALHWRRRADSVTCETSEEVTNLQSQLASLERKNADFRKQINELSMKLQMAGQGKNQALYSAGPFGTVKALRTNPTVMPDESTNPRLAKILQQVAVKKEIIVAVANSNVKQTLEMWFTNIKRVGITNYLVVALDDSIENFCKSKDVPVYRRDPDEGIDSIGKTGGNHAVSALKFRILREFLQLGYSVLLSDIDIMFFQNPFDHLYRDSDIESMSDGHDNMTAYGFNDVFDEPSMGWARYAHTMRIWVFNSGFFFIRPTXIPSVEPLDRVAGRLSREPKSWDQAVFDHLPPLPLLAPRHGRLHPSELRRPLDYL

SEQ ID NO: 125099 - protein, 434 aa, Triticum aestivum
  Clone ID: PAT_TA_19517.pep
HASALRGKRRRETVCYAAKDASCPDGLARVNRVVRGNLRLRLGDLVTVVPCPGVKDAARVAISPFEDSVDGISGNLFDAYVKPYFIGAWRPVRKGDRFVVHGHMHAVEFPRVRARPGGRVGVAAGTQVFCDDASPVKREDEERLDGPGYDDVGGVRKQLAQIRELVELPLRHPKLFKTLGVKPPKGILLYGPPGTGKTLLARAIAAESGANFVVVNGPEIMSMMAGQSEDNLREVFARARAQAPSIIFMDEIDAIAPNREKTHGEVERRVVSQLLTLMDGLRPRAQVMVIGATNRPNSLDPALRRFGRFDKEIDIGVPDEVGRLEILRIHSKDMPLSDDVDLERIGKDTHGFVGADLAALCSEAAFQCIRQKMDVIDLEADTIDVEVLNSMSVIMDDLVHAKEVTKPSALRETGLVEVPKVSWEDVGGLEDVSG

SEQ ID NO: 125100 - protein, 145 aa, Triticum aestivum
  Clone ID: PAT_TA_19518.pep
SVVAAEVRSNKHCLTVDDLPAALASGSLNLLATVRKWHSSQGVVGCQEEIGKKRYLQIISEHCVCQGDVSSVSRDCACHLESSAEAEASNKERHSLCGQSLSFFFKDGVLMPQDLTAGTTLHCSFKTLCVCSLPGTISMLVQIPS

SEQ ID NO: 125101 - protein, 175 aa, Triticum aestivum
  Clone ID: PAT_TA_19519.pep
TRPQIESTRYIFEPRTILRMELLVLTALNWRLRSVTPFTFIDFFACKVDPRGRHMRYLIARATQIILAAIHDIEFLDHCPSSMAAAAVLCAAGETPSLTLLNPRLPAGCPGRPARPGVSSCYQLMQQLVGGKRAKTTAAAAVNLCSDEVLSCDSSSCTTPPPPKRRKRSPPPVIT

SEQ ID NO: 125102 - protein, 138 aa, Triticum aestivum
  Clone ID: PAT_TA_19520.pep
MDELYVQALVLAAVAVALLQLLKAALNPMRERAPPGPWKLPVIGSMHHLVNVLPHRKLRDLADAHGPLMMLQLGQTPLVVASSKETARLVLKTHDSNFATRPKLLAGEIVGYEWADILFCPFGDYWRNNPKRVVTFRI

SEQ ID NO: 125103 - protein, 129 aa, Triticum aestivum
  Clone ID: PAT_TA_19521.pep
FFFFQEKIAWIQIGERRPTNRFVQASTTHYNRDYTGLINPQHYHHTTNLAHACTRIRTRHHIPKSTPQGTGAATKVQPLNAEEILLRRGVLWPVLMLLLFSFGGGLRPRRAGGHRRRPWHVGQDLHGRV

SEQ ID NO: 125104 - protein, 123 aa, Triticum aestivum
  Clone ID: PAT_TA_19522.pep
PRVRVFKPPRRGYYWSYYIITSSQELESALAHPLAQTYPVVLMFWASWNEPCRVMMRPFRAMAVAKRRAAIFCQVDVDKFKDIVERYRVEALPTFLLLKQGVEKGRVVGAKVGDLSNIIMANI

SEQ ID NO: 125105 - protein, 263 aa, Triticum aestivum
  Clone ID: PAT_TA_19523.pep
MGVPAFYRWLADRYPQTVSDAEEEEPVELEPGACVPGAPRRPNPNGLEFDNLYLDMNGIIHPCFHPEGRPSPTTYDEVFKSIFDYIDHLFCLVRPRKILYMAIDGVAPRAKMNQQRSRRFRAAKDAADAAAEEERLRLEFEAEGRNLVRKEKSEAIDSNVITPGTPFMFVLSSALQYYIQLRLNHSPGWQSVKVILSDSNVPGEGGRRLSSYFRRPRMLPGWGPITPRLLSGRGAVFLGLALAPPVAHFALLRVGSSLPGQLV

SEQ ID NO: 125106 - protein, 93 aa, Triticum aestivum
  unsure (1)..(93): unsure at all Xaa locations
  Clone ID: PAT_TA_19524.pep
MGNCQAAEVAAAVVQHPGGRVERLYWSTPAAEVMRANPGHYVALVTLPGRRGAPGRRPRRRAPHRAXSTRVKLLKPKETLPLGHVYRLITANK

SEQ ID NO: 125107 - protein, 313 aa, Triticum aestivum
  Clone ID: PAT_TA_19525.pep
MASSGAFMVAAVLGLVLASAPAARAWSTEGHMLTCQIAQDLLEPAAAQAVKNLLPEEAGGDLSAMCVWPDQVRHWYKYRWTSPLHFIDTPDKACTFDYARDCHDPSGAKDMCVAGAVANFTSQLMHYKQGSADRKYNLTEALLFLSHFMGDIHQPMHVGFTSDMGGNSVNLRWFKHKSNLHHVWDREIILTVLAERYGKDMAAFRKDLQHNITKGSWSDESSWKDCADLMSCPTKYATESIGLACKWGYDGVHDGDTLSEDYFGSRLPIVTRRIPQGGVRLAMFLNRVFGDHKPHSRDVAAPVNLVAAHDDEL

SEQ ID NO: 125108 - protein, 84 aa, Triticum aestivum
  Clone ID: PAT_TA_19526.pep
PGFGGQSFIESQVKKIADLRKLCEEKGVNPWIEVDGGVSPKNAYKVIEAGANALVAGSAVFGAKDYAEAIKGIKTSKRPVAVAA

SEQ ID NO: 125109 - protein, 273 aa, Triticum aestivum
  Clone ID: PAT_TA_19527.pep
MASPSSSLCSSLGYPRAASLGARRRAGFSSSRKLFQVKASRVDSFSKSDIIVSPSILSANFAKLGEQVKAVEVAGCDWIHVDVMDGRFVPNITIGPLIVDALRPVTDLPLDVHLMIVEPEQRIPDFIKAGADIVSVHCEQTATIHLHRTVDQIKSLGAKAGVVLNPGTPLSAIEYVLESVDLVLIMSVNPGFGGQSFIESQVKKIADLRKLCEEKGVNPWIEVDGGVSPKNAYKVIEAGANALVAGSAVFGAKDYAEAIKGIKTSKRPVAVAA

SEQ ID NO: 125110 - protein, 112 aa, Triticum aestivum
  Clone ID: PAT_TA_19528.pep
MAARRNIPYSVLPTEDRDEDNIDRRFTYTPKSLRRIPWKSIALALFLLFLGSSLLFLSYFIFTGHMEGDSTQVYGLLFLGILAFLPGFYETRVAYYSWRGAPGYTFASIPDY

SEQ ID NO: 125111 - protein, 103 aa, Triticum aestivum
  Clone ID: PAT_TA_19529.pep
RVIHTPGDYCPSKYPRKKKENAQGGGCPRRGGTVLRREPPPGSWSMSEEAVRIVVHPCPPPEEQKKECSVWPPDCCSCSFEVGRRPPAGTPLPAGAYWRRSPT

SEQ ID NO: 125112 - protein, 230 aa, Triticum aestivum
  Clone ID: PAT_TA_19530.pep
MGGDATEIAILHAPGPQEMASLPIPDELLPEIFLRLPTPADLVRTSAACVSFRGVVTDRPFLRRYRKIHAPPLLGFLDLNGVFHPAEPPHPFTSAAEAFADFSLSFLPAPASDWAIQDIRDGRVLLGRRGVFTEFVVCDPLHRRHILLPPIPDVNQWLPSVDNSHIFLMGGDEDASDETFFRVIYVAVNQHKQVALVFSSSTGQWRATPPSIVRSPNSYWLQCAYGCLYG

SEQ ID NO: 125113 - protein, 129 aa, Triticum aestivum
  Clone ID: PAT_TA_19531.pep
MRNGSTVCDAAAAVGLGVAPRYRGVRKRPWGRFAAEIRDPAKRARVWLGTYDSAEAAARAYDVAARTLRGPLATTNFPHDLVSFPTLPALPRPSPPASPGPACSASSTVESYSGPRAANAPPAVPRAPA

SEQ ID NO: 125114 - protein, 186 aa, Triticum aestivum
  Clone ID: PAT_TA_19532.pep
MSMAATRMLARRAAPGLLRSAASPGLALPAVLQAQGRWYRAAGGDPSPSFYEPPPTPANLGLSIVPEKKAFVVERFGKYLKTLSSGIHLLMPGVDRIAYVHSLKEEAIPIPDNSAITKDNVSIQIGGVLYVKIVDPYMASYGVENPVYAVIQLAQTTMRSELGKITLDKTFEERDTLNTNIVKSIN

SEQ ID NO: 125115 - protein, 200 aa, Triticum aestivum
  unsure (1)..(200): unsure at all Xaa locations
  Clone ID: PAT_TA_19533.pep
TRPYKVMISVAESEPIILYIRDVDHFLHRSQRTYTMFQKMLAKLSGQVLILGSRLLNSDAEYSDVDDRVSSLFPYHVASEPPQXEIHLNGWKTQMEEDARKIQIQDNRNHIVEVLSANDLDCDDLSSICQADTMVLSNYIEEIIVSAVSYHLVHTKDPEYKNGKLLLSSKSLSHGLSIFQETGLGGKDTLKLQANEDGLK

SEQ ID NO: 125116 - protein, 165 aa, Triticum aestivum
  unsure (1)..(165): unsure at all Xaa locations
  Clone ID: PAT_TA_19534.pep
MASLPVPSVQAMVAATGGADVSPRYLRPAEAVAGDSEAQIPIIDYQRLLLELELDRYGEESARLHGACQDWGFFQLINHSVPDDVVEGMKASIQQFFQLPMETKKQFAMERGQLEGYGQLFVFSEDQKLDWADILYLYTXPHESRNTKLWPDNLPIKFRCLIDGP

SEQ ID NO: 125117 - protein, 277 aa, Triticum aestivum
  unsure (1)..(277): unsure at all Xaa locations
  Clone ID: PAT_TA_19535.pep
MPQHQAIRPRPGAGDADDDAVTVFLFHFLNCAVLTFGPHVVYYSATPLSEYDTIGTSVKAAVVYLGAALVKLVCLATFLKVPDANDSFDPYQELMKILIGFIDVAGLYFALTQLTHRNISQNHKFQAVGLGWAFADSVLHRLAPLWIXARGLEFYLGEYIFQGLEANANLVMTLSLAALGSLMWLRKNKPRTLIPIIYACALLLATMPSITSYLXWQTPKVVGFRGLLLXLVMAFISWQLFSACQRPMCNQQEQSTASFNRRSGAPEMSLFWYLGQN

SEQ ID NO: 125118 - protein, 71 aa, Triticum aestivum
  Clone ID: PAT_TA_19536.pep
GNGRIQSCVLEVTTVHMRVLHPQRRHALCSMYSTLHYISYDDMQYVVCRVLEPFLTFTPGLSGVSHISTNF

SEQ ID NO: 125119 - protein, 157 aa, Triticum aestivum
  Clone ID: PAT_TA_19537.pep
MAASYYNPPPPRASYATLPPPPPGTSSYGTYRQHEHAYLAAHPPPAYGGYFDRAEPLAPPRDELRTLFIAGLPADVKPREVYNLFRDFPGYVSSHVRSGKSTQSYAFAVFADQPSALAAMSATNGLTFDLEKNCSIHVDLAKSNSRSNSSKRPKIRL

SEQ ID NO: 125120 - protein, 147 aa, Triticum aestivum
  unsure (1)..(147): unsure at all Xaa locations
  Clone ID: PAT_TA_19538.pep
MQLAALCTDPFVLSCTLLCLLLHLALRHSLNRSSRLPPGPPGVPILGAMPFVGPAPHTGLAALARKYGPVMYLRMGTCGVVVASSPSXARTFLKALDARFANXPAXXSAADITYGRQNMVFADYGPKWKLMRKLSSVHLLGARXXAX

SEQ ID NO: 125121 - protein, 298 aa, Triticum aestivum
  unsure (1)..(298): unsure at all Xaa locations
  Clone ID: PAT_TA_19539.pep
MGTAGKGAWVVPAPAYKEVEGWEGXXDXSPGYRCGHSLTVIAPTKGHGPRLTRPGGPAPPAPPATSGLPGIRLAGVTNTVHSYDVDKRRWTRLHPAGDPPSPRAAHSAAAVGTMVVFQGGIGPAGHSTDDLYVLDLTNDKFKWHRVVVQGAGPGPRYGHCMDLVAQRYLVSVSGNDGKRVLSDAWALDTAQKPYKWQKLNPDGDRPSARMYGTASARSDGMLLLCGGRDASGTPLSDAYGLLMHTNGQWEWTLAPGISPSPRYQHAAVFDGARLHVTGGVLRGGRAIEGEGAIAVLDT

SEQ ID NO: 125122 - protein, 235 aa, Triticum aestivum
  unsure (1)..(235): unsure at all Xaa locations
  Clone ID: PAT_TA_19540.pep
MQHLTLAASLSAAVLFACILYAESAPRVPDKQALLAGAASLPHGRKLNWSSTTPVCTSWVGVTCTPDNSRVHTLRLPAVGLFGPIPSDTLGKLDALEVLSLRSNRLTVDLPPDVGSIPSLHSLYLQHNNLSGIIPTTLSSSLTFLDLSYNTFDGEIPLRVQNLTGLTAILLQNNSLSGPIPDLRLPKLRHLNMSNNNLSGPIPPSLQKFPASSFXXNAFLCGLPLXPCPXXAPSP

SEQ ID NO: 125123 - protein, 153 aa, Triticum aestivum
  Clone ID: PAT_TA_19541.pep
HASDPDEVKDSERPTKIRLPQPDDHVRCSTAIKESVRDVVLGGGEYIVNDLKFTVNHAVEPINEKIHQISQNMKKHDKDKTNDDSCIDSPRSLHRVISGIDDPLLNGSLSDNSGPKRARRQQRRRLGAVISGESSDHGLGGYEIRGHRWITKE

SEQ ID NO: 125124 - protein, 232 aa, Triticum aestivum
  unsure (1)..(232): unsure at all Xaa locations
  Clone ID: PAT_TA_19542.pep
GQTPAPVTLEIRVDRRAHGDFTGDVVKSDKDSHPTGTSCIAWXKDNKDHRGKRCVDQPDDTAGWRFLRPGMQGTDETLKVQTIVEERSSKDAHESTGENKIEPKSEDKFRDKDRRKKDEKYRDFGARDADRNDRRIGIQLAGGSVERREIQRDDRDAEKWDRERKDSQKDKENNDREKDSAKKDSFVAVDKENTILEKTASDGAVKPAEHESTAAEMKTLKDDTWKSHDRDL

SEQ ID NO: 125125 - protein, 332 aa, Triticum aestivum
  unsure (1)..(332): unsure at all Xaa locations
  Clone ID: PAT_TA_19543.pep
EFPGRPRVRGIGRSRRMPVPKVTMQHNVMIEAVXNHMXEVIVIDEIGTELEAMAASTIAQRGVQLVGTAHGVTIDSIIKNPCLQMLVGGIESVTLGDEEAKKRKVQKTILERKGPPTFSCAVEMVSKTECRVHHKLESTVDAILAGKPPKFEARMMDSKITESGGSLVISERVSETERLPAYHQDLVTRAVTSEDKFIDDFGSSRQAKSKNIPSDDNAPVRVYTYQVSEXDILQVATVMGFXDELDITDDIEAAXVIXASSSEMKQXSXDPXCCQVHKLXXFVVKXNTMAQIVRLQKIVGRITCPARSTKVWKIKLKYLQRLLNCAWRCIDH

SEQ ID NO: 125126 - protein, 91 aa, Triticum aestivum
  Clone ID: PAT_TA_19544.pep
VMSYILELASWRSSDHLFNKLMEIWLRKMRCRYRNKVHQQVQQLISPIGTGTSSIRDHPLVMNMRSHILPRSIVGPDQLLHFDLLRQGESC

SEQ ID NO: 125127 - protein, 126 aa, Triticum aestivum
  unsure (1)..(126): unsure at all Xaa locations
  Clone ID: PAT_TA_19545.pep
MVQEQKGETSSGMYTYKHHGDKGVDIHEIFVKKSRTRVLLSYCGLILLLAIVCRSLLGKEKLCLESVWSVTFGILVAKCLQYKPVKKESVVIMPSFGVQLEIHXLXSGRVDRHFVPIGKILKPLLN

SEQ ID NO: 125128 - protein, 163 aa, Triticum aestivum
  unsure (1)..(163): unsure at all Xaa locations
  Clone ID: PAT_TA_19546.pep
LKESXNITLFWITMLXXLWQSLVLFRAPFFPSTHASVDIWSMGSLWTIAVVILVNIHLAMDIQRWVLITHLAIWGSIAATFLCMVLIDSIPIFPNYGTLYNMAASRTYWLSVCLIIVLGLLPRFLCKVIYETFWPSDIQIAREAELLKKLPQQLRSRPESDIS

SEQ ID NO: 125129 - protein, 76 aa, Triticum aestivum
  unsure (1)..(76): unsure at all Xaa locations
  Clone ID: PAT_TA_19547.pep
MAEKKGNILMERYEMGRLLGQGSFAKVYYERNLKTSQSVAIKVIDKEEIFKCGLMDQVRREISVMKXVKHPNIVQL

SEQ ID NO: 125130 - protein, 181 aa, Triticum aestivum
  Clone ID: PAT_TA_19548.pep
DPRVRAVRSCLARDAVPMSPAPLLPYLDTLLQSLEDGLGQFTSMDWANKEAKLSSSEDGSQIFEAVGLLIGIEEVSPEKQVQCLTALLNPLCHQIESLVMGAKAQGLEESSPRATSLLQIVVALNMVTKGFNERLVMISRPTIGVMLKKTLDVVLQLLVSFPNARPLRSKDISFLHRMIEI

SEQ ID NO: 125131 - protein, 219 aa, Triticum aestivum
  unsure (1)..(219): unsure at all Xaa locations
  Clone ID: PAT_TA_19549.pep
SRTTPVKCPRGASVSVPYSCCRAVARRRRLTARPQPLRAGRRRRRPRSTSRRPCRFGHWPLRFRSSRSDRGEMETNEKNANDLEEKNQPSGHSQQPSFHGPGFSLSPEPQMDSSSSALAAMGNPFPPGLWNPPGQNFGLGETNTNAMLNGHLPPAAGGMLSDSDARISRTPRRGSWIVEHGFPGLSAXSLGAMMDHPFSRNPPMGSFQNDIETSREMNV

SEQ ID NO: 125132 - protein, 262 aa, Triticum aestivum
  Clone ID: PAT_TA_19550.pep
GRPTRPQDIFNITAKAVRGDEESVALQAIEFWSSICDEEIDILDDYSSEFTADSDVPCYYFIKQALPALVPMLLETLLKQEEDQDLDEGAWNLAMAGGTCLGLVARTVGDDVVPLVMPFVEENITKPEWRQREAATYAFGSILEGPSADKLAPLVNVALNFMLSALLKDPNNHVKDTTAWTLGRIFEFLHGSALETAPVITAENCQQILTVLLQSMKDVPNVAEKACGALYFLAQGYVDAGSASPLAPFFQDIIQSLIVTSH

SEQ ID NO: 125133 - protein, 173 aa, Triticum aestivum
  Clone ID: PAT_TA_19551.pep
PVRNFPVDPRVRGTIHNVVSCSTKEESLLAKHQLLFSLVACVCRVSCVGVCSCEKIERNNQRKREGAVRGSTKVEEERRCEEAAPTVTATILDFLNGGELPLGLNYTVITLIPKMRNPQIISQYRPISLCSVMYNIAAKAITNRLRGLMDEIIGEERSVFVKKKKKKKKKKKK

SEQ ID NO: 125134 - protein, 262 aa, Triticum aestivum
  Clone ID: PAT_TA_19552.pep
MSLSLPRFRPRPVKMTRRFSWRCRAERVSAGYSQLEVRKVSYRPPGTEQNLLNQTSLSLQEKSFGLIFGRSGSGKTTLLQLLAGLSEPTSGSICIQKYDDSGNPIGLSEVLAPQRVGIVFQFPERYFLSDTILEEVTFGWPRQKADIPLREQLTLKLQNAINSVGLSAISLDKDPQSLSGGFKRRLALAIQLVQTPDLLLLDEPLAGLDWKARADVVNLLRDLKKDHTILVVSHDLRELYPLVDRSWRMEMGGVLKEEPLPV

SEQ ID NO: 125135 - protein, 199 aa, Triticum aestivum
  Clone ID: PAT_TA_19553.pep
VDPRVRDPFYPTGKVNSDVIVNPTERQKSDSSRKKLLSYRRTSLKLARSSEAEKLPEIFDNETKVELPAKAKELAQHEAAAEKECAISPSIDPEVEKTISSFSRQNQNVAMSSASQVNIIEAVATDSQHDKEVSHATMEAGARKVSASRVKNAGAKRLRSATNGRRQSSACCKSESKSKHGIEAVLSHENVEAEKGNNC

SEQ ID NO: 125136 - protein, 274 aa, Triticum aestivum
  Clone ID: PAT_TA_19554.pep
MEVAVVVGPIVKLLPKLLSVIDGKRKQLDNLEVDAGFIRRDLQSIQEIIGRSNGGRSITDLWVRDLRRLADDMEDCIDRFQVGKMSRISFVGKICKLKKRSKETLEQLQNCISIAGAAAPAPDPPAAAGGTDQDPEGPRLGLLARSQSEGNLKVISVAGFSGVGMTRPALGACSDRDVRSQFPLHAWVRAAPGMSVLKLLQKIHDQLLLISIAKNHGATASSSKIIPQVNGDDTEHAATDHRARRTTQDRKVFVRPSACAYASVLPRPACLLLG

SEQ ID NO: 125137 - protein, 124 aa, Triticum aestivum
  unsure (1)..(124): unsure at all Xaa locations
  Clone ID: PAT_TA_19555.pep
TPHSQSPQPHHQRRPDRHRWRAIRPAAAASAAGKGPRSSTRHQQFRDRAKTRVDDLQEIFSGLQSARKESRSADXXAVLEEQVXKMLXQXRXEVNXXFPALPGKISGKQGGSSNFRLLNCFEKK

SEQ ID NO: 125138 - protein, 390 aa, Triticum aestivum
  Clone ID: PAT_TA_19556.pep
MASEMSKDVKFSEEEVTSHPRVLEGEEQAVAPARQSSIFALTLDELQYSVCEAGRNFGSMNMDEFMSNIWNADEFQAATGGGLVGMEVAPVVGAGGGGGGVDAGGSNLARQESFSLPPPLCRKTVEEVWAEINREPRPVHAQPQGARPSQQPPVQPPVPANDRQGTLGELTLEQFLVKAGVVRGSGAGGQAPVPVGMVHGQMNPAQQGQQPGPMMYPMAPANGMFPAMGDGMGFVPNGYAGMAVVPPPPPPQGGVGIVSPGSSDGRSAMTQADMMNCMGEGAMMENGGARKRGAPEDQSCESSIERRHRRMIKNRESAARSRARKQAYTVELEAELNHLKEENARLKAEEKTILLTKKQMLVEKMIEQSKENVNAKKGGTLSRRCGSCIW

SEQ ID NO: 125139 - protein, 135 aa, Triticum aestivum
  Clone ID: PAT_TA_19557.pep
MPGAKAPAVVDAWSREAPAVVVCVGCRARYGFCRLGVKDGGGPVQRWRARCIGGVRSSGGTCWPLVGCVGMVAPGESLAGARRPAATARVGVVILLGGVVRDLCSPTPGSRPLGENQDPAVGSGGGVVFSVRFPS

SEQ ID NO: 125140 - protein, 107 aa, Triticum aestivum
  Clone ID: PAT_TA_19558.pep
MAPRGTAAMSRFPPLSSYDASARERRTAASDLDGTLLASSSAFPYYFLVALEAGGYLRALALLLLAPFILLLYTAVSEPAAIGLLVFATFAGLRVRDLEAVARGVLP

SEQ ID NO: 125141 - protein, 196 aa, Triticum aestivum
  Clone ID: PAT_TA_19559.pep
MAAEAPPPQPPSSSSSSSAAAPARQAAAAGAASPETYLGSLISLTSKSEIRYEGVLYNINTEESSIGLRNVRSFGTEGRKKDGIQIPASDKVYEYILFRGSDIKDLQVKSSPPPPQPQPAPLHNDPAIIQSHYPQPASTASSLQSAAGAALPHLSSQPAQYGFQRPSFPSNIPLYQAGSKPWGAAGPPPAGNASAL

SEQ ID NO: 125142 - protein, 113 aa, Triticum aestivum
  unsure (1)..(113): unsure at all Xaa locations
  Clone ID: PAT_TA_19560.pep
LAPSHSWSWYCTTVRPPFGLTCDATCDASRHGTHGVRDRGASPAVPRRACRRRRQXGRCCCRRASRAAARGGHGGRLERDTYGNVQSQKPRXGVDXEQGLTXGPVRRPQLLTX

SEQ ID NO: 125143 - protein, 389 aa, Triticum aestivum
  unsure (1)..(389): unsure at all Xaa locations
  Clone ID: PAT_TA_19561.pep
RPTRPIDFDGRTALHIAACEGRGEVVRLLLGWKANINARDRWGSTPAADAKHYGHFEVYNLLRARGAKLPKTKKTPMTVSNPKEVPEYELNPLELEFRRGEEVTKGYYVAKWYGSKVFVKILDKDSFSDGDSISVVISTQRXFKHELTLLEKARHPNLVQFVGAVTQNVPLMIVSEYHQKGDLASYLETKGRVQSYKAIRFALDIARGLNYLHECKPEPIIHGDLSPKKIVPDDEGKLKVAGFGSLXLTKRSQDKLQMVQPVSNLDSVYIAPERYRNEAFDRSVDTFAFGLIPYEMIEGXPAFHPKPXEEAAKMICSEGLRPLFQXKPKSYPEGVKXELIQECWDPTPPIRPTFSDITLXLEQDIRKLFPSKPRWRDNFKLPWEQAVHK

SEQ ID NO: 125144 - protein, 167 aa, Triticum aestivum
  unsure (1)..(167): unsure at all Xaa locations
  Clone ID: PAT_TA_19562.pep
STHASEALLPVKVEVTHRGNIRRKYRISGLTAQTTRXELTFPVDQGGTVKSVVQYFQETYGFAIQHINLPCLTVGNQQRPNYLPMEVCKIVEGQRYSKRLNQGQIRALLEETCQRPHDRERDIVQMVNHNSYHDDPYAKEFGIKISERLASVEARILPAPRLKYSET

SEQ ID NO: 125145 - protein, 215 aa, Triticum aestivum
  unsure (1)..(215): unsure at all Xaa locations
  Clone ID: PAT_TA_19563.pep
STHASGEELSIEMSVQLRDELLIAQGQDRNKKSAKAKAAARILADLKKRGLSMKQCSSKAKQLDIISSEQYPLASLESPLDYCHVNANPSLGGLPSLKEAVXFGLKWTKVDHEVLFLSYARGCRGQCQNSNLLNKGSGLLLFWTGXPQRTSIASCQPSPCTYLMXQPLHFKASGGLTKGVPGIQHRWQCSTSFKSSRSVYARLSKASWIHLRANC

SEQ ID NO: 125146 - protein, 367 aa, Triticum aestivum
  unsure (1)..(367): unsure at all Xaa locations
  Clone ID: PAT_TA_19564.pep
DPRVRFILHWRITLVVLATYPLMVSGHISEKMFMKGYGGNLGKSYLKANMLAAEAVSNMRTVAASSPAAEVIXLYADELKEPGKRSFRRGQGAGVFYGVSQFFLFSSYALALWYGSHLMSKELATFRSVMKSFMVLIVTALAMGETLAMAPDIIKGNQMASSVFEILDRKTEVQIDTGDDIKKVEGVIQLRDVEFRYPSRSEVAVFKGLDLLMKAGKSMALVGMSGSGKSTVLSLILRFYDPIAGKVLVDGMVIKKLKLKSLRRHIGLVQQEXALFATXIYENILYGKDGATEAEVIEAXKLANAHNFINXLPEGYQTKVXGXRRANLSGRGXKQTAIAIXARSEPGHPGSLGPRTLGRSPCWFNKA

SEQ ID NO: 125147 - protein, 100 aa, Triticum aestivum
  Clone ID: PAT_TA_19565.pep
MSSDGRLDLDATTSTLGPEDDTAQGLILPTKDKVMYRPPPGRSALGLDLLAHKKREKEGNNSFKRPPEKVVTAASSMDEDERPGSTENDASSLSGVDRGI

SEQ ID NO: 125148 - protein, 228 aa, Triticum aestivum
  unsure (1)..(228): unsure at all Xaa locations
  Clone ID: PAT_TA_19566.pep
STHASASPPSTSRTASSSSTSSTTTTASSTVSGARTPAKSNSFVGTEDYVAPEIIAGSGHDFIVDWWGLGVVLYEMLYGRTPFRGQNRKETFYRVLTKQPELVGEKTPLRNLIARLLEKDPAKRIGARGIKAHPFFHGVDLGPAILRVARPPLHPGPXPQNEDGGEVLDVEKVVHETFAASDVEAPXGGRRRGATKKKPSPETETGGGDDGERRMMDPSKDGDFSVFF

SEQ ID NO: 125149 - protein, 111 aa, Triticum aestivum
  Clone ID: PAT_TA_19567.pep
MAAAAGSGGVVKHLVIVQFKEDVTPERLAGLIRGYAGLVDKVPSMKAFHWGTDVSIENMHQGFTHVFESTFESTEGVKEYVYHPAHVEFATDFLGSTEKVLIIDFKPAAVN

SEQ ID NO: 125150 - protein, 160 aa, Triticum aestivum
  Clone ID: PAT_TA_19568.pep
LPAVGMKSIMRTFSVEAQDISFKLDVQKGGKRTPWTPSVLSKGGLLKTCVNPFMHVLLCSHRFPELVGLQLEGTLSYEAGVGRRRSPSSRSGGTSCLDLHDDEVLLPRRRGRSPGAAAAAIVASRLVYPAGRLSRVVVPFPRLVACFLVGAGPARRLEGS

SEQ ID NO: 125151 - protein, 188 aa, Triticum aestivum
  unsure (1)..(188): unsure at all Xaa locations
  Clone ID: PAT_TA_19569.pep
VARRSSLTAPAHTRASGSDGSASSWCVRYSSSTPPSLQAAAAPLVTRDGKRGDKIIPRQPRRGVGRATPVAAGSWKTSVVYISTPAAAGDERAGQRAGRAALGITGPALRRGGVALPALLLXAPPALMKGAXSSPKHPAFGDGDWRRGTTTTPGRGCNITPSSAWTTAAAAIRPRCPRTTSPPCFPGS

SEQ ID NO: 125152 - protein, 153 aa, Triticum aestivum
  unsure (1)..(153): unsure at all Xaa locations
  Clone ID: PAT_TA_19570.pep
MAAMNIDLGGLAGRPTTSQADPFQSALYGAGPELIRSGLGAYSEKFLGSSSDFMQSNITQIFVQSNNIXFQSEXTKYXEXNKLKGVLVPFXLHPGHWTRITEPVGGRLSYKPPVQDINAPDLYIPLMAFATYIVVARYALGVLGRVLHTQDNF

SEQ ID NO: 125153 - protein, 62 aa, Triticum aestivum
  Clone ID: PAT_TA_19571.pep
MQDLFSVPSCFSSGEKQLPDAPASAAPATRSGQSAGTLVYRAVISEQSRLVTVTWCRTCSPR

SEQ ID NO: 125154 - protein, 318 aa, Triticum aestivum
  Clone ID: PAT_TA_19572.pep
STHASVGEEEEVVCSGALVAKAVECGLRCLTLERGWSFVGESIYAQSTFAASEERTDLCVLNVEVRSGLNDDYEFVVSPDAFRFTTRSSSDVASSSVIETFQQIKEVSLDGCNLQTACAILPTLQEGHVIGFSELPPSGQILDSFTELCSVKHGVETNYSYHAAVKLTRGASCEKQWLPSPFVLQGPGLQPSPKSVRASKAMSSMRSFIESLKAWNCFGQSQLVIKEQLVVNCTATLPTWDKATSKLAMHTARTENSEDLRLVHPSSVTKDQSLALDFRTPKPAVFSSSAAKFCNTKVEIAQSLDDAGTGDDTHSIKH

SEQ ID NO: 125155 - protein, 127 aa, Triticum aestivum
  Clone ID: PAT_TA_19573.pep
RSECDDTKLKIPLSPGLLSDDLRLQSGFRQSISHPPHHQSIHSRSLGLLETTKGRVQVPTRGRGGVAMWREGRKKSGGLAWERGGARAGRVGIGDRIQKSAPFPFFPFPFSLTSSPACALGLLLPDA

SEQ ID NO: 125156 - protein, 321 aa, Triticum aestivum
  Clone ID: PAT_TA_19574.pep
MDAAALDDVIRRLLEARGGRTVRPAQLSDAEIRRLCAAAKDVFLSQPNLLELEAPIKVCGDIHGQYSDLLRLFEYGGFPPEANYLFLGDYVDRGKQSIETICLLLAYKIKYPENFFLLRGNHECASINRIYGFFDECKRRFNVRLWKVFTDCFNCLPVAALIDDKILCMHGGLSPDLKNMDQIRNIARPVDIPDHGLLCDLLWSDPDKDVDGWGENDRGVSYTFGADKVAEFLEKHDLDLVCRAHQVVEDGYEFFAKRQLVTIFSAPNYCGEFDNAGAMMSIDDSLTCSFQILKPSDKKGKAGTGNSKPGTPPRKIKINII

SEQ ID NO: 125157 - protein, 110 aa, Triticum aestivum
  unsure (1)..(110): unsure at all Xaa locations
  Clone ID: PAT_TA_19575.pep
DIPKGTNIRVSIMLAHRDPSAWGADCDKFDPGRFAGGIARACKPHHMYMPFGVGPRTCAGQNLAMVEXKVVLSLLLSRFEFAPSPSYDHRPVFRLTVEPGSGVPLILRKL

SEQ ID NO: 125158 - protein, 103 aa, Triticum aestivum
  Clone ID: PAT_TA_19576.pep
STHASARPRRRPRRPSSSSPRPCSASTSSSESRADPARDRGPSSRSRVERSSSRSVSCLSPFEVRFCVQSGRRSRWVLSTSGSSSSSYRFCPLVRVCVVAENN

SEQ ID NO: 125159 - protein, 229 aa, Triticum aestivum
  Clone ID: PAT_TA_19577.pep
RPTRPGFQKEAALGRSSQGDRSLLQERSSQSALACEKGADTPLINNQRLIVRFPKPSCSPARSTSGGSCEEPSVSGSRASSPVHADKHEQNDRRVKMKVENSRAHLGSDANAQPERSNDTKRIAGSEEGDKSPCGMLDGDCSRTAEESAKDTCASRLACSANMDEKDVCLGETRVRNSFSPLNALIEIKYAGGSHSMQAGDDTAMNLLASVAGEVSKSELMSSASPTNS

SEQ ID NO: 125160 - protein, 161 aa, Triticum aestivum
  Clone ID: PAT_TA_19578.pep
WPAPTMALGGNAVAGRRRHVLLFPLAYQGHINPMFRLAGILHGRGFAVTVFHTHFNAPDPSRHPEYRFVPVPDGMSGPAPVAIEDVVSHILALNTACEAPFRDRLAAVMEEYSRDDVACIVVDTHLLSRGAAAPPRALPTLVLRTGSAACLSCFVAYPLLI

SEQ ID NO: 125161 - protein, 400 aa, Triticum aestivum
  Clone ID: PAT_TA_19579.pep
LELMNVEKLTRENVASHLQKYRLYLRRLSAVASQQAGIVAALGGRDPFLRMDAFEGLQGYQAFTSPAALSTFSAHGLLNSPRNNQTAVVIQGVATSRSIPTGSSSCTTNPLIGDAAKYHLSLPGNQHGNLGQGLATSLGQAQLQQKWMNEGSGDLSTILSGNSRANGMPRMLPSVTSSPLLPPDLVECTQAKVAIQPSVRAPSASVELLEGAIGASSGPLESRVSQQSALPSSGFSANMLPVHGSFNNNGASFSSNGATRLGDAFSASFRPTNDLTVARGTKVGAGSFGGTIHLSPDTEQKYLSFGSSDSLLDPKLVWSSSQLPSNIGAHYHSMSQRSNNCSIDSSHGGRMFGQTSASASTAAPQTKFDILFSGDTSMARMRLNALKGCRASSASAPAAS

SEQ ID NO: 125162 - protein, 381 aa, Triticum aestivum
  Clone ID: PAT_TA_19580.pep
STHASVQLEVLYGKGNGWFFAITAVKEAILRLGSCLAVLVGDGVAGGASEKGCELRDTGTSLIFVSQVAAAIAALHERLSLDKKIRALQAPRPSKYQLLLEYSQILKQGCDERSKRPNYRAVLDYDGILPRQMDNQESGRSKTREELLAEERDYKRRRMSYRGKKMKRNPTEILRDIPVRHFPVVPRARLGEPPGDIAQNILETNSNGGAYQGSSCDKAILGSRLRSRENSPHTASRSHDTRDSYMNIRYENSGHRHQNVSEHEKGGIRESGNAMNRGYSDRHDYTHKRNTNDHRKYGNKYKKNIPDYHSESSDRSAWSTRTPKSSEREYGGMPGDKSNDRTRTTQNRHGSIPGNKDQFSDRYDPQSRYSDEDPREAYHDA

SEQ ID NO: 125163 - protein, 148 aa, Triticum aestivum
  Clone ID: PAT_TA_19581.pep
SLTENSIGSWEELEDAFRANFQGTYVRPPDADDLSHIIQQPGESARKLWNRFLTKKNQIVDCPDAEALAAFKHSIRDEWLAGHLGQEKPRTMAALTSLMTRFCTGEDSWLAHRVTSDPAHPKLGMAIESRDAVKTSIKTMKRVRTIQR

SEQ ID NO: 125164 - protein, 237 aa, Triticum aestivum
  Clone ID: PAT_TA_19582.pep
MAAAAGGATTSTRRGPGGGGRPMDDENLTFETSAGVEVVGSFDAMGIREDLLRGIYGYGFEKPSAIQQRAVIPIITGRDVIAQAQSGTGKTSMISLSVCQVIETNVHEVQALILSPTRELATQTERVMQAVGNFMSVSVHACVGGKSIGEDIRKLESGVHVVSGTPGRVCDMIKRRTLRTRAIKLLVLDEADEMLSRGFKDQIYDVYRYLPPELQVGLISATLPHDILEITSKFMTD

SEQ ID NO: 125165 - protein, 181 aa, Triticum aestivum
  Clone ID: PAT_TA_19583.pep
KFMTDPVRILVKRDELTLEGIKQFFVAVEKEEWKFDTLCDLYDTLTITQAVIFCNTKRKVDWLTERMRTNNFTVSAMHGDMPQKERDAIMNEFRGGTTRVLITTDVWARGLDVQQVSLVINYDLPNNRELYIHRIGRSGRFGRKGVAINFVRKDDIRILRDIEQYYSTQIDEMPMNVADLI

SEQ ID NO: 125166 - protein, 332 aa, Triticum aestivum
  unsure (1)..(332): unsure at all Xaa locations
  Clone ID: PAT_TA_19584.pep
TYIHKVRSLVLSPTRXVDTLTARVMQAVADCMCVSVHAVCLVAKDIGDGYDGSSXGVPGASGTPGRVCEMKQRRTLRTRAIKLLVLDEADEMLSRGFNDQIYDVYRYLPPELQVVLISATLPHDILEITSKFMTDPXVRILVKRDELTLQCIKQFFXVAVEXKKKWSLDTIYDLYDTLTITQAVXFPVTLMRGDDPLTERDALMSVFRGGTTRVLITTDVWARGLDVQQVSLVINYDLPNNRELYIHRIGRSGRFGRKGVAINFVRKDDIRILRDIEQYYSTQIDEMPMNVADLIWSSGPERSLPLSPSLSRCDVWGFGCVAMFGCISGAVT

SEQ ID NO: 125167 - protein, 146 aa, Triticum aestivum
  Clone ID: PAT_TA_19585.pep
VETRSRGRDGEGQKIERPDGGGRGRGLPVGELGLEPEAALPSLRGGAAHDGEQAGDRDWFFSSFAAGLNVLWVGAEGVEHHLRLGGCSGAPAGLPASLAVVGHRPPPGLPLALLRRRRRVCWWAPPRSIAFNCLPCPSPLAHGSME

SEQ ID NO: 125168 - protein, 162 aa, Triticum aestivum
  Clone ID: PAT_TA_19586.pep
KKLGWQDIATYKPPEDALFAHPRLFRACVPPGMHRFRGNIWDFDSKPKVMQTLGYPLTMNDRIKEITEARNIELGLGLQLCFLHPSKHKFEHPRFCFERLEYVGQKIQDIAMAERLLMKHLDAPRKWLQEKHRRLLMNKFCGRYLREKRLHNFIIYSEEVHD

SEQ ID NO: 125169 - protein, 328 aa, Triticum aestivum
  Clone ID: PAT_TA_19587.pep
RRRLHPATATTQVPTRPSPTASQQVPPPRPHPRPPPAAPALSAAAAMADRVYPAAKPTPPPPMANGGGGPAAPKPQMYQRPIYRPQGQAKSRRGRSCRCSLCCCFCWALLVVVLLALVAAAAGGAFYVLYRPQRPSFTVSSVRLSTFNLSSSTTAPVLTDSIQLTVTAKNPNKKLVYFYDDFSFSAATAANAVPLGDATVPGFAHDAGNTTVFTATITAAGVTVDPSGAGSDLKMSGAFSVAIDADTRAGVKVGSLKTKKMGIQVHCEGIKVTPPSPPPPAPKKVKGKNGTALAPAPALDNAETTAMVSTAAHSCKVRVRVKIWKWTF

SEQ ID NO: 125170 - protein, 222 aa, Triticum aestivum
  unsure (1)..(222): unsure at all Xaa locations
  Clone ID: PAT_TA_19588.pep
TGPDFRSTPRPRIASYAKSSAELLTNLIIHGQSGQYTWECLFRTPLSNYDAVILLHKEKLCRPHHVLFPAEIPNGXVLIFVANLILLHIQLLCRPLHALFPPDIPAGKLVIQGKPSNDFHPYMPLSKSVVRSLHDTRDKLLVNFDPTAYFLRDLKCAFPVTFKLWHDSIGGDAIGLTWESSKKRGRDEDDEAMLDPTSILKEVGDVGKGLVRSVHLLKSTKA

SEQ ID NO: 125171 - protein, 246 aa, Triticum aestivum
  unsure (1)..(246): unsure at all Xaa locations
  Clone ID: PAT_TA_19589.pep
MGSEANGGAAAIDLLRSAAPFLPDADLLLTPGTGLVLVDLVNGFCTVGAGNLAPVTPNKQIEKMVEESTRLARXFCQRNWPVFAFXDTHHPDKPEPPFPPHCIIGSGEENFVPALGCCWRMIQMCSMRRKDCIDGYLASFEKDGSNVFSEWVAKFQIKTVLVVGICTDFCVLDFVSSTLAARNIGRVPPLEDVVIYSEGCATFDLPVEVARSIKGALAHPQDLMHHMGLYMAKSRGAKIVDGILEE

SEQ ID NO: 125172 - protein, 321 aa, Triticum aestivum
  Clone ID: PAT_TA_19590.pep
VLVDNADAFSNRPVLPFFVELAKRRGGQRNENISTVPHGPHWRALRCNITAETLHPSRLGLGHLAPLQREAIQDLVAALQSTGAGAGLRDHLRAAVFRVIACLCFGDGVDECHVRAVCSQVHGLQVAIGEVNPFSAPSLLAKLAEWRYQRQLLAFHARITELCLPLIAARRRRPHDDDLCRPYVDTLIQLRVPDDKHGGRRALSDDEIVDLVLEFLGAGSGSLVVCLEWTLAHLVVQPEVQKKLRHEVDGEAADRSQLIRGMPYLHAVILESLRMHPPAPVALRHVQADAAAAATLVGGGTTSAVTVLFLLGDIGKVQEGV

SEQ ID NO: 125173 - protein, 183 aa, Triticum aestivum
  unsure (1)..(183): unsure at all Xaa locations
  Clone ID: PAT_TA_19591.pep
GPVPAALAVCSGVATLLLARNRLTGDVPLELLSSRQLRKLDLGGNALXGEIPTPATAGASVLEHLDLSNNSLSGTIPPELLAALPGIRVLNLSTNALSRPLPEFPAHCRLTYLAVDSNSITGELPRSLCCRGRPSSPLCLSTELSLSLAHTGEEKKRKRARGRVDTARYPGARTPPPQQPDAW

SEQ ID NO: 125174 - protein, 221 aa, Triticum aestivum
  Clone ID: PAT_TA_19592.pep
ELLFPPISSHHGKQFNDFVCACPNAFAGLRRLWLRNMRPRARDIPNLLTTCKLLESLRLTHCHSGIHSVLQVEHAQLVELLVDYGQFERVELICLPKLKHGAYTNWSSCEDPMYFGFVPQLSKLSLTKIGVRSEKNIELSQLLANGPSISELHLDFRSEKIWIIPECPKLLAPVLSKLQHVNLDHLPEGCDLAWTMFILEAAPSLKELCITVWDHWCIIFT

SEQ ID NO: 125175 - protein, 181 aa, Triticum aestivum
  Clone ID: PAT_TA_19593.pep
MGSGRVCSVVASVVLLWLGVAAAQGDSPWKTLSGNAPAIIAKGGFSGLFPDSSEFAYQFAMIASSPDTILYCDVRLTKDGLGVCLPDIKMDNCTNIPDFYPKGKKSYLVNGVSTTGWFSVDYNGTELSQVSLKQSIFSRTPRFDPSFFPLLAVEDVASKFKPPGMWLNIQHDGFYSQFNMS

SEQ ID NO: 125176 - protein, 109 aa, Triticum aestivum
  Clone ID: PAT_TA_19594.pep
MKTPVCILISTRNRARLPRCHLSRSSDPTPTSEAQVTDSLRVAFACGGAGGHVYAAFALAEEVQASLPGSRSLFLGAPAPSLESATAASSSYPFAPLPPCLPRALLGGG

SEQ ID NO: 125177 - protein, 124 aa, Triticum aestivum
  Clone ID: PAT_TA_19595.pep
MANPARVGAYSILLPSAPHQAVRLPAAAPPSASKCGLQMHHHGRSKPPRVSFACSASNLPGTEPAYVLTAMLAEETIGPRSDVERDARIRKHLKNPELSPSAYDTAWVAMVPLPDSDPQAPCFP

SEQ ID NO: 125178 - protein, 249 aa, Triticum aestivum
  Clone ID: PAT_TA_19596.pep
KRQEDIRYTPVPLRLASFLRSTRSGFSSPWSQKNKETTGSGCPVTLTNSTNDYVGIWIKPINGKFKETEIMEPHSTLVVYATMKMHAQPPKDKVEFEVLMIILRSKQDHGKMKSFIVDKLNMDSGFMVHVKNLKAEVYRAMLTAITCDPASCQIISRSIEDTTLVTSIDAHPTKPWIVTGHEGGNFSIWDYHKKETVMNVQANEVPHMVTRMIHGITKYIIETSVGHADYSVKCTPEGKRDVLGDSHGY

SEQ ID NO: 125179 - protein, 169 aa, Triticum aestivum
  Clone ID: PAT_TA_19597.pep
MARNAADKATSIDAQLRMLAPKKLSEDDELVEYDALLIERFLCILQGLQGDKIRETVQECYELAAEYERTLDPKQLDEIGNLLARLDPEDSIVTTKSLSHMLILANLAEEVQIAYRRRQKLKSGDFADENSATTESDIEETLKRLVCQLNKAPLEVFDALIVFHGGQGG

SEQ ID NO: 125180 - protein, 103 aa, Triticum aestivum
  Clone ID: PAT_TA_19598.pep
VLAAPHPADHEASQRRAERLCRKDWVWEPAVHGRLRDGQGPHPVADRQVQLRRRGARVPRRRVGPGEAARGAPPRPPGRPLPGPRAPPPRRRAPHALPLPERE

SEQ ID NO: 125181 - protein, 154 aa, Triticum aestivum
  Clone ID: PAT_TA_19599.pep
LDFLALARCCGCGSVVSLRGSRLLFQPRAPLNSSFESNHGSVGPSCSGQVLVYHDLLGMMQHPHHAKVTPKFCKQFGNVGSVINKALSDYKQEVETRSFPGPSHTPYKITATDVDGFANALQKMGLGEAADAAAAAAGELRKMMESRAKTVDFS

SEQ ID NO: 125182 - protein, 125 aa, Triticum aestivum
  unsure (1)..(125): unsure at all Xaa locations
  Clone ID: PAT_TA_19600.pep
MFSPAIRKPHLHRREKEEATPSPPPPAPAHSPSPGGFILSDRPATGTPAPWTTSSLLARISTSKQTDRAGDSDQIQPVRVAXFPQVVRNAQANLLQRNFAGKSMLVGGIDKETSLAXVXCGNELG

SEQ ID NO: 125183 - protein, 102 aa, Triticum aestivum
  Clone ID: PAT_TA_19601.pep
GRVGFDNLDCIEKTVSAQEDLSMKAGLYKHVVDLKDLIKVEWKKYDVLSGFGSIQKLQTIGEPVDVLELSPLAPELVLDAHVWGSPSAHDALTHQEKLYCGN

SEQ ID NO: 125184 - protein, 87 aa, Triticum aestivum
  Clone ID: PAT_TA_19602.pep
STHASGSRVPPPLLTTTAPPPTMPSRPATTASTRTTPTAVAPTPCAAVAGRRRRPCPPRRASSTTSSSPVHVRSSRGLGPSPPSRRR

SEQ ID NO: 125185 - protein, 183 aa, Triticum aestivum
  Clone ID: PAT_TA_19603.pep
RPTRPRPAPLPSPPSPAAPPTTSSGRSAHHLLRPRPTTPPSMPAATLFFLPHHKRSWWAAGSGRPRPPARPQPPDTAATTIGAATNHGSGRHRPLGVEAVRSRSLAPDPARSTPVPLYRAAEARVVLSLSGREAPSSNSPACHQEEAGQEAGASGPLLPAADPTSQPTSSSPSWRIRRALSPR

SEQ ID NO: 125186 - protein, 186 aa, Triticum aestivum
  unsure (1)..(186): unsure at all Xaa locations
  Clone ID: PAT_TA_19604.pep
RDDEIDDGSSSGTVDEGCRGVAVDDVVGEEAPAGWRTEQGVGFRRGFSRPRCTNGWADGMAVGNHGLETRLSEMWGKLRKYPHRFEAVLSVQGYHGHFACRDFTGGGSFRARCNFGIARRGLRWRELSEHNETKIYLKYFGLTRRGLKTREFRIMIDRDASLDFRHNISGASLTCTRTXQCALXMS

SEQ ID NO: 125187 - protein, 144 aa, Triticum aestivum
  Clone ID: PAT_TA_19605.pep
MAMSRAAAAVGRRRCGPRLPAARSMASWFGHVEPAAKDPILGVTEAFLADPSPDKVNVGVGAYRDDDGKPVVLQCVREAERRIAGSTNMEYLPMGGSVKMIQESLKLAYGEDSEFIKDKRIAAVQALSGARAPRLFPDSLFRIT

SEQ ID NO: 125188 - protein, 341 aa, Triticum aestivum
  unsure (1)..(341): unsure at all Xaa locations
  Clone ID: PAT_TA_19606.pep
MATSPALLSRQYARPSPPPLPRQPLAPSPVAAAFPAVRLRVRRGPSPAQAKFGKFDAAEAPTEAGPTAPATSEADGAAGQAVLEDDSCLPSDLEGAIWQSGKASADFVNSGGMRGIAELLIPQLEFLNQEGAQAEVWALSRILLDTLAEETGQVVKAVFPDAGVAALLKHQWKDAKFKCASLSDRKPVDTDDGVVVMIIPDHQMLESVERIASQLADDPIRPLVMWNPRLVSGDVGVGYNVRNLRRNFLSTFTTVYSMRPLPTGAIFRCYPEKWKVFYDDPKRPNRYLLARESSSRPDATDIEIIFGXXGASEQPEEEPSMMTNVMAAFSSVSRFMRVISK

SEQ ID NO: 125189 - protein, 160 aa, Triticum aestivum
  Clone ID: PAT_TA_19607.pep
EGFHLIGPPPPAPPLRVPFPGLAPCSSWLSSSGARRAPGTSRRVPTRTGPHRRRSCPAAAQLVTYPSPLNVEKWLQNCEQSTLKDTKFEHIEGYISFVLCIAAGEVVNELVWLSDGKKRVSGGRKFAAGGRWWESQDGRREGMPNLMCQVGRYRGANDLS

SEQ ID NO: 125190 - protein, 174 aa, Triticum aestivum
  Clone ID: PAT_TA_19608.pep
IWIEGARHCFVKMIVGGDYFEGSHDHNLMTGSLTHDSSLAPKCNDNTNIELQRFKVQSFSADILSDSTNLSSEAARAINHLQHQLGIGLEQDMPPVETATWDTSICTIQDQIINHQLSEDPQNILVQQQIQQYDAALYPNSGYTPAPDLLNLLHCTVAPVFPPTASVFGDTALS

SEQ ID NO: 125191 - protein, 134 aa, Triticum aestivum
  Clone ID: PAT_TA_19609.pep
FFDTKHNGILGFEEFARALSVFHPSAPPEEKIDFSFQLYDLKQQRGRGRREVKQMVVATLAESGMNLSDEVIESIIDKTFEEADTKHDGKIDKEEWRNLVLRHPSLLKNMTLQYLKDITTTFPSFVFHSQVDDT

SEQ ID NO: 125192 - protein, 49 aa, Triticum aestivum
  Clone ID: PAT_TA_19610.pep
RVRNVKCVRYDIDGECHVLLVACRDIARGEKLYYDYNGHLVACPTRHVV

SEQ ID NO: 125193 - protein, 182 aa, Triticum aestivum
  Clone ID: PAT_TA_19611.pep
FVKTVIEHKVVRDDNKRPPHIMPHVDAYTTRNDRTTKQMHTLGRRRVFPFLILFRSRWRRSGCCSPPSTACWQPWCSPRTQSCWSKSRSTTGSPRRRSRPCCTSRTRRTCTRRSSERRRACCISEGRRLCTSRCSAGHSRHTASPAPAPVPEPPPAVLGRATDSVPGRAGPSWRGWKRQRPL

SEQ ID NO: 125194 - protein, 265 aa, Triticum aestivum
  unsure (1)..(265): unsure at all Xaa locations
  Clone ID: PAT_TA_19612.pep
MESMEPMDIDWNRVVSRFVLDETYEGIEAPHWADLADPEAPTAAVDDDAWFCRPHCKHPKTADDFLRAHPQPPGQAAAIQCPPXCPSPRRDAYLRDANNNLKRRGSVAAGGGGTAAFASPTKPKPPPKKRFQDDAENQDPALTTPPPAAARPPFGAQRWAKNAKEAIKSSAEKRPDVAEKEALLGRNPAPRQLKSTLSARNLFSGKDILGQISDLYNDLKQRMAGGGGNQQPVSESEAMEEMSPRPMNSSGVVEKVDCSSGGGGR

SEQ ID NO: 125195 - protein, 117 aa, Triticum aestivum
  unsure (1)..(117): unsure at all Xaa locations
  Clone ID: PAT_TA_19613.pep
ATLPPNGGSSDQTNEMHRRXPLSGGEGMEGGGGHAVTAAGAAGRTRGGRGTAERRIDARRRQQNLKPAGRGHGAEARDHHLRRSRGIVRDWEWGNLTAGEPGGRGQLXRAAGSLSGH

SEQ ID NO: 125196 - protein, 162 aa, Triticum aestivum
  Clone ID: PAT_TA_19614.pep
MALALKASLSPSSSPLSSPQRSRARAAVAVATPGRPVVARALAAASVDPAVVMPTARRLAVRARAAATLLAPAPAGKSGMSVAKAMSQARHKGKTAFIPYITAGDPDLATTAEALRLLDTLGADVIEVGMPFSDPYADGPVIQASAARALSAGVTTDAVMSM

SEQ ID NO: 125197 - protein, 119 aa, Triticum aestivum
  Clone ID: PAT_TA_19615.pep
MAFLAVLLLVVLALLAVAATQLWDYAVVRLVWRPYAMSKWFREQGIHGPSYSFLKGCNEDVRSMKEETDRLVLDVGDHKYLPRIAPHYLKWRGQHGEPFLYWHGPQTRICIFDYELARQ

SEQ ID NO: 125198 - protein, 524 aa, Triticum aestivum
  Clone ID: PAT_TA_19616.pep
MAFFAVLLLLVLLALFAVAATQLWDYAVVRLVWRPYAMSKWFREQGIHGPSYSFLKGCNEDVRSMKEETDRLVLDVGDHKYLPRIAPHYLKWRALYGEPFLYWHGPQARICIFDYELARQILSSKSGHFVKNDAHPTLLALVGKGLGFMEGADWVRHRRIINPVFTIDKLKMMTKTMLDFAKSMAKELEDQASQNDNGETKVDINKFFSELTVDNISYAIFGSSYKLGNEVFQAQTELLGITMETFLDVPIPGFKYLPTERNQRKWMLERKLKSLLTQIIQPRLATSEYGNDLLGVMLDSCIETKKGGKQEDLSLSLEEIIHECKLFFFAGHENTSLLLTWSVYLLSIYPEWQDRLRKEVCKEFGRESPNPNALNKLKEMTMVLFETLRLYSPALFMQRKTVTDMTVGSIKLPKGMAIVIPIPIMHRDKEVWGDDADEFKPLRFKDGITRAAKVPHGLLAFSMGPRSCIGQNFSMLEAKSTLALMLQKFSFTLSPDYVHAPVDLFTLKPKFGLHVLVRPLDKCN

SEQ ID NO: 125199 - protein, 168 aa, Triticum aestivum
  unsure (1)..(168): unsure at all Xaa locations
  Clone ID: PAT_TA_19617.pep
MAAAMEVDAGGEKPSEKELFLAAESGDASVFASLAPADLAAXALSLRNEDGRSLVHVAASSGRPEAVAALVAAGGDAVASAVNGKDEEXVGPPIHSVXXNXNXXIIQILLGXGXNVDLTNEAGPNWSSIXCXLKERFXXAXNLNSSTLQNXXKKKXSXXGTTLHKXAK

SEQ ID NO: 125200 - protein, 134 aa, Triticum aestivum
  Clone ID: PAT_TA_19618.pep
MATRPGPLTEWPWHWMGSFKYLVFAPVALQTAYRVVTKGWGDMNLAYAAILPALLLRMLHNQIWISLSRHQTARRKHIIVDRSLEFEQVDRERSWDDQIILSGLYFYLGYAAIPSTRFMPMWETKGAIIMALLH

SEQ ID NO: 125201 - protein, 181 aa, Triticum aestivum
  unsure (1)..(181): unsure at all Xaa locations
  Clone ID: PAT_TA_19619.pep
TSVSLPCDPPGFQGVFLCGGEAQVEHAVATALCERGVQVIKNQKKEYDMLKLRVPEXVLPYLKFSSDETPQMWAGVKLDVKHQIRAPKGATFIPTSQFTLKRTRQDCTYLSIPAMKIPEAMQNVHTCENWLPRRVMSAWRIAGMVHALEGWDIHECGDDMMDLEKVWSAAIKHGFTPLSKA

SEQ ID NO: 125202 - protein, 448 aa, Triticum aestivum
  unsure (1)..(448): unsure at all Xaa locations
  Clone ID: PAT_TA_19620.pep
MEPRVGNKYRLGRKLGSGSFGEIYLGTNVQTNEEVAIKLENVKTKHPQLLYESKLYRVLQGGTGISNVKWFGVEGDYNVLVMDVLGPSLEDLFSFCNRKLSLKTVLMLADQMINRVEFIHSKSFLHRDIKPDNFLMGLGKRANQVYMIDFGLAKKYRDTSTHQHIPYRENKNLTGTARYASVSTHLGIEQSRRDDMESLGYVLMYFLRGSLPWQGLKAGTKKQKYEKISERKSATSSEALCRGYPSELQSLFHYCRALRFEDSPDYQYLKRLFRDLFIREGFQFDYVFDWTILKYQQSQMTSVPPRAIAAAAGQSSGVAPIASKYRLPAGEEGRRSGXGGYPTRXQLPYRGISRGRXSKQKSPVRPRWAAPKETLLCTSTFLGRSGVSSRRAAVSRSRELPSSEAEPSRRRAPDVSPXGTFQRNSAPRRTSQTLDYSDPRHQSNSSNN

SEQ ID NO: 125203 - protein, 134 aa, Triticum aestivum
  Clone ID: PAT_TA_19621.pep
PFIRPILGSFRLPHFLLSLVPTIASTLSNSFISCNSALCHHFHTFILLCAVERQTLLREKNKAPDIFLDAYAIVREGGGRDKKRPAERRLLRYVYISHIIANKNWRIGYSAGERTVAPFLAPGQFPFELRRMLM

SEQ ID NO: 125204 - protein, 324 aa, Triticum aestivum
  unsure (1)..(324): unsure at all Xaa locations
  Clone ID: PAT_TA_19622.pep
MTIPSAEGFLPAASCLPCTAEEERAAVDALTREADANVKDGDLRYLISQSWWTNWQSYVGLLSYGENDTDIPLQPASRPGEIDNRKLVLEETSSGSEDTELQRTLREGEDYTLVPQDVWRKLYDWYEVATARNRKFSLFLPTSRLHFVAVYPLDLSLHDERDNSARTIKLSRKAKASELYRLACSLLSAEQAKAHIWDHYHAPWVVGLSPRHVPPQAAHLRWALQILLEVSADDIWTSDHCTRSTSNELALLPLEPTTSSFSIAGGPNFSNGYSSGIGSSLSQDNSLNPLVKDIEDGYSNFSNGTKDDIHGIXGLPNLGNTCFM

SEQ ID NO: 125205 - protein, 218 aa, Triticum aestivum
  unsure (1)..(218): unsure at all Xaa locations
  Clone ID: PAT_TA_19623.pep
STHASGSSSSGAAVSLSRLSSNLERLLLDSELDCSDADVDVADGGPPIPVHRCILAARSPFFHDLFRARGSRSDGAVTASASASATSGGAGGDVTGRPQYKMEDLVPGGRVGREAFLAFMGYLYTGRLRPAPLDVVSCADLVCPHDSCPPAIRFAVELMYAAWTFRIPELMSLFQRRLMNFVDKTLAEDVLPILQVAFHSELTQVREKCXXXXXXXDL

SEQ ID NO: 125206 - protein, 273 aa, Triticum aestivum
  Clone ID: PAT_TA_19624.pep
ANVGFNFTIAGGPPPTRQSFRPRVSFPVVSRHFKADLNSRGKSFSSGSDREIVSVALHASGPMKRKRSMDKLHMLEGINTISNDVDTSAKGAHHDHGGDNSEKQIANLGVNTDQIQGCSPSDTTEDINMEEVVNGEPESGVATSRSMTSTNLKLDQHGIDPKFSADAAAREEPTNDRNSIQTHANMSKPAEVGTITKSSTNMEKGVHPSGKKQGLYDQMNEFDPIKQHRTFCPWISPDDSDALPGWRLTLSALLAQDKRVDGDSQLETKLSLL

SEQ ID NO: 125207 - protein, 171 aa, Triticum aestivum
  Clone ID: PAT_TA_19625.pep
HWLKEARGIVISLEDGTLKFLSLPRIANDVPVTGRPFAGTKTQGVSTYQLSEYLIWNVHVSEITGYAAYCVADGTAVRFQLTSRFWEKEPGRNRVPYFLCGSLAEEGTAIKIGGTLQSPPMSNVPLVAKKGPKPCQKVPKPTIHKKTSTNLTTQTVQNQERARNLIKQEPG

SEQ ID NO: 125208 - protein, 219 aa, Triticum aestivum
  unsure (1)..(219): unsure at all Xaa locations
  Clone ID: PAT_TA_19626.pep
RRPTPPRPSSPPPXPLLLPSVPPPPPPRGPPSPLPPPPPPPPPPLTVPPGPRSEPPPTLPPPPSPAPWRPDRARSRPPVRCCSPPQRLVVPGPPPAAPASAPPRLRLRGSPPARSARARPALPPLICTRGSPGSGSAWVVARPPTMPCWRGFGSRSRRWGAGARLEVVVAASRTDWVLPPDPDRPSLAALLRCLLCFSHLLRLPLLRGLASAPLLFLHK

SEQ ID NO: 125209 - protein, 150 aa, Triticum aestivum
  Clone ID: PAT_TA_19627.pep
RPAPRRRRSSRPPRRCAPRTSSSCPSASSPRWSSSPASAPPTSAPTASACSAPASAPMATPSRREPRRSSPRRRRVGGRGSRCRVGVLARPTPAGRGADHAQAYAAAGHRAPGARAAAPGARGRAGGRAPRARRPGRPRRPALLLTAPRT

SEQ ID NO: 125210 - protein, 176 aa, Triticum aestivum
  Clone ID: PAT_TA_19628.pep
MRAEEERDAVCVPYPAQGHATPMMKLAKVLHSRGFHVTFVYTEHKHRRLVRSRGAGAVAGLPDFRFATIPDGLPPSDPDATQDQASICHSTTTTCLPHLKSLLGGLNNTAPGTPRVTCVVADSIMSFAVDAAAELGVPCALFWTASACGYMGYYNFRFLVDQGLLLSKVKSNGGRG

SEQ ID NO: 125211 - protein, 72 aa, Triticum aestivum
  Clone ID: PAT_TA_19629.pep
IEKLSMLVVLGFRTSLKDTSSDANLTDAEVVAQRQMHPSFGVILVAQAEVIIHGSMQKLFHLMFSLSHIRSI

SEQ ID NO: 125212 - protein, 222 aa, Triticum aestivum
  Clone ID: PAT_TA_19630.pep
MEANVGPVVRRLYLSVYNWAAFFGWAQVLCYATLALLERRPEAIYTAIERPLLVTQTAALMEIVHSLVGLVKSPVSATILQLIGRMFVAWGVLWSFPETRPHILVTSLILAWSIAEVIRYPYYGMKETFGFAHFWLLWLRYNMFIVLYPIGMLSEVGLIYVTMPYMKASNKYCLQMPNKWNFSFNYHYASVLLMGIYFPGFPHLYRYMLLRRKVVLSKAKSA

SEQ ID NO: 125213 - protein, 131 aa, Triticum aestivum
  Clone ID: PAT_TA_19631.pep
VVPVDLASSKPSLARCTRSKFVHHPSSFSYKRMLPFLMENDISSQEGDRAKFRPRAREKQITSDQNDVQARTQEVKDCCDSAKEETKIVPGDLASSKPSIPRCMRSKFVPHRSSFSYKRMLPFLMQNETSS

SEQ ID NO: 125214 - protein, 320 aa, Triticum aestivum
  Clone ID: PAT_TA_19632.pep
MAALAAAAAFAGLLLALAPVVGADTDAAGVSALGNLYTSWNSPAQLVGWSAAGGGDPCGAAWMGVSCSGSAITSINLSGMGLNGTLGYLLPSLVALTTMDLSNNSLHDVIPYQLPPNLIHLNLARNNFSGHIPYSISNILSLGYLNVSHNSLFQEIGELFGGLNSLSVLDGPLSLLSGVLPGALGSFSHLSSLGVPNPQLSATVCALCILCRSPRCIAFPSFTGVMPGELSSIPALPARGNSFINMPASPPRIIMPPSQSPVAQPDRPQVPTTFPNGPEDDIPIEDKKQGRQTGLLLAVGSVAAASCILFALVFCHSVHK

SEQ ID NO: 125215 - protein, 120 aa, Triticum aestivum
  unsure (1)..(120): unsure at all Xaa locations
  Clone ID: PAT_TA_19633.pep
NKTQHEPRHSGKRTAWSSRNQIDHEPERLRSPPRGPTPNAIDPEPERPTPRRGRTPNQSDQXPRRGPTPNPIYNPPPPATLATPPAPSDPNPSAAAAAAPLPXPPPPPPPPPSPSSAAAS

SEQ ID NO: 125216 - protein, 136 aa, Triticum aestivum
  Clone ID: PAT_TA_19634.pep
LSYRRQLHLNCGKRNLEEPRPPPAGRRFQSGPLLLRPLLLSGASQLPRIPRPPKWYDIQLPSAHQVQVSTVVSLYDRHVPCAYPTLLLSVPLPGAGWPRAPALVATASGYTAAPFGLPALGLPRCVVVLIRCSLSR

SEQ ID NO: 125217 - protein, 257 aa, Triticum aestivum
  unsure (1)..(257): unsure at all Xaa locations
  Clone ID: PAT_TA_19635.pep
VIPNLLALLVKGFLEFKKVEIQCQEDSELIVKVIMSEEHCKSVKFWATLQKSCIAIMELIDWERSRPGSVYDIFCSYGIDSAWKYFVESLRSKTDDIGRNIRREHLLXVANCLSVSGQFXGLSSQGLKQQRTRLSISSPFSEAGFSRPAHTFINAPKQPSGDSRCGTVGAGACARDPAPGTSAPCQVLHSAQAHAPVPNPGLYGSPNSPEVRQAPGEAFLNGSTISVEQDFLVAAVGIGTTLLICALACRTCYESTN

SEQ ID NO: 125218 - protein, 143 aa, Triticum aestivum
  Clone ID: PAT_TA_19636.pep
MAGGSLDLPVACVESGFFYVTNHGIQDGLLEALFAESKRFFELPLEEKMLLQRNSSHRGYTPPYAEKLDESSEFQGDLKESFYIGAVRDVDMPNDPNQWPPKERFPSWKDTMKLYHEAALAAGKRILSLIALSLDLEAEFFQK

SEQ ID NO: 125219 - protein, 308 aa, Triticum aestivum
  unsure (1)..(308): unsure at all Xaa locations
  Clone ID: PAT_TA_19637.pep
MAGGSLNLPVVDLAPPDIKSAVDAVRKACVESGFFYVTNHGIQDGLLEALFAESKKFFELPLEEKMLLQRNSAHRGYTAPYTEKLDASSEFQGDLKESFYIGAVGDVDMPNDPNQWPPKERFPSWKDTMKLYHAAALAAGKRILSLIALSLDLEAEFFQNIGAVDCSSEVIRLLHYPGEVKESDNGNYXSHSGLISLIAKASTTRLQIPREKDRHPQLWEDVRHVDGTLIVNIGDLLEXRWTNCVFRSTLHRVVAVGRERYSAAYFLDPRPDLVVQCLESCCCDASPPRFPPITAGDYLKERLRATYK

SEQ ID NO: 125220 - protein, 216 aa, Triticum aestivum
  unsure (1)..(216): unsure at all Xaa locations
  Clone ID: PAT_TA_19638.pep
RIRGRVDRPSKFSFEYLLLPPRSAPTAAPPGLAPRVLQRPPRPTIYRNYYSPGSASLYFGGWSLGVKPMEVVLDSGSSFTYFSSQPYQALVTALKGDLSKTLKEVSDPSLPLCWKGKKPFKSVLDVKKEFKSLVLNFANGKKALMEIPPENYLIVTKYGNACLGILNGSEIGLKDLNIXGDITMQDQMVIYDNERGQIGWIRAPCDRIPKFGSSLL

SEQ ID NO: 125221 - protein, 212 aa, Triticum aestivum
  unsure (1)..(212): unsure at all Xaa locations
  Clone ID: PAT_TA_19639.pep
STHASGYVHRLNHSKSDVKHAKFSSKCEYPGDNCVNCMHDDSDMGGVMFSSKADTIVDEYNRLLASQLETQREYYEALLSDAKKEREHHISVAVDKTINDKLQELQLKLENTMLEKKKVAEMNEKLTKSLEVPRPSGLGCVHRERAQLKLKDDMILDLEEQIKDFRYSIXLQKSIAKSSHADDLKGGMLVPLAMESDSGKGKRSSRTSKRRN

SEQ ID NO: 125222 - protein, 291 aa, Triticum aestivum
  unsure (1)..(291): unsure at all Xaa locations
  Clone ID: PAT_TA_19640.pep
WVPQQGGRGGGQHLGRGGQYQGQGGPAAHRPGGPPEYQQREYQGRGHPGGGPPEYQPRDYQGRGHPGGGPPEYQPRDPQGRGHPGGAPPEYQPRGPQGRGHPGGAPPEYQPRGPQGRGHPGGAPPEYQRRDYQGRGHPGGGPPEYQPRDYQGRGGPRPRGGGVPQPCYGGHRGGRGGCNVPPGRSRTVPELHQAPXPTSKPRRLGQPGGELGQARSPXPGEGRGQVPQQKQKLASVDHSTASQSSQPAPGRSRAGREPLRGGKGTHGDRCVVKANHFFAELPDKDLHQYDV

SEQ ID NO: 125223 - protein, 115 aa, Triticum aestivum
  Clone ID: PAT_TA_19641.pep
SPFLAGLNALFSRGPKRSSVTRIFTLWNTTSVINIIVAIVYGAMYSGLSSLTVSSAQASNTKSFKGREDDGWWILPVVLFVVKSLQAGLVNWHIANLEIQDHSLFSPDPDRFWTM

SEQ ID NO: 125224 - protein, 147 aa, Triticum aestivum
  unsure (1)..(147): unsure at all Xaa locations
  Clone ID: PAT_TA_19642.pep
KETLRLHPPIPLLVPREPQNDAEILGHHVPAGTRVVHQRSWARRPGTRRAWDPARGSSRPEEDXLDGRGGLPRGRTSSLIPFRCLGGRGCPRGRXSPRRTVEMALASLMYHFDWEPAGGASLDMREVNGLAVRLKSGLPLVAKPRFR

SEQ ID NO: 125225 - protein, 189 aa, Triticum aestivum
  Clone ID: PAT_TA_19643.pep
MEKQDSDVAKRALTEAQERNEDLLKRNEDLLNRNNDLVKKIEESGKVITHLQESLQRIEGKAANLEADNHVLRQQAAATPPSTAKSPPSRSKITRIHRSPENGHVLNGELRQAEMRPSAGMPEATPPVGNAPNSSNQKDFEHGEKLQRVLNQKHQSLQPQQPQDDQQWLLTCIPQYLRFSGSKPVATLL

SEQ ID NO: 125226 - protein, 246 aa, Triticum aestivum
  unsure (1)..(246): unsure at all Xaa locations
  Clone ID: PAT_TA_19644.pep
MLPPRLQPRSWARRSSSTRLRPRHRQGSSSATAWMQAWPSVRCTDTDLALPAISAPCTGTGRALHRRPLHHRNRRSSTSHSPTRTSQRRRPPTKTRSTRPLRGYGPVPAHDGVGGDAERRGGAVAQLRCEAGAKHRRRRPTNPAPPSPTSTLPTGMKIEDEALSSTAPASPPPPPQQARERRXRGSTDPSSFRGGVGAAPPRPPLRLLGPCKPPPPRLRCGGDVLLLKIAGAGRHRRRPAGSRGGG

SEQ ID NO: 125227 - protein, 254 aa, Triticum aestivum
  unsure (1)..(254): unsure at all Xaa locations
  Clone ID: PAT_TA_19645.pep
MEQRSLLASAVGMGVGVGLGLASARWAKPAHAADGGSGAGAGAAEVEAELRRLVVDGRDSEVTFDVRPPRPSGRSDQTKEVLISAAFVHLKQADLSKHXRNLSAASRAILLSGPTEAYLQSLAKALSHYYKARLLLLDVTDFSLRIQSKYGGSSKALVQNQSASETTFGRVSDFIGSFAMFPKKDEPRESLRRQTSSADSRARGSDVASNDPLLRKNASMPSDMSDVASQCSVHSARRASSWSFDEKVLIQSLY

SEQ ID NO: 125228 - protein, 155 aa, Triticum aestivum
  unsure (1)..(155): unsure at all Xaa locations
  Clone ID: PAT_TA_19646.pep
CNCHKHQASLVKIHLIKISPRLITLHGXPWQIVENEDMRRILRTISPMTNKVSLSDMEEHLLALFQKKKINVKDEIALTSQRISLSASIWTHDGPEPAVNYLCLTAHFITEDWKIHRLVIKFGMYWCSPTNLERIIHCKEACVPVSDCIPDAWVD

SEQ ID NO: 125229 - protein, 144 aa, Triticum aestivum
  Clone ID: PAT_TA_19647.pep
MEHYGQPHHGTHGVAGSRQPLGGHGGATCGPTGTYRAAAPAGTGQLAPAGDDRQPDGVLRRPGSSSPPSSSEDDGAGGRRKKGMKEKIKEKLPGGAHKDATGQQHTPAAGEYAGTGTGTHGAEATGEKKGVMDKIKEKLPGGQH

SEQ ID NO: 125230 - protein, 113 aa, Triticum aestivum
  Clone ID: PAT_TA_19648.pep
RVRSSSPALWTCSCKRRPMRKTGLTMGSWVVLLRRGLLNLNPRLLSASPRPEGDICRAGDQCSGGRICRARFVDEERLVQVCSEATSGWTRRYSYPTWLILAGHMWMCNLRLI

SEQ ID NO: 125231 - protein, 194 aa, Triticum aestivum
  unsure (1)..(194): unsure at all Xaa locations
  Clone ID: PAT_TA_19649.pep
LWGDPRAALPSEPXYLVTFTVGYAXKENINRAVKKFSDNFAILLFHYDGRVTEWDEFEWSKRAIHISVSKQTKWWYAKRFLHPDIVAAYEYIFIWDEDLGVDHFNAEEYIKLVKKNGLDISQPGLEPDRGLTWQMTKRRGDREVHKXTEERPGWCADPHLPPCAAFVEIMAPVFSREAWPLLWHMIHNDLVHGW

SEQ ID NO: 125232 - protein, 283 aa, Triticum aestivum
  unsure (1)..(283): unsure at all Xaa locations
  Clone ID: PAT_TA_19650.pep
HYSKTERIAQKAPSYDRSHCGYKVAPAAGIPEGDANTSXHAGVVRIVKAARRXKCLLMPDGFIEARPKKQXMSVQERARGKKENRFPKLRMAKAPRXKQHQMSXLHSSSSSSXNKGTLPLGGEPAKKASSASVLAVEGRVLQHALPPASFLGGPAALSPTGPPPPANARPPTNSLASCPIRGLPTSDSLSPCAPTKPAPRFPDSINKPSSRGTPFNMGNWDSSQTNQQVMPLTQIQLEEAMKPAKFEQGGSGFPLESNNALSPTVTMDMAYTSSASPINSLLA

SEQ ID NO: 125233 - protein, 94 aa, Triticum aestivum
  unsure (1)..(94): unsure at all Xaa locations
  Clone ID: PAT_TA_19651.pep
DVRRGHRGEERGGGGQSQPEAPPLEEPPGRAGPERGGGPPALEEPPPPAPPAPRPPPAPDXRPPPAPPSPPEPPPPAPRPAPPPPAPRAPEKLL

SEQ ID NO: 125234 - protein, 161 aa, Triticum aestivum
  unsure (1)..(161): unsure at all Xaa locations
  Clone ID: PAT_TA_19652.pep
PVAPYTHRSRSLPSSSRLRFRVVFGAKITPSQFLPVSADPAKLRTARLGCLRWSRCKALIRAVFNLGDHHHVDVGFPEATVGEDDFLLDYIDFSTCDMPLFHVDDGDDILPDLEVDPTELLAEFADEPATTTVLSPAGXAGAKTVAKNMGNKGTAFENGLT

SEQ ID NO: 125235 - protein, 63 aa, Triticum aestivum
  unsure (1)..(63): unsure at all Xaa locations
  Clone ID: PAT_TA_19653.pep
IDXLKYRADLDIPYLLHIQVPHIKHTKRKRKSERERQCWHESPRKINDIGLGCAILRAHLNVV

SEQ ID NO: 125236 - protein, 344 aa, Triticum aestivum
  unsure (1)..(344): unsure at all Xaa locations
  Clone ID: PAT_TA_19654.pep
TLPRRATTPAAVAERPPRPRLPRPAAAGKGKGKMKGDDLSEEDLELKARLEDCVERAQSRDPRLRIGAIDTLRKEIRAATSSMTSAPKQLKFLRAHYGTLKTCFERMQDSEQQKKHPARILPVVPRARSGEGERESLKYCMMGSLVDVCSWGHEYVRNLAFEIGKEWKFNGSSTPIESKINVVLEIVKFHMKHNAXETEALDLLLEVGYLEMLSDEKKEEYLTMLLHLVDSTNYKRACLYLTSCSKYLSTPDHEATLGTAYDMYMKFRDLASALRIALLVDDHKYCGQNVKIKMVFEETKDFSLKQQFAFMIARYGLSVEIDDEMVADENEKNALQEVVCNTKL

SEQ ID NO: 125237 - protein, 351 aa, Triticum aestivum
  Clone ID: PAT_TA_19655.pep
MAVNEETSVYVGGLPYDADEDMLRSYFGPCGTIVSVKVINDQRIRGKCYGFVTYTQHRAAQRAILEMDGKQIGNRAVRVNEVRTRGNTRDFGRDGFRRDPVRDGRDVYWDRRDRERSYDRHRDRDPYHDRDSDRPRDHDRDRYDERGGFDHEMDYSMDRDHEGDERRARDLYRGDIDRPVEMRMDSDNDRDKENSKGYDSERDKDDKEQPPRKRFSRPKGRESRDISSSSDELQNDAKHQLDKAIQMHEDLENEVSQIRDKVTSKDHHIADLQKKSQKLEDELAAARKVSSERQLTVTKLYKSFLQLQDYNDRAKTAEEDLKALVDSAMAEVDMAEDATTKDGSGYENGMA

SEQ ID NO: 125238 - protein, 84 aa, Triticum aestivum
  unsure (1)..(84): unsure at all Xaa locations
  Clone ID: PAT_TA_19656.pep
MSYSCGSRCTCXSHCKCGKMYPDLTEHGSAGGQVTSVGSLRVAPDNTARHVEVATTQCAKGCTCKHNCKCSRCNELPACTAVML

SEQ ID NO: 125239 - protein, 233 aa, Triticum aestivum
  unsure (1)..(233): unsure at all Xaa locations
  Clone ID: PAT_TA_19657.pep
SFDHVSAPASANTDVYKNISPTVLGVVQGLNVTVFAYGSTGSGKTYTMVGSRNDPGLMVLSFRTIFDQIKXDDSSDTFEVSCSYLEVYNEVIYDLLEKSSGHLELREDPEHGIIVAGLRRIKVHSADKILELLNIGNSRRKTESTEANATSSRSHAVLEITVRRKQKGKYGSQVLRGKLALVDLAGSERATETNNFGQKLRDGANINRSLLALANCINALGKQNKKGLAYVPY

SEQ ID NO: 125240 - protein, 74 aa, Triticum aestivum
  Clone ID: PAT_TA_19658.pep
KSSGTGFCRVGGCRWMFPRFAHLRARVNVHSTLRYVSVHLPYRMSTIVYTHVHNARLAHKFNSPADIDVLPLHP

SEQ ID NO: 125241 - protein, 399 aa, Triticum aestivum
  unsure (1)..(399): unsure at all Xaa locations
  Clone ID: PAT_TA_19659.pep
YVLWQLAEWITTNGAVSLETALSAPAAGEKMLRMGDRPGRPGYDRKKLLLYAIICGCRRQIDRLLKDLPTLFNTIGDFLWFKLSALREYSSASSSNVANEGLVPYMLEDLQNYLNKFEPSYYTKSGKDPLVYPYILLLSIQSLPAILYLSKEVGEXGYHVDAVHISITLADHGILXEGVGSGQKMGVMDACAEADSIIRQYGSIYLRNGNLDLALEYYAQAAAAMGGGQVAACGQGGADRQRHRGSGAKRLPSEILLRAGGFLLLLGPPRMGVDGGRREGLMDWRSRQQFLLEAAHRCQEAGLYDKSVEIHKRVGAFAMALQTVNKCLSDAVCALAHNMLDGESRAVALIQSGNEILETARYSSEASVQDKDLISDQHIILXQFEPILHIFXGRAMFSG

SEQ ID NO: 125242 - protein, 197 aa, Triticum aestivum
  unsure (1)..(197): unsure at all Xaa locations
  Clone ID: PAT_TA_19660.pep
DPTRPPAAARSPLPRPRRQLRVGRVPVAAPAAEPRLRHRHLLPPRRALLLPREAEPPAPRRPGGGARAPSGSGSPCGSSPWRSPNVIAARVPRLDAPKRGLQDPRSGWAFARRQSGVPFLLLLHPRGRPPRRRAPARAGXGKAXXXTRXPPEQKGXXXETSNSXLAXGWXWKXXXKXHXXPFFLKXXKXLIFKNXNN

SEQ ID NO: 125243 - protein, 311 aa, Triticum aestivum
  Clone ID: PAT_TA_19661.pep
MDNYTGIPGSDVLRSRADSQLVAVTYIPRGEQVDEAVRREILRHRSLRHPSVVRLRELVLTPTHLAVVSEHAPDLHRRVRDAGRFSEDEARLLFRQLVSGVSYCHSMQVCHRDLKLENILLDGSCAGPPRLKICGPGVSKRQSQPGAPRASDQTRVYIAPEVFQQREYDGKIADVWSCGMTLYAMLVGAYPFQCPDDEPINFRKIIQRIQSVEYSVPDDLHISAECRDLISKIFVADPAARITVPEIRNHPWFLMNLPADDSTMSTEEAEQPVQSMDEIMQILALAEAPGDTGDDMEEFVDSDPCIDITTC

SEQ ID NO: 125244 - protein, 199 aa, Triticum aestivum
  unsure (1)..(199): unsure at all Xaa locations
  Clone ID: PAT_TA_19662.pep
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTKGRFRLHSVRDEDAKFKLCKVRSVXFGQKGXPYLNTMMAAHPLPRPLIKXNDTIKLDLETNKIVDFIKFDVGSVVMATGGRNTGWLKTGHRDFH

SEQ ID NO: 125245 - protein, 158 aa, Triticum aestivum
  Clone ID: PAT_TA_19663.pep
MASPSSPSRRLAGSLILRPGAEGSLIPGLPDDVAAVILCLLTFPDQSRLRATSRAWRLLLSAATLLPLRRSLRLPSRHLVCLFPTDPSLASPILLDPAAPTAWWPLPPIPCSPQLYGLANFAAIAVGSHLYVLGGSHFDARSYPLGHPSPSAAAYRLD

SEQ ID NO: 125246 - protein, 100 aa, Triticum aestivum
  Clone ID: PAT_TA_19664.pep
KKRGRLIRSILQRCLRSRKDEQRFGFIASFGQHSSLSVLCFLDAQHLQVVLLLLLLLHWLQVVLLLLEESNSDLEANLNLVLLVLLVLQVPNHHLVEDSC

SEQ ID NO: 125247 - protein, 122 aa, Triticum aestivum
  Clone ID: PAT_TA_19665.pep
MCLFSQGGLAQAAASQMGCTNRGEGPRTNIGLNGAILQILSHGFIGAAVCIKAGTATDRMRLVYLEELGGISIPMPKIFTMFSSFSMASLALPGMSGFVAELVVFFGLITSPKFLLMPKTLI

SEQ ID NO: 125248 - protein, 109 aa, Triticum aestivum
  unsure (1)..(109): unsure at all Xaa locations
  Clone ID: PAT_TA_19666.pep
MATTRMALSCCCLGCKARNDLPCSGLLAEARVTMRTTGGKAKTVCSSCPWYGSNRVVYLGPISGDTTSYITGEVSGDYGWDTTTLSCERYTFGKNCXLDVIHCLWDMLG

SEQ ID NO: 125249 - protein, 65 aa, Triticum aestivum
  Clone ID: PAT_TA_19667.pep
AHTRTLFLAMSHTHLDAVTRWRSYMPLVGGETAVRLNANAEAGLTKLDGYLLTRTYMCGYQSLQG

SEQ ID NO: 125250 - protein, 206 aa, Triticum aestivum
  unsure (1)..(206): unsure at all Xaa locations
  Clone ID: PAT_TA_19668.pep
VDPRVRCQISGSADRDEQIGEAADSIERDLILLGATAVEDKLQKGVPECIDKLAQPGVKIWVLTGDKMETAINIGFACSLLRQGMTQIIIALEAPDIIALEKNGDKDSIAKASKRSVMGQIEDGIKQVPTLGQSSTESFALIIDGKSLTYALEDDVKFKFLDLAVKCASVICCRSSPKQKALVTRLVXHSDKVTLAIGDGANDVGM

SEQ ID NO: 125251 - protein, 172 aa, Triticum aestivum
  Clone ID: PAT_TA_19669.pep
MFVSLDPRNLQTYGSTKAAIYFLLKGRVSVARSLPLGPDVPECAEEPPPGVLSPRCAATRSPHLGPGGAVAAPDVGASGGVVVCACCPSGGGIASCEGKCLRSFHATKDASEDCKTLGYTRNQFDAMKVFLCKNCEHERYQCFACHRLSSAKTNPPEVFPCASASCGHFYHA

SEQ ID NO: 125252 - protein, 65 aa, Triticum aestivum
  Clone ID: PAT_TA_19670.pep
TSYEIANLEVSTNLEGNLYFKPERGILFCKPLKRTSPTNKIHTFTHTHMLNVTCLKMNLALLDYA

SEQ ID NO: 125253 - protein, 129 aa, Triticum aestivum
  Clone ID: PAT_TA_19671.pep
GARRGGGGGLGPISRHQMAPAGGAGGAAAAAKRVPMYRLFAFADRRDAALMAVGAAAAMANGVAMPFLAFLVGDLVDAFGPAHRADLVHAVSKVAVRFVYLALASGVAGFLQVSCWMVTGERQAARIRG

SEQ ID NO: 125254 - protein, 176 aa, Triticum aestivum
  unsure (1)..(176): unsure at all Xaa locations
  Clone ID: PAT_TA_19672.pep
HGPLPSAPAPRRLAAPGAAPRSPRPSAWSRRRAGDDGARGRAGRPRARGPAPPQRRRPPPLTAPRRCFAPVRRLLPPLLRRHRMALLTAPAVFAALLLFWAVLGGTDADYLLYKDATKPVGGPRRLTLLXPGMTLAXEKIGQMXTQIGRRAAAPDVLRDNFIGSLLSGGGSVPRKG

SEQ ID NO: 125255 - protein, 145 aa, Triticum aestivum
  Clone ID: PAT_TA_19673.pep
GRPTRPGFPCAPRAADPVPLPLPTYQSRSHGRPTPTTTDMPPPPRTITAQGSSTVPRWPKGRALTSSVTCCPATRTCSTWPSAKAWRRLASSCRPTSPCRQSTRGQWWEAGIFQPQEKEGRTATGAGCGQAQQIDDAGAGGTQDV

SEQ ID NO: 125256 - protein, 288 aa, Triticum aestivum
  unsure (1)..(288): unsure at all Xaa locations
  Clone ID: PAT_TA_19674.pep
VDPRVRDISENNFTGVLPPSMKNLSSLTTLRIQDNQLSGTLDNLQDLPIKDLNVENNLFSGPVPPKLQNIPIPXRRKDGNPFNTTIAPSASPPSASPPSSIGPAPTPTPAGPKQAPTPTTTPTDLSPTRAPSPPSPPSKSPPPSNSSDGSTTRDSTSSSQKHNSSKKLKIAGFVLLVVVLFISIVLLVIFCLSKYQERRSRYDYNRSQLGRVHHRVEPQIMPASVQKRDDTKKGPGEALDKRSRESSLAAAALPKKPAENRKEHIINLDRTRLGTFCSCTPCTSNTPS

SEQ ID NO: 125257 - protein, 198 aa, Triticum aestivum
  Clone ID: PAT_TA_19675.pep
STHASVLQFVVQEIMKPEGHLGSAACKTDATTSPPCGVDCRKHGLQVVAKLAAELTSTKKAASVDMTGLSRSVSELGVGLGKVHDVLRLNGMAASAESARRFHNAMSAFLRQAEEEIVRLQGQESVCLSSVREVAEYFHGGDEAGDGEARLFRVFAGVREFVAMLDRICREAGEVQGDRVGSTPVSWVAAGAPPMGTT

SEQ ID NO: 125258 - protein, 164 aa, Triticum aestivum
  unsure (1)..(164): unsure at all Xaa locations
  Clone ID: PAT_TA_19676.pep
MLRTAIPAAARRRISFAPARFAHELAQAQAQVQSAVPGRDGLEPSWVPLYRRISKLSHGRQPGMAAAEMTKYLRERRPLSEYQIVAYIRKLRKFKRHACALELMDWMEARGAKLTHGHQALRLDLVSKVHGIQAAEEYFWSLPDILKSXXAYSXXLNCYGEHGX

SEQ ID NO: 125259 - protein, 99 aa, Triticum aestivum
  Clone ID: PAT_TA_19677.pep
WSRTELYPNSQSLMVQDFILLTATRTMCCSPTRTLVHRLIHHAPAESGRTSGGSVASTHTWGAVGGTRRTHGGWSAGVRGGPRRRCSTPRCTVRAHSSG

SEQ ID NO: 125260 - protein, 202 aa, Triticum aestivum
  Clone ID: PAT_TA_19678.pep
MEVDTLKDEFDRVVKKQKLASSRTIDLVNQIEKEIEQAIGAIQENGTDRDAASNLNHEILTNLKNTLKELVPVKQLESCQKEMNTALGKWVKTTEKFFINDISKAYKNVDMEPHVLNEIIANHLYREALFDIGDNFLGEASCLASIKLKQLFQEMYEIFGALRTEKSEPALSWAMKNHDALLQNDSCLELKLHQLQFVEILK

SEQ ID NO: 125261 - protein, 142 aa, Triticum aestivum
  Clone ID: PAT_TA_19679.pep
MKSHDCHVLMMQILPVAIRGIMDAHVRETLFGLCNFFDVISRKSVGVRQLRRLQEEIVVILCELEMYFPPAFFDFMVHLLVHIVEDIIQLGPTFLHNMMPFERMNGVIKGYVRNMSRPEGSIATGFLTEECILLHGLSMHRE

SEQ ID NO: 125262 - protein, 169 aa, Triticum aestivum
  unsure (1)..(169): unsure at all Xaa locations
  Clone ID: PAT_TA_19680.pep
QQPDPLLSLASPSLSPSPLLPSPAAAVARPAWRHANHPPPPSITTTPRFTAPSSPLNTTAPPPSLRHPSTITSATLRDPPDSLAAPPCESAPAAVLRPSPADTLLSPXSAPPPFNTTAAPLLKTAAAPSPTSLLLHSFSELSLAVVAVLYPSPRCCSSSPNEILLLLSL

SEQ ID NO: 125263 - protein, 281 aa, Triticum aestivum
  unsure (1)..(281): unsure at all Xaa locations
  Clone ID: PAT_TA_19681.pep
LKWRWKPRRCDMPRFSARSVLEWLRGKRVVFVGDSMSRTQWESFICMLMTGVDDPKKVYEVNGSQISKTIRFLGVRFESFDLSVEFFRSVFLVQQTPAPPLHVTKRVRAILKLDKMDDLSRKWANADMLIFNSGHWWTPSKLFDMGCYFEAGGLLKLGTSVNSAFKMALETWASWVKEKVDLKRTRVFFRTYEPSHWSGLNQKVCEVTERPTTEAIGADRSEFRDILADVVANMSVPVTILNVTLMGAFRSDAHIGYLXSHPSTILXDCSHWGPPGVPNAW

SEQ ID NO: 125264 - protein, 262 aa, Triticum aestivum
  unsure (1)..(262): unsure at all Xaa locations
  Clone ID: PAT_TA_19682.pep
FVVNGYPPVEEFTPVLAKIYAKLKEVGEKFEVVAVSLDSDEESFNNSFSSMPWLAIPHGDKMCQKLVSYFELSDLPTLVLIGPDGKTLSSNIADIINEHGLDAWEGFPFNAEKLEILAEKAKAKAASQTLESLLVTGDVDFVIGKDGAKVPVAELVGKTVLLYFSAKWCGPCRAFLPTLVDVYNKIKEKNSDFEIVFVSSDRDQSSFDDFFSGMPWLAIPLEDERKAYLKKXFKIRGIPSLVAIGPXGKTVNTDAKTLLGGP

SEQ ID NO: 125265 - protein, 621 aa, Triticum aestivum
  unsure (1)..(621): unsure at all Xaa locations
  Clone ID: PAT_TA_19683.pep
TTASTRSVSAPPTPSPLPLRTTPSSEGTSTAASSPTPGGGLGGILAAGDRDYLIRNSGEQVKIXSIEGDTVAFYFSASWCPPCQRFTPKLIEAYKRTYLIWQECFEVIFVSXDQDEEAFNAYFAKMPWLAVPFSGALKAVKALMSGLEVNGIPHLXVFLDATTGEVXTDEGVEFVSEYGYRSLSILQLKRINEXLKEQEKAAKDNQTIHSVXLATPNRNYVISNXGEKVPIVDLEGKYVGICFVVNGYPPVEEFTPVLAKIYAKLKXVGEKFEVVAVSLDSDEESFNNSFSSMPWLAIPHGDKMCQKLVSYFELSDLPTLVLIGPDGKTLSSNIADIINEHGLDAWXEGFPFNAEKLEILAEKAKAKAASQTLVVPSGYWNGVDFVIGKDGAXTVLLYFSAKWCGPCRAFLPTLVDVYNKIKEKNTFRTTRHKEEXSDFEIVFVSSDRDQSSFDDFFCXMPWLAIPLEDERKAYLKKKFKIRGIPSLVAIGPRWERRSTRTRRTSLAVHGADAFPFTDERIQELEKKIEEMAKGWPEKLKHELHEHELDADPPPQAVTAADGCEEMGTSXWSYNCAECDFDLHTKCALGEGEEGRGRVNGQEACCCPSWGTCARGDVCRKA

SEQ ID NO: 125266 - protein, 121 aa, Triticum aestivum
  unsure (1)..(121): unsure at all Xaa locations
  Clone ID: PAT_TA_19684.pep
MRPPVERPPRPRYELPAEAKKVLQEIEPIVTMVRKIFRESSDGIRLPLEDEKFIIEKVLEHHPEKEKKVSGEIDHIMVNKHHVFQDSRCFYVVSSDGTQTDFSYIKCMXNYVRKTTRTSSS

SEQ ID NO: 125267 - protein, 279 aa, Triticum aestivum
  Clone ID: PAT_TA_19685.pep
MASAAPELDLQDLRLQELIRGSMPDRPPSSSSSRVPPLSDDEIGRFDCAVCMEPKLVFDRFRATPACAHDFCVACVVSHIEARVADGAVPVPCPAAGSGCPAAMHPEACKKLLDMDVFDAWCIALCERAVGPGRARCPYRDCGELVVLEAGCGAAVGAVPEEATCPGCSRAFCLLCEEPWDERHDGGQGCALDRLAVGHNWMRCPSCRAMIDRIDGCKSMLCRCGSVFCYGCGSSPAEGMCRCYASRREDLIPLEAGFELVGAGPSACLSSTRGKDAVM

SEQ ID NO: 125268 - protein, 188 aa, Triticum aestivum
  unsure (1)..(188): unsure at all Xaa locations
  Clone ID: PAT_TA_19686.pep
SGQCYPQQQQQEKMAAPQQVRAVPLARALRLRTRASAAAPPETSRRALLGLTEPELRQLAVDLGQQSYRGKQLHDLVYKNRAQQVEEFAYVPKVFREALVGAGWNVGRSPVHHAVTATDGTTKILLKLEDNRLVETVGIPVDDRGTPRLTACVSSQVGCPLRCSFCATGKGGFARNLKGHEIVEQXLP

SEQ ID NO: 125269 - protein, 214 aa, Triticum aestivum
  Clone ID: PAT_TA_19687.pep
MADPPPPDAHPEQSPATEKPPAAPLTPEPEDAAEQDVESEVDEEYVSDPDDALPEMRRREASDDEGSEEGRRPPRARIDPDHDDDGQGAPEDYEGEVEEDEDEEYYDDCVREEDVGEGLEEEYDGHAVPPKEVAAGQGEAGEKPGEEGAEAEAEADGEEKKEQEPFAVPTSGAFYMHDDRFQEDGRGRRRRMLGGRKLWDAKDDQAWVPDRFQE

SEQ ID NO: 125270 - protein, 88 aa, Triticum aestivum
  unsure (1)..(88): unsure at all Xaa locations
  Clone ID: PAT_TA_19688.pep
MAITNVTKCHIITMHKLPKTIYDYYASGADDEWSLHENTXGFASILLRPRLLIDVSKIDMTSSILGLKLXMPIMIIDTVMLNMAHPDG

SEQ ID NO: 125271 - protein, 64 aa, Triticum aestivum
  Clone ID: PAT_TA_19689.pep
MEGASPELPQDILMTSWATLEIPDLIRAGSVCSSWRSTYLRLRSLGHYTRPQTPCLLYTSESAG

SEQ ID NO: 125272 - protein, 113 aa, Triticum aestivum
  unsure (1)..(113): unsure at all Xaa locations
  Clone ID: PAT_TA_19690.pep
XXCSXXFXGGVLKLXLELGTXXLPXKDFAWEEERWGGSGLGTGGGRKRTGTGPMWRDLPLAAAATNPPRRKGIGGLEAVGGKRRADRPGSVRCAVPVREARAAAGAGREGGRN

SEQ ID NO: 125273 - protein, 222 aa, Triticum aestivum
  unsure (1)..(222): unsure at all Xaa locations
  Clone ID: PAT_TA_19691.pep
VREMSYDIEDIIDDFMCKIGERPTRPGFVHDTIQRLKTSRARHQIAGQIGDIKKLVRETSERRDRYKLDVPTSRSVVVDQRVVALSMKNAAKLVGMEGPTNXLVSWLKDEEKKLKVVSVVGFGGSGKTTLANQVYHKAGGXFQCGAFVPVSQKPNMPKLLHSLLAQLGCGQYYHDCELNVLLDQVRENLKNKRYLVIIDDLWDVSAWNIIKCAFPENNLGSR

SEQ ID NO: 125274 - protein, 104 aa, Triticum aestivum
  Clone ID: PAT_TA_19692.pep
PRVRPRVRFSSQNDLLQEQTLHARPPEKRQRVPSAYNRFIKEEIRRIKANNPDISHREAFSTAAKNWAHYPNIHFGLNPERDGGKRLAVDDAAPAAKKIQGFCS

SEQ ID NO: 125275 - protein, 232 aa, Triticum aestivum
  Clone ID: PAT_TA_19693.pep
METLLSPSALLGPLRVSRKPAAPAAVPCSRPAVSCSLKKQAQAQAGVAWRGDGDGGVGSWASFLHHGLAAAALSLALTLSPAPAPAAASEFDVLNDGPPADTYVVDDAGVLSRVTKSDVKRLARDLEARKNIRINFVTVRKLTSKADAFEYADQVLEKWYPTVEDGSNKGIVVLVTSQKEGAITGGPAFVQAVGDAILDATVSENLPVLATDEKYNEAIFSTAKRLVAAIDG

SEQ ID NO: 125276 - protein, 246 aa, Triticum aestivum
  Clone ID: PAT_TA_19694.pep
IQALAARPGGPPFLRITGIDDSNSAYARGGRLDMVGTRLHSISASCGLPFEFNAVHAASHEVYIQHLDIRPGEAIVVDFAYQLHHTPDESVSVENHRDRIIRMIKSLSPRVVTLVEQESNTNTSAFLPRYLETLDYYTAMFESIDVALPRDDKRRISTEQHCVARDIVNLIACEGAERVERHEVFGKWKARFAMAGFRPYPLSSVVNNTIKTLLDSYHSCYRLEERDGVLYLGWKGRVLVVSSAWC

SEQ ID NO: 125277 - protein, 241 aa, Triticum aestivum
  unsure (1)..(241): unsure at all Xaa locations
  Clone ID: PAT_TA_19695.pep
MAQRERGEERERERERERGWERGRDPRPPLEPHAPAAASEFDVLNDGPPADTYVXVDDAGVLSRVTKSDVKRLARDLEARKNIRINFVTVRKLTXSKADAFEYADHVLEKWYPTVEDGSNKGIVVLVTSQKEGAITGGPAFVQAVGDAILDATVSENLPVLATDEKYNEAIFSTAKRLVAAIDGLPDPGGPAFQESKRESNFKSKEETEEKRGQFTLVVGGLLVIAFVVPMAQYYAYISKK

SEQ ID NO: 125278 - protein, 145 aa, Triticum aestivum
  unsure (1)..(145): unsure at all Xaa locations
  Clone ID: PAT_TA_19696.pep
XXXXXQXXXXLDXXRPDEGREIGSGGACRCACALADGRGEGRPTMVWCADQGDTEGGIRLRRQCLVLEAWNRRSWPQSPHAHHQHSHHTPLPIHEVASSSLPSLGAGQGKEEHDCRTRATDLTPSPPSMSLERLASLPRRIPSQA

SEQ ID NO: 125279 - protein, 96 aa, Triticum aestivum
  unsure (1)..(96): unsure at all Xaa locations
  Clone ID: PAT_TA_19697.pep
MAPSMITSPIVAPTSVPSVSRRGXSLAASCSDGKTIKDDKPIALGGRLTVDIYTNCMTVAKKGVYDTVDXYRANNDGYRPIYTPEERPESGDRYAG

SEQ ID NO: 125280 - protein, 336 aa, Triticum aestivum
  Clone ID: PAT_TA_19698.pep
MPITGLENATNWKSESVKGGELDGAYVIANQLDLIEKQQGQTHANIIQMELQCAQDRVGKLEAERVSAKKQLDRLLEKLREEKATWRRREHKKAQSILEDMKADLDHEMPVRRPRVDPRVRLVDELKEVKLAANNLLEEYDKERKTREMAEEVCNKLVREVEEQKSDIEVLERDFVKRREEVDEDRKLLQMAEVWREERVQMKLVDARLTLEDKYGELSKLQQDVEAFVASLGCAKGDSSILVREAEKIIREISLVRDLEVQFKYEPPAASEEILAIFKELRPSQELGRCKVQRSSLDELEIQQASGQMADVCLENLTNRSPCQDSEIEDESSWET

SEQ ID NO: 125281 - protein, 100 aa, Triticum aestivum
  Clone ID: PAT_TA_19699.pep
RSGIPGRPTRPLEPLEGDEGILEAYAKSWTSGILDKAARRDSMSFTLAKHHLSGFVFRRSASVKVRNKMVKSLIRCYSQKQHHEAMLQSLVLQGIPRVSP

SEQ ID NO: 125282 - protein, 77 aa, Triticum aestivum
  Clone ID: PAT_TA_19700.pep
QVRSASWPRSCPFPCCFVDARSAGSRPAAGSSSAASPVPGEQFRLFSHTIVFKILDILKIQIKIDMCTVYLIMSSYR

SEQ ID NO: 125283 - protein, 176 aa, Triticum aestivum
  Clone ID: PAT_TA_19701.pep
TRPGSEPLVPFFHLPCLLPLLPLTQSSIPNSRSRVSLCSSSKAGDHQSFHRLRYYHRLLQGHTIATAAVAKTTTLYPYRSRRRQALQRSVACGGDRGGCNLQFSPAAADAATHRPSTPTATTAVARRRQALQSNERVAAMELQRSFDGCRRCCVEAFDSATMKQWRRNAARASRRR

SEQ ID NO: 125284 - protein, 168 aa, Triticum aestivum
  unsure (1)..(168): unsure at all Xaa locations
  Clone ID: PAT_TA_19702.pep
VDPRVRADILYRSYTAMEEVFLNHVRKQWLVKPQISSVGSCCLVGIINEGVLYIANTGDSCVVPGRVERGAKDIKAVQLSSEHNASFLAVRDELRQVHPNDPRIMALKHKVXCMKGIIQVSRMIGHTYLKSSEFNHEPLLAXFHIRRPFHNPILCPEPSLEXHRLCKI

SEQ ID NO: 125285 - protein, 120 aa, Triticum aestivum
  Clone ID: PAT_TA_19703.pep
GTSHNTHRRPRCPLRPAAALRVQRGCHHSIPLFLPPLHRYPHMAAIFPRLGGLVSALPSHRCQRRCFLFLRKRPVMPPLTSLSWLHRPNPDQLDLCGTTSLHSQWSGPRHPSPASSASGD

SEQ ID NO: 125286 - protein, 212 aa, Triticum aestivum
  unsure (1)..(212): unsure at all Xaa locations
  Clone ID: PAT_TA_19704.pep
PVRNSLGRPTRPHSWLNRTGEHLVFPPEESEFKGGAQLVPDSAREMAPDLDWGKNIRIALDIGCKSAGFGVALLEKDVITLSLGLTNDQTDLAQVALERGIPATIGSLGSRRLPFPSGSFDIIHCSECNIPWHSNGGKLLIEMNRILRPGGYFVISSRHGDLQSEEGISXASMASVCWNVIAYNSDDVSELGVKIFQRPASNDEYDLRSKKR

SEQ ID NO: 125287 - protein, 99 aa, Triticum aestivum
  Clone ID: PAT_TA_19705.pep
PSRSSTDQPRAALCCGLAVPPCSEELSPSLAHSLFLILSVLTLALDQRSRTQLPVSLGEKESGTGSSSSRFSSRYQGVLSCVLFVHVVTSVPTYSSILF

SEQ ID NO: 125288 - protein, 205 aa, Triticum aestivum
  Clone ID: PAT_TA_19706.pep
MDSTVPRSLIVEFVWMERFGDPLFHRHVALASVWGLIALRLADDEIIPFNYVPYASELEESSKVVEDGCPGCAVSFSPLHKSIKQLEKASAKIHMEKKVLQAEKWGLNTRERTLKVREMNDRLMMAERAFTNREGLAGRPWYKHMIYASSDQDDWGTKAFPGIVSAMANAQKLNTSESWRLLQHEIYRGARAVSKASAVLDGRLT

SEQ ID NO: 125289 - protein, 333 aa, Triticum aestivum
  unsure (1)..(333): unsure at all Xaa locations
  Clone ID: PAT_TA_19707.pep
DPRVRMFTNGMKESSAPNVFFEDASAEAFSLLLQFMYSGELKVDNRYITPALVQLLLLSDQFGITVLQFECCKRIMEFLSEDSTVLPEEAYFNEFKGYGLCTFGELASWLGIDXTPESLLQDTVCSVLQAVSSIPSCKLLEEMCKQNFATHFDYCTTACTDFVLLDEATFKDILQPGGMTVSSEEKVLDAILTWCMEACETFYWSSVDKLLSTSTPEQLFGERLTAINTLLPFVRFPLMPPSLLQRMEKSNLAKHIQLFRQLVAEAXEFSNAGPWMMMTNKCERFLHRRSSYRELQYIPDGDNNGVIYYXGTSFREPQWFXPVLTKVRERLCL

SEQ ID NO: 125290 - protein, 194 aa, Triticum aestivum
  unsure (1)..(194): unsure at all Xaa locations
  Clone ID: PAT_TA_19708.pep
TAAWTHLKSIKVALKGAENLPRASHPAREGEAIAWHIKEMLEQQQDVLGSHVTVARVVFHEITEDAIKNALMSPRYIDMDLVNAYLARRSLDYLIGFGISPLLWRKLPGCQSAGRVQSAALALVCDRETEIERFSPQEYWTVDTEFKTQCSDSSKGLCLTSRXSFSIQKLDQLSISSQEEARAIEKRVDAAANS

SEQ ID NO: 125291 - protein, 76 aa, Triticum aestivum
  unsure (1)..(76): unsure at all Xaa locations
  Clone ID: PAT_TA_19709.pep
MSADWSDDNTMILTELFVQQVHAGNTPDNYLTQNDXEEVAXDFKVRTGLEYPRLQLRNKWDKLKTGYSNFIKLKLK

SEQ ID NO: 125292 - protein, 109 aa, Triticum aestivum
  unsure (1)..(109): unsure at all Xaa locations
  Clone ID: PAT_TA_19710.pep
DPIATTRAIGCCENSYFKSHREGLMSPQTETNAGGGSTAGVIDHKLPYYTPQYETKDTDMLAALQVSPQPVVXPVEARAELAGLSYTATWTTAWTDGLTSLDRFKGHML

SEQ ID NO: 125293 - protein, 151 aa, Triticum aestivum
  Clone ID: PAT_TA_19711.pep
PVRNPGSTHASEFPHLGIINDLLEEEQSNVSMAEPPIHEYHPFGVPFSPGGNFAEADMTSSSSSGQLNLNGHYYDRLNALHRLGEGQFSTLGAYTNGMADSFSSKPWLYSYPNPMVNPGVNGFSQQMGDYNNYASGRANEEYMYRRANGQW

SEQ ID NO: 125294 - protein, 120 aa, Triticum aestivum
  Clone ID: PAT_TA_19712.pep
VQDDYHSLRITSVVKFHIQASPKDNHQQHHHYEAKELVQNIKPRRVSTTVGHLRRTASPTELPLSTHYPPFVPKRRRQEDGRTPIPSKRKGPSWVHQQWPYIVPKKIDHGMTVIAGRSAT

SEQ ID NO: 125295 - protein, 191 aa, Triticum aestivum
  unsure (1)..(191): unsure at all Xaa locations
  Clone ID: PAT_TA_19713.pep
MAEMGVRDNLPCSTSWRELTHTSWRDDDYRRMVMASLIEAVYLLELERQERRDAAEVAQQWWKPFSYRLAHELVDERDGSXVFGAIFEWGGPPPARPPGGASARGKADRRAQPXVXAFRGTLLRPPTLRRDVEDELRLLACNSLRGSARLHGALQALRATIDRFGSENVCLCGHSLGAGFARQVGRMLMAS

SEQ ID NO: 125296 - protein, 308 aa, Triticum aestivum
  Clone ID: PAT_TA_19714.pep
MATPVASPLLLPSPAPTFPPRRLTSIRRLLLTSPPHAGRPRLRDPPPAPVEEAAAATVEEYEAPPLRLLDPPQEDRPGPPPSAPAAPDFYRIGYARMMRAYGVEFLEGPDGMGVYASRDVDPLRRARVIMEIPLELMLTITKNHPWMFFPDIIPLGHPIFDIIESTNPETDWDLRLACLLLYAFDVENNFWQLYGDFLPSGDECTSLLLAPKEDLMELEDEDLSSEMLKRQQRAVDFWQKHWHKAIPLKLKRLAPDHERFLWALSIVQSRSFNLNMRMGAFIQDANVLAPYADMLNHSPDANCFLHWR

SEQ ID NO: 125297 - protein, 250 aa, Triticum aestivum
  Clone ID: PAT_TA_19715.pep
PPPPAPPPAPPAARPRAPTPPAAPARSTPRSTAPPAAPPPPAAPSASGGRGPRASYGDSSFSVGYLSKDTVSFGSNSVPNFYYGCGQDNEGLFGRSAGLMGLARNKLSLLYQLAPTLGYSFSYCLPSSSSSGYLSIGSYNPGQYSYTPMVSSTLDDSLYFIKLSGMTVAGKPLAISSSEYSSLPTIIDSGTVITRLPTTVYDSLSKAVAGAMKGTKRADAYSILDTCFVGQASSLRVPAASMGFSGGAAL

SEQ ID NO: 125298 - protein, 127 aa, Triticum aestivum
  unsure (1)..(127): unsure at all Xaa locations
  Clone ID: PAT_TA_19716.pep
KVNXLXLXATVXXXLMXXPAFWXRHXXRXXXVMEXGXCPPXXGRCSEAFHPHPSCXXDSRNCAGGRSIGEEMLPXLSKGMLFLVPRRPVSEDSEELEGNPESCHRSLLSCWSCASFCHGQASVLRHK

SEQ ID NO: 125299 - protein, 143 aa, Triticum aestivum
  Clone ID: PAT_TA_19717.pep
TLRVHPPGPLLSWARLATSDIHVDGFLIPAGTTAMVNMWAITHDPDVWAEPDEFRPERFAAGEFSVMGSDLRLAPFGAGRRSCPGKSLAMATVAFWLATLLHELEFRPAPPPPPARPRARALRLSCEMAAPLAVTPRPRRPAA

SEQ ID NO: 125300 - protein, 335 aa, Triticum aestivum
  unsure (1)..(335): unsure at all Xaa locations
  Clone ID: PAT_TA_19718.pep
MGNHQKLLNFLRPDPAVAACSPRSFSSSSASVSDDDGYSCSSYPTTDGDASPSRYGGSSTPPTPKSPWAHLPGLGAGGAVAEPGATGLIASLVKEDGHVYSLAATGDVLYTGTDSRNVRVWRDQRELAGFRTASGLVKAIVVADDGRIFTGHQDGKVRVWRARADNPAVHRQVGSLPKLKDYLKSAVNPTSYVETQRKGRQRAVWLRHSDAVSSLSLDEGAGLLYSASWDRTFKVWRVSDSKCLESVSAHDDAINTVAAAGFDDVVFTGSADGTVKVWRREMAAKSDATKHVLEKVLGEGESAVTAIAVSAXXRVVYVGSSDGLVTYWYWVRGVL

SEQ ID NO: 125301 - protein, 375 aa, Triticum aestivum
  unsure (1)..(375): unsure at all Xaa locations
  Clone ID: PAT_TA_19719.pep
MAAPSSSAGFGGMSSDNAKGLALAVSSSAFIGASYIVKKMGLRRAADAGVRAGYGGYSYLVEPLWWIGMISMIVGEIANFAAYAFAPAILVTPLGALXIIISAALAHSILEGKQQTGDIRDGFLCVVGSITIALEAPXEREIDSCXGIFWDFATEPAFFSNAALAVFXGSGYLIYTYLTFFLVNXLLSSLAVCSLLGSLTVMSVKALGIALKLTFSGVNQLFYPQTWAFALIVATCVSTQINYLNKALDTFNTAVVSPIYYVMFTSLTIIASVIMFKDWDRQNPTQIVTEMCGFVTILSGTFLLHKTKDMNDSTGPTLSTRRSKHASQTAFAIEVLPLKYQDCVDDETLPLSLPKADNHYLMQELPLRYKDLNIA

SEQ ID NO: 125302 - protein, 312 aa, Triticum aestivum
  unsure (1)..(312): unsure at all Xaa locations
  Clone ID: PAT_TA_19720.pep
FVLRVEDTDLERSTKKSEEAVLSDLSWLGLDWDEGPDIGGDFGPYRQSERNALYKEHAQKLMESGAVYRCFCSSEELEKMKVTANQMKIPPVYMGKWATASDAEVQQELEKGTPYTYRFRVPKEGSLKINDLIRGEVSWNLNTLGDFVIMRSNGQPVYNFCVTVDDATMRISHVIRAEEHLPNTLRQALIYKALGFAMPLFAHVSLILAPDKSKLSKRHGAXTSVGQYKEMGYLPQAMVNYLALLGWGDGTENEFFTIDDLVEKFTINRVNKKWSXVFDATKLKWMNGQHLPSLSSELLIKDFEXDRWRSTG

SEQ ID NO: 125303 - protein, 230 aa, Triticum aestivum
  unsure (1)..(230): unsure at all Xaa locations
  Clone ID: PAT_TA_19721.pep
MSISSARQRRSTAASPLTDDGYSKEAKERRRRTDGEEVEEGIRWFLPFLALGLLRHMSASSNLIHDCDEVFNYWEPLHFLLYRSGFQTWEYSSDHALRSYLYLFIHGLVAGPASSIFGGEHKVRVFYAVRIFLGLLSTITETVLVVALSRRYGKRLACYVLAMLCLASGCFFASTSFLPSSFSMYAHTLSSALLVLNXDACAVSVAAAGVILGWPFSIXVVLPVTVYSLL

SEQ ID NO: 125304 - protein, 215 aa, Triticum aestivum
  Clone ID: PAT_TA_19722.pep
TRPVARYILRENAFSYDKGVLAEILEPIMGKGLIPADLDTWKQRRKVITPGFHALFIEAMVRVFTKCSERTILKLEALIEKADHGDKSTIVNLEEEFSNLALDIIGLGVFNFDFDSVNKESPVIMAVYGTLFEAEHRSTFYIPYWNLPLTQWIVPRQRKFRSDLKVINDCLDDLIKNAKETRQEADVEKLQQRDYSSLKDASLLRFLVDMRGADV

SEQ ID NO: 125305 - protein, 162 aa, Triticum aestivum
  Clone ID: PAT_TA_19723.pep
MHPKARIHADPAAPELDRIDCLPDSLVLLILNKLEDVHSLGRCAAVSKRFNDLVPLVHDVYVKIDRVVAVDGDPDDALNLSSPKPRNILSHFLKLMLFTIAKPFHGARGPGGAGGRPLFPRLAHHSPAQVLRSFTHVRNLHIELPSGDVGTEDGVLLKWRAE

SEQ ID NO: 125306 - protein, 194 aa, Triticum aestivum
  unsure (1)..(194): unsure at all Xaa locations
  Clone ID: PAT_TA_19724.pep
HASAHLNCETELAFFLSPIPNSPTPNPSPXPPARCSALPATPLASSPRRPPPPRPPLAPPPPPRPPPPPRRPPSPPPPPSDAARRCSTRTATSSPSSASSSATXPRPPAPPRPPRLAPGRALPGPAPPPRRPAQDPRPPPPSPAQRGPSPPRRPPPPTRSAHRPSSRPLPSPPQRKRTPRRAGAALRPRSRSIS

SEQ ID NO: 125307 - protein, 117 aa, Triticum aestivum
  unsure (1)..(117): unsure at all Xaa locations
  Clone ID: PAT_TA_19725.pep
YGFFHVIGVGYLXXWVXHNMIPLSEEXXEITQGFALELQGDLKVVQVRFGYVYLSTTCTTPAGTLHCWFFSLSLDTLVLELLVEGKFNGCAHPYNMAWPPCLVGDDGSIGHEVEASH

SEQ ID NO: 125308 - protein, 145 aa, Triticum aestivum
  unsure (1)..(145): unsure at all Xaa locations
  Clone ID: PAT_TA_19726.pep
MSGTAAPRYAPDDPTVPKPWRGLVHASAGYLYYWNPDTNVTQYEKPVPPEAQLPPPPPLPPPPPRAXRPGTVGDRSRSRSRSRSRXTPPRREHRXDRDRDRDRRRHDEHASFLPAAPHPPPPPAAPFIPTAAADDPSAEAYRRPN

SEQ ID NO: 125309 - protein, 359 aa, Triticum aestivum
  unsure (1)..(359): unsure at all Xaa locations
  Clone ID: PAT_TA_19727.pep
MADRDSDSDDNVKFDWXSDGEAEPSSAPAFRXXDAPGPSTLDSNGQANEEAPSTALIEEYVAMGFPKEIVVKGMKEIGHSDADALLELILTYQALGADDAVGNCSTSGCAPQGVEEEEDDDDLDFENWDGDDDDVGGRGTNCDDPGDEDFXQEMSXKDKKINSLVDMGFPEDEGKXAITRCGVDADLCVLVDSISASLVAGDFNSRNISDHQVTDRCFDSFGGRNPRVRMEESKKRRMQYAQGSGSSFAGSHDEPTRIPDPMVGFNLPSDRKPSMTRMLPEQAVGPPFFYFQNVARAPRGAWTTISKKFYDIQPEFVDSKYFCAASRESGYIHNFANWGKRESSXLPFPXKRTVIPWQS

SEQ ID NO: 125310 - protein, 180 aa, Triticum aestivum
  Clone ID: PAT_TA_19728.pep
HASGAVKKASHTRPNPALHALSIPTRNLSSSRFSSASPPPPLLPLHPYLTENGGDEEGRRLAHTRAPDRGSVLAGPGFPSAPRRRRQGGLGSDSLRGVECAGEVSGNRVAGNWRCFWLWVPATPSRTSEPPPPICFLHVSAPGVTCVLHRLSLLTVVAASACCGSSVFVTVVSASKEFLL

SEQ ID NO: 125311 - protein, 106 aa, Triticum aestivum
  unsure (1)..(106): unsure at all Xaa locations
  Clone ID: PAT_TA_19729.pep
GALEQQLVPSFRTPXSSPSLSPALSSPLRNTKPGSPNAAQGRFTLGESMITLQKLQAEHQESNGPCFHSTSTSRCSRSHFCEAQVSLHLASLSGFLPGFAPSGRCL

SEQ ID NO: 125312 - protein, 69 aa, Triticum aestivum
  Clone ID: PAT_TA_19730.pep
AYIFLRRITQGDLLSFLGTYFLHTISTPAELLNVLLGIVHFIYEHNSVKILPSPGYQCICQHFFCCNIG

SEQ ID NO: 125313 - protein, 203 aa, Triticum aestivum
  Clone ID: PAT_TA_19731.pep
MALLALRLGHSGLLPAPPLRRHRQRQQRQRLLVSCSAVSDGGAAVVWFKHDLRLDDHPGLVAACAEPRRRVVPLYVFDSRILAGYSDTRLELLLFALKDLKLALKSQRSDLLIGLGNAEDAVLKLANEVQAGVIYTEEEVEQCVRSVLANVESSLSNGSFTRGNPPEIKFWSAPLYDYKSLRQLSTSRNQFLNEKFSTTTALP

SEQ ID NO: 125314 - protein, 148 aa, Triticum aestivum
  Clone ID: PAT_TA_19732.pep
GSTAFMLWNKHHGNRHFIEAFEVTTPPRRRTVEQLLALQEAISQLEAHVQAGNIFLLKLRSLMLAAFPQSTNKVATTMLVAAAAFAFMPFRIIFVLILLEAYTRHMPLRKKSSEKLVRRLREWWLRIPAAPVQLLRPHDSRRWRSRRR

SEQ ID NO: 125315 - protein, 85 aa, Triticum aestivum
  Clone ID: PAT_TA_19733.pep
RVRSKDKEKKHKKHKDKDKDREHKKHKHRHKDRSKDKDKDKDRKKDKHHEKKRKHEGTEDSADVHKHQKSKHKSSKTDEMGNGLS

SEQ ID NO: 125316 - protein, 244 aa, Triticum aestivum
  Clone ID: PAT_TA_19734.pep
VDPRVRKSDKDKKQGDGKEKKKMVDKDVKETKIEGLGKPLKALKHPKNAVDASGKGSSSGNKSLTDATSSGESQKVNPSSVEPPQGDCITSESEILLKDVLLDSAFTRLKDSETGLHQKSPSELIEMALKFYDEVALPKLVADFGSLELSPVDGRTLTDFMHTRGLQMRSLGRVVKLSEKLSHVQSLCVHEMIVRAFKHIVRSVIAATSDMRQLALTIPAVLNLLLGVPESEFSGSSPAVHPLV

SEQ ID NO: 125317 - protein, 169 aa, Triticum aestivum
  unsure (1)..(169): unsure at all Xaa locations
  Clone ID: PAT_TA_19735.pep
MGNASGGERARFAGKAANVMVDCAWDYINRENVLRAHPATGMHVSKAPRQGFHVEQEDSTLTNGQGKFVPSEKVMQLRQKXMKFMKDHIYPKEDELYKHAQSTSRWTIHPEEENLKALAKEEGLWNLFIPLDSAARARKLLLEDQSHVSAGSSNDLLLGAGLTNLEYGY

SEQ ID NO: 125318 - protein, 194 aa, Triticum aestivum
  Clone ID: PAT_TA_19736.pep
HASDEGVQKAAAALKGSDHRRATNVSARLDAQQKKLNLPILPTTTIGSFPQTVELRRVRREYKAKKVSEEDYVKAIKEEIKKVVDLQEELDIDVLVHGEPERNDMVEYFGEQLSGFAFTANGWVQSYGSRCVKPPVIYGDVSRPKAMTVFWSAMAQSMTSRPMKGMLTGPVTILNLVLVRNDQPRHEILYQIAL

SEQ ID NO: 125319 - protein, 50 aa, Triticum aestivum
  Clone ID: PAT_TA_19737.pep
AALYDCDQSDVICSCVCCNMMNYHYDHIYPWILLRSICFLCCIILIIYAL

SEQ ID NO: 125320 - protein, 241 aa, Triticum aestivum
  unsure (1)..(241): unsure at all Xaa locations
  Clone ID: PAT_TA_19738.pep
IRHEIGRSCKGEFQRWQLFPGACEDKPVMANQFSAFISRKDSAKYSTVLHPGKPDLXRIGSWDWNLNGQKSTYHALYPRAWTVYDGEPDPDLKIMCRQISPIIPHNYQQSSYPVAVFTFTVTNSGTTAADVTLLFTWANSVGGKSELTGYHSNSSMTEKDGVHGVLLHHRTADGLPPVTFAIAAQEKEGVHISECPYFMMSGNSDEFTAKDMWNSVKEHGSFDLLDPVNSSTSSKPGTSIG

SEQ ID NO: 125321 - protein, 162 aa, Triticum aestivum
  Clone ID: PAT_TA_19739.pep
CWSWTAEYVEGHRRPVARKGGGGSGAVAPIGKAAQSNNIKALPLGQMNFLFKISAPPCPPSTPVCVFLPARIDYLDAAACRRRCCSLLLLLAARCCYSDATPLLLLLRRCCSLLLLLAAPLLLLARKEEGKRWRGGEGEKRGRGPAWPRGGAVAARRARGGA

SEQ ID NO: 125322 - protein, 135 aa, Triticum aestivum
  Clone ID: PAT_TA_19740.pep
MNSQLNASENNAASNHISVNSGSGSKTGENSDEESDAQSSGSKRETEIQIVEKLPEIVTHNGASSSRELKIQNGPFDRINTKALALEGTDDAPSGNACGTSKPQVFSAEKNVHSKYLHGITSAKVAGQIMDNAMR

SEQ ID NO: 125323 - protein, 379 aa, Triticum aestivum
  Clone ID: PAT_TA_19741.pep
AGLYLFCLTEIKSSGSNWETEILIVEKLPEIVTHNGASSSRELKIQNGPFDRMNTKALALKGTDDAPSGNACGTSKQQVFSAEKNVCSKYLHGITSAKVAGQIMDNAMRIADASSCRPSDPGKDLMATGQPTTSKKCKSPVTKNNAVKPVMENTLHENSKGAAIGHPQSCPSHLLDVNLGKQQRSDGHVNQELRDKDNFNHSNSSAFSRYGNKRIEPSAKQLSLPSVHLTHQESVYDKNVQSSGTLPSHEHHTCKITMQAQAPLDSCTVGPAIPSSSSAREDAGTSSSSPRKDNFGHPPYGFIPVPLSVGAAIPYQYSAIMPPIYYTQPPFMQCDPSGINQMGIQHAYHSSYHQNLGDPAELDGPRRLQESSAVASCRQ

SEQ ID NO: 125324 - protein, 175 aa, Triticum aestivum
  unsure (1)..(175): unsure at all Xaa locations
  Clone ID: PAT_TA_19742.pep
MKAKGGAAAGERRPVLSRTILLLCACSFGLGMLFTDRFGAMPDLKSPVVAQRRRQEEELQVVSEDFAAEPKPSDDRDVMGEVAKTHEAIQSRRSSLAPLQRELAARRSKHELLESADDVSLQRKEAFVVIGIXTAFSSKKRRDSVGERWMPLGEKLKKLAEAMGVVGRCLIRRRV

SEQ ID NO: 125325 - protein, 299 aa, Triticum aestivum
  unsure (1)..(299): unsure at all Xaa locations
  Clone ID: PAT_TA_19743.pep
KKLDRIRYSRVHGRPFSAQQALPRRRHDGRFRRALSAGWSCTREAGPHASPSALRPAGRLLFAIGQRLPRRSRGGARRPQHISFADGGGAEGDAFVVEGATNVKFSXELTVPGHTEPLIILGTALXGYRDKFFVKVYAAAFYVDISIGLDTEQWRKKVGLETFDASSGFDSIFKAPVVKSLNITLVRDVDGNTFVKALDGVIARRIQKRTDEEESSLSAFRNSFLGRNLQKGTTIYLTWLEPSRMLVSVSTDQGPSQVDAEVKSATVNYALYDGFFGSSPVSPTLRSSTAQLLEAILTK

SEQ ID NO: 125326 - protein, 87 aa, Triticum aestivum
  Clone ID: PAT_TA_19744.pep
CVKTLQRAAARAGTCIRSTHTHTHTHTHSSILSLHRPDIIQAQQQTTIPKSKLIHKQSERGYSIYRHGRRPSDFKVETKRTPSEAGR

SEQ ID NO: 125327 - protein, 247 aa, Triticum aestivum
  unsure (1)..(247): unsure at all Xaa locations
  Clone ID: PAT_TA_19745.pep
MSSSSSSLASTISAAATAARPRHGAVKQQLSTRVKPHLKHAAGCWESSGSGSSRAVVARAGPGPLTEIEPDLQEDPIDKWRTNGVLPEDFVYGVYDGHHTYXEGQEKKGFWEGCLPEWYQEAEXSSGTFQALISWAFPPAVILGMAFDVPGEYLYIGAAIXIVVFCVIEMDKPDKPHNFEPEIYMMERSXRDKLIADYNSMDIWDFNEKYGELWDFTVNRDDLHPTIGAIQEMVVALARFRNGGQFR

SEQ ID NO: 125328 - protein, 107 aa, Triticum aestivum
  unsure (1)..(107): unsure at all Xaa locations
  Clone ID: PAT_TA_19746.pep
MEPGREPTGTIVFASVGVTSFGFDVFSVAAPQTPESASAAGLAERRHTDGVSVNFNAQFKDDGGEEVAFVSERTGSAGLFLCRPGSERAVPLPXVXGGXLFHDRPHP

SEQ ID NO: 125329 - protein, 224 aa, Triticum aestivum
  Clone ID: PAT_TA_19747.pep
MPRRPRASRGGSGGEEVKMEDFVESMLNLGGGGEGEESEEGEQLPAADAPQYKSKNLDAERRRRGRLNDNILKRSALAPDITKMSKESTLADAIGHIKKLQNQVLELQSQLADSPGEAWEKQGSASCSESFAPTDNIHYQGQVELIPLGSCKYNLKIFWTKRAGLFTKVLEALCNYNVQVLSLNTITYYGYAESFFCIEVKGEQDVVMVELRDLLSSIVEVPSI

SEQ ID NO: 125330 - protein, 268 aa, Triticum aestivum
  Clone ID: PAT_TA_19748.pep
GPPQQQPSPPSSSPDTNHSRSRNASRAAAATDPCKPPKKSRRAGRSWRAASAGSDERGQSVSTVATTPSGRRARLSARRRESIRLLDVLPGQGGIGEFLRHPAGVESLLNTRALQSFAPVEPESESGPAGAFRCTLHPMGFLGFQVAPVLDLRVTPTRDDCTVEMLSCRFEGSDSIEQQNELFSAVMTNRITWGDNGDQEPCLDIDVNLEVTLEVYTKPFSLLPLSAVEKPGNLLMQGLLDRLVPMLGEQLLRDYHSWVQQQAQSSSS

SEQ ID NO: 125331 - protein, 473 aa, Triticum aestivum
  Clone ID: PAT_TA_19749.pep
MQRRRAQTWAGVGKTAQAAAAHAALFCFTLLLALRVDGRTDSSWWIIFIPLWLFHGVAARGRFSMPAPSLPHGRHWAPCHSVVAAPLLIAFELLLCIYLESLRVKNHPAVDMKIVFLPLLTFEVIILVDNFRMCKALMPGDEESMSDEAIWETLSHFWVAISMVFLIAATTFTLLKLSGDVGALGWWDLFINYGIAECFAFLVCTRWFNPMIHRPPTHGEASSSSSAIRYRDWESGLVLPSLEDHEQERICGLPDIGGHLMKIPLVVFQVLLCMRLEGTPPSARYIPIFALFSPLFILQGAGVLFSIGRLVEKVVLLLRNGPVSPNYLTVSSKVRDCFAFLHHGSRLLGWWSIDEGSKEEQARLFYTESNGYNTFSGYPPEVVKKMPKKDLAEEVWRLQAALGEQSEITKSTQQEYERLQNEKVLCRICYEGEICMVILPCRHRTLCKSCAEKCKRCPICRNPIEERMAVYDV

SEQ ID NO: 125332 - protein, 137 aa, Triticum aestivum
  Clone ID: PAT_TA_19750.pep
RGSLSVSSPVPGRLASLLKSTNKLPPRVAMTGDVLRMKETKIPVIAESFKKAILKEHKAASEATYGVSTVLSSASATCRSRSEGLLSLLNEESSYNILKFEIGSCVFIDSLGSSHNIELDTFEPPKADLLLPFSAKL

SEQ ID NO: 125333 - protein, 150 aa, Triticum aestivum
  Clone ID: PAT_TA_19751.pep
RSYLWGFNGIVFRKCYFSCVFIDSLGSSHNIELDTFEPPKADLLLPFSSRLIDGINRSDPRRRALILFCFEYFDVTARDALLLSVDHHGFEVLARVPERATAPDVPQQYHWKEFRFTFKEAVKDVEDFCRMLVELEEEALHSVKSYSGLG

SEQ ID NO: 125334 - protein, 195 aa, Triticum aestivum
  Clone ID: PAT_TA_19752.pep
MSNPPASPSGDGGSRISGSPAAGGSREERGAFLPIADIRRIMRKAIPPNGEIDEEAAQALVPEARGDGCKRARPEAMAGDDLLPEMAKQGFQAYPHKNRVELPCTMEAGPNPLPVSDARDWSELPLDALSAIFMKLGTIEILMGAGLVCRSWLVAAKSPELWRFVDMTRHKLVFSKGGNVMCQMAKVAIDRSDGR

SEQ ID NO: 125335 - protein, 110 aa, Triticum aestivum
  Clone ID: PAT_TA_19753.pep
MQRSGRGLQRSGSKRVLDPTNGTGGGGDDDHAAKRPRVPALASVIVEALKVDSLQKLCSSLEPILRRVVSEEVERALAKLGPARVERRSSPKRIEGPDGTNLQLQFKSQV

SEQ ID NO: 125336 - protein, 329 aa, Triticum aestivum
  unsure (1)..(329): unsure at all Xaa locations
  Clone ID: PAT_TA_19754.pep
LPSAPTIRAGAARRSLTPTLIAPLARPPRGAHPPAHLSPGPLDPPEFPDGPAGRAGAAAREASRAGVLPRSGRRRRRSGARRRRVPSTPPGARADDDHAAKRPRVPALASVIVEALKVDSLQKLCSSLEPILRRVVSEEVERAVXRRGPIWFQQEPEPKKTKALIGTNRQLPLRSRLSLPLFTGGKVDGEQGAAIHVVLLDTNTGXVVTSGPESCAKLDVLVLEGDFNKEEDEGWTEEEFEGHIVKEREGKRPLLTGDLQVTLKEGVGTIGELIFTDNSSWIRSRKFRLGLRVASVFSEGIRVREAKTEAFTVKDHRGELYKKHYPPAL

SEQ ID NO: 125337 - protein, 225 aa, Triticum aestivum
  Clone ID: PAT_TA_19755.pep
TGPEFPGRPTRPANLKYPQRLRRLHIFPTNKAENMQPVDRFVVEEYILDVLLFFNGCRKECAFYLVSLPVSFRYEYLMAETIFSQLLLLPNPPFRPIYYTLVIIDLCKALPAAFPSVVGAAVHALFDRISNMDTECRTRLILWVSHHLSNFQFIWPWQEWANVKGLPKWAPQRVFVQEVLEREIRLSYFEKIKHSIEDAAELEGLLPPKAGPNFRYLTHESKEST

SEQ ID NO: 125338 - protein, 241 aa, Triticum aestivum
  unsure (1)..(241): unsure at all Xaa locations
  Clone ID: PAT_TA_19756.pep
YRSGIPGSTHASGTKQKKKMTVAYLKEKPVGQGSTPSTPSSSSGMRSAAARLLGTGNGSRTLSFAGSNGVSRAVSGSSRVGGGVGMSTGVGGSQAVANYDGKGTYIIFNTADTLFISDLNSHDKDPVKSIHFSNSNPLCHAFDSGXAKMGHDLIXGMGPGDVYSNVHXRQQLQDPGKEPVMSSTFYQIKTKDGNCQQHLVLHGFQNKDFVQQCRWNRCNPRWSYWDSNCRIKQLRLHQSST

SEQ ID NO: 125339 - protein, 295 aa, Triticum aestivum
  unsure (1)..(295): unsure at all Xaa locations
  Clone ID: PAT_TA_19757.pep
MDGEWWRKKWVAWAAAAAIFVVLMLVTPAIPQDEDYHDFADQRDLFLGIPNTLNVLSNIPFLFVGLAGLILCHYKNYFRLCSQGELWSWTLFYAGVTAVGVGSSYYHLYPNDATLVWDRLPMTIAFTSIVAIFIIERVDDRAGTKSLAPLVIAGALSILYWSFFDDLPPYXAAFLCLPSIGSPALAIIILPRCTHASYLLWAAGFYLLPKVEEAADKPIYRWTHDIVSGHTLKHLCAAMXPVFLALMLAKGTIDPDRLSLXQMWKISWRERGSQDGNTVDVKYDYAAVSTTSEQQ

SEQ ID NO: 125340 - protein, 124 aa, Triticum aestivum
  unsure (1)..(124): unsure at all Xaa locations
  Clone ID: PAT_TA_19758.pep
MSVLAEVFREPTLAGVARELATLAAPLWLAALVGLLIGWAWRPRWAAAVVDVAGNNHHEPVAAAAAPATVADHFAIVPRAKPASVAPVTEEEELAVSTPDLMHXRRVVEEKDGGPAWTHMMDRT

SEQ ID NO: 125341 - protein, 237 aa, Triticum aestivum
  Clone ID: PAT_TA_19759.pep
DFRISNTWDDMLLEHETLEECTQTGTMVVRWVRKFPFFCSDREYVIGRRIWASGKTYYCVTKSVPRPSVPRSSKPRRVDLYYSSWCIRPVESRNGDGAMTACEVLLFHHEDMGIPWSIAKLGVQQGMWGCVKRIEPGLRAYQTARASGEPISKCAAMAHANTKFVADELTASEDNAEAGSTSNNAQAEKPKATGTGNLPKVFVIDSVVALACPFNKGLLTKALVFGTARRFAGPGRR

SEQ ID NO: 125342 - protein, 409 aa, Triticum aestivum
  unsure (1)..(409): unsure at all Xaa locations
  Clone ID: PAT_TA_19760.pep
MSVLADMLAEVFREPTLAGVARELATLAAPLWLAALVGLLIGWAWRPRWAAAVAGPQQPVLAAAAAAQAPAQPSLTQATAADHLAVVPRAKAASMAPVEEELAVSAPDLMHLRRLGEEEDGEAAWTHRMHRTLPTLRYQPWQGEPQNGPPQYPRYRSIAVAEDASPGVFCGFVWFRDLRISNTWDDWPLEHDTLEECTKTGTMVVRWVRKFPFFCXDREYVIGRRIWASGKTYYCGVPRPSRPSGPRPRRADLCDPGWRFXCIRPVESRNGDRPMTXLLFHHVASGIPWSIAELGVQQGMWGCVKRIEPGLRAYHTGRTAGGPISHCAAMAHANTKFVANELTASENNTEAGSTSNNAQAEKPKHWTGNLPKVFVIGSVVALACTFDKGLLTKALVFGTARRFAGPGRR

SEQ ID NO: 125343 - protein, 97 aa, Triticum aestivum
  Clone ID: PAT_TA_19761.pep
RRVRVIPIMSYSYLKPMKTRSVALYEGPGPRGGLWPVDINHHIICNLCCKIRKVETEPDTFMSRPRDSVNHRASTCVYKGTTRRRFRDNKQQLESQA

SEQ ID NO: 125344 - protein, 172 aa, Triticum aestivum
  unsure (1)..(172): unsure at all Xaa locations
  Clone ID: PAT_TA_19762.pep
MIVRTYGRRSRTFSDGAAGAGAGGGGGDRGLSSSQDAFAFDAGDGDDELAALGSSASQPFPPSQESSSMWDFDEDPPTQPPPPRLEGPRRKGRRGRHAEPEPEAATATLMEAEEYGEMMESVDEANFALDGLRPTAPRRVRRASLLALLGICASXARXXVLRAQGLVKQIID

SEQ ID NO: 125345 - protein, 167 aa, Triticum aestivum
  Clone ID: PAT_TA_19763.pep
EFAAAKILWKFDWCSRKNYLLSIVWCSRMVGGGEFKGTMVQQMVCGGTSNANIFMSGLMPCAVEEQEESTNMPLMSSSPSMACSHDHQLLYHSSGQVPDVRDSAATSPASFQGGQEESQMPESWSQMLLGGLVGDHESDLLSKGLEEGPMAARAGAPAYSFYGHGGG

SEQ ID NO: 125346 - protein, 234 aa, Triticum aestivum
  Clone ID: PAT_TA_19764.pep
MIRPIFLRMRLTDMLKMNPYAKYMKDIVTNKRKIPEAEISTMLANYTFKGGIPKKLGDPGVPTIPCPIKRNYVKTALCDLGAGVSVMPLSLYRRLDLNKLTPTEISLQMADKSTAIPVGICEDVPVVVANVTILTYFGIPDIPEDDSMSIILGRPFLNTAGAVIDCTKGSVTFHVHGGERLPLLWWNRPQVHSINSIGKNPSIIFGGFEFPLPTVKKKYDILIIGDVHIPVEVT

SEQ ID NO: 125347 - protein, 193 aa, Triticum aestivum
  Clone ID: PAT_TA_19765.pep
LVILYCLQFCHIDSLSSDVISTYTGQFKKIQDIPIRRKKPYSLFVEDPVERPDNAARAVGERGLLLIASAFSDAKNKLASLEHTDRNDLLAMLSTPGVCSKLGGRVIANNYTNTPQRTRQHLINVGAKVSNNQRRPRAKGFTGSRPVKNPTQANTVQNPTQVNTVQTPPQVSTHTPRPQPPELYPNHAPHRPS

SEQ ID NO: 125348 - protein, 558 aa, Triticum aestivum
  unsure (1)..(558): unsure at all Xaa locations
  Clone ID: PAT_TA_19766.pep
IFSPSKDEKDHAFLLQLLFWFKQSFRWVNAPACDICDRETSVVGMGNPLPSEIEFGASRVEIYXATIVRASPVSQGTMIRIXLIQTRKGRCGEWANCFTFYCRGFGYEARLILDFTDRVWTECLLNLYGRAAMGWGLHLDPCEGVYPWPLLLLGGSVIFRQPALGVSIDGGVHEITIRCTRTWLEVLSRRTITSEDTVSAILMNITRKCRSGLSSDELLALENRDRKESEELSKATYLEVNNSISLPGRQSGSAEWRAARSELGQADSLSCSSCPIRRCVDAHVSKIHDALSAILSHFCDNNIPNERIIEVFVTLRSLMQNLKDANFKSRRVTLDQKLQQIFEILPSAERLLSAISLKAELHTVGDPSVATDGNLIHTSLALPVALDAVDEILSNYKSNIFYTKGHQFPRGNRLCSGSVLASSEQLPIGIATAAFDGIRLSKWEEPDGAKGCWLMYKVHGGQTCELESYDLMSANDAPERDPMDWVLEGSTDQGSTWNTIDARSSVIFGSRFCRKSFTVDKRYKANVLRFRFLRGRESSANPRFQIGSIDFYGETHMA

SEQ ID NO: 125349 - protein, 261 aa, Triticum aestivum
  unsure (1)..(261): unsure at all Xaa locations
  Clone ID: PAT_TA_19767.pep
MQELKPINPLHTSHVRPLPLPGPSFRAGPRVPPLDLCDTITSIPDALPVGYPGSHTNVLTLPNHHGAISPALPTSNVNPRLSGSPGMVLGSSLPSPSTLNAPSRYGVPRPTSLQGDEQQRIQYTHMVXGRNLQQPGVSVPGCVARWSWIVGVRMMPGANGMGMMTGLARCAPVARPGFPRIGSPGMRNMVSSGNMLSTMVKXMQNSVNLHPGAVPGPGNTMVRPRDPSQLRRPGLDSAALRRRRVLFPGRHLIFMRTLGSV

SEQ ID NO: 125350 - protein, 221 aa, Triticum aestivum
  Clone ID: PAT_TA_19768.pep
PVRNFRVDPRVRNPSRHLLPCENPLRRRPASPRPPFPPSTSPSLSPNKPDPTCTVAASAFSPPQVKSSQKTPIQPPARAETVALYLYPVTRSTTATPTAPPSPPPAPSSKRRRKTDPAAGATGNSPLRGGGRGRSPASSAPRRSSPGLTGPQGGFDPLDPNADPPARVLMPGQVKHCKTALKVLDKTLKKPAAIFDDFRGLPAIRTSLQLAQKFTVGSKSC

SEQ ID NO: 125351 - protein, 301 aa, Triticum aestivum
  unsure (1)..(301): unsure at all Xaa locations
  Clone ID: PAT_TA_19769.pep
ARGGGRAPRSEAMFPIYVMGSSRARAVLLDPSAAGDPIWEAVKAEARSEAEKEPILSSFLYASVLSHDCLERALSFVLANRLEDPTLLATQLIDIFNDVMMNDVDIRRSIRLDAQAFKGRDPSCAQYSWALLYLKGYHSLQSYRIAHVLWNQGRKVLALALQSRISEVFAVDIHPAAKIGEGILLDHGTGLVIGETAVVGNWVSLMQGVTLGGTGKEHGDRHPKIGQGALLGAGATILGNITVGEGAMIAAGSLVLKHVPPHSMAVGNPAKXIGYTEKEDPSLTMKHDARRXXFEHVPVVS

SEQ ID NO: 125352 - protein, 141 aa, Triticum aestivum
  Clone ID: PAT_TA_19770.pep
MKSAPTMDPEAAAAPGTPPETAPRRGEGRKRLPWRMTLSLAYQSLGVVYGDLSTSPLYVYKAAFADDIQHSETNEEILGVLSFVFWTLTLVPLLKYVCVVLRADDNGEGGTFALYSLLCRHARAALLPPGRGAKPGDQDQF

SEQ ID NO: 125353 - protein, 171 aa, Triticum aestivum
  Clone ID: PAT_TA_19771.pep
PPALSDAAPFSPPNLPKKSLDAMSVRQRERASNSPPRSTRQSLLPRSSKDGQILRNASPLPRIRPARGNSRSPNPEGRTSQRPGRNKQSTSAGQAEPVESAAIRSLRRAWDPRASGRGRGGGGGGGWEWRGEERRREGGLRGALISFVVRLLPPLNRNCFGRGVDPGIRTG

SEQ ID NO: 125354 - protein, 333 aa, Triticum aestivum
  unsure (1)..(333): unsure at all Xaa locations
  Clone ID: PAT_TA_19772.pep
MWRSRARALLLLRSSVPRSPPPQQNPLRSLARAPPPPPRLLSRFLSAENCSGKKLLLLFKTAGKNNPDVKSFGNLDIVASNVAESAEIDKMDAYMLWDLVKEMGSVPGSLSTPLLNKVLAMFWKLEKSKAALEVLDKFSEFGCTPDGDSYYLAIQAAGKKSMVGAAWGACEKMISSGCFPDEKKAGEIVTFFCKGKKLTEAHSVYLAAGARKVQIPTSSLDFLVGALAKNDETVSLALELLEEYKGESLKHAGKSFAAVIHSLCRMKNVKDAKKLLMRMVNLGPAPGSAVFNFVITGLSKEGEMEDAKDMIRXVWRARXLRPDVYTYSVIMNG

SEQ ID NO: 125355 - protein, 170 aa, Triticum aestivum
  unsure (1)..(170): unsure at all Xaa locations
  Clone ID: PAT_TA_19773.pep
FSCATTVQTLTRTLSPRRSLLIHRHRLRSLAASPRLPDRARPRLRRPVSASAAPNGSSSGGEHDYDLFTIGAGSGGVRASRFASTLYGARAAICEMPFSTISADVLXGGTCVLRGPLVAPVRRVVSPAELGPRGARSGPWFPAPEAHNAIWGRSLAAELAKLHRTCYQEA

SEQ ID NO: 125356 - protein, 352 aa, Triticum aestivum
  unsure (1)..(352): unsure at all Xaa locations
  Clone ID: PAT_TA_19774.pep
TRPQAQTGSAXXXRVTSIAGPQNISAYKLTSVCVASGTSSVEAKLESSAVPSATSSSGAKGQLYHIVPQSEIFLDTESKNSKYDGNSILGKPPLMYTQETLPPKSPTTSIFTETRPACPGRPPRPETSEANCSAPLQMQDMMREEHTVNAGVTCSKSKAEQVDMTMHMPGASSGSGNGTDVSKLVNVPTCAESGDLHLSLHIGNVSPSDKNNGSSSDVQIGPCSLNDSIQDNENISMIMAIASNSTSALKEIERGSIDSVVSNQCSVAAASMVQTKKPVLEAAKPKTTHGRRKKRKEILPKSSDSAEEVVQSSSTVDKEICTLDAEMGSSAGSNDNQNKNDIFDWEGDMEIS

SEQ ID NO: 125357 - protein, 152 aa, Triticum aestivum
  unsure (1)..(152): unsure at all Xaa locations
  Clone ID: PAT_TA_19775.pep
MRPVFCGNFDYQTRQSDLERLFSKYGPIRRIDMKSGYAFVYFQDERDAEDAIRRLSNAEFGQTSRRLSVEWSRQEEPVPKNRDRPTGADAKPTRTLFGINFDPIRTKVVDIERHXEPYGKIANIRIRKNFAFVQYEAQEDASVSVNKTDQST

SEQ ID NO: 125358 - protein, 312 aa, Triticum aestivum
  unsure (1)..(312): unsure at all Xaa locations
  Clone ID: PAT_TA_19776.pep
AAHGHHLPSSRARAPAAAAPPGAAPHRTARRSRPGFCGNFGYDPRQSALERPFSKYGPSRRFDLSSGYAVVYFRDEPXRLRKQQGAPAAPGATRPPGGSPLGRTSRRLSVEWSRQEEPGPMNRDRPTGADAKPTXTLFVIXFDPIRTKVVDIERHFEPYGKIANIRIRKNFAFVQYEAQEDASVAVNXTDKSTILDRVXVTVEYAFRDDDNERDDRHGSPRRGGDRYGSPRRGGDRYGSPRRGGDRYGSPKRADQGRRPYVRSPSPRYRSPDYDRRPRNSGYDRRDGAPYGRSRSPVYDHYERGRSPGYGRY

SEQ ID NO: 125359 - protein, 180 aa, Triticum aestivum
  Clone ID: PAT_TA_19777.pep
MVQQLFQQRMMPLSLSSNISPICKFLRIFSNQSEYDSAKRSLLHTGTAAPGPQAPNRRRNGSRTLPGGGEASYSKSETFANPAKRSDLEEQAAKARRGTPGGAFGPTGRGGPRRGGRACAPRPPADRWTAAAGTAGPPPHGAGEAHASRSPGRSAGATAGARPGPGRRWGGGGRRGTAGR

SEQ ID NO: 125360 - protein, 125 aa, Triticum aestivum
  Clone ID: PAT_TA_19778.pep
FFPSLPDASSSPSTSPRILTSMDPTAPAFNRVAAPTVEHLDQRALLIRDKFSADGWLCPRCYQVNNPIYNLLYRVPAFECTNPEKCNAKCPATVELSITDCIMNTVRTNFLIRSQGYNRNCTAHA

SEQ ID NO: 125361 - protein, 120 aa, Triticum aestivum
  unsure (1)..(120): unsure at all Xaa locations
  Clone ID: PAT_TA_19779.pep
DEGQIAANLIKHGPLAIGINAAYMQTYIXGGVSCPYICGRTLDHGVLLVGYGAAGFAPIRLKDKPYWIIKNSWGENWGENGYYKICRGSNVRNKCGVHSMVSTVSAVRTSKEYTLISCLP

SEQ ID NO: 125362 - protein, 89 aa, Triticum aestivum
  Clone ID: PAT_TA_19780.pep
SGGRTGWSCPFKYVVFNGGSRLCVGKRFAYTQMKTLAAAVLETFSVEVAPGQVVKPKLNTTLYMKNGLMVSFRRREQQHVHCTTVAAQE

SEQ ID NO: 125363 - protein, 148 aa, Triticum aestivum
  unsure (1)..(148): unsure at all Xaa locations
  Clone ID: PAT_TA_19781.pep
HAQAQHCGVARPIHSPPCTIAAHSFPATLPTTTTPTRHAPPDAGGKAPRPAPPPSSXPHAQREATTRHGAARPFYHAVTPEAATPSRSDCLAAARTCSSPRRPRAPWPRPSRPPCPPCPACDSSSPALAASFTPPYSRAAAAPAGGER

SEQ ID NO: 125364 - protein, 79 aa, Triticum aestivum
  unsure (1)..(79): unsure at all Xaa locations
  Clone ID: PAT_TA_19782.pep
XGXXYSXNQKNPHXIEXEVGPLPPFYGVFLGPASPPFVGFFRRFFRPLPSLHRVYFRVTISHNERNLNRSELSILAQVI

SEQ ID NO: 125365 - protein, 215 aa, Triticum aestivum
  Clone ID: PAT_TA_19783.pep
MEGRSTPATRRFARLTKGQSKRMRPTRRELEFIEPKNHEESEDDSEEDDNMENFIVDDSDCSENSADSVEESSAGPEESDNEETYKELMDRIRGKRNAKNKDWKIEPEMLSAFDEYPELRLKAVCALYRMQTQEEQAGKAIIMHNKKGFNQIDARRGSNIAQFLLDGDAAGPLKKTAQDLEKYDRRALEFCHKMAFRYSKQLFAIYQKKEDPYFP

SEQ ID NO: 125366 - protein, 65 aa, Triticum aestivum
  Clone ID: PAT_TA_19784.pep
KRNDHTARQSGCCNMLIPNRIKGQDFGVFGDAAYCSNLKHYDVLYMIWLANFFWVTSKWVGAKDQ

SEQ ID NO: 125367 - protein, 104 aa, Triticum aestivum
  unsure (1)..(104): unsure at all Xaa locations
  Clone ID: PAT_TA_19785.pep
FPRSIPGRRHAYCFWGEPSQAAAFRSSFKPGGLGRGAXGRVPIPPPSPCATRTPSFXPARSDGRPTTAGGGQTRTPNGAIPLDKGRKEKNSGINHLTWVPWPRV

SEQ ID NO: 125368 - protein, 148 aa, Triticum aestivum
  unsure (1)..(148): unsure at all Xaa locations
  Clone ID: PAT_TA_19786.pep
EGEEEHRWTPWTREGETSPTGGEWGAAPKRKEAMGFNIICKQDLVCRSGAQGGSAPSVEVRGRRLPRRPPRCPWPISPRGGSVLRRPPVGKGEGYYYHSEESEYFHAGESLYVQEYGLETLDAHLQRLALDGDYGGXXGXXLHHHGDX

SEQ ID NO: 125369 - protein, 290 aa, Triticum aestivum
  unsure (1)..(290): unsure at all Xaa locations
  Clone ID: PAT_TA_19787.pep
MATPSAPADCSPPLMILLLLLVFLPLAVSCGDDGSGGYDVVSLTQSGSALSARLELVLAGETPADAALGAGAQRLCLTASLETDSRLRVRITDGDRPRWEVPQDIIPRPAPEDDLHNAPPASSTPLQGXSRVLSAAGSDLVLTVHASPFRFTVSRRSTGDVLFDTAPGLVFRDKYLEVTSALPAXGRASLYGLGEQTKGSFRLRHNDTFTLWNADIGCGPTWDVNLYGSHPFYMDVRPPGTAHGVLLLSSNGMDVLYGGSYLTYKVIGGVLDFYFFAGPSPLAVVSTRPR

SEQ ID NO: 125370 - protein, 144 aa, Triticum aestivum
  Clone ID: PAT_TA_19788.pep
NHKRVTSYQLALQRIRTGGANNILAATDLSDHGDEACRPLLPSAPRDHLTRKPYTHFGGRRGGVQVQESVRALLPRLELQGGVLDRGQNLQRPSTGVQVHQGRHQGHLLLPLLREPHEVPPPPLKTNIPRRSSRYSLLQAGITH

SEQ ID NO: 125371 - protein, 187 aa, Triticum aestivum
  unsure (1)..(187): unsure at all Xaa locations
  Clone ID: PAT_TA_19789.pep
MTTFLLFLILALAAGSSNHGGAAAAAAGDRPDLIVLHTHGSSPPNASVAFQTHDVSFAGFANGGGHWQAFPGLGHLFPTSTPLPFGXASYDDLIGGLANLPGVPLGRQAMIEAARVLSAYDPSAAAVADVEPVKRALATLKMMLSETQRLQPIHETVXGGWESESRXXPEHLPYIDHXDXMSYEIRN

SEQ ID NO: 125372 - protein, 245 aa, Triticum aestivum
  Clone ID: PAT_TA_19790.pep
MLPRSPASLHLRSLRWPRGFSSSSAPAAVAKEGADGKIVASVVFERLPVVIPKIHPVVYAFQEFSFRWRQQYRRQYPDDVLGKADARGKGDYQIDYVPAPRITEADKANDRKSLQRALDNKLYLLLYGKTFGAPDGKPVWHFPEKVYENEDSLRLCAESALKSVLGGLDNTYFVGNAPMAHMVTEQKEDSTVSPFKRFFFKSQVIGTTHLDIRRCEDHAWVTKAELLEYFPEHKDLLNKMIIHVR

SEQ ID NO: 125373 - protein, 241 aa, Triticum aestivum
  Clone ID: PAT_TA_19791.pep
MAANLEDVPSVDLITEVLRRAKCSSKPDKRIILIGPPGSGKGTQSPLIKDEYCLCHLATGDMLRAAVAAKTPLGIKAKEAMNKGELVSDDLVVGIIDEAMKKPSCQKGFILDGFPRTVVQAQKLDDMLAKQGAKVDKVLNFAIDDAILEERITGRWIHPSSGRSYHTKFAPPKTPGVDDVTGEPLIQRKDDTAAVLKSRLEAFHMQTEPVIDYYSNPRVRANLHAEKPPKEVTVEVQKALS

SEQ ID NO: 125374 - protein, 241 aa, Triticum aestivum
  Clone ID: PAT_TA_19792.pep
MATNIEDVPSVELMTELLRRAKCSSKPDKRIILVGPPGSGKGTQSPLIKDEYCLCHLATGDMLRAAVAAKTPLGIKAKEAMDKGELVSDDLVVGIIDEAMKKPSCQKGFILDGFPRTVVQAQKLDEMLAKQGAKVDKVLNFAIDDAILEERITGRWIHPSSGRSYHTKFAPPKTPGVDDVSGEPLIQRKDDTAEVLKSRLEAFHIQTEPVIDYYSKNGLVANLHAEKPPKEVTAEVQKALS

SEQ ID NO: 125375 - protein, 387 aa, Triticum aestivum
  unsure (1)..(387): unsure at all Xaa locations
  Clone ID: PAT_TA_19793.pep
ASGYDRLRAVKAFDDTKAGVKGLVDAGVTTIPSIFHHSLPIEHTDHDHHFTIPVIDLAAATCGTTTTPSMRTELVAAVKAAAETVGFFQVVNHGVPKAVMSEMLAAVRGFHEEPVGAKALYYGRDFGRPVRYWSIFDLFQSQAANWRDTLIIDTAPELPPPEEIPPTCRSIAPKYAKMMEQLGRTLLELLSEALGLRSGHLEEDASCLERLAGHYYPPCPEPHLTLGTTRHSDPCFLDAVGGLQVLLKEDYDGGCNSNNNNNNKSSAVWVDVPAVEGALVVNVGDFLQIVSNDRFKSVEHRVVAQSAGPRVSVXCFFRRQDAPTSTKVLGPIVADGEARFRTPTVAGLLPRHGPKGLARTSALRPSGLCFSLRKSSFRLRSPRYLRG

SEQ ID NO: 125376 - protein, 201 aa, Triticum aestivum
  unsure (1)..(201): unsure at all Xaa locations
  Clone ID: PAT_TA_19794.pep
APISWYRRSFPVALFPPRGHTGENPYLKGTRELSFMKGEPGFREGTKPAGHDSIPMYFNLGAGDTPKKTHGTSLVRTERNKNTFFQGKHSVRKGEFDFGVRAEKPFILSGTGAGQNGQTKVSDSAGFPRENHMEKTKLLMTPNILSLGKKPPVXEGAAXPRRXQWWRSDQSSEDEDEARTGGYMESGASLITRRRPRFSRR

SEQ ID NO: 125377 - protein, 172 aa, Triticum aestivum
  Clone ID: PAT_TA_19795.pep
DPCARYRIGSFSKSIKPQMASSSEKAPSPAAADLPERGKITVAGGKPKGKTRRMTQEEIDSCIRYKGVRIPVDSVRRASKLRLALTNLDDLGSLPVSPDDLDDYVTNMIREVNAIEDDFQKERDEIAKEYYAKGYVEREVSDDDEAGASNARVEMGSPSPRTGSTVTVRKLN

SEQ ID NO: 125378 - protein, 122 aa, Triticum aestivum
  unsure (1)..(122): unsure at all Xaa locations
  Clone ID: PAT_TA_19796.pep
MALRQALGWSDGEVMRPESKTCSRLMRHTAXIFSVGGALASWVLCRLHYGPRITVPXEPGRWAILWARCTTWIGRARGPAATPGMGLHSPTNLIQWSGGKSEIKNSFTFLVLHTTPDCFQWS

SEQ ID NO: 125379 - protein, 138 aa, Triticum aestivum
  unsure (1)..(138): unsure at all Xaa locations
  Clone ID: PAT_TA_19797.pep
FLRSIPSNNLSNLKPMAQDNSLDLECGHLCVGHASTMVXGEVHAASLSAGRWSTRWGHCLLHPVPSGFAGKGMVQNSPIGGTIVPATTCCPLCRRPNLHPSLHRLPSQNFPSTANLIPSPISVIAAAIQKPPPEGXVC

SEQ ID NO: 125380 - protein, 164 aa, Triticum aestivum
  Clone ID: PAT_TA_19798.pep
MASKSTACFPALFLALNLLLVAGVRGQSRNPCPTNALADLKERADVPGGPRLPNPEPASQPGRRMMGGLVTLDVGASPGGARGLSGSGPPIDPRRETPPGHTDSGRTASAAGPKCFVKSPTYSLIKKKKHACILTPTYVVRTLVCLIYLLMCAIDWLLYPWMFR

SEQ ID NO: 125381 - protein, 100 aa, Triticum aestivum
  Clone ID: PAT_TA_19799.pep
GRVGNKWLHFLPISLHKMVDQVLKHILCNTTFTTLFQGKLSAPYPDSNVQSLGLCSVLGADSKRIVTMVRDTFEKEGLTIVIACGRDTIPNACSVRWLAS

SEQ ID NO: 125382 - protein, 285 aa, Triticum aestivum
  Clone ID: PAT_TA_19800.pep
MASSTAAAAAVSSLSPPPVGAERPVPQGRLLFRASRARSSPLRLNPARHHGLSPAPRAAKAVEAAKADPLNVMIAGAPASGKGTQCELIKAKYGLVHISAGDLLRAEIATGTDNGKQAKEFMEKGQLVPDEIVVNMVKGRLLQPDAQEKGWLLDGYPRSYSQAMALETLGIRPDIFILLDVPDELLVERVVGRRLDPETGKIYHLKYSPPENEEIASRLTQRFDDTEEKVKLRLQTHYQNIESLVSIYEDVIVKVNGNTTVEDVFGEIEKLLTSSLDKKTEMVAS

SEQ ID NO: 125383 - protein, 121 aa, Triticum aestivum
  Clone ID: PAT_TA_19801.pep
DHAAKRYIDQKIELVSGTETDDYLDQLDKALKVAQTRFQPQLIIYNAGTDILDGDPLGNLKISPEGVVIRDEKVFRFAKDQNIPLVMMTSGGYMKSSARVIADSITNLSQKDLIQLGSQPD

SEQ ID NO: 125384 - protein, 100 aa, Triticum aestivum
  Clone ID: PAT_TA_19802.pep
AKLDHAATLFTSSKRVNAKKLKEEEEEEEEGRKKYIFQQASDNTTCTSGSAPQSNKSVIAGLQSCLRLENLQYPFTSTSKNWVPSIVLMDGIRLLERGRQ

SEQ ID NO: 125385 - protein, 157 aa, Triticum aestivum
  unsure (1)..(157): unsure at all Xaa locations
  Clone ID: PAT_TA_19803.pep
HPDLFSQRDKQAPRLPPQRANRVALHAASEPTHCSIQLLPAQPNPILCDFPVTAMADVQMGGGAAETETFAFQAEINQLLSLIINTFYSNKEIFLRELISNSSDALDKXFRFESLTDKXSKLDAQPGGSSIRTPSPDKGKKEALQSSTSWGSGMTKV

SEQ ID NO: 125386 - protein, 184 aa, Triticum aestivum
  unsure (1)..(184): unsure at all Xaa locations
  Clone ID: PAT_TA_19804.pep
MAKGGEGPAIGIDLGTTYSCVGVWQHDRVEIIANDQGNRTTPSYVGFTDTERLIGDAAKNQXVAMNPTNTVFDAKRXLIGRRFTDPSVQSRHXKLWPFKVIPGPADKPMIVVQVKGEEKRFAADPISSMVLIKMTQIGEAYLGTTIKNAVVTVPAYFNDSQRLPTXDAGVIAXLNVMRIINEPT

SEQ ID NO: 125387 - protein, 149 aa, Triticum aestivum
  unsure (1)..(149): unsure at all Xaa locations
  Clone ID: PAT_TA_19805.pep
MESRAISPGETALPYAYAPLAPSDVAEERXGGXCGGVRWRACVAVLAASALVVLVVASPLAPAPRVDRAXAGGGRPGLPPLXETARSRGRDAGXXXEXSGAADXMVGLLXAGGXXDGSLEQRXCMXXXGFHSSPRLVTPRPFRMYTLHI

SEQ ID NO: 125388 - protein, 219 aa, Triticum aestivum
  unsure (1)..(219): unsure at all Xaa locations
  Clone ID: PAT_TA_19806.pep
GKAVIFGWLSPAPAAAARRRRAGMAHIHVESMQTAVPTRVALERGRTLPIAVTGPPIAAAELQHRFRAVLYYRDRLEGEAIGAXEQAAWVQESLSEGAGXDNPKMAGPLLAAARRRRPKGRWDWEREAPATPGVAACSWRPMDTNLEXFLGAVGRAPQEPALPRAAHVVARAPEGPSPPLMQVSPFQRGGFAPGACCSLLHTDPLXXINFLKSWARTHX

SEQ ID NO: 125389 - protein, 124 aa, Triticum aestivum
  Clone ID: PAT_TA_19807.pep
RCKHGEGNFDPLKRPPPFFFFFFFFFFFFFFFFFFFFFFFFFFFFFFFFFFFIKTAIHCINCIMNTEDYYMSILRHTRTHKKLEARFFPPSSHTQESCTSIYCVGLVVVPRSYSYTIPSQSDSN

SEQ ID NO: 125390 - protein, 192 aa, Triticum aestivum
  unsure (1)..(192): unsure at all Xaa locations
  Clone ID: PAT_TA_19808.pep
MAAAAPAETMNKSAAGAEVPEAFTSVFQPGKLAVEAIQVDENAAPTPPIPVLIVAPKDAGTYPVAMLLHGFFLHNHFYEHLLRHVASHGFIIVAPQFSISIIPSGDAEDIAAAAKVADWLPDGLPSVLPKGVEPGXSKLALGRHSRGGXTAFSLALGHAXTKLTFSALIGLNPSPRGSLQPKISPTTVLLGW

SEQ ID NO: 125391 - protein, 122 aa, Triticum aestivum
  unsure (1)..(122): unsure at all Xaa locations
  Clone ID: PAT_TA_19809.pep
RLPCPLGQAKLAHALLISLSASSATLPAHLLSDRPRPVNTKCHPMWFPRRPFLRWALRRVACSPGPGPGEAAAPALSCYPRIFSFGDPLPDTGNYVRLTGEEXEPVRSAAVREDVLWASDRA

SEQ ID NO: 125392 - protein, 140 aa, Triticum aestivum
  Clone ID: PAT_TA_19810.pep
ARWKAPPCRPPQELPLVAHPGSSRCELGGVVPGARRQLLRGEPHRLLAEDLVEEPTSSAPAPHSGAARRARFLLLISSMILVTIFLCIFFLTWRHRLITAIVMNTATVAQTADTVAVTAADMPDMPPSSQRLLASCITSS

SEQ ID NO: 125393 - protein, 85 aa, Triticum aestivum
  Clone ID: PAT_TA_19811.pep
FFFQNHSRLRSNIKAERKYERPPPVYGAPSQARPGGSHRLLRYKHRPQPSLATSHMGSPKSCNNNHNTTMTRSRAHCNVIDSSKH

SEQ ID NO: 125394 - protein, 138 aa, Triticum aestivum
  Clone ID: PAT_TA_19812.pep
DNARFALLLHKTRPAAHILEGTSGVVCSLGPAPCCGGRPGLGCGARLGVQVLQLITDVAGSLASTATAAASWVTYKLKLRSFSCKTTKFASSVVHLLPPSQPIIHPLVISEWSSLLPVEEVVCNREVAEVDERPGHAE

SEQ ID NO: 125395 - protein, 134 aa, Triticum aestivum
  unsure (1)..(134): unsure at all Xaa locations
  Clone ID: PAT_TA_19813.pep
MKRNPRVTSSRRKCRKAHFTAPSSVRKDDEVQVVRGTFKGREGKVVQVYRRRWVIHVERITREKVNGSTVNVGIHPSKVIVTKLKLDKDRKALLDRKARGRAXADKAKGKFTAEDVAAAAGGATATGASLQEID

SEQ ID NO: 125396 - protein, 179 aa, Triticum aestivum
  unsure (1)..(179): unsure at all Xaa locations
  Clone ID: PAT_TA_19814.pep
MGFISFVGRVLFASVFLLSAYQEGGSKLARQEGTPQAGRMGAVPALEQEEQLGEGQGGAGHGCGGMAWTLVNLGHFMITYHFFHWKKGTPFADDQGMYNXMTWWEQMDNGKQLTHNRKFLVVVHVVLYVLSCFNFINTTFGSLLGKEQHGRMYAQRMILASQKYYTYSLIMQRTLVCNI

SEQ ID NO: 125397 - protein, 118 aa, Triticum aestivum
  Clone ID: PAT_TA_19815.pep
RPSRRRRRRRRRGAAGGRDAEAELNLPPGFRFHPTDDELVVHYLCRKVAGQPQPVPIIAEVDLYKFNPWDLPERALFGSREWYFFTPRDRKYPNGSRPNRSAGTGYWKATGADKPVAP

SEQ ID NO: 125398 - protein, 106 aa, Triticum aestivum
  unsure (1)..(106): unsure at all Xaa locations
  Clone ID: PAT_TA_19816.pep
MKRNPRVTSSRRKXCRKAHFTAPSSVRRVLMSAALSSELRHKYNVGIHPSKVIVTKLKLDKDRKALLDRKARGRAADKAKGKFTAEDVAAAAGGATATGASLQEID

SEQ ID NO: 125399 - protein, 103 aa, Triticum aestivum
  unsure (1)..(103): unsure at all Xaa locations
  Clone ID: PAT_TA_19817.pep
LDLRRHTQTQIWHSEKIEIXNCEDDGTSXXSRXENVYVRIIGFDNMRQVQFXXSLPSSHRAARSPARPKQLTHHGPHIKCHCSVVNSDIXLGFPSPFVFLTCS

SEQ ID NO: 125400 - protein, 162 aa, Triticum aestivum
  Clone ID: PAT_TA_19818.pep
DDNNYVPPEYGDAATGEAAEDQEEPDDVPNDAATGEAAEDHEEPDDVPDDDDLRRVIVDARTQCESQKEKLKVDHMLEDHKKGLYPNCEDGNTKLGTVLELLQWKSENAVPDKGFEKLLKILKKKLPKDNELPDSMYAAKKVVCPLGLELQKIHACPNDCIL

SEQ ID NO: 125401 - protein, 186 aa, Triticum aestivum
  Clone ID: PAT_TA_19819.pep
MTAPAELSREENVYMAKLAEQAERYEEMVEFMEKVAKTVDSEELTVEERNLLSVAYKNVIGARRASWRIISSIEQKEESRGNEDRVTLIKEYRGKIETELSKICDGILKLLETHLVPSSTAPESKVFYLKMKGDYYRYLAEFKSGPERKDAAENTMVAYKAAQDIALAELAPTHPIRLGLALNFSV

SEQ ID NO: 125402 - protein, 158 aa, Triticum aestivum
  unsure (1)..(158): unsure at all Xaa locations
  Clone ID: PAT_TA_19820.pep
MASAELSREENVYMAKLAEQAERYEEMVEFMEKVAKTVDSEELTVEERNLLSVAYKNVIGARXRASWRIISSIEQKGRRARGNEDRVTLIKDYXRGKIETELTKICDGXLKLLEXHLVPSSTGXRSKVFYLKMKGDYYRYLAEFKTGAERKDAAEKHG

SEQ ID NO: 125403 - protein, 157 aa, Triticum aestivum
  unsure (1)..(157): unsure at all Xaa locations
  Clone ID: PAT_TA_19821.pep
MAKLYVQAVPPPDLNKNTEWVXYPGVWTTYIFILFVSWLLILSIFGCTPGMAWTLVNLGHFAITYHFFHWKKGTPFADDQGMYNRLTWWEQMDNGKQLTRNRKFLVVVPVVLYLIASHTTDYQHPMLFLNTIAVTVLVVAKLPNMHKVRIFGINAEN

SEQ ID NO: 125404 - protein, 168 aa, Triticum aestivum
  unsure (1)..(168): unsure at all Xaa locations
  Clone ID: PAT_TA_19822.pep
SIRQLASHGHGREEGDDEQRQRRRSAGGAAGPWRRRPGAAGIHVCNVDTGSMLNNCRSYCSGWAATKASPSGRLLRRRCAAPTFKCLCNYKGSLPKGHRRQPRHAIPRQXRYGPAPGYHQLQTLATISSFLGCTTXLSDVPAACFGNHLYLVPLRFLISAXSKHLXNK

SEQ ID NO: 125405 - protein, 312 aa, Triticum aestivum
  Clone ID: PAT_TA_19823.pep
MMTAMVKAEPTAAEGSSGRRDAEAELNLPPGFRFHPTDDELVVHYLCRKVAGQPQPVPIIAEVDLYKFNPWDLPERALFGSREWYFFTPRDRKYPNGSRPNRSAGTGYWKATGADKPVAPKESGGRTVGIKKALVFYSGRAPRGVKTDWIMHEYRIAEADRAPGKKGSLKLDEWVLCRLYNKKNNWEKVKVEQDMAVEAGPNGEVMDALATDAMSDSFQTHDSSEIDSASGLQQRVFTDMAQGQPRGGTVTVKEDSDWFTGLSMDDLQTCYMNMGQMVNPATMPGQDGSGYLQSMSSPQMMRPMWQTILPPF

SEQ ID NO: 125406 - protein, 157 aa, Triticum aestivum
  Clone ID: PAT_TA_19824.pep
MAKLYVQAVPPPDLNKNTEWFMYPGVWTTYIFILFVSWLLILSIFGCTPGMAWTLVNLGHFAITYHFFHWKKGTPFADDQGMYNRLTWWEQMDNGKQLTRNRKFLVVVPVVLYLIASHTTDYQHPMLFLNTIAVTVLVVAKLPNMHKVRIFGINAGN

SEQ ID NO: 125407 - protein, 314 aa, Triticum aestivum
  Clone ID: PAT_TA_19825.pep
MAVASSQPAAPSKYPKMAAPTTGPVPADELLGVIQAAAKAGAEVVMEAVNKPRNIQYKGVADLVTDTDKLSESVILEVVTKNFKDHLILGEEGGLIGDSLSEYLWCIDPLDGTTNFAHGYPSFSVSIGVLFRGKPAAATVVEFCGGPMCWNTRTISASSGKGAYCNGQKIHVSPTEKVEQSLLVTGFGYEHDDAWLTNINLFKEFTDVSRGVRRLGSAAADMSHVGLGITEAYWEYRLKPWDMAAGVLIVEEAGGVVTRMDGGEFTVFDRSVLVSNGTVHDQLLERIRPATEALKKKGIDFSRWFKPDNYPTDF

SEQ ID NO: 125408 - protein, 107 aa, Triticum aestivum
  Clone ID: PAT_TA_19826.pep
MAMAGRKVTTSSASVAAALVALLVVAAASGAAGIHVCNVDTGSMLNNCRSYCSVGSNEASPSGACCGAVRGANFKCLCKYKGFLPKDIDANRAMQIPAKCGYGPASC

SEQ ID NO: 125409 - protein, 55 aa, Triticum aestivum
  Clone ID: PAT_TA_19827.pep
AVGSNEASPSGACCGAVRGANFKCLCKYKGLLPKGIDANRAMQIPAKCGYGAASC

SEQ ID NO: 125410 - protein, 105 aa, Triticum aestivum
  Clone ID: PAT_TA_19828.pep
MAAGRRVMSNAGVAAALVALLVVAAAAGAAGYHVCDVDTDSMVSNCRSYCTVGSTEASPSGACCGAVHGGDFHCLCKYKDVLPKNIDANRAMQIPGKCGYGATSC

SEQ ID NO: 125411 - protein, 314 aa, Triticum aestivum
  Clone ID: PAT_TA_19829.pep
MMTAMVKAEPTGAAAGAEGSSGRRDAEAELNLPPGFRFHPTDDELVVHYLCRKVAGQPQPVPIIAEVDLYKFNPWDLPERALFGSREWYFFTPRDRKYPNGSRPNRSAGTGYWKATGADKPVAPRESGGRTVGIKKALVFYSGRAPRGVKTDWIMHEYRIAEADRAPGKKGSLKLDEWVLCRLYNKKNNWEKLKVEQDMAVEAGPNGEVMDALATDAMSDSFQTHDSSEIDSASGLQQHGFMDMAQQQARMVTVKEDSDWFTGLSMDDLQTCYMNMGQMVNPTTMPGQNGSGYLQPMSSPQMMRPMWQTILPPF

SEQ ID NO: 125412 - protein, 285 aa, Triticum aestivum
  Clone ID: PAT_TA_19830.pep
SARGEISDVKKQLEDARSRGIDVRALVVINPGNPTGQVLAEENQYDIVKFCKNEGLVLLADEVYQENIYADNKKFHSFKKIVRSLGYGEDDLPLVSYQSVSKGYYGECGKRGGYMEITGFSAPVREQIYKIASVNLCSNITGQILASLVMNPPKASDESYASYKAEKDGILASLARRAKALEIAFSKLEGITCNKAEGAMYLFPQICLPQKAIEAAKAANKAPDAFYALRLLESTGIVVVPGSGFGQVPGTWHFRCTILPQEEKIPAIISRFTVFHETFMAEYRD

SEQ ID NO: 125413 - protein, 150 aa, Triticum aestivum
  unsure (1)..(150): unsure at all Xaa locations
  Clone ID: PAT_TA_19831.pep
MASKSSITHLLLAAVLVSVFAAAAATGPYCYPGMGLPSNPLEGCREYVAQQTCGVGIVGSPVSTXEPGNTPRDRCCKELYDASQXHCRXCEAVRYFIGRTSDSNSGVLKGPSPGCPKGAPRGTSPRCSVTPGHCNVMTXHNXPYCLRLGI

SEQ ID NO: 125414 - protein, 147 aa, Triticum aestivum
  unsure (1)..(147): unsure at all Xaa locations
  Clone ID: PAT_TA_19832.pep
STSRSIRQLASHGRREEGDDEQRRRGRPRWWRCWSWRPASGAAGLRVCSVDRDSVRXNCKSYCTVGSTEASPSGACCNAVRGGNFKCLCQFRNALXPRTSDGNRAMQIPAKCGYGAGLLLVTVTHYAARYAPAAAVRRRVAGCTSRS

SEQ ID NO: 125415 - protein, 95 aa, Triticum aestivum
  unsure (1)..(95): unsure at all Xaa locations
  Clone ID: PAT_TA_19833.pep
LXTPLLGGIWAPNVRMLPRPPLAARGGISIRRGRGRGFFFFDAGNKFYFCHIVVDTQQHDFRKSGRGYKGSSMHCPTQSMHAHQINLRTYTPTNE

SEQ ID NO: 125416 - protein, 162 aa, Triticum aestivum
  unsure (1)..(162): unsure at all Xaa locations
  Clone ID: PAT_TA_19834.pep
MASKSSISPLLLATVLVSVFAAATATGPYCYAGMGXLPINPLEGCREYVAQXQTCGIXSISGSAVSTXPGNTPRDXRCCKELYDASQALPGAKAMRYFIRRRSDPNSKRGSKDLPGMPPREPQRDFAKVLRLRXGHCNVMNXHNAPYCLGLTYKKIEPGHEE

SEQ ID NO: 125417 - protein, 106 aa, Triticum aestivum
  Clone ID: PAT_TA_19835.pep
MAAGRKVTMSSAGVAAALVALLVVAAASGATGYHVCNVDTDSLVNNCKSYCTAGSSEASPSGACCGAVRGGDFHCLCQYKGVLPKNIDANRAMQIPGKCGYGAVSC

SEQ ID NO: 125418 - protein, 104 aa, Triticum aestivum
  Clone ID: PAT_TA_19836.pep
MAGRKVMRNAGVAAALVALLVVAAASGAAGIHVCNVDTGSMVNNCRSYCTVGSNEASPSGACCGAVRGANFKCLCKYKGLLSKDIDANRVMQIPAKCGYGAASC

SEQ ID NO: 125419 - protein, 226 aa, Triticum aestivum
  Clone ID: PAT_TA_19837.pep
ADEVYQENIYADNKKFHSFKKIVRSLGYGEEDLPLVSYQSVSKGYYGECGKRGGYMEITGFSAPVREQIYKIASVNLCSNITGQILASLVMNPPKASDESYASYKAEKDGILASLARRAKALEIAFSKLEGITCNKAEGAMYLFPQICLPQKAIEAAKAANKAPDAFYALRLLESTGIVVVPGSGFGQVPGTWHFRCTILPQEEKIPAIISRFTVFHETFMAEYRD

SEQ ID NO: 125420 - protein, 107 aa, Triticum aestivum
  Clone ID: PAT_TA_19838.pep
MAMAGRKVTTSNAGVAAALVALLVVAAASGAAGYHVCNVDTDSLVNNCRSYCAVGSNEASPSGACCGAVRGANFKCLCKYKGLLPKGIDANRAMQIPAKCGYGAASC

SEQ ID NO: 125421 - protein, 263 aa, Triticum aestivum
  Clone ID: PAT_TA_19839.pep
MTAPAELSREENVYMAKLAEQAERYEEMVEFMEKVAKTVDSEELTVEERNLLSVAYKNVIGARRASWRIISSIEQKEESRGNEDRVTLIKEYRGKIETELSKICDGILKLLETHLVPSSTAPESKVFYLKMKGDYYRYLAEFKSGPERKDAAENTMVAYKAAQDIALAELAPTHPIRLGLALNFSVFYYEILNSPDRACNLAKQAFDEAISELDTLSEESYKDSTLIMQLLRDNLTLWTSDITEDTAEEEIREAPKHDSSEGQ

SEQ ID NO: 125422 - protein, 284 aa, Triticum aestivum
  Clone ID: PAT_TA_19840.pep
WGLEISDVKKQLEDARSRGIDVRALVVINPGNPTGQVLAEENQYDIVKFCKNEGLVLLADEVYQENIYADNKKFHSFKKIVRSLGYGEEDLPLVSYQSVSKGYYGECGKRGGYMEITGFSAPVREQIYKIASVNLCSNITGQILASLVMNPPKASDESYASYKAEKDGILASLARRAKALEVAFSKLEGITCNKAEGAMYLFPQICLPQKAIEAAKAANKAPDAFYALRLLESTGIVVVPGSGFGQVPGTWHFRCTILPQEEKIPAIISRFTVFHETFMAEYRD

SEQ ID NO: 125423 - protein, 263 aa, Triticum aestivum
  Clone ID: PAT_TA_19841.pep
MTAPAELSREENVYMAKLAEQAERYEEMVEFMEKVAKTVDSEELTVEERNLLSVAYKNVIGARRASWRIISSIEQKEESRGNEDRVTLIKEYRGKIETELSKICDGILKLLETHLVPSSTAPESKVFYLKMKGDYYRYLAEFKSGPERKDAAENTMVAYKAAQDIALAELAPTHPIRLGLALNFSVFYYEILNSPDRACNLAKQAFDEAISELDTLSEESYKDSTLIMQLLRDNLTLWTSDITEDTAEEEIREAPKNDSSEGQ

SEQ ID NO: 125424 - protein, 157 aa, Triticum aestivum
  Clone ID: PAT_TA_19842.pep
MKRNPRVTSSRRKCRKAHFTAPSSVRRVLMSAALSSELRHKYNVRSIPIRKDDEVQVVRGTFKGREGKVVQVYRRRWVIHVERITREKVNGSTVNVGIHPSKVIVTKLKLDKDRKALLDRKARGRAADKAKGKFTAEDVAAAAGGATATGASLQEID

SEQ ID NO: 125425 - protein, 145 aa, Triticum aestivum
  Clone ID: PAT_TA_19843.pep
MASKSSISPLLLATVLVSVFAAATATGPYCYAGMGLPINPLEGCREYVAQQTCGISISGSAVSTEPGNTPRDRCCKELYDASQHCRCEAVRYFIGRRSDPNSSVLKDLPGCPREPQRDFAKVLVTPGHCNVMTVHNAPYCLGLDI

SEQ ID NO: 125426 - protein, 153 aa, Triticum aestivum
  unsure (1)..(153): unsure at all Xaa locations
  Clone ID: PAT_TA_19844.pep
MASKSSITHLLLAAVLVSVFAAAAATGPYCYPGMGLPSNPLEGCREYVAQQTCGVGXSVGSPVSTEPGNTPRXDRCCKELYDASQALPGARRCRYFIGRTSDPNFRRASRDLPGIAPGEAPRGDFAKGXLRYAEGHCNVMTVHNTPYCLGLDI

SEQ ID NO: 125427 - protein, 359 aa, Triticum aestivum
  unsure (1)..(359): unsure at all Xaa locations
  Clone ID: PAT_TA_19845.pep
MEIDAAVRASSDSRLRTKYDNAVYVVQRAFALYPFGEIAFSFNGGKDSTVLLHLIRAXGYYLHKTSSGDEAQINTVQNCPLRTIYFETPCAFPEINSFTYETVSTYGLPLETIRSDFKSGLEGLLKEKSTKAIFIGTRIGDPNAVGQEQFSPSSPGWPPFMRVNPILDWSYRDVWSFLLTCKVKYCSLYDEGYTSIGSIYDTVPNALLSDSSTGNSFRPAYMLSDGRLERAGRAKKTSNKTETNSVASNGMNNAEGEQMISRSASVIVVGDEILFGTVEDKFGAALCKKLHEIGWRVSHVTVVHNEIDSVAEEVERCKSTDDVVFIFGGLGPLHSDISLAGVAKAFGVRLVRSLTFLCC

SEQ ID NO: 125428 - protein, 278 aa, Triticum aestivum
  unsure (1)..(278): unsure at all Xaa locations
  Clone ID: PAT_TA_19846.pep
MATTAMALSPSSFAGKAVKDLPSSALFGEARVTMRKTAAKAKPVSSGSPWYGSDRVLYLGPLSGDPPSYLTGEFPGDYGWDTAGLSADPETFAKNRELEVIHCRWAMLGALGCVFPELLXARNGVKFGEAVWFKAGSKIFNEGGLDYLGXPSLVHPHSIVPSWACQVTLMGPVQGYPAAPPPPRRDRPPALPPRSFDPRGLADDPEAFAELKGKGLNRPRPALPAGSAAACWPSGPEGPRHFLPSPWPPAPSRRLAPRCPDVSARLSTSVVKLRLPSS

SEQ ID NO: 125429 - protein, 170 aa, Triticum aestivum
  unsure (1)..(170): unsure at all Xaa locations
  Clone ID: PAT_TA_19847.pep
MDKEQQRHDELEAPLLPGDGGKAAAAAGSAYALVCSLVASAISVIYGYNRGVMSGAQKFVQDDLGISDAQIEVLIGAXSIYSLVGSLARGFGRATAPGAARTXALSAAMFFAGSAINNVGXGYAVLMAGQLVAGVAWGVSASVRPRPVLSNWRPGGPRWVPPPPIPENGA

SEQ ID NO: 125430 - protein, 161 aa, Triticum aestivum
  Clone ID: PAT_TA_19848.pep
MAPQVWMVGEDGEDLKNHGELLPLSKLQEIGVLYWHLDPKKPESEEELAKIRKDRGYNYMDYLDIRPGKLANFEEKLKNFFTEHMHADEEIRYCLEGGGYFDVRDKDDKWVRIWIKEGGMIVLPAGIYHRFTLDAANHVKLMRLFLGEPVWTAHNRPQEDH

SEQ ID NO: 125431 - protein, 217 aa, Triticum aestivum
  Clone ID: PAT_TA_19849.pep
MALQVWMVGEDGEDLDNHKELLPLGWFSPIGPFYMALQAWIVGEYGGDRKNHRELLPLSKLQEIGVLYWHLDPKKSESEEELAKIRKDRGYNYMDYLDICPGKLANFEEKLKNFFTEHMHADEEIRYCLEGGGYFDVRDKDDKWVRIWIKEGDMIVLPAGIYHRFTLDAANHVKLMRLFLGEPVWTAHNRPQEDHPVRQEYVKRLTDDNAGLALAAH

SEQ ID NO: 125432 - protein, 138 aa, Triticum aestivum
  Clone ID: PAT_TA_19850.pep
MNTQRKPGDWNCNSCQHLNFSRRDFCQRCRATRSDLQLGDGRCIGGVLTSLDVRPGDWYCNCGYHNFASRSSCLKCGTIVRDFPAGQGGTGAAESGGVRAGWKTGDWICTRPGCNVHNFASRIECYHCNAPREAGTGK

SEQ ID NO: 125433 - protein, 188 aa, Triticum aestivum
  unsure (1)..(188): unsure at all Xaa locations
  Clone ID: PAT_TA_19851.pep
MGFGVVSLLNAVFRRAFTSAGLRPSSVAVDADTTLHFWAHPSLLSSPDAESKQRGRRPVVVLIHGFGPDPTWQWASQVGPLSKHFDLIVPTLLFFGASXTSGAPGRSDAXFXAAXIAKLLRQGTTRPPGEXGGWLNXWATTNXGLVXNNLAXALQXGSGPWTXGKVAXXNSDLXKGPKENRAXGXXXG

SEQ ID NO: 125434 - protein, 218 aa, Triticum aestivum
  unsure (1)..(218): unsure at all Xaa locations
  Clone ID: PAT_TA_19852.pep
MAARSALLAAGPAALVAVAAVFLLPDPASRLPWAQRGCFADLILANATIYTADPARPFAGAMAVRAGRVLRVGTYDSLKEFKGRDTYELNLSGNVLLPGFIDSHVHLIYGGLQLARVPLRGVRSKDEFISRVKGAVRDKHPGEWVXGGGWNNEFFWGGEIPTXAAWLDDISPDNPVWLSRMDGHMGLANSLAMKIAGIDKNSNDPVGGTIVRTTEREP

SEQ ID NO: 125435 - protein, 225 aa, Triticum aestivum
  Clone ID: PAT_TA_19853.pep
MERRRSRPPSVAAAGVLLLCLATLVVVGALLPAAWAASADGCPAGGERASKQQGRSRGGHHHRKHAAEEELWVFGDSYADTGNLGNLGRELTHAWYDPYGKTFPRRPAGRFSDGRVLTDFVASALGMRTPVAYKARRRASRETLARGMNFAVGGAGVLDTGNFQRNISAQIDLFQAMHHSQQQRGCAKRTALVVVSGNDYAYAADKDNGTSAAIAYIPTVVRELR

SEQ ID NO: 125436 - protein, 184 aa, Triticum aestivum
  Clone ID: PAT_TA_19854.pep
AYLQYLADMEEQNVAVNSKIVSSSQQNSCSREGKDIYEDYSTADGVYFVNALANEDYIEMKDLLSSDGSASTSEFSSRRSEEYFDSDALLRELLNDQNTTREIHQDCNHNIAGPTKSDCVVISPPEQGLVHNHDNGAMVAGTSLEKAASDSERDQHSERSVSGSPSSWRLPVPQNQPCRTKPFK

SEQ ID NO: 125437 - protein, 90 aa, Triticum aestivum
  unsure (1)..(90): unsure at all Xaa locations
  Clone ID: PAT_TA_19855.pep
KRXAEEKRGVLSPDLLHRRAAAVRGLGVRVLPRRYARHQLQGLLLRGGGAALVRAPREPRRGGEDGGQDQRGRGHRDQGSHCCARGGLRS

SEQ ID NO: 125438 - protein, 329 aa, Triticum aestivum
  unsure (1)..(329): unsure at all Xaa locations
  Clone ID: PAT_TA_19856.pep
PASNPRAPIVLLSLSLSPPPPAPFLLRXMVAPAPAKRRRGGGGGGGEKKDLFHVVHKVPAGDSPYVRAKHLQLVEKDAEASVVWFWKAINSGDRVDSALKDMAVVMKQQDRAEEAIEAIRSFRHLCSRQAQESLDNLLIDLYKKCGKVDEQIELLKQKLKMICLGEAFNGKITKTARSHGKKFQVSIQQEMSRILGNLGWAYMQQNNYEAAELVYRKAQTIVPDANRACNLGLCLIKQGRHEEAVQVLEDVLLRRISGLDDDKAVARAEQLLRELGPTTHVSSPFDIGLSFTEEIMERLDLVMNDWTPFRSRRLPVFEELDAFRGQMAC

SEQ ID NO: 125439 - protein, 314 aa, Triticum aestivum
  Clone ID: PAT_TA_19857.pep
MAAAEVYSPTAAAAAQHQQRGKAATQAWQAVVGWIGFLLQVLLQILRGTPSCAQLLSFVGFRYPLLSSASAAPDQPSPEVAFMPLRSEIPADAAPVPAPPPEPLQRLTVVLDLDETLVSAYESSGLPPIVRTQAVEAGLHCFDMECISTDKDVEGKQKVNHVTVFERPGLHEFLQKTSEFADLILFTAGLEGYARPLVDIIDAHNRFKLRLYRPSTVTTEYREHVKDLSCLSKDFSRIVIVDNNPFSFIVQPLNGIPCVPFSAGQHSDDQLMEVIFPLLKHLSVQRDVRPALYERFHMPEWFHRPGRSRTDQAS

SEQ ID NO: 125440 - protein, 148 aa, Triticum aestivum
  Clone ID: PAT_TA_19858.pep
MELAAPCSFSCSSYTHCSIGITPARALRAGAGAWRLRAGAHHGGGDGVEPGRPAGRLAADGPPVVDVPAVVGAADGFGGARDAELAMWEKLGAVVRLSYGIGIYAGMALAGRAICDMADIDSSGGFHPSLTALVEGLGYASPPIMALL

SEQ ID NO: 125441 - protein, 182 aa, Triticum aestivum
  unsure (1)..(182): unsure at all Xaa locations
  Clone ID: PAT_TA_19859.pep
PGXXDRLVDVVDICFKSELGKICWIRDVEVEAGGPEGVQALHLAXRGEPLTXQKVSFERRRLAEPLPRPLGMRFMSACDLQHPAYNDAMASGDVVIYCSVLWSWRRPDPGGSWPNAARERRPTEPRARFSPPPCCPSGRGGRTGGRPTEEGIRGRRRRGRGRRVWLGFAWRAGERRELCASC

SEQ ID NO: 125442 - protein, 150 aa, Triticum aestivum
  unsure (1)..(150): unsure at all Xaa locations
  Clone ID: PAT_TA_19860.pep
MLSLRSDARHLAAPVVRGGDDVWLGVSGGAGPAPEGPAPAAAFLLPPVSLDARAKQLVGVNEEDHLALAHQSYKSGKYSQALEHGNAVYEKNPRRTDNLLLLGAIYFQLRDYDLCIAKNEEALAIDPQFAECYGNMANAWKEXXDIDXXI

SEQ ID NO: 125443 - protein, 154 aa, Triticum aestivum
  unsure (1)..(154): unsure at all Xaa locations
  Clone ID: PAT_TA_19861.pep
MAAKEPMRVLVTGAAGQIGYALVPMIARGVMLGADQPVILHMLDIEFAAEALKGVKMELIDAAFPLLKGVVATTDVVEACTGVNVAVMVGGSPRKEGMERKDVMXKNVSIYKSSSXSLLKLNAAPNCKGLGCLQTPSKTTKLLPTLKGGFANFI

SEQ ID NO: 125444 - protein, 361 aa, Triticum aestivum
  Clone ID: PAT_TA_19862.pep
MAAGPTPSTAASFRPPLPPPPPCFDYRSASLADTRASAATADPALAGLVESGALVRVPRRRFGPVPAWRPPDFAEPEDVWILGTSHLSAESADEVERVLRAVHPDNVVVELCRSRAGIMYASDDASGEPLLKSNMFSLGGAKFFGAVNRSINLGGQSALALRLLLAVFSSKISSGANRPFGEEFRAARRVSEDIGAQLVLGDRPIEITLERALKSLSWDEKTKLVISLFRGITSTTDMPQDEKAAVSPYELYEKLSSSYPSLLQPLIHERDMYMAWSLKRSKAVNKSKTVVGVIGKGHMNGVVYALISDQGDLRFRDLVGRESSETWASSVVKGLVRDTVIGLALWALYELLQAAALHITL

SEQ ID NO: 125445 - protein, 169 aa, Triticum aestivum
  unsure (1)..(169): unsure at all Xaa locations
  Clone ID: PAT_TA_19863.pep
RRQPWRGQAASAXKARQLRQRHGHGHRRSYFYLLAADSSPKYQPGQSCRKIRRKEXGLQAEGGDGKGNAAEGLEEGQAKSDCTDEQHDLDGEVGQDGRGSCGGSEYEKGGEMERVLENQAALIGQYEAQKNAQREWEKKFNGSRRFNFYVHTYFSSINNEIIRYNTYGA

SEQ ID NO: 125446 - protein, 676 aa, Triticum aestivum
  unsure (1)..(676): unsure at all Xaa locations
  Clone ID: PAT_TA_19864.pep
ARGSNGISNGISRVMSVGSNEAAPRRGMVLPFSPLSMCFDDVNYYVDMPAEMKQQGVTDDRLQLLRDVTGSFRPGVLTALMGVSGAGKTTLMDVLAGRKTGGYIEGDIRISGYPKNQATFARISGGSGQNDIHSPQVTIRESLIYSAFLRLPEKIGDQDITDEIKIQFVDEVMELVELDNLKDALVGLPGISGLSTEQRKRLGAWVELVANPSIIFMDEPTSGLDARAAAIVMRTVRNTVDTGRTVVCTIHQPSIDIFEAFDELLLLKRGGQVIYSGKLGRNSQKMTEYFEAIPGVPKIKDKYNPATWMLEVSSVAAEVRLSMDFADYYRTSDLYKQNKVLVSQLSRPEPGTSDLYFPTEYSQSIIGQFKACLWKHWLTYWRSPDYNLVRFSFTLFTALLLGSIFWKIGTNMGDANTLRMVIGAMYTAVMFVGINNCATVQPIVSIERTVFYRERAAGMYSALPYAIAQVVMEIPYVFVQTSYYTLIVYAMMSFQWTAVKFFWFFFVSYFSFLYFTYYGMMTVSISPNHEVAGIFAAAFYSLFNLFSXGFFIPRPKIPKWWIWYYWDLPXLAWTVYGLIVTQYGDMEDIITVPGQPNQTISYYITHHFGXYHRSFMAVVAPXVLVLLAVVXAFMYALCLKKLNFQTRSGQKANGQIRRNMVDFLEQLFFLFSIMPV

SEQ ID NO: 125447 - protein, 139 aa, Triticum aestivum
  unsure (1)..(139): unsure at all Xaa locations
  Clone ID: PAT_TA_19865.pep
FQSXXXIXXVXGSFRGXLVXWPGXPRNGXXXGXFPGGQAADGGRRAAAFPWIXFPCWGKTRRELAFWWPFHFPFPMGVGLSSHGTHPIPMAWEPPTYPEGFEVVEEDGXRGYGQLEPAGEEEGPARNPTLATRLGLRSS

SEQ ID NO: 125448 - protein, 145 aa, Triticum aestivum
  Clone ID: PAT_TA_19866.pep
THFELAGRKLGEVWSALKRRREQGRAGAGGRGPRRRPVFRGGAPRTTTWSVAGPSSSSDVLVRNGGGPGLVQPPPSAAAAPRPADAAAARPPGACAPRAAAPPPPSQCPPAASRPWPTPAPPALLPLKARIFGTESKAAGEIFVR

SEQ ID NO: 125449 - protein, 155 aa, Triticum aestivum
  Clone ID: PAT_TA_19867.pep
MASGFHFPLLPPAKIAEQLVEFDVAPLANLRAEHIASPQPDLLPCVLDRFFDYVVGGPGDGEDEQLGFSELEALDNPEHHEEAIRLLRLYNKSQTFLESIHYRDLTLADFTHPTPRRVVEVLSALINFLLYRHDKTELLQSIVSESSDYHERGLE

SEQ ID NO: 125450 - protein, 358 aa, Triticum aestivum
  Clone ID: PAT_TA_19868.pep
MQGTRDMSAKGGKALVQSDAGKYVAWSGVDQPELAAEGLGCGLLLLRPLSFALPHYADCHKFGYVLRGSGVAGVLPVATGDASPAARERVVRLEAGDVIATRTGEVSWWYNDSDGDAGDLSIVFMGDTERAVSPGDMSYFFLAGGNSVLGGFDAGLLAGAWPGVTKEQAAAVFRSQPAVLLTGLSKKLPGVRPREDDRKRLVVNAGQVAAGTLKTLTAADMAALGGLGISVVLGRLEPGAARAPWVLREGAAQLVYVARGSARVQVSSSAGGETLLLDEEVAAGSVFVVPRFTVTLISAGADGAQWVSLIKSARPAVEHLTGGGSVLGGLTAQVVQASLSVAPELVELLGGRSAEPSH

SEQ ID NO: 125451 - protein, 190 aa, Triticum aestivum
  unsure (1)..(190): unsure at all Xaa locations
  Clone ID: PAT_TA_19869.pep
IIFAGIQILLSQLPNFHKLWWLSIVAAVMSLAYSSIGLGLSIAKIAGGVHAKTSLTGAAVGVDVIRAXKVWRTFQSLGDIAFAYSYSNVLIEIQDTLRSSPXENAVMKKASLXGVSTTTAFYMLCGVLGYAAFGNNAPGNFLTGLRLXEPFWLVDIGETXLASVVHLVGAXQGLLPTPSTISGLGPPPRL

SEQ ID NO: 125452 - protein, 120 aa, Triticum aestivum
  Clone ID: PAT_TA_19870.pep
SCPSITWVATQSSWRRSRSPSSWPRRRRSSPPRQGRRTPSPRSSQRKPSAGRATPPACRRATPTAAPPPPMSSTLPTVVQLLHTPPSALQLSSTKPTMVQPPPLLTAMTTKAVTKVAGDD

SEQ ID NO: 125453 - protein, 85 aa, Triticum aestivum
  Clone ID: PAT_TA_19871.pep
VSRTIRREQDQIQQGNKTKRGAPKEHPIFPEHTRRSLSKGLHSLDMSWNKITNVEGLWELMNLRVLNLIYNWISCTGLGTYLEIT

SEQ ID NO: 125454 - protein, 185 aa, Triticum aestivum
  unsure (1)..(185): unsure at all Xaa locations
  Clone ID: PAT_TA_19872.pep
TASASSSATATATATTTSKTLQHGPGRAIWLASASTRVPPRRGRERLSFLSRSLREDLRLIRARAGELETFLSAPVPEPDLFARLRKAYNTTSSSASASGIGRTRLDLSAIGKAFEAEVGRGWGAKTGWXWEDXRRPRXGKPYXAVKGRXXXGTSTAXXQGTXVKRTXPHNGQXPNPENXIXFXN

SEQ ID NO: 125455 - protein, 249 aa, Triticum aestivum
  unsure (1)..(249): unsure at all Xaa locations
  Clone ID: PAT_TA_19873.pep
RQKLERGGGSRTSGSPGLEFGTSDVSRQXXLLRAATYGLAFCSRFPHGRFQEMCKILRVLNAVRDPEIGMPLTVKQYKLLTATVLIGRLINANQHLLALRISEYLNLNPEVVIMHWACEKRTASAAIPDVVLLEGLLGKLRLCKGISYAAVAAHADNSGRRKLAAMLVDHESQSSKQIPLLLSIDEQDKALQKSIESGDTDLVYLVLFHIWQKISCRKRAPPWDFFWGVINAKAFGLENLVNSNMPDNS

SEQ ID NO: 125456 - protein, 97 aa, Triticum aestivum
  Clone ID: PAT_TA_19874.pep
SWAGRSFHQKKKNDRALISTNWTPQTQIDATRIGKEEHINSVGRGRTATRVSPRPHSRGRLANRRQRRRRQAVLRPPAQVPLTAAGRDRLGLMMFPL

SEQ ID NO: 125457 - protein, 171 aa, Triticum aestivum
  unsure (1)..(171): unsure at all Xaa locations
  Clone ID: PAT_TA_19875.pep
EDLKRGFVASNSKDDPAKEAANFTSQVIIMNHPGQIGNGYAPVLDCHTSHIAVKFAELVTKIDRRSGKELEALPKFLKNGDAGIVKMIPTKPMVVETFXATYPPLGRFXAVRDMRQTVAVGCQSKGVGEXKDPPGAKVTKAAIKEEISVLPSRCFSFTAFFCCFKPSSQRY

SEQ ID NO: 125458 - protein, 163 aa, Triticum aestivum
  unsure (1)..(163): unsure at all Xaa locations
  Clone ID: PAT_TA_19876.pep
FNDMSGNHVGVDVNGLNSVDADNAGYYDDGTGAFRNISLVDRKPMQVWVDFDGRTMQVNVTMAPLQVARPKKPLLSATVNLSSVIDDTAYVGFSSSSGILFCRHYVLGWSFKMNGAAPALNISSLPSMPVTFPKPRSKVLEIVLPIAXALLXFPRAAASSCTC

SEQ ID NO: 125459 - protein, 442 aa, Triticum aestivum
  Clone ID: PAT_TA_19877.pep
MLYIYMVAGARDSRLAQAVAGRALAPLISGSASGLLPLLVSVGAARVPGRAPVKKHSSPSILSFLAIDAVAKSRDGRYRIVGNDEREQTLNQLLTEMDGFDTNSAVIVLGATNRADVLDPALRRPGRFDRVVTVEAPDKFGRESILKVHANRKELPLGKDVDLSGIAAMTTGFTGADLANLVNEAALLAGRSNKEIVEKIDFISAVERSIAGIEKKHVKLKGNEKAVVARHEVGHAVVGTAVANLLPGQPRVEKLSILPRSGGALGFTYTPPTTEDRYLLFVDELRGRLVTLLGGRAAEEIVLAGRVSTGALDDIRRATDMAYKAVAEYGLNQRIGPISLATLSNGGLDDSGGSPFGRDQGHLVDLVQGEVKALLQSALEVALSVIRANPAVLEGLGAYLEENEKVEGEELQEWLKSVVAPEELTSFITGKQEHVLQLEVGL

SEQ ID NO: 125460 - protein, 140 aa, Triticum aestivum
  unsure (1)..(140): unsure at all Xaa locations
  Clone ID: PAT_TA_19878.pep
PGSPGSLENAAHTAVHIWVGGDMGVLGTAGRDPVFYSHHANVDRMWHLWTTTLGNQDFLGAGAGTEDDWRDTSFVFYDEKRRPVRISVXRRPXTPAGLGVTYEEKETLEWXDKAGPKPGDRDKTRPGPPXXSPAALSFPG

SEQ ID NO: 125461 - protein, 161 aa, Triticum aestivum
  unsure (1)..(161): unsure at all Xaa locations
  Clone ID: PAT_TA_19879.pep
MVSADVARNIVGIIGNVISFGLFLSPVPTFWRICKAKDVEEFKPDPYLATLMNCLLWFFYGLPIVHPNSTLVLTXINGIGLVIEGAYIIIFIIYAAKNTRGKMLRVPALPAGFRAAGAPGGPGGAPSRGPRPMVVAAPCVSVGFSFVNFGSNQCPSPRNMG

SEQ ID NO: 125462 - protein, 110 aa, Triticum aestivum
  Clone ID: PAT_TA_19880.pep
TGIHIALLTKISSLAATWAAPVARTAAVRPPRPSRGSGRACSTPAPGRATGGSPGSISRGKTWLDRSDPLAASPCTQRTNSHAHGVLRNDERSTWGRRGCSSGQHFKRCP

SEQ ID NO: 125463 - protein, 241 aa, Triticum aestivum
  Clone ID: PAT_TA_19881.pep
FAVSSQRLNLLYNRTAYNLVLPIVTTTTLGASALKKVAPWLTAALGIVPQPSVICPIHILFVVVLLIIMATVYLSLHRRAVYLVDYACFRPSSNLRLTKATFLEHARLSPLFDDSTVNFIATILERSGMSDHTCAPPVHHYIHPYCGLDEARAEVELVVFSVIDDLMAKTHINCGAIGALITNCGAFSPVPSMADMIVNRYKLRGDLRVINLSGMACSAAVTSVGLASNMLQVMPWGSHVL

SEQ ID NO: 125464 - protein, 126 aa, Triticum aestivum
  unsure (1)..(126): unsure at all Xaa locations
  Clone ID: PAT_TA_19882.pep
PDPDPKPXFHPPPPPPPPLPPLPGPKGPSPSSPPAPEMVLERRVRARRRRTVVEAEAEARRLMVVVAEEVAWGRRSTGLAGGEEPAVAVAAEISMVGGRRARVVCGGRQAIQGGGERGLAAAVWGL

SEQ ID NO: 125465 - protein, 182 aa, Triticum aestivum
  unsure (1)..(182): unsure at all Xaa locations
  Clone ID: PAT_TA_19883.pep
SCRIRHEEPTLAAPTTHEPRSVVAVDRRWRWRLSDAPPXRRLAGGGRLLPPALSRPRPAAPGLGRPNLTLTQAFSSHGKEEAGREVLEQIQEKKERLYDLILRHGYKRNDGSMCYSNVQLMHHLSAHIKPRPQSIAWRYLRNVHSLYILWMCFSPGHKRLRNLGTSTKRGASAWPLLSADVS

SEQ ID NO: 125466 - protein, 121 aa, Triticum aestivum
  unsure (1)..(121): unsure at all Xaa locations
  Clone ID: PAT_TA_19884.pep
XXIPGNCVGCTRVGGVCRTDRHDASYGTRPPANIEVLVTQNKFPGVRAQPSSISLLSQPADARSPSSVCSHAVPHVSENKEDPRNLHIFHLDVLVMKNKSNKDLRWPLLELLKSSKILFTV

SEQ ID NO: 125467 - protein, 186 aa, Triticum aestivum
  Clone ID: PAT_TA_19885.pep
QGGFDVAGPRGAQLQIVYGVFGYMQVLSACFMSFAHGGNDVSNAIGPLAAALSLLQGVASSAEIVIPTEVLAWGGFGIVAGLTMWGYRVIATIGKKITELTPTRGFAAEFAAASVVLFASKLGLPISATHTLVGAVMGVGFARGLNRVRAETVREIVVSWVVTIPVGALLSVFYTLILTKILKYFM

SEQ ID NO: 125468 - protein, 191 aa, Triticum aestivum
  Clone ID: PAT_TA_19886.pep
TRELTNNLLMLPLVMLVLIISKTVADALNASLGHLPVSWEACPCLGRHPAPCLPLLSVGDLPPGPPQTFYRWALGGRSVASVTAAALNGCPVGPAPPFAPSPLRSGPGPRAHPLRPLAWSQAVCSSPPPAPAASLLVAPEVSASRGSKKYKSFSQGHGLNHSVRGCVCERMQSTNISSSSASLIPQVMLPE

SEQ ID NO: 125469 - protein, 135 aa, Triticum aestivum
  Clone ID: PAT_TA_19887.pep
MCRGLPERPPPGCAGAPCRRRHPPGLCRGALPAPPPPGLGRGALPAPPPPGLCRGALPAPPPPGLCRGALPAPPPPGLGRGALPAPPAPGLCRGALPAPPPPGLGRGALPAPPAPGLGRGADCIMGALLVASWLM

SEQ ID NO: 125470 - protein, 275 aa, Triticum aestivum
  unsure (1)..(275): unsure at all Xaa locations
  Clone ID: PAT_TA_19888.pep
VSFHVAGWEGERFRGKRSGVSGAGRGKVVLQRIEXNKISRQVTFAKRRNGLLKKAYELSLLCDAEVALVLFSHAGRLYQFSSSSNMFKTLERYQRYIFASQDAVAPTSGDMLASHLAAVPPTAGVQVFHLAHRELLAGVVAPLRSPRARLGEDLAPLSTIELEQLEGQVGKTLRLRTAGKAPVLLAGMRDLKRKEQILQDAKMTLKGKLGEIQLEATPDPPQQPHQQQMPQGVRGVPPHTPPQPQHFFHALERYPPLPPVFRGLDGNQPPPARMA

SEQ ID NO: 125471 - protein, 104 aa, Triticum aestivum
  Clone ID: PAT_TA_19889.pep
MAARALTAAGRRVAGRTGATPLLASRRNGASMNHSSATARREEEPYKDVRAPAAAMTGAQVEAALNRKNVEVLQGEEHVATVLPDEAIGGALDGGEDAAWVPDQ

SEQ ID NO: 125472 - protein, 123 aa, Triticum aestivum
  Clone ID: PAT_TA_19890.pep
MPSARAGVLLLAGLCLWWSATGALAGGGNGTVCLCTGPQCVPPCPVPGTPPTTSPTQFPFCPQRPPAVGPFPWEQQPPASPRSGSGFPQDAGFLAAAAASPARNPAAWLAVAALCSAFLLLLH

SEQ ID NO: 125473 - protein, 167 aa, Triticum aestivum
  Clone ID: PAT_TA_19891.pep
ARGKKNRFQVGDVLDFKYAAKDSVLLVNHDDYKMCSTVTPLTRFADGDTRFKFDRTGFFFFVSGVPGHCEAGQRMIASVVGHSTLAAAPAKPPAVGVVGGHAPGPSPSPNQAVSAPESPSYGSSSGGSTSTTGFGPSPSTEPSGASRRALSTVTGLVASVVAMIALA

SEQ ID NO: 125474 - protein, 144 aa, Triticum aestivum
  Clone ID: PAT_TA_19892.pep
MSCDNVVGQTYHHAVVTDSIPDQISGIFFGWTKSETSGVFKAVVSTGWDLSPGKFERVMHICFLDSHYKAKTEDHLELLLIGYIRKLQSSENISQAMNITDEDQATARDALDLPAFSEYAKTRGALDLPALPEYAEPRNGLLLA

SEQ ID NO: 125475 - protein, 97 aa, Triticum aestivum
  Clone ID: PAT_TA_19893.pep
ASDLLLISSMDTTPGLEAPSSLTGVGGRAVTGCTSPHGRCCHRVGAVVDRRLGHEIADKLNLLDLMHPHLAIGGWCGYRRGLGASEHRGDRLPVLLG

SEQ ID NO: 125476 - protein, 431 aa, Triticum aestivum
  Clone ID: PAT_TA_19894.pep
MGNEPLHSSGGSGSGNFSSSSEMGYGSSKSSMSAASPSSSTPGSSSACAWAPVTATASSLSLPTAVRVGDNTRTGTSPSPVVAVSSGEPVIGLKLGKRTYFEDVCGGQNVKSSPSGAASAPNKSPALGKKAKAEQQKPHNSYCQVEGCKVDLSSVKDYHRKHRVCELHSKAPKVVVAGLERRFCQQCSRFHALAEFDQKKRSCRRRLNDHNSRRRKPQPEAISFSSSRMSTMFYDARQQPNFLFGQAPYVQMRSCGSSSWDDPGGFKVTHTKAPWLKPTTAAGVHGIHLSSQQMSDNIMPHGAHHGFDGFMAFKGTCTKFPNQGVQASAVASDSSGAPDLQHALSLLSSNPVGAANLQPSPQMHSGVAAIAGAPNPAMHALGSSTGLWLDGSQPLDDHPRFQVFERLGDHDSELQLPKPSYDHASHFDRMH

SEQ ID NO: 125477 - protein, 119 aa, Triticum aestivum
  Clone ID: PAT_TA_19895.pep
RATRPPTRPPTTDHQRRQHREATSLLRLAWGRCAAAASRRRRRGSASWGSSSRPSSPWCSCSSAPRRSGAPSPSTRAVEAEESPRISGCWEEGYSVVHGREQARQWSLVFFGSENNFYY

SEQ ID NO: 125478 - protein, 143 aa, Triticum aestivum
  Clone ID: PAT_TA_19896.pep
MASKSNYNLLFAALLVFIFAAVAAVGNEDCTPWTSTLITPLPSCRNYVEEQACRIEMPGPPYLAKQECCEQLANIPQQCRCQALRYFMGPKSRPDQSGLMELPGCPREVQMNFVPILVTPGYCNLTTVHNTPYCLGMEESQWS

SEQ ID NO: 125479 - protein, 188 aa, Triticum aestivum
  Clone ID: PAT_TA_19897.pep
MASKSNCVPLLAAVLVSIYPSDPTGPDKESDKTNLYQRTGPVKTNMASKSNCVLLLAAVLVSIFAAVAAIGNEDCTPWMSTLITPLPSCRDYVEQQACRIETPGSPYLAKQQCCGELANIPQQCRCQALRYFMGPKSRPDQSGLMELPGCPREVQMDFVRILVTPGYCNLTTVHNTPYCLAMEESQWS

SEQ ID NO: 125480 - protein, 154 aa, Triticum aestivum
  Clone ID: PAT_TA_19898.pep
MAPKAEKKPAAKKPAEEEPAAEKAEKTPAGKKPKAEKRLPAGKKTASKEGGGEKRGRKKGKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 125481 - protein, 154 aa, Triticum aestivum; identical to SEQ ID NO: 125480
  Clone ID: PAT_TA_19899.pep

SEQ ID NO: 125482 - protein, 167 aa, Triticum aestivum
  Clone ID: PAT_TA_19900.pep
MVGMEGTGCGALLRELQQIWAEVGESEGEKSKVLSEIERECLEVYRRKVDDANRTRVQLHQSVATKEAEVALLMATLGEHKLYLKKDKGYLSLKEQLATVVPVLDDLKCKKEERIKQYYDIRSQIEKIHSELSERSDKADHVNSPADDEHDLSTRMLNSYQAQLSAL

SEQ ID NO: 125483 - protein, 140 aa, Triticum aestivum
  unsure (1)..(140): unsure at all Xaa locations
  Clone ID: PAT_TA_19901.pep
KKNTLVAGSTPPPAPPLPPARAAPPPXPPRPPPPACPPPRPASPPPVSSPAPPAMAAEQPSEKKKPPPEKKAPLPKVVTLNKALKLAQTWVDGMSALEPDELNDKDFEGRPSGLGLGAKVAPNAKRAAPTIRWRGGCSGR

SEQ ID NO: 125484 - protein, 237 aa, Triticum aestivum
  unsure (1)..(237): unsure at all Xaa locations
  Clone ID: PAT_TA_19902.pep
YAKFREMVHLAIDGIWQVFKLQHSTPRNDFCRIAAKNGILLRLVNTLHSLNEATRFASISGSGAPGQNGSTXPRLKSGQLDVPMLESSKVRLDHYHSSGSMQSLQADADKHHILLDPSASPRFNDISAAGHMERNDNDLVRPQRLSVSGGRSSTDRSPKHIELVSNGHSSGQNDQIRPLLSLLEKGPPSRPVSGLRDVARRPPRPAALVCFSPLCRPARERKTNGELDLLMAEFAEV

SEQ ID NO: 125485 - protein, 217 aa, Triticum aestivum
  unsure (1)..(217): unsure at all Xaa locations
  Clone ID: PAT_TA_19903.pep
EFGTRGNESFQARRYSEAVEQYSAALAYNSDSRPFSAVCFCNRAAAYQALGQLTDAIADCSLAMVLDANYPKAISRRATLYEMIRDYGQSANDLRKLISLLQKQANKPGVSPKVFNKHSDLKQARARLLSAEDEARKDTPLNFYLILGVEPSCSPADVKKAYRKAALRHHPDKATQLLVRNENADDGFWKDVAXEVYADADHLFKTIGEAYNILSDP

SEQ ID NO: 125486 - protein, 101 aa, Triticum aestivum
  unsure (1)..(101): unsure at all Xaa locations
  Clone ID: PAT_TA_19904.pep
MTKKQRREAGARRQQQARQRLRPSPLLQARDERSVSCTTFNILAPIYKRMDSENGRESQNRANWFSRNEKIIDRLLGDRSSIICLQEVWLXGNDELVNMYE

SEQ ID NO: 125487 - protein, 209 aa, Triticum aestivum
  unsure (1)..(209): unsure at all Xaa locations
  Clone ID: PAT_TA_19905.pep
ASHRKEEEEEGERGGKKKVSVRTRWRRRRCPCSSPPSPCSSRRRLRSGTSPXRLLLASAGCRFRAPEQHRHAPPAXTRGGPARRCPSRRTSRSRRCSPTTTPASRSSPRASPWRRRRSRRAPRSRRVRFTGRYRANDDVDGVAASLASVPLTPGTSYGYGQLREPAMGPRAPRPKPLHQWWSDTGVLPQPGSSASPCRVFQTPIPGPVF

SEQ ID NO: 125488 - protein, 125 aa, Triticum aestivum
  Clone ID: PAT_TA_19906.pep
LLSLGVTGAGYAAYRFYDAHQKQLVRVEQRAAEERAADEIIKNHLEAHFEKVQRISDTTTLPFAMHYLRSRVMDELDISHLTERLLQGKGELTPEDKYETCEKIKILSFTMTVSSMWAMTLLSLY

SEQ ID NO: 125489 - protein, 224 aa, Triticum aestivum
  Clone ID: PAT_TA_19907.pep
ARGFSSPPRRRALLPCSPPPAPPPPLPPRASAPLLRPRPMEQFHHGHHVRLRSRVLGTYLHADEDGHGVSLRLRRASMNAAWAVHRHPPPEAFVPFLLLHSAAYGRYLAATDVPAPPGHHGRRVEQRDYDHPEVEPLGLIWLPALSAAGDKVFLRNFNGGCLRANGRYRPWNNGASVDDVDVNDIGNLSTMMHVEDIPAREIMPLLPRPAWLTLPAVISPSRVI

SEQ ID NO: 125490 - protein, 86 aa, Triticum aestivum
  unsure (1)..(86): unsure at all Xaa locations
  Clone ID: PAT_TA_19908.pep
HLTINYPKGRESSNESRRSSQASIGYQGPGHSCQGYASPHLPPIVIVHGSSEYNIFLCQHAFLTPMILIDQWXXAFISMNRXXYXX

SEQ ID NO: 125491 - protein, 103 aa, Triticum aestivum
  unsure (1)..(103): unsure at all Xaa locations
  Clone ID: PAT_TA_19909.pep
RAAVWRAPGVAAALHPRPGRVPPGDNPSPPPPAGHPPAAPAAAAAAARPDPDRPPPPAXAAAPGGTPRRQRGGPPAATPAAPPPPRPHRPPARSWIGLPSCAG

SEQ ID NO: 125492 - protein, 137 aa, Triticum aestivum
  unsure (1)..(137): unsure at all Xaa locations
  Clone ID: PAT_TA_19910.pep
QIFTVWDRWLAERFPESDFACRTYAVRLVPGLPRYGLNLQRLCFRTAYVASTSARARLVPYFNEVLGLLGALIFWPLIIYLPVQMYCVQRXRVRAWTPTWVALQAFSVACFAVGTFAFVGAALLPKSILGTPEHVSL

SEQ ID NO: 125493 - protein, 178 aa, Triticum aestivum
  Clone ID: PAT_TA_19911.pep
MLQAVVSNPQPVAASLGPRAPCRPGRGSVRVRSTRNGPADNLDQLRRPPTATARQPRQGSGSPAPGSRLRRAAPSGPRHCFPDAPAPRPRVPSTGRCAPGAAAGAGPPPSAAPAPPSARPPRGPPPRYRPRPTPAGGHRRAGDYLVRFDMPGMTCRAGRGSARARARSGRRWGAPARR

SEQ ID NO: 125494 - protein, 185 aa, Triticum aestivum
  unsure (1)..(185): unsure at all Xaa locations
  Clone ID: PAT_TA_19912.pep
KCXXRKXXNSSHPTXPAPRPGHPSGXXKISHQHQRRGRRKRTAANHTNKGEERSSSPCIHRPSEDPNGQCRWTSSHHSRDLDEIRGSPTPLAPRRKQKPRLTANGARRNLFRRDTTATASAASPSTLTLRHTHLANRPEVPPPSRRRSGRRREREPAARPGARGASRRAPSAPSDPILLRGRRLR

SEQ ID NO: 125495 - protein, 247 aa, Triticum aestivum
  unsure (1)..(247): unsure at all Xaa locations
  Clone ID: PAT_TA_19913.pep
WRPPAGAGARARCRRRGRPWRWRPRRARRRRCGRSWSSAGPSGCSPTGSRRAAPRMRKQRHLDDLAAQAAHLRREERARRRRARAQPRGASRPSTPRTPSSAPRPPSSPRASTPLNDIIACMKRQQQHRRRRRAHRRRSRHPHHRRPSVPTGLIPXXLFXFSPEXHFPSLQSXTXHGMEQXKTRQQKDITFXDVRVQVRGAGPXPXGXLAVXASLKXXGTGXPLXXKTLXXVXKXRXFKXTMMDXVX

SEQ ID NO: 125496 - protein, 166 aa, Triticum aestivum
  Clone ID: PAT_TA_19914.pep
WARRARFLAGGPCGPARNVHPAVPPKLGPQLVSSDHSILPVPPQVGTVSGPSPGTHEQSSVDGAASSYAGLPAFPAPNASSLPSRVFVGPHPCCLHASVGGGILPAPRPAASPAARDHSSTAHRAASAPRSPASPAPGPASPPSRGVGGPDTMIQNDESNVTSRRP

SEQ ID NO: 125497 - protein, 151 aa, Triticum aestivum
  Clone ID: PAT_TA_19915.pep
PTRPQECSTILDVVESALPMGLPAKFGDGSNLNATIHSAVELLPELWKLADFPPKVLSSYRGALLSNWNLDAKAIGRIQKEFAIFLLYSGCEACTPPLRSQLDGSFVPRNNLEEAILLLMILLMKFNLKRLERDPTVMHHLTFALAISRPG

SEQ ID NO: 125498 - protein, 621 aa, Triticum aestivum
  Clone ID: PAT_TA_19916.pep
VRPRVRSGTIPFQSPHSTESIMLSSQPSLKIVDLSSNSLSGQLPPEISNLQRLESLTLAMNELSGEIPDEINKLQGLEYLDLSHNHFSGRIPDMPQADLKMFNVSYNDLRGTIPKSLEKFPITCFRPGNDFLIFPDGLPAPNSGDGGLAQSRASQSHGHKAGVKVAVIVGCIGGVLLVIFIVLAIYVVRSQELCGRNGFRGQITPRDLKLGKLSRPNLFKNQKDNVIPTKTSFSNDHLLTAAARSMSAQKELLAEAAVEYGYADPKEVVESTSSGVTETSAAASVRESSPRSALPSSPHFLDSRFHEEPVTFEVYSPDRLVGELIFLDNTLVFTAEDLSRAPAEVLGRSSHGTTYKAALQSGHVLTVKWLRVGLVKHKKEFTKEIKRIGTIKHPNIISWRAFYWGPKEQERLIISDYVNGDSLALYLYESTPRRYSRLSVCQRLKIAIDLARCLQFLHHEKGLPHGNLKPTNIFLTGPDLSPKLVDYCLHWFTTPSGIAEQILNLGALGYRAPELANTAKPMPSFKGDVYAFGVVVLEMLTRKSAGDIISGQSGAVDLTDWVQMCNREGRGTDCFDRDIAGLEESPRVMDELLAISLRCILPVNERPNMKTVCDDLCAITA

SEQ ID NO: 125499 - protein, 53 aa, Triticum aestivum
  Clone ID: PAT_TA_19917.pep
MSVALNGEPATMYTDPGLALATGWLKVGGYLYYGSLASSYISRVDLTKSSIEA

SEQ ID NO: 125500 - protein, 186 aa, Triticum aestivum
  Clone ID: PAT_TA_19918.pep
MASASKQQSMYPEVPQSHPDHNTAFQYNPAASTATGAGESLYPTMDPHEMAENLFPADAAEDAAPAPPTVEEALVDVPGAQLHLVDPDRSLDLGAGTLSVVRLRQGDHCVAVLARLTPDKSNQRRGFFSFLSSGRSTDAQEPVQWPLASDVAVVKLDAGHYFFSLHVRTATTLTTRRTPWRRTTGR

SEQ ID NO: 125501 - protein, 113 aa, Triticum aestivum
  unsure (1)..(113): unsure at all Xaa locations
  Clone ID: PAT_TA_19919.pep
PRAAARRRRDGGRNPFAPLVELWRRTVQPLGDYGFGKRSVWEGGVGLSMVSGAALLALALAWLRGFQLRSRFRVYAAAVDFRRACRARGGPPLXLPGVPVGSVVRVDSSLXXI

SEQ ID NO: 125502 - protein, 78 aa, Triticum aestivum
  Clone ID: PAT_TA_19920.pep
KKLTVSDIFALQLMQVPQVTEETAIAVIELYPTLVSLARAYSMLDGDTPAQEKMLNMKSKMVNAGASRNIFKLVWGEG

SEQ ID NO: 125503 - protein, 272 aa, Triticum aestivum
  Clone ID: PAT_TA_19921.pep
QKNIGIMLRGQDVEPHNVVNDLLYRECVLYKPQIAGLPELSIVTTIGFVKGAPDTDVQGFNVYHKNRLITPFWKVASNSYGKGRGVVGILDASFIKPTHDKQDFEKSVLHQRLENRLKEMTYEYWGLHCHRLGYDNKSLPKASRALYRAKQTGAGSSPASVPHQLLTADVPTSSCVQSSMGQKRNFDALGVISDINNHQTKHRDVIQRKRFHEYKTLTLENDKLRDECLQYEESEKQLVEKEQKLRYQIAKETKKYEELLEELKLLDVKLET

SEQ ID NO: 125504 - protein, 165 aa, Triticum aestivum
  Clone ID: PAT_TA_19922.pep
MANTTMGSTTRSCDAYLLFNGETLLPNGVCAFLCTVALAYCFIGLSAITARFFKSMESITNHSREVVTIDTETNTPIVKHETVWTYTIAAIVLLDFVTIFPNAVLAILASGARAPRFSRASAVAARFLGPLAAGTNHSREVTVDTETNTPIVHWNYTIADIALLA

SEQ ID NO: 125505 - protein, 58 aa, Triticum aestivum
  Clone ID: PAT_TA_19923.pep
TVHCRYSSCSKPQNLSTLWLKNFTVLLYELTTLAPGVVMHKFITILRQIQARKSSPGS

SEQ ID NO: 125506 - protein, 153 aa, Triticum aestivum
  Clone ID: PAT_TA_19924.pep
TVPLILMKAAVKEVHTIWVLTAAVGAAAGYHLLHLLRCLYLGRFAHNPCRNSRALAWAFLLLDKGCAYVTFAATVAAAQACLIALDGAQALQWNKVCNIFTRFCQQVAGSLVCGGLAAAGTALLSALSARNLFRLYPSLSRPRPHPHRSSSTK

SEQ ID NO: 125507 - protein, 189 aa, Triticum aestivum
  Clone ID: PAT_TA_19925.pep
MVNSTASPRPRAKLAGTGTPLGKLHRGGRPYYNAYDPCGDYHILDYMNRADVQKALHANVSGAIPYRWEPCSDALTNWTDAPASTLPAIGKLVKDGIRVWVFSGDTDDRVPVTSTRLALKKLGLATKKEWREWFTSDQVGGYTVVYDGLTFVTVRGAGHMVPMITPVQARQVFAHFLTGEELSAKAIVA

SEQ ID NO: 125508 - protein, 194 aa, Triticum aestivum
  unsure (1)..(194): unsure at all Xaa locations
  Clone ID: PAT_TA_19926.pep
MSSSSPQLRRLKPAYQCVVNNFLAVLAVPLPLAVAGAVGAARVGPEELLARMHALRPAHVFLAAFLPAAAGILYLMMRPRSVYLVDYACFRTKPSHRVPFGTFLEHAKLVTFIEGASIDERSVRFMTRLLERSGLGEETCLPPAHHFIPPYRNLEASRDEVELVIFSAIDDLLAKXXIRPDAIDLLVVNCSXXA

SEQ ID NO: 125509 - protein, 114 aa, Triticum aestivum
  unsure (1)..(114): unsure at all Xaa locations
  Clone ID: PAT_TA_19927.pep
SRVHLFLESAMSSIPKSVAHYIPEACVRVFKPYLEFSGASSPDPPCRATSWRYLQISDQFQLGASRFGGARGVRHFEGXGMALKIGSFKCNFQFILHVTSFLYRSLCTRCQQKV

SEQ ID NO: 125510 - protein, 146 aa, Triticum aestivum
  Clone ID: PAT_TA_19928.pep
APTGAAPCRRRPCAAPPVCTARRPPPPCFPQPWQLERITRNHTCPPWRWIDNTRRSTQPAAQPLTAVDFHCWPIRTPLTAANAAPLRPGTSPSAGIENGAAVVAGAASRKASPVTENSPVPRAQAKPPALQPMDDLTRAERGRGLV

SEQ ID NO: 125511 - protein, 185 aa, Triticum aestivum
  Clone ID: PAT_TA_19929.pep
MALAPTSLQSFLTGRPLCTAPQLTRSSIRPASARLSCRASDQKDAPPSWAGNLELKNLGKLAMVAMAAGVLVLAPVDDAMAGKSGGRIGGKAFRSAAPRSSGPRINNSRTNIYVNPGVAPPLVGGYGYGGYGGYGLSPFGFYGGPSVALGVGGGFDTLVLFIVGGAVVGAVRRFLNRRDNDDYDD

SEQ ID NO: 125512 - protein, 140 aa, Triticum aestivum
  Clone ID: PAT_TA_19930.pep
MAAAQPQTRDAQQQGAEEAMKLLFVEMGVGYDQHGQDITSAAVRACKDAISSNSIPAFRRGSIPGVNSEQMKLQIKLGVPRPVQHLLDFERIKAVFPYGEITSCEVVDGGMICSSGTCIEAMGDKNDDCYIVNAAVYVGY

SEQ ID NO: 125513 - protein, 71 aa, Triticum aestivum
  Clone ID: PAT_TA_19931.pep
ISNLFATRYVWAEPCSRTYCNIVSKQVSRNFCPNNAYKNFLLCHLVFVTYLFYTKYNVSRQDVKYSLCKLL

SEQ ID NO: 125514 - protein, 117 aa, Triticum aestivum
  unsure (1)..(117): unsure at all Xaa locations
  Clone ID: PAT_TA_19932.pep
MLPPFFVGSMWQSAPGGGVAAALSEEDEVAAAAAAEAAHDRAVVATRNHREAEKRRRERIKSHLDRLRAVLACDPKIDKATLLAXAVERVRELKQRMAGVVAAPASHLFPTEHDGAR

SEQ ID NO: 125515 - protein, 119 aa, Triticum aestivum
  Clone ID: PAT_TA_19933.pep
AFQRSAKVLCPGTRDLLGDRHPPSQISDARRGLAGAGATAVAQTRGPRLVQNWPPRQRTYKLWSCTNIPLDLEKLAWKMSMYEFFREICGPDHRFLRAANLQPRRHVRYPLTVIHDEVE

SEQ ID NO: 125516 - protein, 240 aa, Triticum aestivum
  Clone ID: PAT_TA_19934.pep
HLSLAKPEEHADAWENNERTPQSERHSGSVSEQHPEVLSNGTSSTARKKSYGPIVNQKLKAYFEKEPYPSRPAKESLAQELGLTFHQITRWFSSTRHYSRVSAAKKGKRLENYTAENNDGIAADSIQQREPNGSVLGKPNVDRNGIVSEERMAQKNLDEGEREDTPFRQHISCEQTLDGTPPANKHNTANSRNDTSRNAEDTPLGQDIGCEQTVAAVNQNCTIGSSNVGSPKVAWRKQAP

SEQ ID NO: 125517 - protein, 136 aa, Triticum aestivum
  unsure (1)..(136): unsure at all Xaa locations
  Clone ID: PAT_TA_19935.pep
MEPRPRPLAVAVNALLCVLSLCVSAAEAENVTTYDAKNFGAKGNGVDDDTKALVAAWKKACGTPGTVTLVIPPGTYYIGPAHFHGPCEALAITFLLQGVLMAATDLKRFGNDWIEFGWVTNLTVAXXNGGXXXAAS

SEQ ID NO: 125518 - protein, 367 aa, Triticum aestivum
  unsure (1)..(367): unsure at all Xaa locations
  Clone ID: PAT_TA_19936.pep
HEELIDLALKKEDAALARHCVIKAMRADPEDVGLKFDCANIYRTLGDCHKAAEIYEQIVGIHPSNTVARKAAAQMYRDSGQIDKAIDLLEDFINAQTSNIDWGLLDLLISLHLRNDAHGEALRQIKKAQLVLGSGHKLPVRLQAKAVICHAYLGDMKHAXXFLXXVHLGRSKENADMVKEVASTLQTLGQYEYALKFYSVMEDVAVHNDVSSYVEAARCYMVMGDKGKAIPYLYQALEGMEDNVDVRITLSSLLVDEDKSDKAITVLSPPENPELQSADIPDHQKPWWLHGEVKMQLAKLYYNKGMMEKFVKTIFLPILETLDIEYANRKVKMNRKLTNDVLQERTKVLGEARQDSVFQGCRPIAST

SEQ ID NO: 125519 - protein, 435 aa, Triticum aestivum
  unsure (1)..(435): unsure at all Xaa locations
  Clone ID: PAT_TA_19937.pep
MGFRRSLATRSLQAVLDGDLRLLKEMAGVVAADVGVWARALTVAVMEGRLDIGRCLVEDHGVDVNQGTFTGDTPLAISATYGTPAITRYLLDRGADPTLAGALWPPLHAAASFGQCEIVELLLSTGIDVDHFDSVYGTALHCXAATNAQDGSMNILLQHRADPNKVFRLDSTPLRLAMTSESLECAKLLIMAGADVNKIDYTGVTYLMVAAGNGLPDILKCLLDAGANPDIDDGFGTTPIEIAALQGRWDMVEMLFPLTSPISRLPDWSVDGIISYVQSFGLKPRDIHLCEMKRAELKLQATEAFKRKEYVIAGELYTCAMSFQSSPKGLANLLAHRSFCMLHAGIGKEALSDAARCTVLRPFWPKGYYRLGAAFMLLQDYGKAAQTFEAGLKLDPTNADMANALREARETARNPPRTRGLECLHPFGMRRSWRD

SEQ ID NO: 125520 - protein, 125 aa, Triticum aestivum
  unsure (1)..(125): unsure at all Xaa locations
  Clone ID: PAT_TA_19938.pep
MAMAPHPPVLLLLLLAPLLLCSLLPDAARAAGAEDAGVTIVRKDGTTCTLCASCENPCNPNPGYNYPSPPPPAQVTPAAPVYPPPTSYPAPSGGGGGGGGYFYPPPTGGYVEGSXXXXGSXXGQG

SEQ ID NO: 125521 - protein, 71 aa, Triticum aestivum
  Clone ID: PAT_TA_19939.pep
MASISRASSLVAMAIVVVLASVASAQGPAPAPTASDGTSVDQGIAYVLMFVALALTYLIHPLDAASAYRLL

SEQ ID NO: 125522 - protein, 201 aa, Triticum aestivum
  Clone ID: PAT_TA_19940.pep
TCHKKCSELSCVRATHVTLIMVQEISFGGDTGTVATLATPSKRQKKNGAVAWPGHTGDTEPGARHSRWGRQGSGGVTDHTRRGTHKTPRRCHARAHCPQWHEGNALPITNTVEWWRHCFHQARYLLATDGSERDHGSFVTTRGMPNPGSMVSRNNGACRYPGDSEKANLVSRRTSTTFSSIIARFCPAQTLGPCPNGRYMC

SEQ ID NO: 125523 - protein, 170 aa, Triticum aestivum
  unsure (1)..(170): unsure at all Xaa locations
  Clone ID: PAT_TA_19941.pep
MKGGGKNLRRACEEGTAVTLAEGESIMQVVTLRGSNLIEVTDXAERRAPRXLWPDKESIMQGIKNAKLEPHHGDGRRGRQVSRPLPPPXFHEELLDQRTGISWLLMLVGRTSPSHLPAGWPASPQGTTSQAEEEQNSDEDDDHDMPPLQAITNRNRPLDRHPKTEGDSNS

SEQ ID NO: 125524 - protein, 169 aa, Triticum aestivum
  unsure (1)..(169): unsure at all Xaa locations
  Clone ID: PAT_TA_19942.pep
MGLQWMLLTCVVGAEAAVAALLTLPAPRAVRAQIVGLTSMLLQPMAAVLPFAAFQLLDIYWKXEHRLICTGEMCTSXERVRFEKSIFKSQRNVILCVSVFILYWSIYRILQVQXDIKALEEVEKRIKGMSRIILVCDGFWWYFSAFSKCIQTLGYPMYILVFPLSKVRM

SEQ ID NO: 125525 - protein, 81 aa, Triticum aestivum
  unsure (1)..(81): unsure at all Xaa locations
  Clone ID: PAT_TA_19943.pep
SXDVKCLGAFCSVQRDRVTLPPHRKFAPGVPEFASIAICVLLLNAMGLWRCCYTHLTFKLEYTSVNMTFYTFVCVCCGKKK

SEQ ID NO: 125526 - protein, 204 aa, Triticum aestivum
  unsure (1)..(204): unsure at all Xaa locations
  Clone ID: PAT_TA_19944.pep
GMQFRMHNHPFEREMETFTTLIVDKLKEAKMFAGQGGPIILSQIENEYGNIMGKLNNNESASEYIHWCAAMANKQNVGVPWIMCQQDDDVPPNVINTCNGFYCHDWFPKRTDIPKMWTENWTGWFKAWDKPDFHRSAEDVAFSVAMFFQKRGSLQNYYMYHGGTNFGRTXXGPYITTSYDYDAPLDEYGNIXXPKYGHLXXLHN

SEQ ID NO: 125527 - protein, 148 aa, Triticum aestivum
  Clone ID: PAT_TA_19945.pep
RRIIYPRPSLSSPISRFLPSPEHQRRHWPPPADPPPTAAGPPPTDPAAACLLLQNPPPPRASSRKPRRCRVPPPAEPATAAATSSCRPHHRREVHPANLPPPRASSRNPAGGLLPQPRRRPPLASPLPATPMCVPAGSTRSSAAVSRR

SEQ ID NO: 125528 - protein, 222 aa, Triticum aestivum
  unsure (1)..(222): unsure at all Xaa locations
  Clone ID: PAT_TA_19946.pep
DGTVQLWDASTGQGFTQFTEHRKRAWSVSFSEVDPTKLASGSDDCCVKVWNINQKNSVDTIRNVANVCCVQFSPYSSRMLAFGSADYKTYCYDLRHTRIPWCTISGHGKAVSYVRFLDAETLISASTDNTLKIWDLNRTNPNGLSTNACSLTLSGHTNEKNFVGLSVHDGYIXCGSENNEVYSYYKSXPMPITSHKXFGSIDPITGQXXNDDXQQFVSSXXW

SEQ ID NO: 125529 - protein, 60 aa, Triticum aestivum
  Clone ID: PAT_TA_19947.pep
PRVRGRVGSTMRKHGLRSCSRSRMWRAAATNRDEAAAVWKLAGRTGKEQRRLTYSLRKLI

SEQ ID NO: 125530 - protein, 161 aa, Triticum aestivum
  unsure (1)..(161): unsure at all Xaa locations
  Clone ID: PAT_TA_19948.pep
MMKHQRRQTHVNPLRRNIWKLKRRLCIAFSIADHIKKLFYSEHGANPRRDDPEVKSLTDEIEKLREAFESIERPTLSIEDHKSKPLPEERSDLSPSPIQAPVTPKAAHVDSPKSPMKPEQQHQLDPDSEFANLGADFGKDGKDYSAEEISGWXFDELEEES

SEQ ID NO: 125531 - protein, 238 aa, Triticum aestivum
  Clone ID: PAT_TA_19949.pep
PSVRPAKRRVLAAKTRVGRPRQARRRAQPQPPTPLQRLFRACRAVFRGPGTVPAPPEVALLRAMLDRMRPEDVGLSPDMRFFRTRDNTAQGNPTITHTTIYKSDNFSMVILFLPQNAVIPLHNHPGMTVFSKPLIGSMHIKSYDWADPDDDPAASSPDDQLRLARLVVDDLFTAPCNTSVLFPTAGGNMHRFRAVAPSAFLDILGPPYSIEEDRDCTYYTDIPYSQHPSKLEILISEI

SEQ ID NO: 125532 - protein, 198 aa, Triticum aestivum
  Clone ID: PAT_TA_19950.pep
MASMHVLRESEAEGATPTITHTTIYKSEKFSMVLFFLPTNAVIPLHNHPGMTVFNKLLIGSMHAKSYDWADPDDPANESGASSPDGKLRLAQLIVDDVFTAPCDTSVLFPTAGGNMHRFRAVAPSAFLDILGPPYSIEEDRDCTYYTDIPYSQHPMTSNELIGDEQEGRRLAWLKEVEMPRDLKMCSVRYGGPPISGR

SEQ ID NO: 125533 - protein, 178 aa, Triticum aestivum
  Clone ID: PAT_TA_19951.pep
APRAAARPAAASRRWAASTYGGTCLPLSATIQRVSLRLLLSFWSCLLPWERGWWSSGPGWWRLVRRRPRRPCRRPRGGGCWPLRPRRRRRQEGGRGATGGRPPSNGLFRACRARLPGRPGTVPKPAERRPRSGDHCSTKIQTTRHFRPQLKHAPLDPIRQGGNRRTPRHSQTPPYTEQ

SEQ ID NO: 125534 - protein, 261 aa, Triticum aestivum
  unsure (1)..(261): unsure at all Xaa locations
  Clone ID: PAT_TA_19952.pep
MVSPDAIRTVIGVIGNGTALVLFLSPVPTFIQIWKKKTVEQYSAVPYLATLLNCMMWVLYGLPLVHPHSMLVITINGTGMLIELTYVALFLTFSVGAARRRVLLLLVAEVAFVGGVAALVLSLAHTHDRRSMVVGIXLCVLLGTGMYAAPLSATSWAPRSPWARWVAALVLSLAHTHDRRSMARRHTMCPLRNPGTNAAAVSLTKMVMPTDTTRSNTTPIPLPGHARQWNLLASPRLHHVRTLRPHPHSGWARRSLWGRSP

SEQ ID NO: 125535 - protein, 178 aa, Triticum aestivum
  Clone ID: PAT_TA_19953.pep
MPRGQASSVSTRERPRVDAAVVSDKDNGRHRRSAYLLLGLLIVFLHGSWSVYRMQFANLPLPLDAEQAGKRGFSEASALKHVKYLTGLGPHPVGSDSLDLAVQVVLAGALAFALSALPAVDVRLEPFHTVSGAFPLPGGLLNGKALWYSALKHVVLAVVPWSVPAAGRNLILVSSILT

SEQ ID NO: 125536 - protein, 241 aa, Triticum aestivum
  Clone ID: PAT_TA_19954.pep
MLLSSAFRSTGMLAQQKQPVAIYKRRFNLTMYEGRIQRRAHRRISRKVKAALSRYEVQNSGQACYQLHVVCGVNEYVSGPDKSDTPVEDDRYHHTHANFLVTRNVGSVCSGPVLFFAELSNKNNGDQDCQLLCCPVVVPLPGAEPVRCLFCELEGIRIVHPASGEGFHGHEVEFGKMVRGEDLYDNGYYREVYNNDRILSNSDYVTNWIHDGLEEDYMYLGSNDFTIKEDDGHESDEYGDE

SEQ ID NO: 125537 - protein, 189 aa, Triticum aestivum
  unsure (1)..(189): unsure at all Xaa locations
  Clone ID: PAT_TA_19955.pep
PQRGVVQLRVVVVSSPPXRPYLLQPLSEPDVLHRKAPPRWHRVRHQEHRRDRPVRPDVDDRDRAGNGAGIDLHDVVPHARRLVQIAYVNAAALGRVAWRRGHPRSRRGAGCRXQYRRRRRCTPRWSWRQRWSCEPARGVKSRGXERGGGLAGVDGAEREADGDGGRDPRSVEERGGRDHRRCRLARCSC

SEQ ID NO: 125538 - protein, 32 aa, Triticum aestivum
  Clone ID: PAT_TA_19956.pep
SRVHGMHYNGVVYDAVMHIMLNALVIESQQRI

SEQ ID NO: 125539 - protein, 140 aa, Triticum aestivum
  unsure (1)..(140): unsure at all Xaa locations
  Clone ID: PAT_TA_19957.pep
MSSRSLVRSPVSCSAVNECFSYNSRRPRSYYQYSNTMKLQTPQAGQMLLPRKLWKSTRLQTTLLIQRRTVSNCCSDLSTTYTEQLPSYLALNVLQDQSNAKQNNIRKVLVILNPNSGFRSSREVFYKKVQSTLKLXXFAX

SEQ ID NO: 125540 - protein, 370 aa, Triticum aestivum
  unsure (1)..(370): unsure at all Xaa locations
  Clone ID: PAT_TA_19958.pep
MPALYQLQQVPGITDLGLMPRXKVSNVAIVGGGLMGSGIATALILSHYPVILKEINEKFLNAGIGRIKENLQSRVRKGKMTKENYDKTLSLLTGVLDYEKFKSVDLAIEAVVENVKLKQQIFAELEQHCPSHCILATNTSTIDLNLIGEKTNSQERIVGTHFFAPAHIMPLLEIVRTPRASLQAVVTLLDVGKKIKKTPIVVGNCTGFAVYRMFFPYTQAALLLVDHGMDVYKIDQACTEFGMSIGPFRMTDLVGFGVALATGMQFLENFPELVYKSMLIPLMVEDKRTGEASQKGFYRYEGKRKASPDPEIMNYVNESRRIAGATPDPELLKLDNSAIAVVGFVPVLSVPSRVPVEGIMLLDIRNTNGH

SEQ ID NO: 125541 - protein, 281 aa, Triticum aestivum
  unsure (1)..(281): unsure at all Xaa locations
  Clone ID: PAT_TA_19959.pep
TRERMNDWRHRLVTQLGKKMVEMTGDFTPDMVALLSADIIISTPEKWDGISRSWHSRSYVMKVGLMIFHASRLLGADRGPILEVIVSRMRYISSQTERSIRFVGLSTALANARDLADWLGVRDDGLFNFKPSVRPVPLEVHIQGYPGKFYCPRMNSMNKPAYAAICTHSPDKPVLIFVSSRRQTRLTALDLIQLAASDEKPTQFLSMADNSLDMILSQVTDSNLRHTLQFGISLHHAXLNDRDRSLVXXLFSNNKIQVLVCTSTLAWGVNLPAHLVIIXXT

SEQ ID NO: 125542 - protein, 340 aa, Triticum aestivum
  Clone ID: PAT_TA_19960.pep
MGNCWFRGSSYINRVSTAKSETPKIQSPSERDRSDESRLPSNAREVEAMRLDSAARNPLTAFSFEELRKVTNGFRQDSLIGGGGFGRVYKGAVGTDGGGDEPLQVAVKVHDGDNSFQGHREWLAEVIFLGHLSHPNLVKLAGYCCEGEHRVLVYEYMPLGSVESHLFSRVMAPLAWATRMKIALGAARGLAFLHEAEKPVIYRDFKTSNILLDHDFNAKLSDFGLAKDGPVGDMSHVSTRIMGTYGYAAPEYIMTGHLTVMSDVYSYGVVLLELVTGRKSLDKSRPVREQTLADWALPMLTHKKKVLGILDPRLDSDDYPVRSVQKAAMLAYHCLSSNPK

SEQ ID NO: 125543 - protein, 274 aa, Triticum aestivum
  unsure (1)..(274): unsure at all Xaa locations
  Clone ID: PAT_TA_19961.pep
DPRPRPPPPRPPPGHPPPXPGRRSPPPPPPPRPPPPPPPAPPSPPPSGRSPPPPPRPPPPPSPPPPHLPPPPPPAAPAPPGRPGPWRGARRNGGAAGRRAPCRRWPPRPPRPRRGLGGAAAGRSGRASPSASTLKVAARWGRAASRPTSSPPSRDNLESNELLKLKIHGNCPGELPDVIRQLEESTGSIAVDQIGRSVILYRPSSSKMKKREEVARNREEYARNNPRFGKSENAFEERPRNNSAGRRFVKSGSTFRTQQKRRPVASKGSSYSRG

SEQ ID NO: 125544 - protein, 128 aa, Triticum aestivum
  Clone ID: PAT_TA_19962.pep
MKAVERAKLVRSLRQESRRLRLLVLVIGFFLVTLTFVVLSKPDAPLFNLNGRLSVDDAPRSLLIRQATDATAGADPRPDSPPPPPAAQEPKGAGRIPKTPTTKGTNQKDSRGKGKNLPAILQSAQKGP

SEQ ID NO: 125545 - protein, 188 aa, Triticum aestivum
  unsure (1)..(188): unsure at all Xaa locations
  Clone ID: PAT_TA_19963.pep
MSSIGMMEARMPPGFRFHPRDEELVLDYLLHKLTGRRAYGGVDIXDVDLNKCEPWDLPRGGVRRAAGSGYCFSLRDRKYATGQRTNRATRSGYWKXATGKDRAILAHGAGDALVGMRKTLVFYQGRAPKGTRTEWVMHNSPGGGRTHTTQSRAHPRQCTRSSVYQVDHLATTQHSSTRAQRPARPLPK

SEQ ID NO: 125546 - protein, 203 aa, Triticum aestivum
  Clone ID: PAT_TA_19964.pep
MFSLLHGLWNHVFSKTEFRVLILGVDKAGKTTLLEKLKSIYLKGEGLPHDRIGPTVGLNIGRIEDANVKLVFWDLGGQPGLRTIWEKYYDEAHAIVYVIDSASASTFEDAKSALEKVLRHEDLQEAPLLVFANKQDLPAAVTEEELDRHLHLKEFDERPYMFVAGSAYDGTGIKLGIDWLVEEMGKSRRTEALRARTDTYAKI

SEQ ID NO: 125547 - protein, 74 aa, Triticum aestivum
  Clone ID: PAT_TA_19965.pep
AGRLGLAATRQFQRSALGSQDRQVKPRRDDGERNREHAQSRTNDAATTASVTASAPSLPTDPRGGRQALWFTCL

SEQ ID NO: 125548 - protein, 155 aa, Triticum aestivum
  Clone ID: PAT_TA_19966.pep
MEALASSPRALFARTASPTTALATPARWTPSSTRRVKAAAAAEPAGEAKPAAAAASPAPKKILKKKPVYSMKKGQIVRVEKEKYLNSINYLSVGHPPFYKGLDYIYEDRGEVLDIRIFEETGEYALIAWVGIPTPPAWLPTYMLIKSDKLDYERI

SEQ ID NO: 125549 - protein, 202 aa, Triticum aestivum
  Clone ID: PAT_TA_19967.pep
MASSSLCALLLLLAAFACHCHAAAAAAYRRPRAIGVNYGNLGDDLPTAARSVKLLRKAHAGAVKLYNADQRILHALAGTGIPVSVMVPNDIVPSLADSRAAAREWVDNNLKRHPRVRVRYLLVGNELLSYPALAASTWGKIVPAMKNLRHALHAIGRGRVKLGTPLAMDALAASYPPSAGAFREDIAGPVMRPLLDFLNPSR

SEQ ID NO: 125550 - protein, 142 aa, Triticum aestivum
  unsure (1)..(142): unsure at all Xaa locations
  Clone ID: PAT_TA_19968.pep
MCGNVCCLVFTLDACRRFGQLFRVNFIAPSLSVLILVHNVSQPKMAVLGSREQMCIHEEVSKLRGKAQNNGCHYLCKKRLCRHNNIVTDYMKNNTELGSEPFDIEDLVNIGRTKGPCPYYISRELSXKSXDILFAPYNYLID

SEQ ID NO: 125551 - protein, 131 aa, Triticum aestivum
  Clone ID: PAT_TA_19969.pep
MTAPLLAGESSAVDAVPPWREQLTVRALVVSAILGVLFCLLTHNLNLTVGIVPSLNVAAGLLGYFLVRTWTAALGMFGVVSKPFTKQENTVIQTCVVACYGLAISGGFGSYMLAMDQKTYELIGTDYPGNF

SEQ ID NO: 125552 - protein, 169 aa, Triticum aestivum
  unsure (1)..(169): unsure at all Xaa locations
  Clone ID: PAT_TA_19970.pep
PCSLPSSPLPLSSPPPPPPPPLPPRXPAPQTVRLPAPRPLTATLAAAAAAGLLLLTPAAPSHAEGEFKVYYGTAASAANYGGYGGNANKRDAAEYVYDVPEGWKERLVSKVEKGTKRHGQRVLQPAQALRAGVLNFLSGFRKLAPVGAVLDNSPSLTSGCRTRSRRRTT

SEQ ID NO: 125553 - protein, 315 aa, Triticum aestivum
  unsure (1)..(315): unsure at all Xaa locations
  Clone ID: PAT_TA_19971.pep
LVALTQVFLRTGQPVVGXTFTMXGVTECPVADIYDYINXHEERAFVLKFSAIEIYNEVVRDLLSAENTPLRLWDDAEKGTYVENLTEVILRDWNHLKGLISVCEAQRKTGETFLNEKSSRSHQILKLTVESSAREFLGKDKSTTLVASVNFVDLAGSERASQAMSAGTRLKEGCHINKSLLSLGTVIRKLSMGSNAHVPYRDSKLTRILQPSLGGNARTAIICTLSPATSHIEQSRNTLFFGSCAKDVVTNAQVNVVMSDKTLVKHLQKEVARLESELRQPVSNSSLEAQVKEKDNQIRKMEKEIKELKSQRDLA

SEQ ID NO: 125554 - protein, 124 aa, Triticum aestivum
  unsure (1)..(124): unsure at all Xaa locations
  Clone ID: PAT_TA_19972.pep
RISSRSVRRLHRQPTSTRTMHRQAVQAATSRSTARVFLDPNLRASLSRPESRSFLAARRGYDGAFPEQPHTEPRRWSSRLQSGDAARGTGLLSAQPHVDFDRAVNNRVQPIHHWTWTKEDXXIX

SEQ ID NO: 125555 - protein, 208 aa, Triticum aestivum
  Clone ID: PAT_TA_19973.pep
MAVPGGRNGLVEDDDVADHAGAFVAPSDDEEAPLPPHLQALSDAAQSGDVDALRTALDNYGGSIDDPVEDGDTVLHLACLYGHLPCVQLLLERGASLECKDEEGAIPLHDACAGGFTEIVQYILSFAANAEGCATRMLNTVDAEGDTPLHHAARGEHMDTVKLLLEAGACPKKENAYGQAAAEMADQDTEVRALLTAKQVEASIHMAN

SEQ ID NO: 125556 - protein, 228 aa, Triticum aestivum
  unsure (1)..(228): unsure at all Xaa locations
  Clone ID: PAT_TA_19974.pep
ASKPPPPLRGSPIHGRRRPGPQAAPAPAPPTPPLQPAAGPRPAPPPPADAAPPPAATAAGASAPGPAAPGPPLXPSTPPCTHTRPSSNVPERRPGRPRRARGRRGAQGAGGVGGQRQEEAQAQDEQAQAPQAPEAPPPPDLSCHGSRLEDCDCKEVLRCRCHTGFKLMVSSSYFGLVIGVAVLVPTKQLLRLGTIPTNTVMTRSQERAVSCLDFWQANKASNARLKKK

SEQ ID NO: 125557 - protein, 184 aa, Triticum aestivum
  unsure (1)..(184): unsure at all Xaa locations
  Clone ID: PAT_TA_19975.pep
MDASPTAAARRAAAIARHLAGLPFGAAAAVAGLQFSPCLSYAPPESSEAPPAFAPMELRALLDGHHLRERDWAYGAMEESPLFCPRRAGGKVFVSPDYNEGKEGQREATMRRIGYLTRRGVFRGWLTEPGPDAELRKLALLECLGVYDHSLAIKVGVHFFLWGXALSSFFGTKPHHDXWLLDTE

SEQ ID NO: 125558 - protein, 162 aa, Triticum aestivum
  unsure (1)..(162): unsure at all Xaa locations
  Clone ID: PAT_TA_19976.pep
MTAGAASAGAVRRAVDRACAAARGARRALARFAPRPSAFGAAADAEAAAVRGVRNARTFRYHYAALQWALLLASLAAAGHRASVLFLMAASKVLLVCLGLLAPFPRLALLRRLVAAAFVALVLADIAAAGAVANLMAALAVGVPVIVLHASFRVRDXXRXPX

SEQ ID NO: 125559 - protein, 242 aa, Triticum aestivum
  Clone ID: PAT_TA_19977.pep
PAGFRETCLKLPFQEMYGILEAMKARNLEPALNWAAKNHDQLLQNSSMLELKLHSLQFVEILTKGSRDVALQYARTPPPCRQIQKLMACLIWADRLEQSPYAEFVSSTHWDKLAEELIHQFCSLLGQSRESPLRVAIAAGFQGLPTLLKLSTVMAAKKQEWQTMKQLPVPIDIGPEFQYHSVFVCPVLREQSSEDNPPMLMPCGHAVSKQSIMKLSKSSSRPFKCPYCPSEAVASQCKQLHF

SEQ ID NO: 125560 - protein, 322 aa, Triticum aestivum
  unsure (1)..(322): unsure at all Xaa locations
  Clone ID: PAT_TA_19978.pep
VQTEVSKAVAEEKRVVFTGHSSGGSIATLAAIWFLENCTRRGSVNQAQPFCVTFGAPLVGDNVFNHAVRREGWSQCILHFIMPLDIIPRILLAPLASSREQIQSVLDWLSPHSPNFSPVARALVIPEFYETLLRSTLSIASYEACSFMGCTSSILGTLTSFIELSPYRPCGTYLFLTSTDQLIVLTNXDAVLQXLLFYCLQLGPQQQLLDAAARSLSAHWEYESIKQSVMQEIGCVDYLRAIPSPLPGGQGNGSALAGLDLCLAAVLGLAAAPPGAKHSGANQAKIDANCSKIQEALKSLNEYKRTCELHEVSYYDSFKLQR

SEQ ID NO: 125561 - protein, 143 aa, Triticum aestivum
  unsure (1)..(143): unsure at all Xaa locations
  Clone ID: PAT_TA_19979.pep
LDLFFVRAPTPPEPRHLQFAPDPLHPSLRPNPPLTLVPSPPPGSTIVPQCVDSASPGDDLRGCVSRHWIAIVAKLRQCLRVAGDGWDCLSMIDGCSRVHQLGISGGGEKRATAEPRRCLARKWCKVRVCSSXXMLLPPRRCGL

SEQ ID NO: 125562 - protein, 160 aa, Triticum aestivum
  Clone ID: PAT_TA_19980.pep
MKFRKGGKVEVLQKAEAPFGSWRPAEILSGNGHTYLVSYDPCLLAGSLAIERVPRKVIRPSPPSPDGPVCWVPGDILEVFDNYSWKVVEVVRLLGHEYYLVRLLGSSLELRVDASNLGTRQLWQDGKWVALPQDSASCAAGSHRSRTEGADSARSQLPPT

SEQ ID NO: 125563 - protein, 223 aa, Triticum aestivum
  Clone ID: PAT_TA_19981.pep
MEKMRAAGEAPPTQQLPPGFRFHPTDVELVLQYLRRMALDRPLPAAVIPVVHAAAMPDPWDLPGASEGESAYFFSQRQGRGGRRRRAAGGYWKATGKEKPVFVQLPVGKRLLVGVKTALAFHRGKSRTDWVMHEYRLAGAAEQNKGANDGSQSSEWVVCRVSLKSRARRTAAGGETTGDHQQEQPSPSPSSTSSCITDHTCHAPDQEEVSSSTTSHCQQHPRR

SEQ ID NO: 125564 - protein, 75 aa, Triticum aestivum
  Clone ID: PAT_TA_19982.pep
RRWGKGGRGDVEEEGGGGGDSEQWNSAAVEEGVGEALVAERHRRHPCRGLCRRRLRRERRRRRRGGGRGFCGGWG

SEQ ID NO: 125565 - protein, 137 aa, Triticum aestivum
  unsure (1)..(137): unsure at all Xaa locations
  Clone ID: PAT_TA_19983.pep
YPATSSTPSPSTPPPASTRRRPPTSRWPAQSSTSPSASPPTVLGAPCAWTLASTWRFPTAASRLPPAPPRRTGSASRRGTGGTSPCSRXSPHPPAGVHDGQPRRRHTERGGGVRRHAQTVLRWCSSRRGRECGKVWG

SEQ ID NO: 125566 - protein, 215 aa, Triticum aestivum
  Clone ID: PAT_TA_19984.pep
QVVETFPDCEVLMGPSVHRTSARLEEILVDCSGNDNDEKNPETAFSNKRTALLKIIEESPVRKTIVFCNKIETCRKVENVLTRLDRKATQIKVLPFHAALDQAKRIANMKEFLKKQTTDSMFLVCTDRASRGIDFTNVNHVVLFDYPRDPSEYVRRVGRTARGASGDGKASVFAVGKQVSLARRVMERNLKGHPLHDVPCFQFLEVGLMMLLLQL

SEQ ID NO: 125567 - protein, 156 aa, Triticum aestivum
  unsure (1)..(156): unsure at all Xaa locations
  Clone ID: PAT_TA_19985.pep
KNRIKXPTHXLRIINVIGNGMRTIGFWSNYSGLLSTVPPEALYSKSPNTSLANQQLYDVIWPGQTAQRPRGWVFPSNAKELKIGIPNRFSFREFVTKDNVTGSMKGYCIDVFTQALALLPYPVTYKFVPFGSGTENPHYDKLIQMVESNELDGAVR

SEQ ID NO: 125568 - protein, 236 aa, Triticum aestivum
  Clone ID: PAT_TA_19986.pep
PKHCQEDQYFAGLPISIIESWYQREGYVKSMADLIEKELSVFTNPEEVMIFFSAHGVPLTYVKDAGDPYRDQMEDCIALIMEELKSRGTLNDHTLAYQSRVGPVQWLKPYTDEVLVELGQKGVKSLLAVPVSFVSEHIETLEEIDMEYRELALESGIENWGRVPALGCTSSFISDLADAVVEALPSASAMTTRKVKDTDSDMDMMHYLTKMFFGSVLAFFLLLSPRLVSAFRNTLH

SEQ ID NO: 125569 - protein, 235 aa, Triticum aestivum
  Clone ID: PAT_TA_19987.pep
RRLPPPPPPAPPRPPPSSPRPPPSATCRRDSGCRGGVFRCLRVFRRPLLHSRPPLVRAPAARVAGPGPGPAVHRRVPPFHLVRPPGHLRRPPRVARRAPLVAGRFELWGQGATYDELEKAIRQYPDERKLPYLTPESSFKIVVDSFGKVISFEEQNEIIKGFTYIPFEGRVNLKKPEHKFFVLETDDYGSQNGLPPVVQKTVFFGREVGAADRHLLPTYQLKSRKYIGPTAMDCE

SEQ ID NO: 125570 - protein, 179 aa, Triticum aestivum
  Clone ID: PAT_TA_19988.pep
GRAPRRSPWPRRQWKQRVGVPGDDAGRRRRRGVRQQAEGRRHPDARRPVEEEGQQVRRRRPGLHICVMPNARLSRVTDPQFARDGELAQLSSRSSSMHAWIDALMFTAFWFGFRLCLYDDEMMFVRLNSVWCSRRELYDDDRWLDAVLLLAAVAHCKMQFGVILDSVEAITRLYASKKK

SEQ ID NO: 125571 - protein, 414 aa, Triticum aestivum
  Clone ID: PAT_TA_19989.pep
MGGDAPPMKRPKLEKDDGWSRHPSPANGSAPRPPASPSQAPPPDGEEDDGELPEEAVLALIAHHEREVERYKLKLEAAERKLADTRSRLARHRGRAPDRSHPPPPPPPVQKAAAPDRRTPPPSQREAPKPAAQSQKPPAPQARPQLVIPGAGHSRPAPRPALPVPKKSPSSSSPSLAQAPQRKADKKPKREIVQREHQNLVQSVKKSSAPTTLKFYGGTLVSSQHKRKLRCLELCPADDQLVVTSALDGMVTLWQVQSSGPSISLLSTTNCFSSKQRWPEDVAWHPDGDTIFAVYTADGGDTQVSMMNLNTSGQKKVTFLQAKPHTKGIINNINFMPWSDTCFMTGGSDHAVMLWQEKDDSWNHKKVHRDLHSSAVMGVAGLQQRKTIISVGMDKRIISYDVSAERAEYLPGRP

SEQ ID NO: 125572 - protein, 114 aa, Triticum aestivum
  Clone ID: PAT_TA_19990.pep
PLVPARHAPWYPTEVALIEIARTTPTPAAPISSCKTKKSKSGRIKIRNVNTRRSPDTDQKRGAASYQIVVLLVLSIPRHGRIQRRRGEARLRSHGEINSSGRFATSVALDWGEL

SEQ ID NO: 125573 - protein, 271 aa, Triticum aestivum
  Clone ID: PAT_TA_19991.pep
VGFSHSRILRTIVQRACSRFPSLVSSNNAWTALSRKMQSAKQAEIIQNGTCKQKAFVIFGGDTSERQVSLMSGTNVWLNLQGFDDLDVTPCLLAPSNGYSSHNEDFSKSSRDVWTLPYSLVLRHTTEEVHAACFEAIEPERVEITSRLRDQVMKELERALSKQDWFAGFDITDEQPIKYSLQQWIDYVKEAKAVVFIAVHGGIGEDGTIQSLLESAGVPYTGPGPIASRTCMGEEATTQADMKIGIIFLDFFERKFLELMNSINTYLLLSQ

SEQ ID NO: 125574 - protein, 65 aa, Triticum aestivum
  Clone ID: PAT_TA_19992.pep
DLQEVSPVLFQSSNTRHVQLLNNKFPTDSSSEYVWDPGVVTHGSQYKNYCAVLFRASNTRYARPI

SEQ ID NO: 125575 - protein, 145 aa, Triticum aestivum
  Clone ID: PAT_TA_19993.pep
MASDRLSALRAFDDTKAGVKGLVDAGATAIPAIFHHPPDAFAPSTVATDVAVPIVDLSCERSAVVGAVRAAAETVGFFLLANHGVPEAAMSGMLAAVRRFNEEPAEAKAPYYTRGAARRVRYSCNADLFQTLVGKWRDTVYMDDA

SEQ ID NO: 125576 - protein, 145 aa, Triticum aestivum
  unsure (1)..(145): unsure at all Xaa locations
  Clone ID: PAT_TA_19994.pep
PPGRSRTGRRRAAPPGAPPPSPPGRXSARRGRRPPRAPAAPGAPGPPRRAPPRPPGRGRRPPPAPAPRRARRRRPAGTPPPCPRPPPPPPPPPAPPAPAPAGAPPTPGSRAPPPPPPAATAPSSSTDTRWRPSSPSRSSGRMASR

SEQ ID NO: 125577 - protein, 354 aa, Triticum aestivum
  Clone ID: PAT_TA_19995.pep
HLLCGHSTYCKLVCKAVLQEHVSEVTRAWKESTGVARLLYLFSGDHVVIASRSPDSVLQTINELEENIQEGLSVAKKKQRETLLQAKVVGTSCDVCKPEDVKKLVNFAVGELGSIDIWINNAGTNKGFRPLVNFSDEDITQIVSTNLVGSLLCTREAMDVMQYQEKGGHVFNMDGAGSGGSSTPLTAVYGSTKCGLRQFQASLMKESRRSKVGVHTASPGMVLTDLLLSGSSLQNKQMFNIICELPETVARTLVPRMRVVKGSGKAVNYLTPPRILLALVTAWVRRGRWFDEEGRAVYAAEADRIRNWAESRTRFSFTDAMEMYTENTWVSVFSLSVVCAFIMLSSSGGPFPGT

SEQ ID NO: 125578 - protein, 222 aa, Triticum aestivum
  unsure (1)..(222): unsure at all Xaa locations
  Clone ID: PAT_TA_19996.pep
MSKPENMFSLLNLDGEDDAGNDSEVNQTSSTSAKETAARKPDKGVQNDTTVVSNNGGTLASSSGGYRMPLVWIDLEMTGLDISKDRILEIACIVTDGKLTKQIXGLTERVLQSEISEGDAEKQVLDFLMKHVGSDTPSIAGNSVYVDLLFLKKYMPRLAAIFSHVIVDVSSIMALCTRWYPKERKQTPRKGKSHRAMDDIKESIAELKYYKGNIFKPQKSKK

SEQ ID NO: 125579 - protein, 123 aa, Triticum aestivum
  Clone ID: PAT_TA_19997.pep
PDVATPLGRLPPFMSFPSPQSQSSSSPSSCFFQQGFSTMSVLKNQHETPTICRQEHLSSYYMMSGCSPYAGDGKQWASGVSTPYHSTPETKSERSPCSGELRTPYSGIEGFSRQRKVSCSRER

SEQ ID NO: 125580 - protein, 253 aa, Triticum aestivum
  Clone ID: PAT_TA_19998.pep
MASPGTLLLATVLVILSIFVSPISGYWKPSRTRTRRPSSRRSWSSGGATWYGSPYGAGSDGGACGYQSAVGQHPFSSMIAAGGPSFFKSGKGCGACYQVKCTGNKACSGRPVTVVIADNCPDGICASEDHFDMSGTAFGAMANRGMADRLRSAGQLKIHYARVPCNYNGMNIVFKVDAGSNPFYLSVLIIYQAGDGDLSAVDIMQGGCAPGHHNDHGAPWMAMKQSWGALWLLQSNNGKPLQAPFSFRLTSGS

SEQ ID NO: 125581 - protein, 97 aa, Triticum aestivum
  unsure (1)..(97): unsure at all Xaa locations
  Clone ID: PAT_TA_19999.pep
SFSVXXSTPSPSSSSSTSLYSSSSTSLYSSSSYTSSPASASTSSSSPSLSSPSSSSSWALDMPLLGNVPKALGFLNCSNILPEEFDPFLHRARSSFS

SEQ ID NO: 125582 - protein, 268 aa, Triticum aestivum
  unsure (1)..(268): unsure at all Xaa locations
  Clone ID: PAT_TA_20000.pep
MAVPSSPSLLLVAALLLCATATLAAAQAVTTRKYQFDVQMTSVTRLCGTKSIATVNGQFPGPTLHAREGDHVEVNVVNNSPYNMSIHWHGVRQLLSGWYDGPSYVTQCPIQPGQSYVYRFQIVGQRGTLWWHAHISWLRATVHGPIVILPPAGVPYPFPAPEAEVPLMFGEWWRNDTEAVIAQALRTGGGPNVSDAYTMNGLPGPLYACSXAKDTFRLKGEAXGKTYMLRLINAALNDELFFXXASPTRPVVLLVPPLVVPAXLVHPL

SEQ ID NO: 125583 - protein, 284 aa, Triticum aestivum
  unsure (1)..(284): unsure at all Xaa locations
  Clone ID: PAT_TA_20001.pep
RHRSYFLMLNLQLGIRYTVGKITPVPLREVRSNDFGPRARIIMYFPCEGSQYTPPHCSVNFFWKDYCPMVFRNLREMFHIDAADYMMSICGGDSLKELSSPGKSGSIFYLSQDERFVIKTLRKSELKIRWRSPPIYYHLNMLPDYTTNVWPAHGSPITXKFVGVLWWALSAGAIARVLVRGPGRCTDLRCHPQDDLQRSSRGRSATLRKICVVASXKDLDLAHAFHVDXSWRQALFRQIALDSMFLESQSIIDYXMLLGIHFRAPXHLKTATSHQNTLESSGIT

SEQ ID NO: 125584 - protein, 76 aa, Triticum aestivum
  Clone ID: PAT_TA_20002.pep
LAAPQADLSARPPPPRPDRSSSASQPVRPSVRPSVRGSSVTSTSLPVVSCSPPLLERYFLFSVVHLLCRYLIRIKL

SEQ ID NO: 125585 - protein, 87 aa, Triticum aestivum
  Clone ID: PAT_TA_20003.pep
MSVTRVLALLAAAALVVAAPARVGAAGACTAEKFSKNRVYAACTDLPTLGASVHWTYDPAASSLSVAFVAAPPSSGGWVAWGSTPPA

SEQ ID NO: 125586 - protein, 566 aa, Triticum aestivum
  Clone ID: PAT_TA_20004.pep
WIPRAAGIRHQGPTPDFYSTHYQPTGVYKSKESQTLSGQSFSFTDPGVLRLGLQTDGAETIQPLQTPNETVHSFAVVDEASTSAAVRSMGGYMPSLLFAPRSSSSAANETQLQSRDSLNSTHYNSNNGRVVQHLQLSPEPSATTETSFGVSSDVVTGATTSEQRSHPRHPKKCRFKGCSKGGRGSSGLCIAHGGGQRCHKPGCHKGAESSTAYCKAHGGGRRCEELGCTKSAEGKTDYCIAHGGGRRCEYPDCPKAARGKSGRCIKHGGGKRCAMEGCIRSAEGKAGLCISHGGGRRCQYPDCAKGAQGSTLYCKAHGGGKRCVFDGCSRGAEGSTPLCKAHGGGKRCMFEGGGVCPKSVHGGTEFCVAHGGGKRCAAPGCTKSARGRTDCCVKHGGGKRCRIDNCGKSAQGSTDFCKAHGGGKRCTWGSGCEKFARGKSGLCAAHGTLVARQQEHGMVKSGGSMIGPGLFSGIVASSTTAASSMTNEHSSSGISTASDSDGTVRSQAMIPPQLLVPRSMMPSSSSEPTVHGGREAGCPVPEGRVHGGGLLSLLGGSFRNANIDKL

SEQ ID NO: 125587 - protein, 159 aa, Triticum aestivum
  Clone ID: PAT_TA_20005.pep
VEERTNEEDQKMLSVYGIAKTDFLDGILTAQYNENDLNLRYCYKDNELTLVPSVSLPSNAVSLDFKRRFGSSDKLSYHFNFDTDEWNAVYKHTIGKNYKLKAGYDSEVRVGWASIWAGQEEGKAKTAPMKMKVQFMLQVPQDNIRNPSLLFRVKKRWDL

SEQ ID NO: 125588 - protein, 207 aa, Triticum aestivum
  unsure (1)..(207): unsure at all Xaa locations
  Clone ID: PAT_TA_20006.pep
ARGPPPPRSPDGARAALPSPAPSSPSSAHWLSLVGTVWLQTINGPNSDFPVYSSQLKALKGISQVQLNFLAFASDAGKLFGWXFAGVAALYVPLPLVAVVGAAFXGLVGYGVQYLFLDTPGLACWHLFPLTALAGNGICWINTVCYLLCINNFPPRARPAVRLPPRRLALSATLGTSLAESLPRLADSXXXTYLLLNAVVPMIVTVF

SEQ ID NO: 125589 - protein, 172 aa, Triticum aestivum
  Clone ID: PAT_TA_20007.pep
KKQSRRDYPSMAALRHAGRRLCERALQRGGPQVIPSGRRSMFISIGGKPKPTTAAAQEELKMQFQKKKEELFDVLVELSRTRTYPNLSWEALQVNQLATRLVGKVEPRPGDYYWRSYRLQGRLSTFLVSYLFLHFVYMEHFWIPKKQREDGATSNNGEAKILPDSDENQIRT

SEQ ID NO: 125590 - protein, 249 aa, Triticum aestivum
  unsure (1)..(249): unsure at all Xaa locations
  Clone ID: PAT_TA_20008.pep
AHVIRLPPPARHAETSAGRPLATAAQVAATFLSFLSCPRHHTAPSPSISFLATPVLPASLRAAAAGGQTLTFRCRGRRIAVVAQLPTMIPELASGEKKIRWSSRAVRSXAMAELEARKMRYPTTGTEGLLMGILVEGTSDAAKLMRAKGITLLTVRDAAATILGKSEMFYFSPMHPPLTESAQRALDWAVNEKLKSGEDGEVTANHLFLAIWSDKESAGHKVLASLGFDDQKASLLAKTAGEEKAMSPR

SEQ ID NO: 125591 - protein, 223 aa, Triticum aestivum
  Clone ID: PAT_TA_20009.pep
MSRLASELHRLRRSPWEVLCSALVSCGLVLFSQLAVAIVPRLLPSISLLAMLPVAGLVFLAAILVGRFWRRFIGVAASAPLFVLFNVLFLWGVYLFVIRRDTSSLLDMLINAECALLLWGLYRILSGDPGIVAYESSFLEEAGCKDFVDAICSSENYPSLSRVRHCNCCKANVRGCDHPCPAFGDCIGHKNRTLFMALSTGFVAAESTYTVCATKYITSCITS

SEQ ID NO: 125592 - protein, 117 aa, Triticum aestivum
  Clone ID: PAT_TA_20010.pep
MAPERRRSGLAAAADAASWCCGLALVTLLLVSSLRAGEGEESGGGAVVVRGARIASAPRRPCDEIYVVVEGETLHSISDRCGDPYILEHNPHVHDPDDVFPGLVIKITPRAAADSRR

SEQ ID NO: 125593 - protein, 295 aa, Triticum aestivum
  unsure (1)..(295): unsure at all Xaa locations
  Clone ID: PAT_TA_20011.pep
EGSFHTYPSLGGPFQSLQEAENAITSHLDELRSPMMCTDGLSDAEIGILHDLYWPDGTRQNSSEGDADHRNISLLVQALLDKYNEDHHLLGDFAHELDDVVIFREFVEGEKVVRFYHINLATKTKGEDGLHSGVNNLFFAEVRQIKGENVYVLSCLCMVKPTDSGQCYGCLSYGNIDLKHPVDTDKYKGGHTAPRSPCCGFDLRCDVPAYIEDEDEEARLAKEEARLRYIYKCPAPAKLDGARVRAGLAKREDAGLTKGDVAREKRNTLCLLXVVCWLSNHISKYLGRRIXRCAP

SEQ ID NO: 125594 - protein, 97 aa, Triticum aestivum
  Clone ID: PAT_TA_20012.pep
KYEETRNSVTGETVVQHFNTAQEADQGNFKDKATSADLEVVEVTLLLEWFAENYRQFGCTLELITNNTQEPGPVRAIVGLAGDPAPPGCGPRFRCHS

SEQ ID NO: 125595 - protein, 184 aa, Triticum aestivum
  unsure (1)..(184): unsure at all Xaa locations
  Clone ID: PAT_TA_20013.pep
MGHAQSTSRHNGRAGAANGVEPPLPSRFSRFRSRLRLRRHRGRDRCGAAGDSSESGKGVAADEFAGIARIRIVKADLRFKDKFFACLSLGERTYRTETSDSTHRPVWNSEKKVVIETNGPHIARISVFETNRFSKNTLVGYCEVDLFDLLTXXLEEEHAXXLALLDPSSSITTMGTISVSCYIX

SEQ ID NO: 125596 - protein, 109 aa, Triticum aestivum
  Clone ID: PAT_TA_20014.pep
GVISHPTIGISDGRCTRTTLSILHPCSSFNALFSTAPALAPAPAPAPAPAPHRGGLNTGHGGSVEPPIFFNKMNRVEPRHTSSCRRDRRRKIRREPRELLRFEMAGALR

SEQ ID NO: 125597 - protein, 68 aa, Triticum aestivum
  Clone ID: PAT_TA_20015.pep
YGRGVAVLVGVPHKDAEFKTHPMNFLNVRTLKGTFFGNFKATWRPFTMFDTAPPWNSLCGSRDKISRS

SEQ ID NO: 125598 - protein, 168 aa, Triticum aestivum
  unsure (1)..(168): unsure at all Xaa locations
  Clone ID: PAT_TA_20016.pep
MACKSSCNLLLLAAVLLSVVAAASASGSCVPGVAFRTDLLPHCRDYVLQQTCGTFTPGSKLPEWMTSASIFSPXKPYLAKLYCCQELAEIPQQCRCEALRYFIALPVPSQPVDPRSGNVGESGLIDLPGCPRQMQWDFVRLLVAPGQCNLATIHNVRYCPAVEQLLWI

SEQ ID NO: 125599 - protein, 182 aa, Triticum aestivum
  Clone ID: PAT_TA_20017.pep
TFAKEQSRESFCAGLFVFVHAVQQTQSTTQTSRHTTITHSYLVLSSSSSHKGHTDRQTDRRLSSSCFDNTNNYKQHGVSFPLLHLQQTDRHMHRWGLVQALHSLQTQLLSLARSLKAPSGGRGPHEGLLHPCRRESPRLPCRHQESLLHPCRRESPRLPCHHRESLRRPCHQESLRRPCPQE

SEQ ID NO: 125600 - protein, 168 aa, Triticum aestivum
  Clone ID: PAT_TA_20018.pep
MACKSSCSLLLLAAVLLSVLAAASASGSCVPGVAFRTNLLPHCRDYVLQQTCGTFTPGSKLPEWMTSASIYSPGKPYLAKLYCCQELAEISQQCRCEALRYFIALPVPSQPVDPRSGNVGESGLIDLPGCPREMQWDFVRLLVAPGQCNLATIHNVRYCPAVEQPLWI

SEQ ID NO: 125601 - protein, 244 aa, Triticum aestivum
  unsure (1)..(244): unsure at all Xaa locations
  Clone ID: PAT_TA_20019.pep
AAPRLAPTTSAPLSPYPDCDRSRALDCRHGRVLLHVWVKGRGWHFTVWDPVTGDQQSLPEPGIPWLIYTAAVFCPVAGCGHLDCHGGPFRVVFVATDDYDELVKAAVYSSRTAAWSTPVTLDDGCESYVRHXRDVLAADGSFYYIPYVEPKRGVVIGDETYFALREGNAIIRYDWAKNCISMVDPPDPNVYDDVALMAMEDSSLGFPCLGESSLYLFSXRKVNAEWVCCRAIKLGDXIPVAXPG

SEQ ID NO: 125602 - protein, 94 aa, Triticum aestivum
  unsure (1)..(94): unsure at all Xaa locations
  Clone ID: PAT_TA_20020.pep
SSGPLRLCKYMYWVSASKKKKKKKKKKKKRESCPPLPPPALTLSNCLCXKGQTVSNMMSHINEXSGSPKLKHYCQIFGFFSSSSGGILHKVXQL

SEQ ID NO: 125603 - protein, 108 aa, Triticum aestivum
  unsure (1)..(108): unsure at all Xaa locations
  Clone ID: PAT_TA_20021.pep
ARGDPPHPPSSSPPPPXPSSSLPPPHLLCLRAPRPPRAGHHXPPPPPPYPPPAAQKCCAVSHPFLPQREISPFPVPPPPARSAPARPLQRTASTAGSGCREAPAPHSL

SEQ ID NO: 125604 - protein, 121 aa, Triticum aestivum
  Clone ID: PAT_TA_20022.pep
MATIDENSGFPRSLVRFVADAWDETNFLLKEEKRLRSLVKKTIRYFHGNDAKDDGFSLFVIVRDFLVMLDKACKEVGASQKKAASQSRSSGSCNPASQLNPQEKQFPAVLDDHLDSSDSND

SEQ ID NO: 125605 - protein, 288 aa, Triticum aestivum
  unsure (1)..(288): unsure at all Xaa locations
  Clone ID: PAT_TA_20023.pep
MASSLPEKAGVPPWSRLEGQVVLVTGASSGIGRDFCLDLARAGCRVVAAARRADRLRSLCDEINASADAAVSHPWAVAVEIDVAAGGSAVEAAVQRAWDAFGRIDVLINNAGLRGGVHSSLDWPEDEWDKLIKTNLTGLWLVAKHVCRHMRDAKIKGSVINISSVAGLNRGNLPGSIGYASSKSAVHSVTKIMALELGAYGIRVNAIAPGIFQSEITAPLLQKRWLSTVVSXKIVPLKTNGTTDPALTSLVRFLIHEKASYITGNIFIVDSGVTVPGVPISLLCNLCY

SEQ ID NO: 125606 - protein, 214 aa, Triticum aestivum
  Clone ID: PAT_TA_20024.pep
GCRPSSGTIRRNAVPGPAALARFVSHCGYSTASNSQRLAGKVAVITGAARGIGKATAAEFVRNGAKVILTDIRDDLGRAVAAQLGPDAAYARCDVTDEAQVAAAVDLAVARHGRLDIMHNHAGVTGRMVLDSVGSLDLADFDRTMATNARSAVAGIKHAARVMVPRRSGCIICTASTAGVLGGIIAPTYGISKAAVIGAVRAFAGELGRHGVRV

SEQ ID NO: 125607 - protein, 122 aa, Triticum aestivum
  unsure (1)..(122): unsure at all Xaa locations
  Clone ID: PAT_TA_20025.pep
SLYLRRRGGSGSDGDAPVGGAGAAYPGPSLGVQFQGTDGFLRLRCRGGAGVPVHNYSSRRTLGDGARWWEALGDGKLTRAGWWEQPAARPALSSTRSPGCRRPPLPQLLLLGLRSSTGKXRX

SEQ ID NO: 125608 - protein, 157 aa, Triticum aestivum
  unsure (1)..(157): unsure at all Xaa locations
  Clone ID: PAT_TA_20026.pep
QKAKREATGVLPVSAGEPAGSLFLRPPLRRREDGGALRCRIRSVHTGSFRCSRGAAVWWVTALRRGRAAAAFPPLLESWRRLSSHWVSPAKWDCVSRGLGPQGRRPANQRQLGILNLPGFCLLLTNDGLPPPTVLSIPGRXYKSFAGLVLSGKHSVC

SEQ ID NO: 125609 - protein, 176 aa, Triticum aestivum
  unsure (1)..(176): unsure at all Xaa locations
  Clone ID: PAT_TA_20027.pep
VCSAEQGIRTLLSRNFQARVSFVSPALKLPLLQPASRLVIPKFGRARELPPHPKSLPQPRHAKSPFYPSVGNEAPRRGVKTGPSVLLSQPTFRDKRVPKLGSPLPLHPPFVHRXRQKHGTELVRPAPDAAXRRSSRLVVNATVASSSRMGRXVVIRLRRIXTLSTQXVXDFAVIXH

SEQ ID NO: 125610 - protein, 139 aa, Triticum aestivum
  unsure (1)..(139): unsure at all Xaa locations
  Clone ID: PAT_TA_20028.pep
GLKKALRWMPRSSASPRLEEDEDNNERNGLLRSHRDQNRVVPVTDLHVDEQPKAGAHVEPKTVALKVSMHCHGCARKVEKQISKFHGVVSIKIELGMKDXVPLVGNVTPMQSWETVPKVIKYAHICRRPKHAVSRSTVW

SEQ ID NO: 125611 - protein, 90 aa, Triticum aestivum
  unsure (1)..(90): unsure at all Xaa locations
  Clone ID: PAT_TA_20029.pep
SGRCRRRPRCWPWPSYSGSPSALPARASRCWPPRSRPPPPTPPPAASCGSTRPSSRTTPTPAPPRSXTGSRRARPTPRSPARXPPRRSRR

SEQ ID NO: 125612 - protein, 411 aa, Triticum aestivum
  Clone ID: PAT_TA_20030.pep
MESSNGKPPQGEEEGKAAGSIGGHESLHRLLESNLPPELFKEASRLLLGLNCAHPLEAVSLPGATTDLAKAHNFDVQAFHFNADKEHMRQPRIVRVGLIQNSIAVPTTCHFADQKKSIMEKVKPIIDAAGASGVNILCLQEAWTMPFAFCTREKRWCEFAEPVDGESTQFLQELAQKYNMVIVSPILERDINHGETIWNTVVVIGNNGNIIGIHRKNHIPRVGDFNESTYYMEGNTGHPVFETAYGKIAVNICYGRHHPLNWLAFGLNGAEIVFNPSATVGELSEPMWPIEARNAAIANSYFVGSINRVGTEVFPNPFTSGDGKPQHADFGHFYGSSHFSAPDASCTPSLSRYRDGLMISDMDLNLCRQIKDKWAFRMTARYDMYANLLSEYLKPDFKPQVIADPLINKRA

SEQ ID NO: 125613 - protein, 126 aa, Triticum aestivum
  Clone ID: PAT_TA_20031.pep
DSLNGHGTSIPGGPPCLCLQEPNFQILVGNLNNLRELYLDGVDMSTSADDWCDAFADSLPNLRVLSLRYCNLVGPICPSLSTLHSLAVISLQDNFDTSVTSSGDAHGFSQFKFSSACLEKYPTLVP

SEQ ID NO: 125614 - protein, 324 aa, Triticum aestivum
  Clone ID: PAT_TA_20032.pep
VFFSIHSDKAKALLDTYRIGELITTGTGYNSDNSVHGGSSLSHLAPIREATKVAGAPIALSSPREKVPCRLVDKKELSHDVRLFRFALPSSDQVLGLPVGKHIFVCATIDGKLCMRAYTPTSMVDEIGQFELLVKVYFRDEHPKFPNGGLMTQYLESLQLGSCIDVKGPLGHVEYTGRGNFVINGKQRRARRLAMICGGSGITPMYQVIQAVLRDQPEDETEMHLVYANRSEDDILLRDELDRWAAEYPERLKVWYVIDQVKRPEDGWRFSVGFVTEDILRAHVPEGGDETLALACGPPPMIKFAISPNLEKMKYDMANSFISF

SEQ ID NO: 125615 - protein, 388 aa, Triticum aestivum
  Clone ID: PAT_TA_20033.pep
MEIRARAPGKIILAGEHAVVHGSSAVAAAIDLYTQSSLHLPPSWDGGAGEVEVDLTDTGLAFSWPCSRLLEALGETCRKAELQAPRPCSPEELAAIAKLVELHEIPEANIWLSAGLSAFLYLYTSILGCRPGKVVVSSGLPMGAGLGSSAAFSVSLSGALLTAAGVVHPDSAVGGTEWRLLGKDHLELVNTWAFPREKIIHGKPSGIDNAVSTFGSMIKFKKGELTNLKSGNPVKMLITDTTVAAKAKALVAGVSERASRHPDAMASVFHAVNTISEELSSIVELAATDEIAMTSKEEKLAELMEMNQGLLQCMGVSHASIETVLRSTLKYNLVSKLTGAGGGGCVLTLIPTLLSKLVLEKVTTELESHGFRCFKVEVGGQGLQIHQG

SEQ ID NO: 125616 - protein, 106 aa, Triticum aestivum
  unsure (1)..(106): unsure at all Xaa locations
  Clone ID: PAT_TA_20034.pep
RTELGGSTWLQWRLFPPYPLPPPLSCGTTSASGTPLLPGAASLTVRAMAAAAECLTPGAARXLRLRREGPGTLPRAPAVGGDRSTGFPLARGSRNGTKPXEPAGAP

SEQ ID NO: 125617 - protein, 165 aa, Triticum aestivum
  Clone ID: PAT_TA_20035.pep
PRDERPRATSDHREDGGTNKNAAGARGGAPRQRWGERPRPPAVAAGRAEASRPTQPPGAGHEGGARSARRAAGHEQGARRPRRWAAAGRPRADGRSGPPNRRRRSRCSRGGAAPSSAIHLPRVRRRCAATPDEARSHAGDGDPWMRGRMERHGERLHRGGSEERG

SEQ ID NO: 125618 - protein, 100 aa, Triticum aestivum
  unsure (1)..(100): unsure at all Xaa locations
  Clone ID: PAT_TA_20036.pep
RPGPGAPVASPAPRGPSGSSAARGRDPRPGVAFGTAERRRLTATHWLVAYGXGKPGKKGRPSGAAAGKVGTDVLWSMSSRVVADMWLKPMRNPDVKIAAN

SEQ ID NO: 125619 - protein, 322 aa, Triticum aestivum
  Clone ID: PAT_TA_20037.pep
PPPRRTNIKHPSRRLDAQTSNIRAAAPTSTNLNDKNGANICIWLSKATPPRRMRRSRSERSELGISPGEPIRHGVERGSTTTPPMRKMASRCHRCRHQPRSGRSHPQTREWRGCTTRSGHRSAKMAGACSMSQTPWSKPTNLHLASCPPQHLSLRRPKHHHRSWIRAVTARSRHHSSLPARTSNIEPEAAAPASSTPSAAAMEPCTRWTDRRSQIRPSPTKCSPPHPPPPHNRRHSPTGDARGRRAGSCRPPLRIAPPATGSGAAGRSSHRKRAEQRRRPRRRHHHAGFARRWPPAAAAAGEEQVEGAAGGGGPSRRPCRLS

SEQ ID NO: 125620 - protein, 233 aa, Triticum aestivum
  unsure (1)..(233): unsure at all Xaa locations
  Clone ID: PAT_TA_20038.pep
MDDHQEEAPEKVKLFGMWASPYVLKVKWALSIKGVEYEYVEEDLRNKSDDLLEHNPVHKKVPVLLYRGKPVAESDVIVEFVDEAVELPRRPXLPDDPHERAMGRFWVRFVHDKLSPPIWKWFTAAPGEGQKAALXAAVEQLQVLEDLLALGGGDVLGGGGVGVVDRSLGALAYVIPMYEEIIGVRMVTEERFPSLSASVVRFLDLMPVKDHPAPVPRLKPRYRAMREAFLNMG

SEQ ID NO: 125621 - protein, 104 aa, Triticum aestivum
  Clone ID: PAT_TA_20039.pep
TRSCSAASPIHCPVNFPPSGRVKELQPNSTAVRVYFNNSNVTVHCGSPVSVLGREAFYRFRGYGCVIREQNFVTAVMTISCVSLRSSGWRFRGPAVMRYNTNEA

SEQ ID NO: 125622 - protein, 256 aa, Triticum aestivum
  Clone ID: PAT_TA_20040.pep
MELAVRAAAASCSSSPSLHPPRFPCRLGRNPGLPLPARHVAVAALAAIALDPFQEIKTELNDTSKTEVFACPVCYEPLIRKGPPGMNLPAIYRSGFKCSKCNKSFTSKDVFLDLTVTSGMKEYSELKPARTGGRRRALVSYLYERGWRQNFNRSGFPGRDEEFQMAQDYFQSVAGGILVDVSCGSGLFSRKFASSGAYSSVIALDFSENMLRQCYDYIKQEETPMNTNLALVRADISRLPFASCSIDAIHAGAAIH

SEQ ID NO: 125623 - protein, 149 aa, Triticum aestivum
  unsure (1)..(149): unsure at all Xaa locations
  Clone ID: PAT_TA_20041.pep
MGRGSPRWAALLLLLLLLAAAGLSSAHPGACPVPAAAEAVLGPPSTCSPLDRRLGDPVGVXIEGDEATLARAVNLLYLNKEXYIAVLFHAXVGAPFSQECFPPFVFVALLAPTFPPFASGQSALWPRLFSGFGPPPFPTLFLLNSTMRV

SEQ ID NO: 125624 - protein, 241 aa, Triticum aestivum
  Clone ID: PAT_TA_20042.pep
SFHGEPCTSAFHNSLTLQSLTVFSLVAVFAADHAQGGDDGCPRFSCGHLRDIRHPFRRLGDPLECGVEEYELGCTSSKAIIHINTGTYYVTAINYTGSYFWVMDPNFNTNSSCPLPPSTHVPYFGYWCRLDSVSPSGFRFSVRQSDDIACSTNYALAVTVNPAYMPVAYLSPKITCVCLASFNIWVVEARGCNSRKIMIYTHTGAKFGPAPGSTGPDFWVIDANFNTESQMVKLNQFRASI

SEQ ID NO: 125625 - protein, 171 aa, Triticum aestivum
  unsure (1)..(171): unsure at all Xaa locations
  Clone ID: PAT_TA_20043.pep
MATTAMALSPSSFAGKAVKDLPSSALFGEARVTMRKTAAKAKPVSSGSPWYGSDRVLYLGPLSGDPPSYLTGEFPGDYGWDTAGLSADPETFAKNRELEVIHCRWAMLGALGCVFPELLARNGVKFGEGVWFKGGSXLSEGGLNNSGNPASPPPKQPPPPSAGKWPMGVQG

SEQ ID NO: 125626 - protein, 481 aa, Triticum aestivum
  unsure (1)..(481): unsure at all Xaa locations
  Clone ID: PAT_TA_20044.pep
SRPLAVTAYPAPGKSLSCSGGRRLLRMLESRAFEGSRGPPQQINPTRPLLTNLGSASNVSSPIAVNSERPDRMLPAVSMSGLASMDVSRTPDVKPRITDESEKLKTWKLADIVDSGHLRARRCPDTGASPTKVVRLLYTNSGVALLSLGSNAVHKLWKWQRSDRNPNGKSTASIWGSLCQLGHGIRMHKGESRLPRLTEPTRPCHQLQQHLTTRRRKKTVRFMRQGEVICINSTPSPXPQVVIDDGMSRLVFGSWLFFCPKNLNXHHLVPSSFVKLFLLPASGGYXKQLCVWSNDGWEKKKSNYIQPPANRSGALVGDTRVQFHNDQTHLLVVHESQLAIYDGNLECSRSWYPRDALPAPVSSAIYSCDGLLVYAGFCDGAIGVFEAESLRLRCRIALSAYVPPSISSGASVYPMVVAAHPLEPNQIAVGMSDGAVHVVEPLDADPKWGXVRPPKDNGAHPSMSSAPAASEHPGRLDQPTR

SEQ ID NO: 125627 - protein, 158 aa, Triticum aestivum
  unsure (1)..(158): unsure at all Xaa locations
  Clone ID: PAT_TA_20045.pep
MGAPAYGAVLLFALALAAGAAAAETARPEEPTLPAAAGGWWRPGGGGRPXRSSXGSGAGVNSNLGCWWRLLDSHYTELAELVEKGAAAANLXDPLXPKKSTILRRPPNXXAWNRNLQPGFKRXPVQAXXXQXRSKSLLXXKVLPGGANPGGLLRGLPN

SEQ ID NO: 125628 - protein, 94 aa, Triticum aestivum
  Clone ID: PAT_TA_20046.pep
STISGSGCPRIHPNHDLDQTLNLLKYNFCMPYGDRTGAQLCPSGSPCTRDAGEAGVTPSHVAQYAWHPRSCFDRRLHAQVHGIAYTSCTSWMHA

SEQ ID NO: 125629 - protein, 208 aa, Triticum aestivum
  unsure (1)..(208): unsure at all Xaa locations
  Clone ID: PAT_TA_20047.pep
LKAYGTSKPTRYTFPEVKKXARRFKDKLGQGGFGSVYXXELQNGGPVAVKMLESSTGEGEEFINEVATIGLIHHANIVRLLGSCSRRTRRALISGFTPDVSRVFALLPPRRLLFXGRLGPLIMLDVALGIARGMEYLHXGXNQSNLXFDIKPXNILLGFNFNXKISDXFXPTKLXCXGNKVINLPLTAXKXGTIGLKPGHFQRGTFGG

SEQ ID NO: 125630 - protein, 115 aa, Triticum aestivum
  unsure (1)..(115): unsure at all Xaa locations
  Clone ID: PAT_TA_20048.pep
MASNTVKLIDIAVNFTDGMFKGIYHGKQCHSADLPSVLARAWAAGVDRIIVTGGSLKESREALEIAETDGRLFCTVGVHPTRCGVVAVGECGLDYDRLQFCPSDIQKXKYFEKQF

SEQ ID NO: 125631 - protein, 359 aa, Triticum aestivum
  unsure (1)..(359): unsure at all Xaa locations
  Clone ID: PAT_TA_20049.pep
GRETRSVDLERYVKELRKYKRHSQALELMDWMVHTKGMNMSYTNHAIRLDLIYKVRGIEAAEKYFDGLPDPAKNHRTYGALLNCYCSSKKEEKATXLYRKMDELGISSSTLPINNLMSLYMKLGQHKKVCSLFEEMKEKNVKPDNLTCCILMTSCAALDKIDDVEQVLKEMEEKGGVLGWSAYSTLASIYQSAGLVEKAESALKKLEGLVQDRDGRQPFDFLMSLYASVGYLPPVKRVWGVLKGTFPKVTNTSYFSMLQALLKLNDADYMKQVFEEWESNHECYDVKLTNVMTRAHLKNGMAKEAEQLWEKAKEMGACFDSKTCELFLDHYMGTGDMKSALNWVENVTXLPKESREAGS

SEQ ID NO: 125632 - protein, 338 aa, Triticum aestivum
  Clone ID: PAT_TA_20050.pep
MRRKAGKEKLITSPSGSLNGRVPVDSDVVVGVSQSACTGLQDDVASENLEDKYQYATIVLPVKESEALSSSKALISFEKAHSFEIRNSHFDEPSPTSVLDALFEDRNEKSASSSESAITAKQEPLSRCLPIGSVARTLSWDDSSEEEAAPCSSKEEDSHEQEQYEFVEKILSSAGLCNGATSNVFARWHSLDSPLAPNVPDQFLERKVEDAKCRERRSSQRLLIDSVNAALLDIGQSKLWGAYPCTAGPIIINVSQRDEPVGDAAWRLVKGWLSDDEAGNGLPDNVGAAADRVVGEEIEGRGWSEMLRMEVDDMTKEICGDVLGEVVEEALSELAGCR

SEQ ID NO: 125633 - protein, 104 aa, Triticum aestivum
  unsure (1)..(104): unsure at all Xaa locations
  Clone ID: PAT_TA_20051.pep
SGSTARTSFSKRFQEASITSDPKNITTTWYGPDICNKTKICWVPLRGSTRGGLRSSQSREVVFNGXWAACNRRLQGFIEQLPEPLRSFKLPPKKLWGEXSPSPD

SEQ ID NO: 125634 - protein, 84 aa, Triticum aestivum
  Clone ID: PAT_TA_20052.pep
PTPSESAIAPSCVSSAAHLRTRRDGAAGGDGAVQHLGALLLMSDGTLLVVSSGLSDAGEFVYCAAARRRGRHPAPRHPPPSCLS

SEQ ID NO: 125635 - protein, 237 aa, Triticum aestivum
  Clone ID: PAT_TA_20053.pep
MLQLWEAAERTCKNQTAKSSSCEHEHDIEAVEEVKSEYPSSELSRGRDLGIINKLEMSSSAEPDELWGKNVAERLASDGQRLASIQESIEELKRKMGGPAKGHSEYESVSSQLRETEGLVLEQMNLNSKLAKKAENYPALLDSMNAEREGGFPSKRKMLEQVRKGSDKVARLELELQKIQYVLLKLEEEHEYTRLKVSEKRTRVLLKDYLYGRKDHRGKKKRAPFCSCVRSKSRTEP

SEQ ID NO: 125636 - protein, 156 aa, Triticum aestivum
  unsure (1)..(156): unsure at all Xaa locations
  Clone ID: PAT_TA_20054.pep
MLPSFSPAATAVATPPPKPIPGGYGAPVLGPLRDRLDYFWVQGPEXEFFRRRAAQXRSTVFPRKTIPPXXFPFLVGREPRRVAPLXLAAPAALFRPDLVDNAMLNRPXNQTILGRTLACTGQEDRTTHKARMALAPLWFQHDPRTSLPRKGGQFPK

SEQ ID NO: 125637 - protein, 138 aa, Triticum aestivum
  Clone ID: PAT_TA_20055.pep
MSLVARRRKPELVLPARATPRETLPLSDIDDHKELRYLQPAVEFFRAVDGHGWPAKAVVRAALAEALVHYYPLAGRLREASGGRLVVECTGEGVVLVEAESDVSLDELGEPPLLACPFVEELLCDVGDARVVIGSSMF

SEQ ID NO: 125638 - protein, 297 aa, Triticum aestivum
  Clone ID: PAT_TA_20056.pep
MAASAARSLALFSSAASLGLGRASSRLALSSSPSHSGLLPRPALAFRGRASFAATAVVMGKAGAVDAEADAGMDAVQRRLMFDDECILVDEQDNVIGHESKYNCHLMEKIESGHALHRAFSVFLFNSKYELLLQQRSTTKVTFPLVWTNTCCSHPLHRESELIEENCQGVRNAAQRKLFDELGIQAEDLPVDQFIPLGKMLYKAPSDGKWGEHELDYLLFMVRDVKLNPNPEEVSDVKYVNRDELKQLIKKADDGEGGIKLSPWFRLVVDNFLMGWWDHVEQGTLKEVADMKTIHKL

SEQ ID NO: 125639 - protein, 92 aa, Triticum aestivum
  unsure (1)..(92): unsure at all Xaa locations
  Clone ID: PAT_TA_20057.pep
SAGGRAPPRPPQPSGLRGAFVSRPAALGXGEGAPAARPLHATAPRLAPPLPPSARGHGPPPVGPAGLPGPPPPRPLSPPPAPPPARLSPPGF

SEQ ID NO: 125640 - protein, 97 aa, Triticum aestivum
  unsure (1)..(97): unsure at all Xaa locations
  Clone ID: PAT_TA_20058.pep
MANRGKILMERYELGRLLGKGTFGKVHYARSLXSNQSVAIKMLDKEKVLKGGLSEQIRREVTTMRVVAHKNIVQLHEVMATXNKIYFGMEYVKXGEL

SEQ ID NO: 125641 - protein, 266 aa, Triticum aestivum
  Clone ID: PAT_TA_20059.pep
MQLEVMANRGKILMERYELGRLLGKGTFGKVHYARSLESNRSVAIKMLDKEKVLKVGLSEQIRREVTTMRLVAHKNIVQLHEVMATRNKIYFVMEYVKGGELFDKVAKSGKLTEGAAHKYFQQLISAVDYCHSQGVYHRDLKLENLLLDENENLKVSDFGLSALSESKRQDGLLHTTCGTPAYVAPEVISKTGYDGAKSDIWSCGVILFVLVAGYLPFHGSNLMDMYRKIEQGDFRCPNWFSHKLQKLLFKILDPNPSTRASIQKI

SEQ ID NO: 125642 - protein, 189 aa, Triticum aestivum
  Clone ID: PAT_TA_20060.pep
MTIVEMQMNIDCDGCEDNVRKALLRLQGVHYVDVDRARDKVTVTGTASQKKVLRAARRTGKARRAVAVGVRPGVPPRPRLRSTRSRPTTTPTRPSPPPPTRTATTTASRTAGPRPRRALRGPRRPAPPPRPCAPLHAGPPTGGLHPPTPTGAPGPHPPCRLSPTGLASVHVGALPPVPRTHPQGLNYPE

SEQ ID NO: 125643 - protein, 195 aa, Triticum aestivum
  unsure (1)..(195): unsure at all Xaa locations
  Clone ID: PAT_TA_20061.pep
PPRRTPPPPTLTLAAAPPPPISAPPLPLHQRRRPPSSTPARVPAPRSVPPCRPKSPSRLHQSTKGQAHNLSPPPRKIHRIPRGSTNQIFGRMGRGRKDPWGGRADPVDSRGGRRNRRTRGWEGGGGGGKCXGRTGEEWRPRGRVEAEEEGRRRRKRSGNRRMRRLRRPRRRRSRRPRARRPSGRRDSTRSRPSAA

SEQ ID NO: 125644 - protein, 153 aa, Triticum aestivum
  unsure (1)..(153): unsure at all Xaa locations
  Clone ID: PAT_TA_20062.pep
MAGRGEELKLLGMWASPFVVRVQIALRLKGLXSYEYVEEDLQSKSEXLLLRSNPAHAGKVPVLIHNGKPVCESSVILRYIDEAFSGSGPSLLPADPYGRAVALFWARFRRRHGASIHRPRSLPLTWPRAPIYRVRRRRLKARRRRWGNLGGGF

SEQ ID NO: 125645 - protein, 81 aa, Triticum aestivum
  Clone ID: PAT_TA_20063.pep
MGCDDKCGCAVPCPGGTGCRCTSARSGAAAGEHTTCGCGEHCGCNPCACGREGTPSGRANRRANCSCGAACNCASCGSATA

SEQ ID NO: 125646 - protein, 81 aa, Triticum aestivum
  Clone ID: PAT_TA_20064.pep
MGCDDKCGCAVPCPGGTGCRCTSARSDAAAGEHTTCGCGEHCGCNPCACGREGTPSGRANRRANCSCGAACNCASCGSTTA

SEQ ID NO: 125647 - protein, 121 aa, Triticum aestivum
  Clone ID: PAT_TA_20065.pep
MPLYQMMKKTDDFVWSDAANSTFEDLKKQLAEPPVLAAPIEKEPLLLYVAANSRAVSVAIVVERKEVGNEQPVQWPVYYVNEVLIESRHRYPHWQKLVYGVFMASRKLKHYFQGHPITVVS

SEQ ID NO: 125648 - protein, 102 aa, Triticum aestivum
  Clone ID: PAT_TA_20066.pep
QFGVCAKQVLQFHYTLPLVGACPASASSTWGCNSIAPKPSWRGACAPFGPRWRPLLRAPRRLSTLAAPRGARLVFPLVPVVGLGGGHPFRPPTGGPAGHLMM

SEQ ID NO: 125649 - protein, 284 aa, Triticum aestivum
  unsure (1)..(284): unsure at all Xaa locations
  Clone ID: PAT_TA_20067.pep
MARPSISLHLCLAVLAMAAAASEAGFYDQFDVVGSGNNVRVNDDGLAQQVALTLDQGNGGSGFSSKDKYLYGEFSVQMKLIVDGNSAGTVTSFYLTSGESATPHESDIEFMGNSSGDPYVMNTNVWASGDGKKEHQFYLWFDPSADFHTYKIVWNPKNIIFQVDDVPVRTFKKYDDLPYPSSRPMTVHATLWDGSYWATRHGDVKIDWTQAPFVVNYRGYSSNGCVSNGGSSACPAGSDAWMNTELDGKALGTVAWAESKYMSYDYCTDGWRFPXGFPAECNRN

SEQ ID NO: 125650 - protein, 283 aa, Triticum aestivum
  Clone ID: PAT_TA_20068.pep
MAMPRAVSLSVAVLLALLASAESWLYEEFTTDGNVRADYNAQGQQVASLVLTQQSGGGAFGSRQKYLYGQFSIQMKLVPGNSAGTVTSFYLSSGDGPGHDEIDMEFMGNATGQPVVLNTNVWANGDGKKEHQFDLWFDPAADFHTYTIIWNDKNVLFKVDDLFIRSFRRYADLPYPGAKPMSVHATLWDGSYWATQKGKVPVDWSGAPFVVSYRGYTADACVPNGGEGSPLSCPAGTDRWMNRQLDDAERGTVAWAKRDYMRYNYCDDGWRFPQGFPAECSRG

SEQ ID NO: 125651 - protein, 437 aa, Triticum aestivum
  unsure (1)..(437): unsure at all Xaa locations
  Clone ID: PAT_TA_20069.pep
MTMLRAVSVTVGVAVALLAAATAAESWLYEEFTTDGNVRADYNAQGQQVASLMLTQQSGGGAFGSRQKYLYGEFSIQMKLVPGNSAGTVTSFYLSSGDGPGHDEIDMEFMGDPPPPPPPPPAPXNQKATRSHPGAHAAGGAPAPPPRPPRPAXPPPPPPARPGXRDPASGARGARPHPGPRRGAGPQAGALARDGHGGSPLPPPTGPPPPRGSRAEPASRRRHPPAPGRPPHPAPPGGPRAARDGTTVDCEPQGPALGAARPRVGPRRRQEGAPAPPLVPPPPPSSPTTASPAPQTRHTPAGRPLAGHPRGRPPRPGTAAPGPTGAGNALGDAAHWATQPPRPPATXGPRRPSSRPLPRAPPPVAASRQRRLRRRPPRAAAAWMNRELGGQGPRPPPPAPRATYTSNDYCTDAGAPPQPAPPPRTPPTDLILFIDCS

SEQ ID NO: 125652 - protein, 142 aa, Triticum aestivum
  Clone ID: PAT_TA_20070.pep
DSLHHSQRSLVRPPPPLRHHRRRSLVRLPSPSSPALAALSHPVGQRLNFYLPLMVLLGEEALDAGSACAGAGSAPSGSGDLTLWLRDRKATPTTYNNWTLCTERRMKTPSHGIFSSTHSRENETSTRQWDAAKPPTHKQLHN

SEQ ID NO: 125653 - protein, 114 aa, Triticum aestivum
  Clone ID: PAT_TA_20071.pep
MVFSQTSSLAVKLAQGPKLFTTKTILPMDPPGVVSSENAEYDFSDVFGSSPVETATELCVVDPDSPAAPVESPEEVYNDPAVIFKRSHSLVGPSSLVSCSLGLGKLTLNIADGS

SEQ ID NO: 125654 - protein, 218 aa, Triticum aestivum
  Clone ID: PAT_TA_20072.pep
RLKQKHLLVPAKMNDGSSKKSKVTKAFGNRLKQKDLPVPAKLNNGSSKKSKATKTFSNHLKPKDCRFQQNLIMVPAKSLVAATKLMAAMENQGLARGELTREIDDSRGGEEIRWGADAWDPDATPPQLWSMLWLVAARPLEVQQLPMRFTADSTGGPARPAPPAAPWGPRRCGRGLQQSNALAMRRGDGRSWNGRWFASHDGGGGWLSAATKLISCRI

SEQ ID NO: 125655 - protein, 126 aa, Triticum aestivum
  unsure (1)..(126): unsure at all Xaa locations
  Clone ID: PAT_TA_20073.pep
MAAPPARVPLLRAPSRPFPASQINPRRHFRPSVSVAVGGVGGPVLRTCKNCKKQYDPAANHPSSCRYHTAHFGGETKRKFESVHXGGTMDTPGAGKVLHYWXHCCGSXEDPFDVGCTAAPHSSYDD

SEQ ID NO: 125656 - protein, 133 aa, Triticum aestivum
  unsure (1)..(133): unsure at all Xaa locations
  Clone ID: PAT_TA_20074.pep
MTLIFRAAPAARPAGGQAAGAGGMLHAPQRPPPPAHVRPRCTGTXPPSTPWPSMVXTVEGRAARGGPAPPPLPRAPPPGGPGSPPPRGVGASPPAPLGCPFYGSLSPSLCAILPPSCRPPPPRFNFSRKFFFF

SEQ ID NO: 125657 - protein, 205 aa, Triticum aestivum
  Clone ID: PAT_TA_20075.pep
ADHRLGALKAFDDTKAGVKGLVDAGATAVPAIFHHAPESLNDAPHHHDHQFAIPVIDLAGLATPSGRASAVGAVKAAAETVGFFQVVNHGVAGGRPCRRCSRRLRCFIEPAVGKGAVTTTVNTGGALGNKTTSYLFQSPGGQLAPHPPFLDTGPPPPGAPRGSPPPLHGKAPHAGARVARSGRAGRWSGCCRTRLGPPENKTPFK

SEQ ID NO: 125658 - protein, 391 aa, Triticum aestivum
  Clone ID: PAT_TA_20076.pep
MSKLDYCFSNDYMVLRPDRTSPFDLLHLLFSPKVGRNKAVDCFTSTEIRSFPRRLALFLNLLLQILLLSLAGPVAAIGAAVELALNLVDNVLHGKMEYPDRSSASYRSLTGLIDRRVDLDRSIAPADSRHHAALCVMASKVAYENEAFIRDVVTRRWQMEFVKFYNCWNEFESAYTAQAFVFCDKAGPDAELVVVAFRGTPAFDAARWRADLDPSWYKVPRLGRAHAAYTHALGAQRNMGWPKWVEHVKGKPQKVYAYYTIRDAVKGLLEASPKARLLVTGHGSGGALAVLFATVMAYHREKAVMDRLAGVYTFGQPQVGDAMLAMFAERNLDRPKKRHFRFTYAGDPLPRLPGVGSPAHFLHFGLCLHFDVSYHLKVIIELHFSKLTALT

SEQ ID NO: 125659 - protein, 290 aa, Triticum aestivum
  unsure (1)..(290): unsure at all Xaa locations
  Clone ID: PAT_TA_20077.pep
ENLNKIQNXKGSPYSFQALMQQEIIEFIGVEEEEDIQCAWGIRHLFQSSGEEVSGYTHCELDLSFLLGLSCGLIPFANHNFARRVLYQAEKHSQQAIGYSTTNPLTRVDTLSHQLYYPQRPLFKTVSADCIGRSDYTFGRKDDFWGPEYFNGQNAIVAVNIHQGFNQEDSLVMNRASLERGMFRTELMRSYKAEVETKGPSKRLKMKEKVNFGKMESKRGRVDNLDDDGLPFVGSSLQIGDIIIGKVSESGEDHSIKLKHTEKGMVQRVLLSANDEGKHFAVVFLRQVRS

SEQ ID NO: 125660 - protein, 229 aa, Triticum aestivum
  unsure (1)..(229): unsure at all Xaa locations
  Clone ID: PAT_TA_20078.pep
WAVYVGRSSRDWSPRAVFGGVLRGGASSWALCAACLPPLGRCRPVPRCPPLASPWLAFVALIFKFMVNGSLDRWLHSEQHNGIPGRVLNFGQRICIAADVASALDYVHNQLTPPLIHCDLKPANILLDDDMTARLSDFGSAKFLSLDMFIPESLDDVGGTVGYMAPEYGTGYEISVGADAYSFGVLLLELLTGKRPTDDMFVDGLTLPIFSESMFPERXAEILDPRMGH

SEQ ID NO: 125661 - protein, 224 aa, Triticum aestivum
  Clone ID: PAT_TA_20079.pep
MAAPSAALSISGGAHTSAFGCKPKKLISNRNYLQLAAPSNSQNANLYGKLTVCRAESEDSKGGGGFLTGFLIGGAVFGTLGYVFAPQISKTLDTLLNDDGQDGKPDEQGVQSVPRPRNAQYYDEGLEKTRQTLGDKISQLNLAIDKAAARLKRVTGSVEKEAVKDETEIEISTLDDNGVLEGNLSEQGFVQGESALYFLYSICIAVVLYALSSPSAPKTFMKIV

SEQ ID NO: 125662 - protein, 143 aa, Triticum aestivum
  unsure (1)..(143): unsure at all Xaa locations
  Clone ID: PAT_TA_20080.pep
GGSAYDLTRTETVKMVYSMNISALLDPPLPAGYWGNVCVPVYVALAAGDLVGRPLAETASLVRKSKRGVDEEYVRSYVDLQELRRGEGGVTAGRRGVSAFTDWRRLGHSEVDFGWGGPDAVLPFSWRLLGSTQPCFLLPYXAG

SEQ ID NO: 125663 - protein, 346 aa, Triticum aestivum
  unsure (1)..(346): unsure at all Xaa locations
  Clone ID: PAT_TA_20081.pep
MAREDRKRRQPDGDEAADEGERRGRRDKRPKEEKPAPPLPSEIRNKEKRSEVYAKLKREKKAQKRRLGRERGQAAQRAAELGEEVPEKQVPRTIENTREPDETVCRPDDQELFAGNDADEFNAVLKQVVTPKVLITTCRFNSXGRGPAFIKELMQVIPNAQYVNRGTYDLKKIVEYANNREFTSVMVVHTNRREPDALLIINLPEGPTAHFKLSKLVLRKDIKNHGNPTSHKPELVLNNFTTRLGHRVGRMIQSLFPQDPNFRGRRVVTFHNQRDYIFFRHHRYIFEEKEKKIVSKDKKSKGETKTEKQINCRLQECGPRFTLKLLTLQHGTFDTKSGEYLGRDHA

SEQ ID NO: 125664 - protein, 91 aa, Triticum aestivum
  Clone ID: PAT_TA_20082.pep
MAGGKKLQERVALGRSAWMLADFVILFLLLALVARRAASLGERGGTWLAALVCEAWFAFVWILNMNGKWSPVRFDTYPENLSHRYVRSCAH

SEQ ID NO: 125665 - protein, 213 aa, Triticum aestivum
  unsure (1)..(213): unsure at all Xaa locations
  Clone ID: PAT_TA_20083.pep
XFXPSACXNAVFXXVMSTVXCGPGAATLAGRXXPAPRLLQLSAXRXDGPWXFAPPFLDARVVEQVHHVEAPEGPPGGPAGRAAGAAGGGRWPPAGAGAGAGARSALTLVYPPGGGAAAGEGSCTGLDAGLLLRRRRSRRRGSLLHGLDDARLLRLYEWWPCRAATAVKTTPALSGCCEELRMTMMGKMIRWWWRWMERRECECXQPTKPNRPA

SEQ ID NO: 125666 - protein, 153 aa, Triticum aestivum
  unsure (1)..(153): unsure at all Xaa locations
  Clone ID: PAT_TA_20084.pep
MATLRVDEIHKILRERIEQYNRKVGIENIGRVVQVGDGIARIIGLGEIMSGELVEFAEGTRGIALNLESKNVGIVLMGDGLMIQEGSFVKATGRIAQIPVSEAYLGRVVNALXAKPIDGKGEIIASESRLIASPAPSIISGGSVPLLQRGLIG

SEQ ID NO: 125667 - protein, 76 aa, Triticum aestivum
  Clone ID: PAT_TA_20085.pep
FGILLEKPTRILSMGSRTHPPCAPSLDPAAVSSRHAPVISTWPFSSSLPRPLTDITLVFYVAWSSHPTEAKNWEAA

SEQ ID NO: 125668 - protein, 149 aa, Triticum aestivum
  Clone ID: PAT_TA_20086.pep
MQQPKPADPPGRPFPPPSPSMAAAATAMRGAHHRRARSEVAFRLPDDLDIGGGADGDGSAGFDEIGSEDDLFSTFMDIEKISSGPAAGSDRDRDRAAETSSPPRPKAPLQQLRRRLRPLLRCRQPCAEGRRCRPSAGRCPGMSPEQLAE

SEQ ID NO: 125669 - protein, 73 aa, Triticum aestivum
  Clone ID: PAT_TA_20087.pep
DISISITYNWLLVSHLVRDLAIFFSFFSLGMKTKTRKISKAGEKQKTCEPTRQTNSVPIYSTLYPGRGAAIIR

SEQ ID NO: 125670 - protein, 277 aa, Triticum aestivum
  unsure (1)..(277): unsure at all Xaa locations
  Clone ID: PAT_TA_20088.pep
LWSMRSSLNLVGSTLDVLAADWIEYSSGIGAGVDSFYEYLIKAYVLFGSDEYWDMFHSAYLAVQKYFRHGPWYHEADIRTGRXTHWQLTSLQAFWPGVQTLLGDVAAANLSHREFYNVWQRFGVLPERYLLDYGILHPTEKYYPLRPEFAESTFYLYQATKDPWYLEVGEAIIGSLNYYTKVGAGFASVRHVSTMNLEDHQHSFFLSETCKYLFLLYDDSFLRNKNYIFTTEGHPLPVMSTWHEKIPRLDVPTNWTVLKDDNQPIRVSALSSKVCPE

SEQ ID NO: 125671 - protein, 95 aa, Triticum aestivum
  Clone ID: PAT_TA_20089.pep
CSAVFSVLLGGCIRDLYYDAYDINEKRIIVKRKKFNQSIIGESTRGMIRHSAKLSNQIYFIIYRNPFISVGIAPATHKAAGTIISGHIHTSITAR

SEQ ID NO: 125672 - protein, 213 aa, Triticum aestivum
  unsure (1)..(213): unsure at all Xaa locations
  Clone ID: PAT_TA_20090.pep
MVSEAANAGIDRVLWTEAEIATPRARVASELAADIRRLAEPAVVVGVATGAFLFLADLVRRVDVPLAVDLVRVESYGDGTESSGRPRVTADLKVDVAGKHVVVVEDIVDTGNTVSCLIAHLQKKGALSISVCTFLDKPARRTAVFQRVGXXKFYRGFECPDSFVVGYGMDYAELYRNLPYVGVLKPEMYSKKTDNGSRDLQPLLQEHINFEET

SEQ ID NO: 125673 - protein, 249 aa, Triticum aestivum
  Clone ID: PAT_TA_20091.pep
SKLCFGRSSCFFAKSPRGLPKSTRMFYRNHLKKSPAGTIPRSNPRLHLSPCQLLHEPINDLPLLSRRRDGLPRGRGPTPPLHRQRSRPRPPPPPRPVSPDAELSEDDRPSACSLGVRRRGTSVTREGCATEETKRGTIESIEGSWNLASPRLSQRPGEPPLEHDKEMAGEGIPAVLGRGSCVTQAMDEPALRSVQRLPAAGKAGTRRIRISSRNRRTTPARAWPCASRPEMETRLLSGREGTTVGEPGR

SEQ ID NO: 125674 - protein, 130 aa, Triticum aestivum
  Clone ID: PAT_TA_20092.pep
HASEESTEFWKTGLASDFIWSEAQTPLEFLGSFLTISCDDPASLPIKNHELTTDEIKQLCEYLFVLRENGYNHLLEWRMRVRKALSSCSQVTPRTDGTATDNKGREGDQVLHEVEDLKNVFDRKRMRVKC

SEQ ID NO: 125675 - protein, 274 aa, Triticum aestivum
  unsure (1)..(274): unsure at all Xaa locations
  Clone ID: PAT_TA_20093.pep
PRVRSDMEQILKEAQTRWLRPTEICEILKNYRNFHIAPEPPNMPASGSLFLFDRKVLRLFXXDGHNWRKKKNGTTVKEAHERLTSGSIDVLHCYYAHGEDNINFQRRSYWMLEEDYMHIVLVHYLEVKLPSGNDGTSTECLQLPSAIDGTTTEFQLPSATDSTFATVDSFEQNNKLLGEAINFPVLKTQSSNLSDMLKDSFKRSDSFARWMSKELAEVDDSQVKSSSGLYRNSEDADNIIGASRHDQLDWFTLDPMVAQDQLFSITEFFPSWTY

SEQ ID NO: 125676 - protein, 322 aa, Triticum aestivum
  unsure (1)..(322): unsure at all Xaa locations
  Clone ID: PAT_TA_20094.pep
MEPEGVRHRMVEVAKGVGLHVAEGGPEDGPVVLLVHGFADLWYGWRHQMVALAGRGFRAVAPDMRGXSTSDGPPSAGSYSICRLVGDLVALVAYLAQPQVFVVGHDWGALVAWQLCLLRPDLVRALVSISVAYHPRSSEGSPLQVIRALCGEDHYMCRFQEPGVAEAEFALYDNSHKFKTVFGMRKPAPPILPKDKTFFDSLDSDGTCPPWLSEEDISYYADKFEKTGFTGGLNYYRCMDLNWELSAPWTGAPIKIATKFIVGDLDVTYSVPGVKDYIHKGGLKASVPNLEDVVVMEGVSHFCNQEKPNEVSDYICEFFSKF

SEQ ID NO: 125677 - protein, 334 aa, Triticum aestivum
  unsure (1)..(334): unsure at all Xaa locations
  Clone ID: PAT_TA_20095.pep
YRHITLTLMCKMEDHPGHPISNYDFLSGNGCSYXMKLVHKNYDRDSSSAKSGRXHNKKSSATSDSHLNEQDTSRPSSQSDNDNDHGKPDQHMVKPLLSLGNPETVAPPPMLDCSQSFAYIPYTADAYAGIFPGYASHAIVHPQLNAATNSRVPLPVEPAAEEPMFVNAXQYYAILRRRQIRAKLEAQNKLVKARKPYLHESRHRHAMKRARGTGGRFLNTKQLEEQKQKQASGGASCTKVLGKNTLLQDSPAFAPSASAPANVSSFSTISMLANQERTCFPSAGFRPSGGARPSHLRHQLPPTCQAFQQPAWWLIRSAPASPRLASVPRLASVH

SEQ ID NO: 125678 - protein, 61 aa, Triticum aestivum
  Clone ID: PAT_TA_20096.pep
MSYWGTSPSWGAARHGPSPMVPLMVVLALGWVIYNETLLECYERVTEVRDTVADNAMVFIL

SEQ ID NO: 125679 - protein, 341 aa, Triticum aestivum
  Clone ID: PAT_TA_20097.pep
MVLDKEEERSRVLVIGGTGHIGKHIVAASVRRSHPTSVLIRDAAPADLAKAQLLKSFIDSGVALIKGDLFDHDSLVNAIKGADVVISAVGTCQLDEQTRIVMAIKEAGNVIKRFLPSEFGSDPERVHTVDPAATLYAGKISLRRLIEAEGIPHTYVCCNGFAETYLRSIGDVTALGAGPPSDKITVLGDGVAKGKHASYPFSCHWVFVVEEDIAAYTVRAIDDTRTLNKILYMRPPANIVSHTELIALWEKKAGRTFQIARIPEPDLLMLIKEAAYPLNMMLSHSLSVFVRGDQPNFDIEPSFGVEATELYPDVKYTTVDEYLHPSSDSSWLDGAIKMMEQ

SEQ ID NO: 125680 - protein, 218 aa, Triticum aestivum
  unsure (1)..(218): unsure at all Xaa locations
  Clone ID: PAT_TA_20098.pep
HASAIAFMSKSLSPRYQGLSTYEKEYLAIMVAVNQWRPYLQHNEFIIYTDQKSLIHLEEQRLTTPWQQRAFTKLLGLRYVIRYKKGSENTAADALSRAHTPDLLFDITTCRPSWLEDVAASYHSNPQAQKLMKQLAIQEDPKQRFTLEQGILRFRGRIWLGGTTAMQQKIISAFHDSPMGRHXGFPATFQRIRRLFAWXXXXXHILQYVRCCSICQQL

SEQ ID NO: 125681 - protein, 202 aa, Triticum aestivum
  Clone ID: PAT_TA_20099.pep
MQRGVAASACSTTECTTTPLPPQAQPMAAEAAMDGKKGKKKGGLRTMPFIFANEVAEKLAVVGFSTNMLTYLTQQMHMPLAKAATTLTNFGGTSAMTPLIGAYLADACIGRFWTIAGASVVYQFGMALLTVSAALPQFRPAPCKGAGGGGRQRRVPSRRCRGSSPLLQSLFLNLWARVTGVHPFADSTIAAPWALNWDTEAG

SEQ ID NO: 125682 - protein, 97 aa, Triticum aestivum
  Clone ID: PAT_TA_20100.pep
YAPKTTFPMSLTNTLSSEDHCLCNLTRRAKEHRVVVVVVAPHVPLQRQRVGAAHLSPAPRGAAQRRRPVGRRSAGDCVAVAAAGGGGECCEGGKKGE

SEQ ID NO: 125683 - protein, 195 aa, Triticum aestivum
  unsure (1)..(195): unsure at all Xaa locations
  Clone ID: PAT_TA_20101.pep
VSLFLRWCVLVDTXRLILSSPPVQHRDHHHRCIRAGVLHQLPGAASCACLAFIGGLRRHRDVEDADAAHRGASAGSAVSRGREGVACLVVEAGPHLVRAPSLRGRTSVPGRPLQVAGLLTASLGTASAPGGSRCCRAPPWEAGEGCAMARAASRAPXXGHDQGCFRHGRTRGAAPRTSRRGSGNTPRXGXXXXXX

SEQ ID NO: 125684 - protein, 207 aa, Triticum aestivum
  unsure (1)..(207): unsure at all Xaa locations
  Clone ID: PAT_TA_20102.pep
MKGSEYSVDLSFTATGTIASLPSFDAKPPNNTDPASAASTELSLSLPLPLPLPSSSDGSAPSLNHDSSAEAVDPSSKINFAYDEDQKVWIPQDKKDEMVLILVQRQKELQAHMRDWTDWAMEKVMQVTRRLAKEKEELQSLRKEKEEASRLHDERHCLEESTRKKLLEMESAISRANNQLDKADASARXREAENAQLGCDGSRKRGA

SEQ ID NO: 125685 - protein, 154 aa, Triticum aestivum
  unsure (1)..(154): unsure at all Xaa locations
  Clone ID: PAT_TA_20103.pep
RFPSCEAPLPVTCLSPLALLVHHFTLPPLALALPRLPASPHSTHTRHHSLAQLSPQVQVQVRGRESKAMSMAEEQYYGGPRGAPHGLLLAVVVGLVGGGPALPRRRRARRSPNAIXRAAQPPLGXAPPPRGPLPLLNPAPLSPRNGGXPGXXAE

SEQ ID NO: 125686 - protein, 170 aa, Triticum aestivum
  unsure (1)..(170): unsure at all Xaa locations
  Clone ID: PAT_TA_20104.pep
RPPXPLTLPILHTARRRRRLPSPGAATMPTHHRAVAPSPPPRPLAAQQEEHGSPPALTRRLSPPPRRGRSIEGTLMASTGEAAGQPPAAGTTGWRRRPPPPGQPHRAMPIFAPSCHSLLCARPSSLMAGEEEGEALQPPFLFISLCASVGWLCTPNLSTSTPTCFCIPFL

SEQ ID NO: 125687 - protein, 64 aa, Triticum aestivum
  Clone ID: PAT_TA_20105.pep
GHPTFNWCRETPLALNKDRARNSLEACLLFHLSDGSKGRGERTLGTHPCLLFSHLPGRVGGRVG

SEQ ID NO: 125688 - protein, 147 aa, Triticum aestivum
  Clone ID: PAT_TA_20106.pep
RVLLVSSGNVGSSPASGTESFSHPVVARSTGRKNEYEIIPRFRDIWAVYKNWRAGWTAEDFKNCEYEFVEIVGQTDSSIQVQPLGKVDGYRAVFRRGADVKTISKDEYPKFAHHVPCSRLTNEKAGKLRGCFELDPYSVPEVFLYTS

SEQ ID NO: 125689 - protein, 532 aa, Triticum aestivum
  Clone ID: PAT_TA_20107.pep
MERRHRTFWRTDLLETLTPRTSRTSMDGLAAPSPSHSGATSGGGASHRKRKLPPPSLSDATADEDDDTTAPSSPATSLSSPSRPSSPSSSHSDEDDDDSLTTFTAARLDAAPASSSGRPPKPDSSSASAVTAAAPKPDAASAAAGDGKEDSKGLFTDNIQTSGAYSAREEGLKREEDTGKLKFLCYSNDGVDEHMIWLVGLKNIFARQLPNMPKEYVRRLVRDRTHKSMMVIRNNNVVGGITYRPYASQRFGEIAFCAITADEQVKGYGTRLMNHLKQHARDADGLTHFLTYADNNAVGYFVKQGFTKEITFDKERWQGYIKDYDGGILMECKIDQKLPYVDLATMIRHQRQAIDEKIRELSNCHIVYSGIDFQKKEAGIPRRLMKPEDIPGLREAGWTPDQWGHSKSRSTFSSDYNTYRQQLTSLMRMLLKSLVDHADAWPFKEPVDSRDVPDYYDIIKDPIDLKTMSRRVESEQYYVTLEMFVADLKRMFINARTYNSPDTIYFKCSTRLEAYFTNRIQSHLAQAASTKN

SEQ ID NO: 125690 - protein, 188 aa, Triticum aestivum
  Clone ID: PAT_TA_20108.pep
ARGSSDRASRSGSSASPPSVRILRHAIPARRPTSSPPRPPPHTTACLLFAARGSPTPRPRPQRSRPASAGWSARRRPRSGCSTRSSPPWATAGRRRTRGRRGSGIISACWIQPRLRSPRDPVTGGLLVVLLRETTEGRGGAGLTPENGDNPAATGRIQMEEGQGGARGRPSRFGGAGSRVRGGAMVAR

SEQ ID NO: 125691 - protein, 205 aa, Triticum aestivum
  Clone ID: PAT_TA_20109.pep
MAPTAPQPPRPSAAAPSAAPVDALFLQNLMSRVQLRPPFLDTNSFLTQDLDDFLLNEFAALSAAAGESDDDEDDEEGEDGGLSDGEASGEARRRRMLSREEAKLEKEIVRMVLAGDGDALKPNSGQSVAVGDHHVCVGFHDEAGGEYRVWEWHGHVMLFDDEDGYSAEYIYGNHFEPLAAAAARAKQKEKEKREKDLTSGLRDLI

SEQ ID NO: 125692 - protein, 353 aa, Triticum aestivum
  unsure (1)..(353): unsure at all Xaa locations
  Clone ID: PAT_TA_20110.pep
AWVAIGDVMPRTAHRWCKWHVLKKAKEXLGHCFAKGSEFKPEFNKLVHHIVSIDEFEKGWACMIEKYGLQTNXTQRSESANHLLKGYVPPGCPMHLFIRQYEKMQFDGNSEESYQEKRTKLGGIVLKQKIPVEVHASQVYTRTMFEKFGEALHVCGSYDLVEVKPQLEYIARHIKFQSXEKWCKNEFVISLSETANEFRCECGTFENYGMVCSHALKGMSYLLFGILQTIFCVSSPPKTCAVGXGHETDIFWLLVRQVMIHLKLHELPPKHVLKRWTRDARDILLPEYLRYQKDHGPLKYSSRRHNTLYLLAVDVVKLGDNNVEAYALAMEKMRDVKVLPEPVAAVREGLVCL

SEQ ID NO: 125693 - protein, 356 aa, Triticum aestivum
  unsure (1)..(356): unsure at all Xaa locations
  Clone ID: PAT_TA_20111.pep
MGVSRANQSSWIRRAEYGAYQPDSRSQARAMEIAIGDVMPRTAHRWCKWHVLKKAKESLGXCFAKGSEFKPEFNKLVHHIVSIDEFEKGWACMIEKYGLQTNAFLTQLYEVRGKWAKPYFMGVFCAKMTSTQRSESANHLLKGYVPPGCPMHLFIRQYEKMQFDGNSEESYQEKRTXTRGIVLRQNIPVEVHASQVYTRTMFEKFGEALYVCGSYDLVEVKPQLDYIARHIKFQSREKWCKNEFVISVSETADEFRCECGTFEHYGMVCSHALKVMMHLKLHELPSKHVLKRWTRDARDILLPEYLRYQKDHGPLKYSSHRHNTLHLLAVDVVKLGDSNVEAYALALEKMRDVKVM

SEQ ID NO: 125694 - protein, 123 aa, Triticum aestivum
  unsure (1)..(123): unsure at all Xaa locations
  Clone ID: PAT_TA_20112.pep
AVGGXXXXAXXRRARARCIAQGAATRTKSGGSGGWRSGRAPGTAGGTISEYASSEMSAPTSEYGLNPSSEYTASSAADTEDMTDFPHRAGAGRGSAEGGSGEAGRGTTEGFSRRTTVRRTGRG

SEQ ID NO: 125695 - protein, 223 aa, Triticum aestivum
  Clone ID: PAT_TA_20113.pep
NSAREEDTYVDLLQFLEPLELCYRSLCDCGDKLIADGSLLDFMRQVSTFGLCLLKLDIRQESDRHIDAVDAITTHLGIGSYRDWPEEQRQEWLVNELRGNRPLFGPDLPQSDEVADVLGTFRVISELPADSFGAYVISMATAPSDVLAVELLQRECGVKKPMRVVPLFEKLADLQQARATMELLFSIDWYKERINGKQEIMIGYSDSGKDAGRLSAAWYLYKA

SEQ ID NO: 125696 - protein, 147 aa, Triticum aestivum
  Clone ID: PAT_TA_20114.pep
PRVRRRNDVRKVPGFSYTEISGVMHKFINGDKEHPRLQEIYRALEEIVSRIGELGYEPETSNVLHDIGEEEKQYALSYHSEKLAIAFGLIATPPGETLRVIKNLRICGDCHVVAKLISKAYGRVIIIRDRARFHRFEDGQCSCGDYW

SEQ ID NO: 125697 - protein, 77 aa, Triticum aestivum
  unsure (1)..(77): unsure at all Xaa locations
  Clone ID: PAT_TA_20115.pep
TSXXXXQKGEFTILNTITGPRNICLINWNHITKFHKSALSAKERSDPLLHLKSKFQGTERGSVYSECSCNTELFVLT

SEQ ID NO: 125698 - protein, 70 aa, Triticum aestivum
  unsure (1)..(70): unsure at all Xaa locations
  Clone ID: PAT_TA_20116.pep
XCCSLAQCWRRQXXGGSNGRPDRPLRASAAMTGHHLLPDQXTDAGRCPLASLTQRISSLAAFSLCVSSAD

SEQ ID NO: 125699 - protein, 243 aa, Triticum aestivum
  Clone ID: PAT_TA_20117.pep
MLNLYHTVAHKCVGFPARKEGHAHSRSAAALPLRKRRLASDASAWCMNKHLSSYGGSLPSYAVTMDCKNIIAGSAPSDEADGIGITEFFVGKNFFITGGTGFLAKAFELEFYFSIAPLIIEKILRTTPDVGKIYVLIKAKDSEAALERLQNEIVGTELFKCLEQLHGKDYRHFLARKLVAVVGNVREANMGIAPELADEIAKKVDVIINSAANTTFDERYDIAMDVNTMGPFRFMSFSRRFSN

SEQ ID NO: 125700 - protein, 243 aa, Triticum aestivum
  Clone ID: PAT_TA_20118.pep
KNLTLFNLFRNRLRGDIPEFVGDLPGLPRVRLWENNFTGGIPRRLGRNGRFQLLDLSSNRLTGTLPPELCAGGKLETLIALGNSLFGPIPDSLGKCKALTRVRLGENFLNGSIPEGLSELPNLTQVGLQDNLLSGSFPAVVSAGGPNLGGISLSNTLPAGPVPAASRGASGPRKLLPEQTPCSRAIPPATARLQQLSKADLSGNSFDGGVPPEIGKCRLLTYLDLSQNKLSGDIPPAISGMRI

SEQ ID NO: 125701 - protein, 94 aa, Triticum aestivum
  Clone ID: PAT_TA_20119.pep
MGNSLGCSASGERLVSAARDGDAVEARMLLELSPALARYSTFGGLNSPLHFAAAKGHLDIVTLLLEKGADVNARNYCGQTALMHACRHGHWEVV

SEQ ID NO: 125702 - protein, 167 aa, Triticum aestivum
  Clone ID: PAT_TA_20120.pep
MAANVVQALAAVLTLLVITRALWYLLWRPYAVARWFEQQGIRGPPYKFLVGSLPDCQRMLVAGRVKDLDTSSHDCITTVQPFFRKWASLYGKTFLYWLGPTPALCTTDIEIVKKVLSDRTDMFQKDYLNPSLEAILGNGVIFANGDDWKRRRKFIHPAFSQEKIKVT

SEQ ID NO: 125703 - protein, 185 aa, Triticum aestivum
  Clone ID: PAT_TA_20121.pep
MGSRAGGTETAEERTRVCDLPEACVAHVIALTSPRDACRCAAVSPCFRDAAGSDVVWARFLPPDYLQLHQAPARRFPLSRSASTASAGASASSTKKEAYLGLTDAALLVDGGGMAVWLAKESGAKCVAISARRLSLPWDDGEFSWRWTPHPLSRFADVAQLVDCTCLDIYGRLPTAALTPATGYT

SEQ ID NO: 125704 - protein, 150 aa, Triticum aestivum
  Clone ID: PAT_TA_20122.pep
MMIWHLWLLLCCLGHPLEEFLLHHRRLGHMSFNTLGQLYPNLYNNICKESLVCDACQYGKLTRSIYASSDHRSTVPFQTIHSDVWGPSGVWSLYGYKSFVTFIDCCTRTTWVYVLRNKSDVFECFKDFHNLIKNQYDARVKIFRTDNGTE

SEQ ID NO: 125705 - protein, 260 aa, Triticum aestivum
  unsure (1)..(260): unsure at all Xaa locations
  Clone ID: PAT_TA_20123.pep
MDKFRHLRFLDFEDCKQLENHHLENIERLFQLRYLSLRRAEKVTKLVXQIGHLRASEILNLXGTHVCGLPTSILNLKRLVHLLVDSGVTLSCGISKMQSLXENLKLVSVYNHSFNFLQELEQLQSLKKLALDFEDYSSADRVNAENESKRAIIVTSLKNLGNLLPLAIGDGPEFVGESLCPMPLNLQKLKVRGSIIPHVPNWVGSLVNLQELRLELFRAEQKDFYILGGLPVLRCLILRIFDREIRNTSLTEPEVTHSLW

SEQ ID NO: 125706 - protein, 326 aa, Triticum aestivum
  unsure (1)..(326): unsure at all Xaa locations
  Clone ID: PAT_TA_20124.pep
MPAPPPPAGGRRRWRHRLSPTLARDRCYARAFRSAGLRQAAVPLPDGAVVHFWLPRPDPALHPVLLLHGFGANATWQWAPFLRPLLAAGLAPFVPDLVFFGNSASPAADRSPAYQAASVAAAMAALPGVPQRYSVVGVSYGGFVAYHLAHAFPAVVERLVLVAAGVCLEEADLASGLLAVDDISEAASLLLPQRPEDLRRLVELTFCKPPKFMPSCFIRDYIRVMCTENVKEKTELLYALISGRKLSDLPKINQQTLIIWGEQDRVFPLELGLRLKRHLGDTSELTIVKDAGHAINREKPAELCRLIKNYIIDSSVXXXMIMLEVC

SEQ ID NO: 125707 - protein, 79 aa, Triticum aestivum
  Clone ID: PAT_TA_20125.pep
RAPLARWRPRSPRAPPPRRSACRGARPWRPGRSGTLRRARGARARSGRGRPSARRRPTRGRPQTRRRAASRRPRARSRR

SEQ ID NO: 125708 - protein, 104 aa, Triticum aestivum
  Clone ID: PAT_TA_20126.pep
VFNQGLPFDDAQSCGWDRTAAARPEGLSPLAAGSMRTGLETRRVRLGFRPARSSQPASQERERLDQPNGERERLPSRSAGELPAGYLRRPAARGSAHRSRGLVP

SEQ ID NO: 125709 - protein, 150 aa, Triticum aestivum
  Clone ID: PAT_TA_20127.pep
MRSAAWHALLPSLVPAKPGIFFLRSRPGRFLSHAHGLRPCGAASSLPPGEYLPPLFSVAPMMDWTDNHYRTLARLISRHAWLYTEMLVAETIVHQKDKLDRFLAFPAEQHPIVLQIGGSNLDNLAKATELASGYAYDEINLNCGCPSGKV

SEQ ID NO: 125710 - protein, 202 aa, Triticum aestivum
  Clone ID: PAT_TA_20128.pep
KHEKMGMNMVLLKELPPEETKVLTLNLLKTMDPNDIQNEKSRGQIILEATYKPFKEEDMEKENVDGADEVQKAPDNTPAGGGLLFVVVHEAQDLEGKHHTNPYAKIIFKGEEKKTKVIKKNRDPRWEDEFEFVCEEPPTNDKLHVEVLSKAGKKGILHGKEALGYIDISLADVISNKRINEKFHLIDSKNGQIQIELQWRTS

SEQ ID NO: 125711 - protein, 539 aa, Triticum aestivum
  unsure (1)..(539): unsure at all Xaa locations
  Clone ID: PAT_TA_20129.pep
MGVISTVLGLFGFGFGFSSGIVIGYYFFIYFQPTNVKDVEVRPLVEYDSNSLDGILPEIPMWVKNPDYDRVDWLNRFLELMWPNLNKAICRMAQDIAKPIIAENCEKYKIDSVEFETLTLGSLPPTFQGMKVYITDEKELIMEPSLKWAANPKITGGRVGYGLKATVQIVDLQVFASPRITLKPLVPTFPCFANISVSLMEKPHVDFGLNLFGADLTAILVLYKFIQDTINKQVGNMYLWPKTXEVPIMDPSKASKRPVGILLLNGVRAQNLKKKDLLGESDPYAKLKMTEDKLPSKKTSVKRSNLNPQWNEDFKFVVTDPENQSLGVDVVARDHSSSVDMLKLNNVPSDDFFCLCSTARRTTTPXDHGNKGFSQXKAMEPTNKAVTYEPFKEENVEEDDEVQNATEKNAPGGGLRFDVVHAAXSSWRWGHHTDPYPKTTFKGEQKKTKEDKKDGDXNGDPRWGDEFGFVCEEPHCMLKSYSEARKKTNXHGKEALGYIGISLVDVMNNKRINXKFRLIDSXKNGEIQIESQWGTSEKL

SEQ ID NO: 125712 - protein, 257 aa, Triticum aestivum
  Clone ID: PAT_TA_20130.pep
MNLEKSEKELHISKLERQITVSELKYMEEIQTMQVETTEKNEALTSKMQEHANLVHEKDQLEQQLLEVRKELEAAYRTIANQEEQASVREIKWDAFKTYSADQLEAAQKHAAELEVQVSALNQQLQEAEIHYKKKVAKESEKLALVNTQLNKLTQNVSKSAEMEKKVQDLEQKLQLAHSKSEEQAKDAVVSTRSREFSLDSLAPQNKQRDISQAPSTASPNPAQQQLREPSGIMAFKFILGVALLSVVIGVFLGRRY

SEQ ID NO: 125713 - protein, 236 aa, Triticum aestivum
  Clone ID: PAT_TA_20131.pep
MQVLTRVQMVCTKTSGRNWRPIVLTGITLSADDMDPDDGDPEPRNGDALDRISYFDKRKSLSSVDMEPDDGSELHRGSLVGKDPVTFSSSVYNATDAEKEATESAKEKTEESPTRQNIDPVTDSSTIVASGDESKPDGSGAPRNAWWQKQLISLYRSAKESNKLWPIVVAAAALMGMAYFRRRWQKGKLQLQQVKLQPASSKERINQATVPLNRIKDILVAGNHPSPATHGNARLG

SEQ ID NO: 125714 - protein, 238 aa, Triticum aestivum
  Clone ID: PAT_TA_20132.pep
PTRPEKVPVDGVVIKGQSHVNESMITGEARPIAKKPGDKVIGGTVNDNGFIIVKATHVGSETALSQIVQLVEAAQLARAPVQRLADKISRFFVPTVVVAAFLTWLGWFIPGQLHLYPQQWIPKAMDSFELALQFGISVLVVACPCALGLATPTAVMVATGKGASLGVLIKGGNALEKAHKIKTIIFDKTGTLTKGKPSVVQTKTFSKIPLLELCDLTASAEANSEHPLSKAIVEYTKK

SEQ ID NO: 125715 - protein, 412 aa, Triticum aestivum
  Clone ID: PAT_TA_20133.pep
EFAAASTEKLAVAVSKAMRSHSLHETKSDAHASAHASAHASGAILKEEMERSADVLSAGLLEVSDPSLSSRFFLKQHWMDEQDNVQDSIKHKPIWESYMPRNKKEKRGAGKKKHGAMYRTYGTRVIPVFVLSLADFDAELMMEEESLVWTSKDVVIVLEHNNKMIPLSYVSETTRQFAYPSLAQRHILAGLASAVGGLSAPYERASRIHERPIVNWLWSAGCHPFGPFSNSSQISQILQDVALRTTIYARVDAALRKIRDTSESVQSFASDHLKTPLGEPVKGNKNKSSTELWVEKFYKKVTTMPEPFPHGLVERLEEYLDRLEEQLVDLSSLLYDHRLVDASQNSTDILQSTIFTEQYVERVLSAERDKMECCSIEYSHPKQSSQAFVYGGILLAGFLVYSLVIFFSSPVR

SEQ ID NO: 125716 - protein, 273 aa, Triticum aestivum
  Clone ID: PAT_TA_20134.pep
MGGQTGASEPLQFTNDAAFWNQSAGFGMGMAAPPATDNTSVRLAKQPAPAPRGANLALKTVLESVGDSSSIVTKKASGEPAFKKPRMETPSPLPTFKVRKEKLGDRITALQQLVSPFGKTDTASVLHETIEYIKFLHDQVGVLSAPYLKSGHHQHQVPQYLKSSSNGSPDKSCKDGGEVPLKGRGLCLVPISSTFPVANDLPVDFRHPLPPAASSAARPHPPGLLPLTMAAAPPRCRRPASCPPLLPWSACFSKCMSNATLMCRPSALTMPTI

SEQ ID NO: 125717 - protein, 99 aa, Triticum aestivum
  unsure (1)..(99): unsure at all Xaa locations
  Clone ID: PAT_TA_20135.pep
NFYEDHTVADHSSAASXSLVCPYLSLRGFLHPVHVPLGSNSGAEGASFHRHPTSLVRLAPPVLGVSPASCLILLCRASRGLRCPHLVDYSPGIGPPPIN

SEQ ID NO: 125718 - protein, 198 aa, Triticum aestivum
  unsure (1)..(198): unsure at all Xaa locations
  Clone ID: PAT_TA_20136.pep
MAASIAAAAAAASVSHVLPAPKPKPRTPPRLSLLPRRRSRAAGAISASASAASDFLAPVPSLKSRLAAGDTLYGLFLLSFSPTLAEIAALAGYDYVVVDMEHGPGGITEALTCLRALDAARTPAVLRLPEACPVWAKKALDLGPAGLMLPAVESPAAAAEAVSHCRYPPRGVRGAAYPIVRASAYGLDDSYLSRCXXD

SEQ ID NO: 125719 - protein, 270 aa, Triticum aestivum
  unsure (1)..(270): unsure at all Xaa locations
  Clone ID: PAT_TA_20137.pep
XHIQHMSDDKAESKVTSSVSAVNLEETNVSINIQNDLEKEEISEPMEEDVQVIEKTTISGFRAGGEDVQVINKVVQDEACDAVFVNKALKDENLDSSREGTCHXVIFSQDLIVKRVLSAQVLAASXKTGGVNFKRXFKKRQTVSGNSFKALIPCAQEPYRESDYEKGTLNDFMREEKRRKQMESIAEDLFNNQKPQKKKAAAGSSIQTLLTGCRCGRAEKRLFVGSNRMVALFLGTFVSQAVPKGSCHHERSQWWKLLLLLLHRRGACRR

SEQ ID NO: 125720 - protein, 214 aa, Triticum aestivum
  unsure (1)..(214): unsure at all Xaa locations
  Clone ID: PAT_TA_20138.pep
PRVRVLILPRSADEREEVWLEIQRESNHTITILFSIDGSGPNNAISXDEDEAISDVGCEDDQLCKQASEHSLRGCDGERQTDESRLTLECDKRRAIVQXEVPEASGQSQSIGLRSEGRRSRSGKKGKKRPARRRSQQKMDELSTVESGSNYSSRRDDDTVMSGRDQVLSSSSRFASPXXSKNKLXSSAESPMEIISEHKLPXXLGRKPPXXLKX

SEQ ID NO: 125721 - protein, 261 aa, Triticum aestivum
  unsure (1)..(261): unsure at all Xaa locations
  Clone ID: PAT_TA_20139.pep
FNVGSAIGLTIKNIPGSSRAIISRNKLATFGERNQDKDTENGMPKSPPPAAPPPVRPGWLLLPVAPRPFSSRVVFDVADSPAEMREHGYMERKLQLLHNITGAFQPGVLSALMGVTGAGKTTLLDVLAGRKTGGVIEGDIRIGGYPKIQQTFATISCYCEQTDVHSPQITVGESVAYSAWLRLPPEIDSKARNEFVNEVLETIELDEIRDSLVGIPGVNGLSTEQRKRLTIAVELVSNPSIIFMDEPTXXLDAXAAAIVMX

SEQ ID NO: 125722 - protein, 105 aa, Triticum aestivum
  Clone ID: PAT_TA_20140.pep
SRSLMDSYNEVLLYPQKKCTFTMLGTNLFNHRGACGLAFPWRPARAATSSSFCQPHHARADLCVCTRGRPRHLIHTNNRQGSHSPQRISHAFSVVHRFNQWESAD

SEQ ID NO: 125723 - protein, 284 aa, Triticum aestivum
  Clone ID: PAT_TA_20141.pep
AKKVNCIIHLGPSSVTNTVDYQNWMKSFGTTQHIMAGHENKNMEVPILKGSARISSRLNFVCPQLFPSSGFWPVEPANGIDLEKNKSTSFQACESVTAANVLQFRLRPYAQLGLDRASIPSLFSYEEIVDELISEIPEIKEVPEQISKFWQSSVDQKNALAPAGKHMLMVEEPWISKDSCLPDILDEQGNSEKVSGESAQRAIQRPPAAWRMLREKIWKLRFWVRVLPSLQNIEMFGVSGADEAVKNLRCIWISHIHADHHTGLARVLALRSKLLNGVPHKPLL

SEQ ID NO: 125724 - protein, 143 aa, Triticum aestivum
  Clone ID: PAT_TA_20142.pep
RGRGAAAPPASAPSPSPPSSAPPAAAASRASARGRCDRGSELRDLHSPISKSRGRVDYLVRYNTCFDSEQEADHPLTEAEEVFLDRLESQLEDDRPEGSTSKQHEVSSEIVEMEDDQPELKSETKALEDIEEEEEEECAELLK

SEQ ID NO: 125725 - protein, 174 aa, Triticum aestivum
  unsure (1)..(174): unsure at all Xaa locations
  Clone ID: PAT_TA_20143.pep
MAHIILLYGIYASSRCSPVQQTGAVKQKSNDVSGREALDKARSLVLLLATLAATITYTAGLDPPGGVWQDNGDGHMAGDPILLATNARRYKAFYYCNSVAFVASLVVIILVQMEKLVKHHXWEAGMILDLFGLXGAYAARNCRGVNTPIYVMAFGKRLPYLMLIQKWSFLTAWV

SEQ ID NO: 125726 - protein, 121 aa, Triticum aestivum
  Clone ID: PAT_TA_20144.pep
VQTELKVEYLHQLIGIGVCACSTVSSDPISPPPSSLTLVVSPAPATNTGRCPFCHNGSSTNISVVVLNQSLTRPPRKPCSCMLTPKQFNRGVGFSSTVTTQAAGLRITKWCSLILCELEIP

SEQ ID NO: 125727 - protein, 176 aa, Triticum aestivum
  Clone ID: PAT_TA_20145.pep
RVGGENPVRFASRLVFPPSRRQPNDPPARRRSPGERDRLRRRRRERMSYQQVPPQESYPPPGYSPVYPPPAGGQQGPYYPPQQQQPPPPPGYQGYFSQGQPQQPPPYYYPPPPPHSGHHHHGHHHHDHHAEDHHHHHGHHHHHHHNDDDCCLGFLKGWLAALCCCCCLEECCCCFW

SEQ ID NO: 125728 - protein, 573 aa, Triticum aestivum
  unsure (1)..(573): unsure at all Xaa locations
  Clone ID: PAT_TA_20146.pep
FGQENDRDEKDVRKNEKVQAYLYTIIKVRREDELTAPIGKDIGFYLVDHDKGPILRIQXXMPFTQFNEEVANELGIPSQILRFWSXAKRQNHTYRPNRPLTPQEEALTVGQLKEAANKAHNAELKLFLEVELGLDLKPLALPDKTREDILLFFKLYDPEKEQLRYVGRLFVKASGRPQDILPKLRKMAGFLQDDDVELYEEIKFEPNVMCEYIDNRIIFRSCQLEDGDIVCFQKSPKPDTADQFRYPDVPSFLVYIRNRQVVHFRSLEKPKEDDFCLEMSKIFTYDEVVEKVAQQLGVDDPSKIRLTSHNCYSQQPKPQPIKYRGVERLLDMLIHYNQTSDILYYEVLDIPLPELQALKTLKVTYHHATKDEVSVHSIRLPKNSTVGDVLSDIKSKVDLSHPDAELRLLEVFYHKIYKIFAPSEKIENINDQYWTLRAEEVPEEEKNLGPFDRLIHVYHFTKDTQNQTQVQNFGEPFFMVIREDETLSSIKERLQKKLKVSDEDFSKWKFAYISLGRPDYFEDSDTVATRFQRNMYGAWEQYLGLEHPDTAPRKAHSANQNRHSFERPVKIYN

SEQ ID NO: 125729 - protein, 167 aa, Triticum aestivum
  Clone ID: PAT_TA_20147.pep
MASGVSTSMVLTLLGFCVSVLFIVFVCSRLVCALVRRRRRRSRASPLPPGFPPLAANYFFAVQVDRLGAQAAAGPGAGGLDLAAVASFPTRAFAAAASSDSDSSDAAPQCVVCLAEYEDKDVLRTLPYCGHNFHMVCIDAWLKQHSTCPVCRISLSDYPDSKQKKKK

SEQ ID NO: 125730 - protein, 183 aa, Triticum aestivum
  unsure (1)..(183): unsure at all Xaa locations
  Clone ID: PAT_TA_20148.pep
TRPTRSYIGAAGVPNLQKEEKKKEIPPRTPRSPPLPPRSLPDPCRRHPRPRIAIYLNPPRTPAPPXPRTSPRATAAXTPPHQLPTSPPPESCFLLPPRGSXPPYRIPPPRLSLAGPEDASEADPSVISGQRGAAATPPPVSTALDPDARRRRSSSPTPSSXSTPPPPPVTRSTSLLPRCEPPA

SEQ ID NO: 125731 - protein, 122 aa, Triticum aestivum
  Clone ID: PAT_TA_20149.pep
MTASVSYGLRALPTWSSSVSGDDHCSALAMSVSARGPRWTRPLRTPARMGNVNEGKGIFAPLVVVVRNIVGRKRFNQLRGKAIALHSQVITEFCKTIGADPKQRQGLIRLAKKNGEKLGFLA

SEQ ID NO: 125732 - protein, 200 aa, Triticum aestivum
  unsure (1)..(200): unsure at all Xaa locations
  Clone ID: PAT_TA_20150.pep
KLTIXVHLPKXRTVTGWIEHPGRYVDFLIVNVKDLSVFDVARVSLDCDMQFEPYRKVAAVWRNFSSGLLGATSGVDLASLSALTSETMFSTCQINKAGIGGPLVDFDGNFVGMNCSRTRRKKTPYVRREQILQFLEYYRMVSVRAKEEIDDAEEPGIESEMKQLLCSIPGGKRKIHFLEANFVDDIWSKLPKGVASKMSR

SEQ ID NO: 125733 - protein, 155 aa, Triticum aestivum
  Clone ID: PAT_TA_20151.pep
NVQPVRRLFTYHSIMAAKGKLLIGKRSKLDCEELCVSTCKITKAGIGGPLIDTGGNFLGMNFYHEEETPFLPRDVIHRLLLNLNKGWTRAGDTIVEGDEKRWLLAGTCWSHGNADTIAEGGVNKWPLPEPCVLPADIPEPTTLDFYKLDRRQCAF

SEQ ID NO: 125734 - protein, 49 aa, Triticum aestivum
  unsure (1)..(49): unsure at all Xaa locations
  Clone ID: PAT_TA_20152.pep
SRSXXXSGRTKLPMALKATFSVFKSSNSGAPSFVQISQIGSVLANQWVI

SEQ ID NO: 125735 - protein, 209 aa, Triticum aestivum
  unsure (1)..(209): unsure at all Xaa locations
  Clone ID: PAT_TA_20153.pep
MATPTVVLLPVWAAGHLMSMLDAGKRLLARSGGALSLTVLVMPAPGENHRSEVAAHIQREEASGLDIRFHHLPAVEPPTDCLGIEEFXSRFVQLHAAHVQAAIXGLACPVAALVLDFFCTTMLDVSRELAVPAYVYITADAAFCALLLRLPALHEEVAVEFEEMEGMVDVPGLPPVPPSSLPVPVMDKKXPHYTWFMYHGXRFTXXXGV

SEQ ID NO: 125736 - protein, 210 aa, Triticum aestivum
  unsure (1)..(210): unsure at all Xaa locations
  Clone ID: PAT_TA_20154.pep
TRPRSLPPPISHPPTLSKPFPSKTPCAIPNPXPWRPGRRRRLRPSHRPPRRPRPRPSPRPRPRRRRRRLPQGPRPRRRRRRRPRPGPSPARGSRTPPRTPTPTSSPPLPGPRPRPPPSPPPPPPSPPPSGRSVPXPAPPPPVPQRRFLVAKKGAHRRRQAGASGGGGQFDFDKCREAAREALRASHEEFFLKERAVSAASEEQESQAAED

SEQ ID NO: 125737 - protein, 236 aa, Triticum aestivum
  Clone ID: PAT_TA_20155.pep
TRPWKQKWSPEEVCNENLDVTKGPIKIEWFKGGKTNICHNAVDRYVEAGDGAKIAMYWEGNEPDQDGKLTYSELLDKVCQLANYLKSVGVEKGDAVVIYLPMLMELPIAMLACARIGAVHSVVFAGFSADAIAQRITDCKPKVVITCNAVKRGQKLIPLKDIVDASLVESAKNGVTVGICLTYENQLAMKKEDTQWIAGRDVWWQDVVPNFPTRCDVEWVDAEDPLFLLYLPGRPL

SEQ ID NO: 125738 - protein, 82 aa, Triticum aestivum
  unsure (1)..(82): unsure at all Xaa locations
  Clone ID: PAT_TA_20156.pep
LFVXAGICPACGSVGRNVGPASDASCSLCLRGFELGDCKVEITVAWSLLIGSQYDISVMGSIQPYAWESIPRRPTMKLVDAC

SEQ ID NO: 125739 - protein, 398 aa, Triticum aestivum
  unsure (1)..(398): unsure at all Xaa locations
  Clone ID: PAT_TA_20157.pep
KVLILDPQTVGMVSVVYSQSDLLRKEVFLVETVDDASSSRASMAHLKAVYFLRPSSDNVQKLRCHLSAPRFAECHLFFSNILKIPQIQVLADSDEQEVVQQIQEFYADFCAIDPFHFTLNIHNNHIYMLPTVVDPPGMQSFCDRAVDGIASVFLALKRRPVIRYQXRTSNVAKRIAQETTRLMYEQESGLFDFRRTENSPFLLVIDRRDDPVTPLLNQWTYQAMVHELIGIENNKVDLKEFANVPKDHHEVVLSAVQDDFFRVNMFENFGDLGMNVKRMVDDFQHLSKSSQNFQSIDDMAKFVSNYPEYRKTHGNVTKHVALVSEMSRMVEERKLMQVSQTEQELACASGQAAAFEAVTSLLNNESVSDIDRLRLVMLYALRYEKESPVQLMQLFNKL

SEQ ID NO: 125740 - protein, 120 aa, Triticum aestivum
  Clone ID: PAT_TA_20158.pep
LPNKPTPSTERRSSERPRPIPQDTRPFFLLRKFDISPLVSGSERGICGVGSLWGRMNWIGRKIHLYNVNIGLYMLDWWERYLFNTLMLCLLWYILRYLTGFFQSNLETILQGANYLLQGS

SEQ ID NO: 125741 - protein, 112 aa, Triticum aestivum
  unsure (1)..(112): unsure at all Xaa locations
  Clone ID: PAT_TA_20159.pep
XFTLFFLFVRLESVRVYFGSSTHPAVTEACPKHLQPSAQLRLLDSTGSGPRRHQARAGASRGTWRRARQRIDPRARPGRYTLQLASPYHHRAHGEKTLMPPQLHRKRPPKGH

SEQ ID NO: 125742 - protein, 218 aa, Triticum aestivum
  unsure (1)..(218): unsure at all Xaa locations
  Clone ID: PAT_TA_20160.pep
HASVNLAGNLLAGVIPRELGQCRNLKFLNLSSNRLSGSLDKNLHLHCMDVIDVSGNKLSCSIPASANKECASQQPLDGVTSGYSSPFMSRAVAQLSLGYCESRECSVVYHNFAKNKFGGRLTSLPVSAHRYGNRTLYALILDHNNFTGSLDAILLEQCSNLNGLIVSFRDNKISGELTEEICSKCNAIRVLVLAENQIXXVLPANIGLLGALVKMDIS

SEQ ID NO: 125743 - protein, 67 aa, Triticum aestivum
  Clone ID: PAT_TA_20161.pep
WNLYPLMPNGMASKINSSVCIIKCSLYMRAFIFLCTHGLFVYHASLFEFVLHSFKKKNRKNKQQKKK

SEQ ID NO: 125744 - protein, 215 aa, Triticum aestivum
  unsure (1)..(215): unsure at all Xaa locations
  Clone ID: PAT_TA_20162.pep
HASXEVEQQVEKAVQELFTKGSKALKDEDFFGAEDCKRRILEIRVAHHGKLSPKCRSAYHNYGCALLQKALPNQDSVKSTTTQSNTESDIVEDLDLAWKMLHVARAISEKSPGSTTEKYKLFAALARVSVERGDTNYSLIACFKALANMEHLLEPDHRHIINRILLLRCACVLRPSPGDAIATASRFSRVVNLLRACPAVLADVLSYPAASVAGS

SEQ ID NO: 125745 - protein, 232 aa, Triticum aestivum
  unsure (1)..(232): unsure at all Xaa locations
  Clone ID: PAT_TA_20163.pep
HASDEFVSNGTLYEFLHGSADHNLSPIPLDLRLKIATQSAEALAYLHSSTSRTILHGDVKSANILLDDQRHAKVADFGASALKSMDESEFIMLVQGTLGYLDPESFISHVLTDKSDVYSFGXVVLLELITEEEGSLXIAPSKEKRSLSHSFLLMFHQNMHLKMLDSEIAEDAAAMVVVEKLAALAVHCLSARGDDRPTMKEVAERLQVLCRIEMHPAGDGDNDDVFCGSLET

SEQ ID NO: 125746 - protein, 399 aa, Triticum aestivum
  unsure (1)..(399): unsure at all Xaa locations
  Clone ID: PAT_TA_20164.pep
MQMKATEAGILGNAGMRAVYASNGEILKVGDVCRNGKLAWTLEAVAGXGPAACYSGPVADLLVKDVNXAGGIMTREDLEXYQVKVRRPLSQSVMGLTVLSMPPPSAGGAGLMLVLNILAQYGVSGISGSLGIHRLVESLKHYMAVKMNLGDPDFVDVGAVVSDMLSPXFAAELNHRIHDYMTFSPQHYGGRWNILQDHGTSHLSIVDGERNAVSMTSTVNAYFGSLILSPSTEVLLNNEMDVFLLDAATRGDLLKKGHALNLLPLKRPLSSMCANSVLTHGKLRREVGDGGGSMIRVGTIMALLHLWVKSMDPLSSVMAPRHDTHAYPXIEVKYENRTKTHGDVLLLDPATKGDLLKKGHVLEPLAGGTISQLVVHNVEGRGDLTAVSDPRKGGVPAGY

SEQ ID NO: 125747 - protein, 120 aa, Triticum aestivum
  Clone ID: PAT_TA_20165.pep
DGYHHNTKKKDYTLLVKLTSLPAVRQSEDDRSRGPTESVTREYRVSCRTTTDCMWPKHVCMKGLCNVLNNEFTTLMWHLPNKTANAHGGSQLVVYCKPPATPQTHTPTHTQQIHRNYDAC

SEQ ID NO: 125748 - protein, 207 aa, Triticum aestivum
  Clone ID: PAT_TA_20166.pep
LVEEIGFGGMLGIQMLAKLNLKFSAWLMERVDVESSTLKIDEQRVLQIQDHDVQKVFSLPCGTRSICPDTTEPSEACKEFMRASAYLSKGAHSLKAAEAYLLRDDINADSSKVQIDCFKIAFGIFVVGHLLAPSTKHDYITIDFWAALNDISQVKEFNWCAYVLEHLNRAVGKLKTDIRNRNITVHLVGCHLFLQVFYLDNLDLGPL

SEQ ID NO: 125749 - protein, 228 aa, Triticum aestivum
  unsure (1)..(228): unsure at all Xaa locations
  Clone ID: PAT_TA_20167.pep
MLAARVNLKGWQQAAVAVGSAFGALLDPKRADLIAALGETTGKPAFERVLQRMKNSAEGREILLERPRVISTRVSHAWDMPENTFGAAYAQFMGSRNFSPDDRPPVRFMETDDLAFVATRAREVHDFWHVLFGLPTNLIGETALKVIEFEQIFLPVCLPSVLGGPARFRAKQRRLFSQHYXPWATKAGVKATDLMSVYYEKHFHEDLEEVRRNWGIVPCPDPKTTSSA

SEQ ID NO: 125750 - protein, 111 aa, Triticum aestivum
  Clone ID: PAT_TA_20168.pep
MCTGKTTTSQQKWTPPPSSYLKINVDAAFKEEDHTGGWGYIIRNPEGFAEAARAGRLTHIMDALHAESLALIGAIERASDLGCQNVISETDSHVLQQAISTEEYDASQCGA

SEQ ID NO: 125751 - protein, 268 aa, Triticum aestivum
  Clone ID: PAT_TA_20169.pep
PLLTPDPLPLPARALVRRPPPPPRLVRYAGRPRLVAAGGGVASPAAPRLRSWPPKRSYDFCNRAVSTMHAGTRAAPACLAVPGGALPGLSVPAPASPRSPVASPSSPRQMRALAVTLSYMIYDGACCHLSGDARLDNALHHLISIVGLAAGLAYQRCGTELVACLLVTEISSPLLHLREMLKELGVKDTDLNLLVDILFAVTFSVARMVCGTYVTYRTVTADNPILIKTMATSLLLVSAYWFLRILRMVRHKIGKKRLASKAAGKGSM

SEQ ID NO: 125752 - protein, 198 aa, Triticum aestivum
  Clone ID: PAT_TA_20170.pep
YPTAVIRFQHRSGAANLSISRASFACRPRQTSAATHGPDNAASARLLAERRQPSARLLPALHPEVAAAANGRRPAWQCPQARGSAVHSPGRGDTLCARRTPAAPPIGLNPRRTATSPPHGHHPRLSTSGRLPRSDQPRRGYPALRHERTMSGSGGDVLRHGAETDGRQRPLARGVVRASPPATAGGAMNRSIGASLQN

SEQ ID NO: 125753 - protein, 274 aa, Triticum aestivum
  unsure (1)..(274): unsure at all Xaa locations
  Clone ID: PAT_TA_20171.pep
PAPPLPPRPALGHGTTGPRPARTSTPTRIFRTVYAQMTIFSVSQATTMDRRIGPSFQIPAGSLTVFFVSWIVPTGPIYDRIVVPVSRRLNGNPHGLTPLQRIGIGLVLSILAMTSAALVEVKRLRVARDSAVPAGAPLPMAVFWVTPWTFFGAGAMASTYFGPLELCPPECPKGMKTARTGPFVCTFSLXFFVSSSLVTVVHRSTGDRRPWIADDGSKGELYRFYSLLAGVCLANFVVYLFRRQCGTSTRPDGPAPTAASTASRWPTPSRASTD

SEQ ID NO: 125754 - protein, 93 aa, Triticum aestivum
  Clone ID: PAT_TA_20172.pep
MASGQQERSQLDRKAREGETVVPGGTGGKSLEAQQNLAEGRSRGGQTRREQMGEEGYSEMGRKGGLSTNDESGGERAAREGIDIDESKFKTKS

SEQ ID NO: 125755 - protein, 93 aa, Triticum aestivum
  Clone ID: PAT_TA_20173.pep
MASGQQERSQLDRKAREGETVVPGGTGGTNLQAQENLAEGRSRGGQTRKEQMGEEGYREMGRKGGLSTNDESGGERAAREGIDIDESKFKTKS

SEQ ID NO: 125756 - protein, 100 aa, Triticum aestivum
  unsure (1)..(100): unsure at all Xaa locations
  Clone ID: PAT_TA_20174.pep
QGRQREQWLPGQQERSQLDRKAREGETXVPGGTGGKSLEAQENLAEGRSRGGQTRREQMGEEGYRXMGRKGGLSTNDESGGDRAAREGIDIDESKFKTKS

SEQ ID NO: 125757 - protein, 166 aa, Triticum aestivum
  Clone ID: PAT_TA_20175.pep
YLLKGLNKTPYEILTGNKPNVKYFRVFGCKFFILKKGVCLSKFEARAHEGIFVGYATNSHAYRVLNKSTGLIEETCNVEFDENNGSQVEQSGTCDVGDEIPPQAIRRMGVGLLLPTGDPLLVAADGPCSAHALPPPAPRPRASLVRPGGPQPHEQRPRAISTSRWC

SEQ ID NO: 125758 - protein, 135 aa, Triticum aestivum
  unsure (1)..(135): unsure at all Xaa locations
  Clone ID: PAT_TA_20176.pep
MAPTVMASSATSVAPFQGLKSTAGLPVSRRSNGAXLGSVXNGGRIRCMQVWPIEGIKKFETLSYLPPLSTEALLKQVDYLIRSKWVPCLEFSKVGFIFREHNASPGYYDGRYWTMWXLPMFGXTDXTQVINEVRR

SEQ ID NO: 125759 - protein, 143 aa, Triticum aestivum
  Clone ID: PAT_TA_20177.pep
VVLHHRAVRHQLGGCPRISIRNPHAAHLLEREGPVLGFIGGARRTPEVYPEHGEQEAQACQHSPGHALPPDPPVSTTGLQLVGVRPGPAPDSERALRHDAQGRLEGAVQGRRGPSLSHRGPRAKRERPAHPVSSVHPVRYLFP

SEQ ID NO: 125760 - protein, 227 aa, Triticum aestivum
  Clone ID: PAT_TA_20178.pep
NSPILAMLDKDVREEHGHDWQMSEIISLMFMIIEGLNDRNLATRSTRLTIVSPDSTQVIDPVFASYAPMGYDIGAFLGNLILAYFAQDGHADQTNDRKAYKQWILKTIEESWNLFQQKFLGLWNKHKDGNGEAYLPAIYNNPELLSDVQKKYMTGLLHDSLGFGSAKMIRRIVGIAHVEDFDSIEDASKRASCERRALDCAKAILKGRRQFESIEQVIVHVQSVNHD

SEQ ID NO: 125761 - protein, 107 aa, Triticum aestivum
  unsure (1)..(107): unsure at all Xaa locations
  Clone ID: PAT_TA_20179.pep
MVPCKCKPVPAYKKWILKTIXESGNLFDPKFLGLXNKHKDGNGEAYLPAIYINPKLLSIVQNKQVRCLRSSSAPMSAPVEGGDGQQWLGGEGTTVAWRHRRLTVVCI

SEQ ID NO: 125762 - protein, 134 aa, Triticum aestivum
  Clone ID: PAT_TA_20180.pep
QRMGRCLSFLLLLGVALKLAGPANGDMSAAFAGTGAAYSIDGAVRQLMSPPLMKLEDGVDPELKYRPGGAPPRPRRHQPRCPEPQQARLPRRVPGARRIVHQPGMPEEVPVPWLNGAAEHSGRQPPARMHVRPA

SEQ ID NO: 125763 - protein, 171 aa, Triticum aestivum
  Clone ID: PAT_TA_20181.pep
KKLVLLRLLLVGFIINHVARTAAGAGDDDHQFVYSGFAGSSGLLLDGAASVTESGLLELTNGTLRQKGHAIYPTPLRLRGRSFSSSFEFGILSAYPDESANGVTLFVAPTANLSGAMAAQYLGLLNTSNNGNATNRVFAGELDTMHNNEFRDLIDNYVGIDINSAVLAKLT

SEQ ID NO: 125764 - protein, 68 aa, Triticum aestivum
  Clone ID: PAT_TA_20182.pep
MAGFGSLAPKTKNVVVAGGLTGFVFGVYYYTMWAVGSTDELQVTIDKFEDLKKKEEAASASSSTPGSS

SEQ ID NO: 125765 - protein, 71 aa, Triticum aestivum
  Clone ID: PAT_TA_20183.pep
MAGFGSLASKTKNVVVAGGLTGFVFGVYYYTMWAVGSTDELQVTIDKFEDLKKKEEATFAAAASASTPGSS

SEQ ID NO: 125766 - protein, 110 aa, Triticum aestivum
  Clone ID: PAT_TA_20184.pep
MAPTKKSKKSTENINNKLQLVMKSGKYTLGYKTVLKTLRSSKGKLIILANNCPPLRKSEIEYYAMLSKISVHHFHGNNVDLGTACGKYYRVCCLSILDPGDSDIITTVPQ

SEQ ID NO: 125767 - protein, 208 aa, Triticum aestivum
  Clone ID: PAT_TA_20185.pep
SCITDQTISRKILNASSNSATQGGKQPEKNNEVVPRAQQEPYNSTNKIGSTLCWLLLGGDGCADESPRGCLGSTDSRGSTPGSTLPQAVRSINSVSVEDCATAKFFAKTMRGTQPILLPNGEGRLFLRMISIPLLRLAGSWGRSCSRACASRSALPAASCCCVFCPALLRLSLVGAIASGEASVGKGVPEGAGGGGGAEGGGAGGGGP

SEQ ID NO: 125768 - protein, 119 aa, Triticum aestivum
  Clone ID: PAT_TA_20186.pep
MASLSVATLPQLAGAPAAAAAKKRSGVTYVEGMNAYSGLKGLNKVTMLGVRKSADYKFARIVASLSPAGKRRGGSFGAQCNAAGEIFQIAVVMNALTLVGGAVGFVLLRAEAALEESEE

SEQ ID NO: 125769 - protein, 119 aa, Triticum aestivum
  Clone ID: PAT_TA_20187.pep
MASLSVATLPQLAGAPAAAAAKKRSGVTYVEGMNAYSGLKGLNKVTMLGVRKSADYKFARIVASLSPAGKRRGGSFGAQCNAAGEIFQIAVVMNALTLVGVAVGFVLLRAEAAFEESEE

SEQ ID NO: 125770 - protein, 110 aa, Triticum aestivum
  Clone ID: PAT_TA_20188.pep
KWLSKSTIDSGIPLIVKGEIRISAEFEGGYSWGETITRTRETTMKYQVIVPPMSKVLVTATQSQGICDVPYSYTQKDVLLNGHEVTHHFTDGIYRGVSVSDTTIKVEPMP

SEQ ID NO: 125771 - protein, 230 aa, Triticum aestivum
  unsure (1)..(230): unsure at all Xaa locations
  Clone ID: PAT_TA_20189.pep
MADAEPWKTVKIPPIVQELATGMQEPPSRYVIAEQNRPTAAGFEMPDPIPIIDLSRLSANCADEVAKLRSALEKWGLFLAVGHGMEQSFLGEVMGVAREFFKLPLEEKQKYSNLVNGNEVRIEGYGNDMVVSEKQILDWCDRLYIIVEPENRRIYSLWPTQPPSFRDILSEYTVRCRKIANLFLQNLAKLLDLHEDYFVNMFDENALTYAXLNYYPNVRSRTRLRHKPTR

SEQ ID NO: 125772 - protein, 159 aa, Triticum aestivum
  unsure (1)..(159): unsure at all Xaa locations
  Clone ID: PAT_TA_20190.pep
LAGAPSPWSRPIPVWGWPHSPGSTASIRVPLAGAGRAGDHLVAPRNLGNGSFCQRLTADGKIDCLNASADSMVGRARFHLEEPVISREIYDIEFHLDEAKGQLKKLEDVKTAHLINDIPTPGTQRRGFSSSDREXXEXVLLKWFSHHCLDHHVKGINCL

SEQ ID NO: 125773 - protein, 169 aa, Triticum aestivum
  unsure (1)..(169): unsure at all Xaa locations
  Clone ID: PAT_TA_20191.pep
MATVGISAASWVVGKALSPLSGGVLEAWSASSMLGSNMEALKMQLLYAQAMLNNVRGREIHNPALGELLDKLRHLAYGAEDVLDELDYFRIQDELDGTYHAADAHDAGFVQDLALNARHTVRACVNKLKLPVCSRAARKVEQDDGGKQGYLSXFRFCGXHEISSSXPSP

SEQ ID NO: 125774 - protein, 83 aa, Triticum aestivum
  unsure (1)..(83): unsure at all Xaa locations
  Clone ID: PAT_TA_20192.pep
MIFKSFLFSSLSFSMRIINSVVVVGLYYGFLTTFSIGPSXDLLSPILGLGKKEIFATTGDFIMGQLMIFISIYYPPLYLFFLS

SEQ ID NO: 125775 - protein, 169 aa, Triticum aestivum
  unsure (1)..(169): unsure at all Xaa locations
  Clone ID: PAT_TA_20193.pep
SCRIRHELFLXIXAFLXPFLAMSMQPLTDDMARPSHLMAIRSTGPFSAEHARLLNEIKQDVMKFVVINIALLLVTLTLGFAKQALTFFLRSMGYFGGRYSLADIIRKVIKGSSLKGPSITIDVADVLGFTCMALLGSMLFAMTCRRSGGFSVEGXIFLXXLVVYLYLNS

SEQ ID NO: 125776 - protein, 214 aa, Triticum aestivum
  unsure (1)..(214): unsure at all Xaa locations
  Clone ID: PAT_TA_20194.pep
MRDMGVVCDMGVMHGAVAALMRHIMVNGKEAARAFPIKRKNRRRAAHLPSAPLPISEPPFPSSSSGERFEDLASACCRCAPIALDPSPSPSRHGTKNQQGQGSGKDAREKEARRAIGGAADATRLFPSTVDASTQELILPCGEEDDGHLQARLPPISQAPQSTFSPFPPGLAPFPTLGGCKYVHTVPYHGEVLHSRLPGPKFXRIPPRRGRRGX

SEQ ID NO: 125777 - protein, 95 aa, Triticum aestivum
  unsure (1)..(95): unsure at all Xaa locations
  Clone ID: PAT_TA_20195.pep
QNDILTQGGRDHPVCAFSMSPSSPLFAPSLVPPMXCAPAHFFVGPTTGDNAAVASIDPCRIRFSTDATEHTLSPESPECLPTTRLLEVAGISRFF

SEQ ID NO: 125778 - protein, 191 aa, Triticum aestivum
  unsure (1)..(191): unsure at all Xaa locations
  Clone ID: PAT_TA_20196.pep
SRRCILAPASPTTSHARSCNWRTEELLPATPGAATGGQRSYKPGTKPTTAVLDSARRGAATGRSNSCNYLLFLLGPVRNFAATIDGEPASSFGTGFLLGAAHVLGWSGSCSRPLKCWHRRRPLCGAPGGARPSRAPAPSAAGSTFGVGRISMCGLLHSSWGRAADVALPPTGMAPRRNWLSXLRHSSFSDX

SEQ ID NO: 125779 - protein, 112 aa, Triticum aestivum
  unsure (1)..(112): unsure at all Xaa locations
  Clone ID: PAT_TA_20197.pep
LGEVCGSVTSFGIYGFTESFRTCGWWSWSSMGLIEEGYNLQIGGWDRIVGALGVADRVWEAGLPSPERILPEPRSGSGAAGVGEERPSPEVFLVXKAWALVXLEGVMLGPNP

SEQ ID NO: 125780 - protein, 146 aa, Triticum aestivum
  unsure (1)..(146): unsure at all Xaa locations
  Clone ID: PAT_TA_20198.pep
FAVMALHLACGYRYGALLLAFFVTSSKVTKIGEDRKRRVEEDFKEGGQXRNWIQVLANSAIPTVLVILLAIMTGGQDQCLDSNGSKVITGIIGAIIGHYCCCNGDTWXSEIRVLXDEQPKXVTNXKPVXKGTNXGVXLKGLCCNVV

SEQ ID NO: 125781 - protein, 237 aa, Triticum aestivum
  unsure (1)..(237): unsure at all Xaa locations
  Clone ID: PAT_TA_20199.pep
XEGWKDXXERYILQWXXKHIIAVSTAIQDXLTSRLALELMKQGAMRTVLSGFLAAFAWPATLLAATDFIDSKWSVAIDRSDKAGKMLADVLMKGSQGNRPVTLIGFSLGARVIFKCLQELALSSDNEGLVERVVLLGAPVSVKGERWEPARKMVAGRFVNVYSKDDWILGVTFRASLLTQGLAGIQAVDVPGVENVDVTELVDGHSSYLSAAHLILEHLELNTYYPVFVPLPPAVSK

SEQ ID NO: 125782 - protein, 215 aa, Triticum aestivum
  unsure (1)..(215): unsure at all Xaa locations
  Clone ID: PAT_TA_20200.pep
MATAIVPTDAELLQAQADLWRHSLYYLTSMALKCAVELHIPTAIHNLGGSATLPDLVAALSLPAAKLPFLGRVMRLLVTSGVFASSDDVQYRLNPLSWLLVEGVESEDHTYQKYFVLGTVSRHYVEAXMSLADWFKKEEDXTASRRSPSDALHGCPSFNESTKLLDKELDXVLEEGVAXHRTLGLRGVIRXXGXXFXGFVLGSRERGHKLSRINT

SEQ ID NO: 125783 - protein, 176 aa, Triticum aestivum
  unsure (1)..(176): unsure at all Xaa locations
  Clone ID: PAT_TA_20201.pep
FAAVTVPLLYGSSLAEPKSIPSKSMYPTFDVGDRILAEKXVSYIFRDPQISDIXVIFRAPPGLQVYAYSSGDVFIKRVVAKGGDYVEVRDGKLFVNGVVQDEDFVLEPHNYEMEPVLVPEXYVFVLGDNRNNSFDXHNWGPXPVRNMFGRLSSGIGPPSKINDTIMSLCPAQVPSS

SEQ ID NO: 125784 - protein, 143 aa, Triticum aestivum
  unsure (1)..(143): unsure at all Xaa locations
  Clone ID: PAT_TA_20202.pep
MVKICCIGAGYVGGPTMAVIALKCPDIEVVVVDISKPRIEAWNSDTLPIYEPGLDDVVKQCRGRNXFFSTDVEXHVPEADIXFVSVNTPPRPWLELEGADSLRETAQISPLQSQFGLVAPSVTPVYRCGPQTQIIQSSTGFKE

SEQ ID NO: 125785 - protein, 295 aa, Triticum aestivum
  unsure (1)..(295): unsure at all Xaa locations
  Clone ID: PAT_TA_20203.pep
CDASPHRPHHAGPLVHDLLAFQESNVDYAQVRKAWNRGDLLXGPPATGTSTMTAAMANFLDYDVYDLELTALQSNTGLRNLFIKTTGMSSILLEKTTPNIDCSGDLTGKRRKDKEXLATRHSDGNDKPKLPIEPEKDDATKVTLSGLLNFIDGLWSACGGERIIIFTTNYKEKLEPSLIXRRGRMDKHIEMSYCRFESFKVLTKNYLDVVRHERIGEIQQLLEETDMSPADVAEKLLPMTKKKKREQDVCLTGMMKELTQTKKDTEVAKAKEETSAKETGEKKAKEKEQAEVKKT

SEQ ID NO: 125786 - protein, 165 aa, Triticum aestivum
  unsure (1)..(165): unsure at all Xaa locations
  Clone ID: PAT_TA_20204.pep
MARTKQTARKSTGGKAPRKQLATKAARKSAPTTGGVKKPHRYRPGTVXALREIRKXYQKSTELLIRKLXPFQRLVREIAQGLQDRPSGFQSHAVLALPGGRRGFLVGXFRGHHPGQPVRPNRVPQHRPPPSGGPAASFACAICVHIRGYAHCPFPFRFGLFSSLF

SEQ ID NO: 125787 - protein, 176 aa, Triticum aestivum
  unsure (1)..(176): unsure at all Xaa locations
  Clone ID: PAT_TA_20205.pep
MATTGGGKAALVLGRLLLLLCVLGHGAAQXYNAIWSFGDSISDTGNLCVGGGCPSWLTTGQPPXYGETFFGRPTGRCFRRAASSFDFLAEHFGLPLLPASKXGGDLKKGANMAXNRRHTMDFDFFKSXLNDKFWNNGPLDTKSMGQELLPPCAEGCKNTVKSFLVGNSRNTPGSPG

SEQ ID NO: 125788 - protein, 175 aa, Triticum aestivum
  unsure (1)..(175): unsure at all Xaa locations
  Clone ID: PAT_TA_20206.pep
YPTRAAPQWAPARDSRQPHRREERDPPFLHSTRNLVKSSHQRLEVILERRPWPECCVDSRHRDFQSSKVVDNTSDTGFQSEHIHGSFVLHRREDGVQACLNSPSFFLEVLAKFFKHDEHLLGKPSQIVLQIAPFASNAFHLFGQIVLVLLQMSRLXVGFIKGSFQLGILFLXFAD

SEQ ID NO: 125789 - protein, 243 aa, Triticum aestivum
  Clone ID: PAT_TA_20207.pep
MATTAADATAAVPKEQQPANGSAAATTGGEQVTRHSEVGHKSLLQSDALYQYILETSVYPREHECMKELREITANHPWNLMTTSADEGQFLNMLLKLIGAKKTMEIGVYTGYSLLATALAIPDDGTILAMDINRENYELGLPCIEKAGVAHKIDFREGPALPVLDALLEDEANHGTFDFVFVDADKDNYLNYHERLMKLVKVGGLLGYDNTLWNGSVVLPADAPMRKYIRYYRDFVLELNKPS

SEQ ID NO: 125790 - protein, 264 aa, Triticum aestivum
  unsure (1)..(264): unsure at all Xaa locations
  Clone ID: PAT_TA_20208.pep
MATTAADATAAAPKAQPANGSEQVTRHSEVGHKSLLQSDALYXYILETSVYPREHECMXELREITANHPWGTWMTXTSAARGPTFLNMLLKLIGAKKTMEIGVYTGXYSLLATALAIPDDGTILAMDINRENYELGLPCIEKAGVAHKIDFREGPALPVLGRAAGGPTANHGTFDFVFVDADKDNYLNYHERLMKLVYLGDVLSHENTLWQXSVVLPADARTRRYIRDYRDFVSDLTKAGAXNPAAGTCQPPVGHGITPRRRAQ

SEQ ID NO: 125791 - protein, 55 aa, Triticum aestivum
  Clone ID: PAT_TA_20209.pep
ESEMFYSCVRSTIYRMMMSIVCTYGFYTYTCTRYAMNSTNGHGMYGRSCVSAWCL

SEQ ID NO: 125792 - protein, 122 aa, Triticum aestivum
  unsure (1)..(122): unsure at all Xaa locations
  Clone ID: PAT_TA_20210.pep
MCSLEATRAELGLAVLYLNKAEARDKICRAIQYGSKFISNGQPGTAQNVDKSTTLARKVFRLLKWVNDLHALISPAPKGTPLTLVLLGKSKNALLSTXLFLDQFVWLGRSGIYQNRERTDRI

SEQ ID NO: 125793 - protein, 265 aa, Triticum aestivum
  unsure (1)..(265): unsure at all Xaa locations
  Clone ID: PAT_TA_20211.pep
TRSPPQPLSTSRPHPPPPHSPPLSPLRCARWRRTRAELGLGVVYGNEAEARDKVYGGVQYGSKFIMQRPGPAPPTNVDTAHTVDRKHFRLLKWLNDPHALIEPXPKGITLTPVMGTHLKIALLGKSKNALLSMFLFLDQFVWKKERRDCITRKCIDCGTASSVYSSLVELGELSLLSNAMRKRAXELRGTHEYEDEQYLGKMKQSDARLLALVKAGMDVVVAVGLLQLAPKKVTPRVTGAFGFVTSLISCYQQLPSRAPLDKLKA

SEQ ID NO: 125794 - protein, 398 aa, Triticum aestivum
  Clone ID: PAT_TA_20212.pep
PLAQGAAARPPPSPLPPIVVQELVGLANVAPAVGPLSPLVAPRGAQPEEGAVVRSRSPGLIGFPRCSLAPTAFALGLSLAAVAWYPLPGAWASLLSDTLLSVLCSATRARGLPRALRVGCVLRLHVSASAVVLAQSLPLLGGTLLCPWVCARAAVVGGPLLTEYLGSPQRHIAASESNSEVNGTGKKEDIVGGAENNGKSTESLTEKNESGEINEDLDDGVSKELEGGHEQCNEAVRNQNSEEASSLVNEESIDAKAADCSEHSKTREEGSSISKNDVLAATACQFKNFVAIVDPPRAGLHPTVIKVLRTHPRIRRLVYISCNPDTLVANAIELCTPSTEHREKNKGHRGWRNMSSAGLARQRTKSMPNSEPFVPKRAMAVDLFPHTSHCEMVMLFER

SEQ ID NO: 125795 - protein, 86 aa, Triticum aestivum
  unsure (1)..(86): unsure at all Xaa locations
  Clone ID: PAT_TA_20213.pep
KCKLRGMQACKTFSFVVYIAGTIVGGYVHVPLCAGSGHVLTKQAXLIVLRGASXKKXGXXXKXXGAGPFPXGXXTXHGXFXRXREP

SEQ ID NO: 125796 - protein, 197 aa, Triticum aestivum
  Clone ID: PAT_TA_20214.pep
MAGSDLLRPDPATGLAIVIMGVSGCGKSTVAAMLADALGCGFVEADDYHSHANKEKMSRGVPLTDEDRLPWLESLRDAIRERLGRGEDVAVSCSALRLKYREVLRQGDISYKPGSYETCRVKFVCLEASAEVIAGRVERRAAEGGHFMPASLVRSQLDLLEIDAAEGITVVDATVPAHAIVQATVAQFRDELASMAC

SEQ ID NO: 125797 - protein, 149 aa, Triticum aestivum
  Clone ID: PAT_TA_20215.pep
SSKSDSKLSRNRGEKTRWMVGRNSYPSENGKVDGLQQNLPIRIPKHADEDAYESEGIPLRSAADRIPLRSPRGTEGIPLRSAADGIPLRSSSRGHRIVPLGHHDLVMVAAGFKSMRRLRATLVKSWCLNALYLGREESPFFRRIELLRF

SEQ ID NO: 125798 - protein, 144 aa, Triticum aestivum
  Clone ID: PAT_TA_20216.pep
MRSSEAMELLGFAPYSRPSPSEVKAAYRRMVMESHPDRVPTHQKPQAESKFKQIVEAYSCLKDGRRFGNRMEVHVMRSGVPTGYRRSNKTLSKAPFLLFIRAAISFGSYSASRAYQRQKELCSSHNPLLPYWQSSELSVSHIYI

SEQ ID NO: 125799 - protein, 206 aa, Triticum aestivum
  Clone ID: PAT_TA_20217.pep
MSTSRRRTLLKVIVLGDSGVGKTSLMNQYVHNKFSQQYKATIGADFVTKEVLIEDRLVTLQIWDTAGQERFQSLGVAFYRGADCCVLVYDVNVNKSFDTLNTWHDEFLNQASPSDPKTFPFILLGNKIDVDGGKSRVVSEKKAMEWCSSKGNIPYYETSAKEDYNVDEAFLSVAKLALEHERDQDIYFQTVADPVPETEQRGGCAC

SEQ ID NO: 125800 - protein, 117 aa, Triticum aestivum
  Clone ID: PAT_TA_20218.pep
HIHAWPASSLIDAQDAPRLCPGSPPPRSSPVVHGRPQRQGFPAAPLRRGRARAQQAACVRTLATAPRARCGQLWAGRCHRLRRRCGQRAGCACWAWPQSLGDRPSGKVPRPVRRRGR

SEQ ID NO: 125801 - protein, 98 aa, Triticum aestivum
  unsure (1)..(98): unsure at all Xaa locations
  Clone ID: PAT_TA_20219.pep
TDSCAQFHYITEFXRSADAMRSLCTAFALVMVSAGSYLSSFILTLVSYVTTRGGDPGWIPDNMNEGHLDRFFWLIAGISFVNLLVYISCAMKYKYKNV

SEQ ID NO: 125802 - protein, 132 aa, Triticum aestivum
  Clone ID: PAT_TA_20220.pep
SPSLSLSGGSAVRCEDGLGGRSPSVHSSLRFRCRLCLASVASGVMPYLSSPSTNPGSVWWLPVASQAGHPWWMEADGSGSGASSLSPISLRSSLIWRMALYCCLLFQLTLVVDEERGRCRYLKPADRVRAYQ

SEQ ID NO: 125803 - protein, 167 aa, Triticum aestivum
  Clone ID: PAT_TA_20221.pep
MAAESIPPGVCALWKADLAAVQRPWCAADAGHGDFVTPSGSSPAAPWFFPGGGGPRPARRRACLIGGRPGCCSEAMVCRCCGHGDFFTPSGSSPTEVQSGRWLIGTRSRFVLSVWGPPCKSQGLVCYVFYFGVLVGALYFHHFGVKRKLGVVLDPSSVKKKDGAAHT

SEQ ID NO: 125804 - protein, 168 aa, Triticum aestivum
  unsure (1)..(168): unsure at all Xaa locations
  Clone ID: PAT_TA_20222.pep
CGPRRAPMQCGALQFFRFVLGNSVWSFASAPQPRWSPTSLLPSSAADPQLRTHGSSHLPLPTPMRWTTTAQQHRRXRHGHLNLVLAPHHGPRSIATSPTTKCCSPLFSFCNSHVKVSFCSACVLFGVSSNEDTDQSTLFSNAEKGGKTNYKKRNARLALLHAVRLEFD

SEQ ID NO: 125805 - protein, 250 aa, Triticum aestivum
  Clone ID: PAT_TA_20223.pep
LAYAFSHQWKNSSRSSNPMFVDPNNPHWGWSWLERWMAAKPSEAGRTGTGKESNIDQGSVKSTSLNLGEGEITKAFNRRGSKPDKSSPTTPKLTRPASRLSPSTPTAKVTPIVVKKKPATPKNGISQVDDDARSVLSVQSERPRRHSIATSTVRDDESLASSPSVPSYMAATKSARAKSRLQGSPLIDSAETTPEKGGSISVGSAKKRLSFPAGGVPPSPMRRHSGPPKVESVVKDIAVTPQPEALAISG

SEQ ID NO: 125806 - protein, 130 aa, Triticum aestivum
  Clone ID: PAT_TA_20224.pep
SLTPLTWTYWQNLCSGKIACKKGEDEAARLQTFLVREGEGAFAVLVEPVTRGQAYAVLVVQLKVGTCPCTCEGRNKAIRPDLDTVVAISVGGASEEGGDQKEEGELGHGHGGGWLPAVATRIDMLMNQVG

SEQ ID NO: 125807 - protein, 52 aa, Triticum aestivum
  Clone ID: PAT_TA_20225.pep
MAVMDTAFKALTAGLGVATLYLAGSFSFNVYRGLAWHSEQSKLEKENEKSQD

SEQ ID NO: 125808 - protein, 52 aa, Triticum aestivum
  Clone ID: PAT_TA_20226.pep
MAVMDTAFKVLTAGLGVATLYLAGSFSFNVYRGLAWHSEQSKLEKEKEKNED

SEQ ID NO: 125809 - protein, 198 aa, Triticum aestivum
  unsure (1)..(198): unsure at all Xaa locations
  Clone ID: PAT_TA_20227.pep
MLSWCVSARRCPAATPVAQRGRGVVSASCNLSNVPPTQVVSWRCAVSVVWSLSIASTVQCRGVVCLAMLFDYAGGTQVPWRRLGSACPFRMCLRDTVVSRTLCSLGMRGAFRLPSTVQCPWFWVLGWARCRSASIIWCSLLCPPSLYPMYGVVVACVFFCFSPSFSCAPWYSRFTXNLSPATGCKALIRQMEYIPNGE

SEQ ID NO: 125810 - protein, 174 aa, Triticum aestivum
  unsure (1)..(174): unsure at all Xaa locations
  Clone ID: PAT_TA_20228.pep
GSTSTLVHLADQWAPLAQPYSTQHSAMSSGSPASHLYNQDTSVVHPNPSSSLMNDGNLGINSASGSAILSNLLPSFASQFLMGRPPMSSPFFGTPLQHVQLSSGLPQSGSNPQPSVSSMQARATSTATITQQXINXEPAXXCFSXMXXTAXAAXSYXPNSSSXXXFAVXNNXCP

SEQ ID NO: 125811 - protein, 154 aa, Triticum aestivum
  Clone ID: PAT_TA_20229.pep
MAASRTSGMAVALVPVVAGLLCPGLRRGEACNGHPCPSPAANGPVTAVKLAVGADVLDGLVHVVLGPVGRPKHARGCSRPSPGRGWDLGRRPPWRLPRPSNAQRPLRHRTSDVRRLTFTLLFNLLRMQGAQGLPAPLALNQPFCMDDCAWPCTS

SEQ ID NO: 125812 - protein, 538 aa, Triticum aestivum
  Clone ID: PAT_TA_20230.pep
MTSLNKVVPNNGDARSMLPNKFTALNPNAAEFVPSCVIRPSYGNSTASDASKSELRGSPGKKILDRSESSKSNNSHDEAHQFWRKQLPDDIIPDFTSFEKIEQEPEELSLAGLSLNAPPFYGTKASRLSREHQELSSSASNLELGHTNLFYEDNSQATFSTVGSSNWEQNYVGDLHFANENQDLQYDPTTGFTDGFASEYVAASDGLFDPLEYLASQFPGFSAESLAELYYANGCDFNHTIEILTQLEMQVDPTSNQAMNLTPSSPNFSTGDFPALPTAEDQNGFSKGDMDILGFFSGRNSSTISSGTGDFVSAVRKLASQNSGHNKFKKGLITAMVFLPFLYPSSTCFGSKTSSGNKYQSVSSARAAATPWLDTGDAVANMYSESREEARDFARVRNACFEQARQAYLIGNKALAKELSIKGQAYNSQMKAAHEKAREAIYRQRNPGSLQRGSDRLIDLHGLHVSEAIHILKVELSSLRGMARASGERMQVMVCVGTGHHTKGSRTARLPIAVEQFLLDEGLHYTQPQPGLLRIAVY

SEQ ID NO: 125813 - protein, 167 aa, Triticum aestivum
  Clone ID: PAT_TA_20231.pep
ATYGNTRLERSKNAGAQKQTGREGGRANKNTQRTEISQHTTNSAGDRRPHTHHHFALHASSQASVGRTLARVLHATFGKGSLAFLALGLAGEHTGYGSAAAGSELVPAAHVAGKSPADDDLGWLVTSPPTSGSLGQLGQLGHCLQMPGEQDDHADGRHLLKHCTGGN

SEQ ID NO: 125814 - protein, 179 aa, Triticum aestivum
  Clone ID: PAT_TA_20232.pep
MKLPAGASPGIALATEMLHKTLLLLLLATAHTTAAEWLGEDVVLLCLPEVIPVLLWFSLHLDRKPGSSSIISVDKLKPHRNWFIFLGAMVVAPPFAYLANSMDEVGLSGWSTTFQVSCGVSGILSYYLVFMLSHWPKKQVAAAGKDGGASGMLKLWAYALLIAAAASLLLRCLVSARLV

SEQ ID NO: 125815 - protein, 108 aa, Triticum aestivum
  Clone ID: PAT_TA_20233.pep
RVKDVSIPSIYPFNLHAKIPKNSPKLHRPNMRERIGQQISFPQHQIGAETDQIPQYYTSIQPSNQRRSRRHGERGGKLGTLRRWGRSIRRAWSRSETRLGGDLLVPCL

SEQ ID NO: 125816 - protein, 138 aa, Triticum aestivum
  Clone ID: PAT_TA_20234.pep
LSFTSARVRGVESDSTTSLLVLRARPLESPCSCMDLLASASLKNSFVHSRSRQWRAASACVSACEVLNYMNETEDVCARIAPLTCLEAQMTPPRAPASSWRAAGTAARRRRRWPGRVAPGRRRAAAAAAPASSSAPAP

SEQ ID NO: 125817 - protein, 421 aa, Triticum aestivum
  unsure (1)..(421): unsure at all Xaa locations
  Clone ID: PAT_TA_20235.pep
MAVEYRCCGGPFFEHIAVIVVLVLFAGLMSGLTLGLMSLSLVDLEVLAKSGTDKDRKYAAKILPVVKNQHLLLCTLLICNAEAMEALPIFLDSLVTAWGAVLISVTLILLFGEIIPQSICSRYGLAIGASFAPLVRVLVWICIPAAYPIAKLLDHVLGHGKAALFRKAELHTLVTLHGNEAGKGGELTHDETTIIAGALELSEKKAKDAMTPXCDTFVIDINAKLDRNPMQEVIEKGHSRVPVYYEKDTNIIGXLILVKNLLSINPDDEIPIKSVTIRKIPRVSEDMPLYDILNEFQKGHSHMAVVIKQNIPSYPAKQPSIDGGSLEVAIAIDEKQGEKVAKSLTPLRRWKSYPNTLNSNTGSRRGKWSKDQSDVLQVHEEPLPTLSEDEEAVGIITMEDVIEELLQEEIYDETDVHVEEQ

SEQ ID NO: 125818 - protein, 322 aa, Triticum aestivum
  Clone ID: PAT_TA_20236.pep
DVGLYMLANKWMVDEKELRVIHYTLGPLKPWDWWTAWLVKPVEIWQDVRQKLEESLPGTGGGRNPHDQLVVKFLFILPFCLLLFGYYQSCFQNKKDFPSVQSLCAFARRGRHKYKSEEALPSYLAVGVSSSTFSTSNQRISNGPHLKLPSYFGAIAVLICFMSAGVSLAFAFTIIPRQIMPWTGLLLMFEWTFVAFFLLFGGYLRFVYRWGSISATHVGYSNSDSSENHMATGHHQRNISDFDMEATFYWTGMAVIAIITVFSPTILGITALFTKLRLVVAGGVLLASFMTYASVHLAISAFHKGQKDRNGSRTRRICFWCL

SEQ ID NO: 125819 - protein, 198 aa, Triticum aestivum
  Clone ID: PAT_TA_20237.pep
MAALAALFASPALPFPSTSASSSPSCSCRFRRAVACAPRHPPASRRVTRRFDEVEGASKKRRGGGIGGGGGGGGGSLASSTRKDKGLSVDFKESQVADFEDLEEDKFLNAVVKVYCTHIRPDYGLPWQKQRQHSSTGSAFMIGDNKLLTNAHCVEHDTQIKVKRRGDDKKYVAKVLARGTKMDLAMLSVENEEFWAGT

SEQ ID NO: 125820 - protein, 92 aa, Triticum aestivum
  unsure (1)..(92): unsure at all Xaa locations
  Clone ID: PAT_TA_20238.pep
RITEGTSASSTDSTQLRHHRCFCPSPICRRNRAEPQILSRRLWRRSSIYRWMECVQVQHVGPWISSARHRIPSAAXDPRMPQDLLGGELRET

SEQ ID NO: 125821 - protein, 84 aa, Triticum aestivum
  Clone ID: PAT_TA_20239.pep
APSTHCCFLHPDHCCRRPQPQQSGTAEHQLTRSITSPSHSTGDHPPPLYAVVYQLPPSSRASSPKLALCTSSPEHQGAPPLEVN

SEQ ID NO: 125822 - protein, 107 aa, Triticum aestivum
  Clone ID: PAT_TA_20240.pep
PRVRASLQSLISKQLIAPNCTATARLNGAPPSVVNASSSEASSDEKKVTKRRLALLGAGALSTVLLNSSSAYAEEVPKNYRSYVDAYDGYSYLYPAEWRDFDFLGHD

SEQ ID NO: 125823 - protein, 224 aa, Triticum aestivum
  unsure (1)..(224): unsure at all Xaa locations
  Clone ID: PAT_TA_20241.pep
YPTKQLRPPDCTASARLGGAPPSVVNARAKHPSSRRKSVTKDWQALLGAGALSTVLLNSSSAYAEEVPKNYSSYVDANDGXSYFYPAAWRNWDFLGHVSAFNDRNVKLQSVRVAFVPTQKTDIRDLGPMDEAIFNLVTEVYAAPNQIPTIYXMQERTVDGRNYWTXFEYDLEAPGYXVSAFATVAIGNGRYYTLIVTANERRWSRLRNRLKVVADSFKIYDLNA

SEQ ID NO: 125824 - protein, 210 aa, Triticum aestivum
  unsure (1)..(210): unsure at all Xaa locations
  Clone ID: PAT_TA_20242.pep
HIPYGKTIALVGESGCGKSTVISLLERFYNPDSGTILLDGVEIKSLNINWLRKQTGLVSQEPVLFNDTIXRANIAYGKDEEVSEEELIAAAKASNAHEFISSLPQGYETSVGEXRGIQLSGGQKQRVAIARAILKDPKILLLDEATSALDAESDRLLLLALGRGMAPAPPRPCAPRPAFIRDVIVSGGCLFGDGPSPYDKWVTLTVNHKS

SEQ ID NO: 125825 - protein, 98 aa, Triticum aestivum
  Clone ID: PAT_TA_20243.pep
FSLTVANRGSRDGTHVVMVYTVPPAEVDDAPLKQLVAFRRVFVPAGAAVQVPFTLNVCKAFAIVEETAYTVVPSGVSTVLVGDEALSFSFPVKIELAV

SEQ ID NO: 125826 - protein, 335 aa, Triticum aestivum
  unsure (1)..(335): unsure at all Xaa locations
  Clone ID: PAT_TA_20244.pep
MERSAAGASYQRFPRVRIRELKDEYAKFELKDTDASMANALRRVMIAEVPTVAIDLVEIESNSSVLNDEFLAHRLGLIPLTSSAAMSMRFSRDCDACDGDGSCEXCSVEFHLAARATDSGPRRSEGHLHQTDLRSNRHPNGLPCRPCKGSTKQALGNVDAYEPDAAGDHRGILIVKQRRGQELRLRAIARKGIGKQHSTWSIAPTVTFMYEPDIRITQELMETLTLEEKQSWVESSPTKXFDIDPVTQQVTIVDPEAYTYDDEVIKKAEAMGKPGLVEINAKEDSFVFTVETTGAITAYELIMNAITVLRQKLDAVRLQDDDGDLGELGAHLIGG

SEQ ID NO: 125827 - protein, 238 aa, Triticum aestivum
  Clone ID: PAT_TA_20245.pep
HPGQRPPPLLASGADLLDLSSAMMDLDPRLYEDASVSDNDVRNIVLSYLMHNCFKETAETFLSSTGLKLPVDYTVDVDKRKAILNFVVEGDAVKAIELTEELAPNLLENDMDLHFDLISLHFIELIRSRKCTEALEFGQKKLTPFGKVSKYVEKLEDFMALLAYEEPEKSPMFHLLAPEYRQNVADSLNRAILAHANLPAYSSLERVIQQSTVVRQYLQQEVDKDSYPPFCLKAFLDK

SEQ ID NO: 125828 - protein, 281 aa, Triticum aestivum
  Clone ID: PAT_TA_20246.pep
GRVGGFAPDIWLWIRSLPGHWRADESHSLQICNSPSTNQSLNLVVTRQSEETHPFSLSFSICDKSRDHDPVSLWSSHYSKLKPANTTDVAAQFLLEIVCGVLRYGPYSSSRAIFRLPAVHVSEGSGKILSLSVLALAFLVCIYEAPSTPRREFIGAITARLTRDEMRHAARELMLALGSDLEEQWMRSLNLGVTNWAMEALRSGAGASSPLRFAVFSYALSASRLWKVQLYCPVVAMTMEHHPSHHHQQQQQHQLVKDERLLFSLNYQQLESVIQFTYRVA

SEQ ID NO: 125829 - protein, 127 aa, Triticum aestivum
  Clone ID: PAT_TA_20247.pep
GSRAESGALPGHSPGHTNGPPAPASPRPRTCPAAAPAGDANLAPLDAQTQLVFDNAYYRNLVAQRGLLHSDQELFNGASQDALVRQYASNPALFAADFVAAMIKMGNIAPLTGASGQIRRNCRVVNS

SEQ ID NO: 125830 - protein, 73 aa, Triticum aestivum
  Clone ID: PAT_TA_20248.pep
TCRTPRPPPTRWTGAATRCSASDRPPACFGCVTSLPLPAPGLTAAARLPTAKCFFYYLDRIGFLVSVLLPLKF

SEQ ID NO: 125831 - protein, 140 aa, Triticum aestivum
  unsure (1)..(140): unsure at all Xaa locations
  Clone ID: PAT_TA_20249.pep
AVALGFAXPSLDDGCGRRVEESTLFYMPHCEASLYDALLAANWEPXAQLRRVCXLGNSFRRYALQAEENRSGPAAKANLVLKAGRFAWEQRIDDAGDVDDEDWFARAFNETSWHFFEVDQDVDQRKEISSQALSFEKLSL

SEQ ID NO: 125832 - protein, 324 aa, Triticum aestivum
  Clone ID: PAT_TA_20250.pep
MAAMPTMVFEAGPMEVDVKHVDKSMIPNLAKPLMVVAPKEAGAYPVIVFLHGWNMLNSWYEQLLTHVASHGFIAVAPQLYWMVVSEPDADDIDATKRITNWLADHDKGLAYVLKDVFKLEHVEPDLSKLALAGHSRGGQTAFAVALGLGDAKTKLELKFSALIGVDPVAGVSRAQQLEPKVLTFEPDCLDVGMPVLVMGTGLGPKHIGGFPCAPVGVNHAEFYKECAPPRYHLVVKDYGHLDMLDDNVPYIINNCMCMRNQHDTKDLARRTMGGAMVAFLRAKLRIDVRDLIAIYHNPEIAPAVLDQVDEFLPCFVGRPNPSSV

SEQ ID NO: 125833 - protein, 337 aa, Triticum aestivum
  unsure (1)..(337): unsure at all Xaa locations
  Clone ID: PAT_TA_20251.pep
ARGSKPSNSKVSQVTNSGIFHMPIYSKENALYCDVCMRGETVLNRVSVCSGCKQAAVHIDCYKYLEICIGRWKCELCEDISPEDASSSDQSDSNGTKLSLVRCALCHGTSGAFRKTIDGQWTHAFCAEWLLETKYMRGQDDPVSGMETLVKEKDXCCVCNXKLXACLKCNSEDCHTTFHPSCARDAGFYMNTKGFGTVAQHKAYCGKHSSEQKETDAWKYWPEEVNSLKRTRVELEKFRLLCERVIKREKVKRETVLCDHDILPKTKDTVVFPYRTPGASSDPALLPLIIIMQLDHAHSDDFTIFPGKISFPLTFLKEHNLRYLNGFIGTFRFNDRI

SEQ ID NO: 125834 - protein, 137 aa, Triticum aestivum
  Clone ID: PAT_TA_20252.pep
RERAEKDEQLEYLMLLGVLAASVTYQSGLRPPGGVWQEDSAAYSAGDPMLFDINRRRYDIFFYSNSASFIASVVAIVMLLPLTLSNLERLRHCLPFHTGDPKWALWPVHAALLLGHARPPGGLRGRKYQELGVVQGM

SEQ ID NO: 125835 - protein, 137 aa, Triticum aestivum
  unsure (1)..(137): unsure at all Xaa locations
  Clone ID: PAT_TA_20253.pep
SGYNGGSGSSRRHSSILLGPGGRGRGEHIQTTGSGRRLDRPRRDHLHLRHRGHDSQLHPQRDHFSEPSPAARSGRGRRGASSPGAGHRGHLRGPRLGPIGGLSTRSNGHCGPSRSGGGLREASPAVKRXKQITXGEG

SEQ ID NO: 125836 - protein, 76 aa, Triticum aestivum
  unsure (1)..(76): unsure at all Xaa locations
  Clone ID: PAT_TA_20254.pep
GGWGPRGSWGXNFIXPXRAKGSPVRXGCPXLXXXXGGLXXXEADGKVEEAKAALRPMLDEVMVLDFVVDDAAAASL

SEQ ID NO: 125837 - protein, 87 aa, Triticum aestivum
  Clone ID: PAT_TA_20255.pep
CCKLKTNEEPTPHSMRHDSRWNGHGHVYMFSMFTMVVHRRRKEAQSAEWGVGCKGYDEKVKSITIRSVVPFQMMHSLQNQIMLTTER

SEQ ID NO: 125838 - protein, 167 aa, Triticum aestivum
  Clone ID: PAT_TA_20256.pep
AKRILANRQSAARSKERKIKYTGELERKVQTLQTEATTLSAQLTLLQRDTSGLTTENRELKLRLQSMEEQAKLRDALNDALREEVQRLKIAAGQAPNMNGSQFNGGLQQIPSYFSQQHQRQRQQQQQQQMAYLGGHQAQRHHPNHHQSPSNGGIAEWSVPRRSMDFI

SEQ ID NO: 125839 - protein, 163 aa, Triticum aestivum
  unsure (1)..(163): unsure at all Xaa locations
  Clone ID: PAT_TA_20257.pep
MADESWRLPNSVQQLAANMQEPPSQYLLREQELLGAHLAGAEMPEPVPTIDLGLLSASNDPEEAAKLRSALQTWGFFQVSNHGMEASMMDSVFTASREFFHLPLEEKKKCSNLIDGKHFQVEGYGNDQVRTQDQRLDWSDRLHLRVEPXXGRNLVHWXTHPKS

SEQ ID NO: 125840 - protein, 197 aa, Triticum aestivum
  Clone ID: PAT_TA_20258.pep
MDEQFILRVPPSVAEQIERLMNESAAGSSSNPDDASLDLSFSEDGRSGTFMIGNQRFPASLLDLPTVMESYKTYDDSFLVKTADIGQMIMVREEDDPAPEGVEYKHGLTPPMRDARRRRFRREPDLSAELVHRVEKDLISIMQGVPVNHNVGLAGGGEGGDRKKAAPAPAPKPDVQEPAANGEEAEADRSDSDESDS

SEQ ID NO: 125841 - protein, 148 aa, Triticum aestivum
  Clone ID: PAT_TA_20259.pep
YPFLTISLHVSLFHMLSGLRYFKSINLFVGVILCHISPKAFPKKCCYCGDYPWSQLSLYHLGGRSIFISMVLEHMLTIGRDPRNWQAHSKDFSLQLSLSKRSFTSLLFRAYSKIPFSENISLSPFDHTKIQLMRPLQEVQDIGQLRPL

SEQ ID NO: 125842 - protein, 146 aa, Triticum aestivum
  Clone ID: PAT_TA_20260.pep
MHPTVPFIQRHVHADAAGFLGVGGTTSDLLMQVSVGAIGRYTKTWTDPDEFRPERFLPGGEAEDVGPLPGPKEIRMVPFGTGHRFCPGVGLAMMNIKCFLAALVHESHWKPPTVGCAGVDVTELNTFVKGMKTPLSVRLTRRTLSS

SEQ ID NO: 125843 - protein, 106 aa, Triticum aestivum
  Clone ID: PAT_TA_20261.pep
ALLPFCVIPINTHTRAPGCLAEMEGRKETRGKRWSMVNDAIVRAFYCTRDSNHPSISASTRCSVAWGSQCRNLQCGNIQCTWEHKPPDCVRQRSHRSPTPSPAGSS

SEQ ID NO: 125844 - protein, 97 aa, Triticum aestivum
  Clone ID: PAT_TA_20262.pep
TNETLYYRSSETSREMPSSAPEKSMRQQQQQSDKSIRSPQDMGKQGSEASPPVSGTGKPGRTPGQDLLESQEQASPDTQQVKNNRDNSKSDGSSKPT

SEQ ID NO: 125845 - protein, 69 aa, Triticum aestivum
  Clone ID: PAT_TA_20263.pep
YHRSGGSNDDDDNEREGEGSGRRISVISVDHQITLLIIPSHPNSNPCTIIILVVCYYNYCAVMICWIYI

SEQ ID NO: 125846 - protein, 86 aa, Triticum aestivum
  Clone ID: PAT_TA_20264.pep
APVLNLDTCYDFTRSPKVTLPKVSLVFAGGATVPLDAASIMLGGCLAFAAIPGNGSLGFIGNIQQQNYEVLYDVGGGSVGFRRGAC

SEQ ID NO: 125847 - protein, 234 aa, Triticum aestivum
  Clone ID: PAT_TA_20265.pep
MAAVPAVRFPLFGLVRLLGVAAAAVILVWAVHFRGGMALSAEKDKLLIFNVHPVLMLIGLVVLNAEALLAYKTVPGTKKLKKLVHITLQFLAMFLSLVGLWAVWKFHDEKEIDHLYTLHSWLGLSCIIIFSLQWAAGFLTFWYPGGSRSDRASLLPWHVFLGVFLYVLAIATSVTGLLEKSIFMQSAKMIGRFSTEAMLMNSLGMMLILLGALVILAIFNPGAGKINTYRGSSE

SEQ ID NO: 125848 - protein, 220 aa, Triticum aestivum
  unsure (1)..(220): unsure at all Xaa locations
  Clone ID: PAT_TA_20266.pep
SRLSINYCPKLRMGPLLPRAGCRLEIRRSDNVLSSWGECTTSSTGASSSSASPVLTPTDTLIVEYSELPMQQWRLLRHLSGLDHLGARVSPCSVPRPCPPSHPFPPGKLRGLFQLRRSAFPPSPEGLKPFSXLPYNGCXSTSXPGGHTTITXSKYLNWAVHIXELDXPRKQENWSHKNKVLLNNTQRIYQAXRWELPITKXTTIRIXKXHDQGLXNPYKT

SEQ ID NO: 125849 - protein, 201 aa, Triticum aestivum
  Clone ID: PAT_TA_20267.pep
MDGKGATESSNPNRVVESVPSAAVASASAPTKRMLAFHFLRALSRIHGAAGPARRRTRTIRRAAYSSMARATGPRRAWSRALLLQAQARARRSRAETSRRAAVLVRRRVVAGPAAAAPASVALAPVVGQPSSAAARAALVPPAPPARQAGEPARSDALRRLVPGGAGMEYCSLLEETADYVRCLRAQVQLMQGLADLFSCQ

SEQ ID NO: 125850 - protein, 132 aa, Triticum aestivum
  Clone ID: PAT_TA_20268.pep
EEDDIIHDGQRIPTGTNVLFPLKSLAQDKATWADPDEFKPERFLADKGGENISLVAAAGSGGEIRMIPFGAGRRVCPGMGVAMLHMGYFTANLVREFEWREAEGELAVDLRPHFGFFTVMKHPLRAHLAVLP

SEQ ID NO: 125851 - protein, 233 aa, Triticum aestivum
  Clone ID: PAT_TA_20269.pep
MRRKLAGDAPASASAGGCSVPSEADLAQLSTAISAGEDLGPFVRRAFACGRPEPLLSSLRAVARDRESEIEELCRAHFHDFIRAVDDLRSLLADAEVLKGSLSASHSALLSSSAPLLASLESFLAARALAGNLSSALAFSHRCVRLLALAARANDHLQAGNHSLYLALRAVDAIDLNLASGPEPLPLPALRRMLLSLVPAVRVHAEREISREFADWMVSIRAASRHLGQVAIG

SEQ ID NO: 125852 - protein, 266 aa, Triticum aestivum
  unsure (1)..(266): unsure at all Xaa locations
  Clone ID: PAT_TA_20270.pep
MASPSPSPSPDWAGLPDDALLTVFERLGAPEVLMGAGVVCRNWLRVATGEPDLWRRVDLSDCFDPTIDMVAMAXRRVDRADGRLEHFAADCFVTDALLFYMGKRTNGLKSLRLVNCMKVSHKGLVALGKRSPHLEELELTTCSIYISMKAVGQAFPQLKRLRLNNRWVNVECEEQFDNHRALDIASNMPELRHLQLFANRLRNSALAAILDNCPHLESLDLRQCFNIHIDAELRAKCARLRDVRLPKDSTNDYDHEAYIETLELNS

SEQ ID NO: 125853 - protein, 85 aa, Triticum aestivum
  Clone ID: PAT_TA_20271.pep
RQRRPCRRRDARDQWALLARDRLEWLRVIRPPVVHRPVYACLAFFLVVHVVHGPSIDHSWRRFFFSLSLSIFSSCQLLPSYDPIM

SEQ ID NO: 125854 - protein, 90 aa, Triticum aestivum
  Clone ID: PAT_TA_20272.pep
VISWLDHLAVASYESRTCKVEFQLQARQKGERIPKERKRKGMEESMERVLLQAAPQESHLFEAPACVNSKQPPPEKKQSVSQHPAAVILP

SEQ ID NO: 125855 - protein, 247 aa, Triticum aestivum
  Clone ID: PAT_TA_20273.pep
MRQADPEKKRPHRSKVSRPPRPSFVVADAKNKDRNKRLDRLENLITERPELAQNLNGRVAWEGDALQEVLGKEKIGQVHGMGLLPTPKQVYGRTPRYLKNINMTRTDGSPYEVEHDVWEVIAKMQEHIKKQDQIIKDMNNKEGYVNNGIEEENLQSNDNGISRSPVLLGETKRIQCNGPVEACSSMQHHIPEDNNLSCSHEKVMPVVTLTHVTKIEYKIIACLPLLCHGTRLATMMSTDYKFNKIHH

SEQ ID NO: 125856 - protein, 235 aa, Triticum aestivum
  Clone ID: PAT_TA_20274.pep
ILQEPPENAVITTCCHIFCYECAQESLSEEEVCPVCKQKLSSELLFSRPVLRLCISDELESYAITSSAAAAAGNSSAASASASSAAVVAAAGADNSASSAAAAAAAGADSSAAAAAAVAAAAAGGAAAAPPEISGGRVTRSSHPSSRAALLTRCSLFNSPPPFGLACSSAWSLLPIHFINKLMGNVPRHREHSRFKVTNVNDPTEALGKHINSISEPSGANATFVRIHHAMETTE

SEQ ID NO: 125857 - protein, 130 aa, Triticum aestivum
  Clone ID: PAT_TA_20275.pep
SNSTVNISAYVALLLLLKLVCSLNLNAISIHSEEAYPLSLTTYSFDLSNNPKDPFKLVLNVYAASVLYGTRKHVERILSSVEKTIAELFQGLLDQLGYFDRFLRGCDREGTRPSPSSFLDSPNPLIAKPP

SEQ ID NO: 125858 - protein, 188 aa, Triticum aestivum
  unsure (1)..(188): unsure at all Xaa locations
  Clone ID: PAT_TA_20276.pep
FGSVVAMEGSTASCSSVASFSSAVAAAGSSAFFSAAGASTSLSSFXTESGSTRFPPSTTCASRASSGSRISAVRGGSAGGAAGRSGRCSSAAPVGPAVAGAGPTAFFSASGASTSLSSFSLSRSLRDLRRLPSAAGSVSATATQATFFSAASSRTTGASPFTLRSAGFVAHAPISTAAPPLERGLTEA

SEQ ID NO: 125859 - protein, 69 aa, Triticum aestivum
  Clone ID: PAT_TA_20277.pep
ERIPIPSDEFLASMEGTDITNQMAVGHFHHIFYEGCSTDFDIEEDGEEASLLYPEVRCTRMEDYMKRYL

SEQ ID NO: 125860 - protein, 320 aa, Triticum aestivum
  unsure (1)..(320): unsure at all Xaa locations
  Clone ID: PAT_TA_20278.pep
MHEAGRRARFWVVGGTGYIGRRIVRASLAHGHRTFILMRPEMRPRTSDKLQLAVCRSKAHGALLSLRRRWRTXGSLVAAVGKQVDVVXCSAISGASLPACSCKLGGGHQKEAGNIKRFXPSEFRHRPSKEWGTLIEPGRITFXDEKMXIRRAIEEXNIPHTCVSANCFAAFFVPNLSQMRTLLPPKKKVHVYGDGNVKVIFMAIFYLTKNTIKSFDDPRALNKTIYLRPPENILSQNEMIAKWEKLSGKVLEKIPIPYDEFLASMKGTDLTNQVAVGHFYHIFYEGCLTNFDIXDDGEEASLLYPGVLYTRMEDYMQRYL

SEQ ID NO: 125861 - protein, 142 aa, Triticum aestivum
  unsure (1)..(142): unsure at all Xaa locations
  Clone ID: PAT_TA_20279.pep
PPCKHKRRHLDPTHLPARYHLLRRRWPWHPERCSSWPSGSSSSPRRAPPAAARGSCPTDGLKLKACVDVLGLLKLKVNVPRHEPCCSLLDGLVGLDAALCLCANIDANVLGLNLHLPVDLRLILNXNCGKVCPTDFRCPPRH

SEQ ID NO: 125862 - protein, 231 aa, Triticum aestivum
  unsure (1)..(231): unsure at all Xaa locations
  Clone ID: PAT_TA_20280.pep
AWSRPRYMAQFYQYLEMGLQNFEEYQVCAITVGVVGDLCRALEDKILPYCDGIMTQLLKDLSSNQLHRSVKPPIFSCLGDIALAIGENFEKYLIYAMPMLQSAADLSAHTTATDDEMLDYTNQLRNGILEAYSGILQGFKSSPKTQLLMPYAPHILQFLDALHNGKDMDDSVMKTAIGVLGDLADTLGVNAGPLINQSTSSKQFLDECLSSDDPLVKKSXNWARIAISRRV

SEQ ID NO: 125863 - protein, 101 aa, Triticum aestivum
  Clone ID: PAT_TA_20281.pep
ACAPSSPPPPPGAPPPPRRPRCRASPPPRPAWPPPRPPLRRRPSARLGRSAPPPRACAAARLGTDWPHSLGPPPRPWPVLRASVRVGPRWLAAVTVSVSCS

SEQ ID NO: 125864 - protein, 260 aa, Triticum aestivum
  unsure (1)..(260): unsure at all Xaa locations
  Clone ID: PAT_TA_20282.pep
QSKKRKLFSSDIFWQSFPKPPGSSSGSTPKSAEEQSAPANLRVCSVEADAPDKFCSDKHAGEHQAPAEPQVLAVEADVPAAADVPLVLVVEPQAPAWAQQIVHFLQTGELPEEQEEAERVARQSSVYQFVDSILYRRRLNGVKLKCIRREDGQKLLAEIHGGICGHHIGARALAGEXFRQGFFWPTALQDATAQVTKCEACQFHSKQXHQPVXSPDDPLSGIFVWGRYLGLSPSCRGLDLYIESTSYKWPKSVGSHSSNF

SEQ ID NO: 125865 - protein, 46 aa, Triticum aestivum
  Clone ID: PAT_TA_20283.pep
RKKGASLYLAKIGLAFVFLFLLGGLFTYLLETIPDMILASTPPQSI

SEQ ID NO: 125866 - protein, 87 aa, Triticum aestivum
  Clone ID: PAT_TA_20284.pep
SSPGISHCLIYNKNRRCPAALHGDLIVVAGVPCLIYRKNSAASAALHGDLIVAADVLSPDLQKNSLTASRGSTWRSSRRHGCLWFDQ

SEQ ID NO: 125867 - protein, 137 aa, Triticum aestivum
  Clone ID: PAT_TA_20285.pep
MAAATTTASRPLLLSRQQAAASSLQCRLPRRPGSSLFAGQGQASTPNVRCMAVVDTPSAPAVAPARKRSSYDMITLTTWLLKQEQEGVIDNEMTIVLSSISTACKQIASLVQRAPISNLTGVQGATNVQGEDQKKLD

SEQ ID NO: 125868 - protein, 408 aa, Triticum aestivum
  unsure (1)..(408): unsure at all Xaa locations
  Clone ID: PAT_TA_20286.pep
MRAATTTTSRPPLLSRQPAAASSLQSRQPRSPGSSLFADPGQASPPDVRCTPGVDTASAPAPAAARKRTSCDRSSLRXEPEGVIADEVTIILSSISTACKQIASLVQRAPISNLTGVQGATNVQGEDQKKLDVISNEVFSNCLRWSGRTGVIASEEEDVPVAVEESYSGNYIVVFDPLDGSSNIDAAVSTGSIFGIYSPSDECHIGDDATLDEVTQMCIVNVCQPGSNLLAAGYCMYSSSVIFVVIIGLTIGTGVYVFTVDPMYGEFVLTQEKVQIPKSGKIYSFNEGNYALWDDKLKKYMDSLKEPGTSGKPYSARYIGSLVGDFHRTMLYGGIYGYPSDQKSKNGKLRLLYECAPMSFIAEQAGGKGSXGHQRVLDIMPTAVHQRVPLYVGSVEEVEKVEKFLSSE

SEQ ID NO: 125869 - protein, 162 aa, Triticum aestivum
  Clone ID: PAT_TA_20287.pep
LKKHDSLSGSCSDNVVTHPSLFFLLTGFFLTVILACGIYNCPCTQVFRVQDIAEHLTTIHLSRCERARRGRGERSSPLGASPLGGCPAAWCAAALSTPELSVIHIWDKGFDDDGSQVWGTKAGPYEFKPAPKSNYDDMFSPLNFSAPLSLEKMESSHAIDDQ

SEQ ID NO: 125870 - protein, 112 aa, Triticum aestivum
  Clone ID: PAT_TA_20288.pep
FCPIPELCPHVCIHASCCFSMFFSHGLALPSSYCPLFLFFPFRRAHSAVGVIAYFLLPLSGTLPVLRVQSRERCARFGYFSSAVNSSIVRLTAFIMFSPTRKCISPGVYYNG

SEQ ID NO: 125871 - protein, 65 aa, Triticum aestivum
  Clone ID: PAT_TA_20289.pep
TVCTLYTLVLFLSRLHHPKLETRLHGMHIYRGGRKIAKKGRKLDETTIRFFLVSLVLGCLLLHER

SEQ ID NO: 125872 - protein, 198 aa, Triticum aestivum
  Clone ID: PAT_TA_20290.pep
MSGAVLVAIAASIGNLLQGWDNATIAGAVLYIKKEFSLETQPLIEGLIVAMSLIGATVITTFSGAVADAVGRRPLLIASSVLYFVSGLVMLWAPNVYVLLLARLIDGFGIGLAVTLVPLYISETAPTDIRGLLNTLPQFSGSGGMFLSYCMVFTMSLMPQPDWRIMLGVLSIPSLMYFALTVFYLPESPRWLVSKGRM

SEQ ID NO: 125873 - protein, 141 aa, Triticum aestivum
  Clone ID: PAT_TA_20291.pep
MGLLDQLWDETVAGPRPDHGLGRLRKYSSFSTSTPAAADVAPAVTRSITIARPPSLSLPSGESNSVPSSPASGPDSPLAAASIARRRGWPGGAPLPPSRQLQCQFGNTAGHRPTYTTVPTGASSCTTPSVRSPRVPTPPGR

SEQ ID NO: 125874 - protein, 117 aa, Triticum aestivum
  unsure (1)..(117): unsure at all Xaa locations
  Clone ID: PAT_TA_20292.pep
TDPTLDGRYADRXRXTLPRPRRRGAAAEMDAGSCGTFDTSYYRQVARRRGLLRSDAGLMEHPFAGAYVRRAATGRYDGEFFRDFRVSMAKMGAIGVXSTGNQGKIRTKCNLVKLNVL

SEQ ID NO: 125875 - protein, 84 aa, Triticum aestivum
  unsure (1)..(84): unsure at all Xaa locations
  Clone ID: PAT_TA_20293.pep
SXSRTCVVLGSRXYPPKKKAGRLVHTITLKASINQSLVNGKPPSGSPYFYRHQGSQLMPIISGSKLWHLASLFSHQNCSFIQFL

SEQ ID NO: 125876 - protein, 234 aa, Triticum aestivum
  Clone ID: PAT_TA_20294.pep
MVAAMEEEASKGGSEETFAVVNPAGQAAVTGSGDGANHQTGEHDATITRPPPPRSNNYGAVVIGGTFDRLHRGHHLFLQAAAELARERIVIGVCDGPMLAKKKYGYLIQPIETRMENVKDYIKSVKPDLEVHVEPIIDPYGPSIVDEALEAIVVSKETLPGGHAVNRKRAERGLTQLEIEVAELVPEKSTGNKISSTAFRKMQHQKLDQQEVLQTVQLECTVELDILSYVPLAD

SEQ ID NO: 125877 - protein, 106 aa, Triticum aestivum
  Clone ID: PAT_TA_20295.pep
TAARKLSGSSSEVVTCHDLTFPYAVYYCHTSSPTAAYMVTLASVEEGASPATMEVMAVCHLDTSLWSPKNPFFELHNVRPGDVAVCHFLTKLSIIWVTVDEHADTL

SEQ ID NO: 125878 - protein, 152 aa, Triticum aestivum
  Clone ID: PAT_TA_20296.pep
MVHFKNRYMVMEVFIDASRGEADPVILTQFNITKVIRDSIQLNFGECGLAASLGSLQVKYVNPVTKLCVIRVSREDHQKVWAAITMVKSIGKIPVSFNLLDVSGSIRACKKAALECEEAKFEQYKLAAGDRMTQEIIESMQSCFAKLKGLDS

SEQ ID NO: 125879 - protein, 270 aa, Triticum aestivum
  Clone ID: PAT_TA_20297.pep
PGALSRPGLPVSVPVSGAHFTPRVRDYQDKLFHNDDGRLEFAGDNWAALWPGTGKPGLWVSAMSRLAALYRLIATDEQLRHMEEGSTKTTADEQDAGLELRIPPVFDRCSKVLDPGEQIAGRDLYWDAIRRDGKEGAESLLRRCIAKNPYVGEPWLVLAQVLLNGGGRWEEAEAAAAEGLRLVLEWGSSWDKRMSWEGWVSWGRVMRDKAKEKQWPRSAWGIINLGLVKHIHDHDWPPFLPPPALVLSWRVPGASGSALVCCVRVWYLSM

SEQ ID NO: 125880 - protein, 368 aa, Triticum aestivum
  Clone ID: PAT_TA_20298.pep
VTLITDEDESAPDLDKMGDFNLAHRVVLAPLTRCRSYGNLAQPHNALYYAQRAAPGVLLVAEACAVSEAARGYPHVPGLWSQEQVEAWKPVVDAVHGKGAVFFCQLWHTGRVSPTEFQPNGQAPVSSTDKQVPPQVAHDGSVLEFAPPRRLATEEIPHIVNDFRVAARNAMRAGFDGVEIHAGNGYLIDQFMKDGVNDRTDEYGGGLDNRCRFAAEVIAAVCHEAGAGRVGVRLSPFADYVDCVDSDPEALGLHVIGVMNGLGVLYCHMIEPRMCVNERMIPRRLLPFRRAFRGTFMVNGGYDREEGDKAVVEGYADLVAYGRLFLASPDLPERFGRNAVLNKYDRSTFYTSDPVVGYTDYPFLDPED

SEQ ID NO: 125881 - protein, 258 aa, Triticum aestivum
  unsure (1)..(258): unsure at all Xaa locations
  Clone ID: PAT_TA_20299.pep
SRATRTHTWEQEKKLKVLCLHGFRTSGGFLKKQISKWHPSILQQFDTVFPDGQFPAGGKSDIEGIFPPPYFEWFQFDKDFTEYTNLDECIAYLCDYMVKNGPFDGLLGFSQGATLSALLIGYQAQGKVLNDHPPIKFMVSVSGSKFRDPSICDVAYKDPIKAKSVHFIGENDWLKVPSEELASAFADPLIIRHPQGHTVPRLDEASVKQLSEWSASILXEPKNADAPKASDSESPVDKDNVGVQSAENLMGTSCSLRQ

SEQ ID NO: 125882 - protein, 148 aa, Triticum aestivum
  Clone ID: PAT_TA_20300.pep
MAMATSVCLPRPLATGARASISLPARPRRLPRPQRRPHRLGGAAVGMDALHVSSRDAEPLLRPVSAAAAATAHRRLRVRTHAQGADESAKDAGDGAAAGADYSLAAVILPFVFPALGGLLFGYDIGATSGATISVHSAELSGTTWFNL

SEQ ID NO: 125883 - protein, 90 aa, Triticum aestivum
  Clone ID: PAT_TA_20301.pep
TAVLLLVIFISANFIPSIWDAFQFTGATAAVCIAFIFPAAITLRDPHSIAKKWDKILAIFMIVLAVTSNVVAVYSDAYSIFHKKSASSNA

SEQ ID NO: 125884 - protein, 130 aa, Triticum aestivum
  Clone ID: PAT_TA_20302.pep
MTVEKVDATVADFDGHFERLFASDDGGKLKLLLFLADREPSSSLTWCPDCNVAEPVIYEKLESLGKDVVLLRAFVGDKPTWRDPTHPWRVDPRFALKGVPTVLRWDKGAAAGRLEDDEANVGAKIDALLN

SEQ ID NO: 125885 - protein, 120 aa, Triticum aestivum
  Clone ID: PAT_TA_20303.pep
LAHKCKGTSVKDGTKLYKNATGKDAELQFTTSAEEIVSDSSSAQNVAEKAADLIDGKVEAEGSTGGEEEEEDSADEGALRTIKPSAALGWKYVAAALLAVVAAVVVCHLLLENGWEGRMA

SEQ ID NO: 125886 - protein, 290 aa, Triticum aestivum
  Clone ID: PAT_TA_20304.pep
MGQEEEAQSLALTPTWVVASVCLVIVAISLAAERLLHRLGMVLKFNGQEELFSALHRLKDELMILLLIVGTKLEHISTRLAQEAAECSDEASGNPWTKPCKEHFWFSHPRAVLHLIHFILFQNSFEMAFFFWVLATYGFDSCIMENRSYAIPRLAIGIIVQVLCSYSTLPLYAIVTHMGGDIKLQAFGEHVHVSVHSWATDVKKKATSLPAHPHPHQHPHSHLRIPFLNKKRHSGRDPATEEAAAAARATEQRAGSSSSPTAPPQQRADDLEEIVTTTEEDHRRRNASFS

SEQ ID NO: 125887 - protein, 151 aa, Triticum aestivum
  unsure (1)..(151): unsure at all Xaa locations
  Clone ID: PAT_TA_20305.pep
LITRFASKNLTADEMVTLSGAHSIGRSHCSSFSSRLYPQIDPTLNNTLAKALRAGKCPAATGPLDRVVQLDAKTPLQLDNQYYKNIGTHEVLFNSDQALLDQSDTAALVGQYXXPNRKLXWSQKFAPAMVKMGYADVLTGAXGEIRKSAAA

SEQ ID NO: 125888 - protein, 142 aa, Triticum aestivum
  Clone ID: PAT_TA_20306.pep
PVPVAFFLMWKLHDVNTLIAGTALIGLSSGFIFAAAVSVTSELFGPNSIGVNHNILITNIPLGSLLYGQIAALVYDANGLKSTVLDNLTGTVDTMIVCMGAKCYSNTFFVWGCITVLGLVSSIALFLRTRQAYATAAGQSKL

SEQ ID NO: 125889 - protein, 148 aa, Triticum aestivum
  Clone ID: PAT_TA_20307.pep
RHDVCLSLSYKWGNSIVRGLCRPTTPVCFVFRSSSPLCWPGDFSCELRELRAAILQSPDPPKKLKISREVDIFFSKYLRKPIFQEYTLFVDIEGFPVSYENYLNSFKARGEIGDEVMNSFIQVLNYQSKMSSEVNPSLKKYCFTSVLH

SEQ ID NO: 125890 - protein, 114 aa, Triticum aestivum
  Clone ID: PAT_TA_20308.pep
KVAHSPFSCSCTLILLPSTLNYMRPTVKMPRLETPCFYGPKLETYSRKILRTPVNNRRQHSQLPRLPHQFYGLKCVRGRRNGRSLEQYCNTNTVGRSFCKLQQDVVPQKSQHTR

SEQ ID NO: 125891 - protein, 100 aa, Triticum aestivum
  Clone ID: PAT_TA_20309.pep
MDLLRKELEKKRKAATADFGGKNFVRRSELEDKQLQKRRQIPAKVPSVPTPNFSAASDPTNSNADPAQAGGGNPNPSSAAAASVPPALAGKKAPPEDTLH

SEQ ID NO: 125892 - protein, 431 aa, Triticum aestivum
  unsure (1)..(431): unsure at all Xaa locations
  Clone ID: PAT_TA_20310.pep
MDLLRKELEKKRKAATADFGGQKFVRRSELEDMQLQNRRQLPATIPSVPTPNSSAASDPTNSNADPAQAGGGNPNPSSSAAAASVPPALAGKKATPEDTLHSEERRIDELVLPRNEVMRRLRVLREPVTLFGEDDADRLDRLKLVLKSGAIDDIDDLEMTEGQTNDFLRDMIELRMRQKAGRDAYGKGKGKRVGAGDXGEGGAPGEDGYGGCEDGRGGCPQEGTGGGLKPLPPKLKERRKPEKVIVKVMSVRNEWNQELDDMTELEKRSAKGKSMFATFKQCARYLSPLFEFCRKKVLPDDIRKALLFIVDCCMKRDYLQAMDQYIKLAIGNAPWPIGVTMVGIHERSAREKIYTNSVAHIMNDETTRKYLQSIKRLMTLCQRRYPALPSKSVEFNSLANGSDLQALLSEEKNPTKGPSEDRLRLMPASKE

SEQ ID NO: 125893 - protein, 123 aa, Triticum aestivum
  unsure (1)..(123): unsure at all Xaa locations
  Clone ID: PAT_TA_20311.pep
VLNCNTYEVATACALAIEADKLICVVDGQIYDEHGRVNRFMSIEEADMLIRTRAKQSETAANYVKVVGEEDISYAHNFPIKEEKEQVXVGRDFISDYTASFRNGVGFNNGNGLSGEQGFAIGG

SEQ ID NO: 125894 - protein, 108 aa, Triticum aestivum
  unsure (1)..(108): unsure at all Xaa locations
  Clone ID: PAT_TA_20312.pep
LASKLIKLEILIELNKXIPSDTHSFCXLAKQFISLXFGIDGDACILGXKKRXXRSXLXMIXEXTQGGPVPIXLNDPYXATAVXKXLMETRXPIXXXNPXHXXQRRRAS

SEQ ID NO: 125895 - protein, 64 aa, Triticum aestivum
  Clone ID: PAT_TA_20313.pep
TESKSWRGRAMLPCWLPSSSSSSQAAVGEQSISYKSLDQAHQGVPEAWHLRSAWILPTPRGAKC

SEQ ID NO: 125896 - protein, 172 aa, Triticum aestivum
  Clone ID: PAT_TA_20314.pep
PAPSSPTTPPTCSTASPPSPPTPRSSPPGSRRPCSSSPPPPPAPRGRRRPRRWSTRPPPGAGPRPSPRRWSRWLPSELKDRCQRRDLGGTVRVRQANRVAGYLYLTLRTCMRSVLSSGCIAFCSFHFLLLHSADTGRNPINRAFFTISDRCLNKIFISDLKKKKKGATNPPI

SEQ ID NO: 125897 - protein, 98 aa, Triticum aestivum
  Clone ID: PAT_TA_20315.pep
RKAPAGEQLSSTAGPRRMLVHESSGQPVSSLEELEALLADLGWERDEDDGTALLKFYKPGSQPDPLTLSLPRDLADFTSVHMRDVVVKNRGSFHVVER

SEQ ID NO: 125898 - protein, 133 aa, Triticum aestivum
  unsure (1)..(133): unsure at all Xaa locations
  Clone ID: PAT_TA_20316.pep
MGRVAIWIACVLLLAATCQGKGAPGHRVRVGYYNRKCPAAESIVRAVVGKAVSRNPGLGAGIIRMAFHDCFVQGCDASVLLDATPANPRPEKLGPPNFPXLRGFQVSTRCRGRSALPGPAPARRYRRERSASK

SEQ ID NO: 125899 - protein, 137 aa, Triticum aestivum
  Clone ID: PAT_TA_20317.pep
NMRLHQLQSSHHAVAQNWMLTFLGSFSELQHPAPELGLLKAIHGRHNCHHLQHLSLLEQKLNQIQSTLALINVLHPNFPEIPDDHPSTTNNTILNFTVAAPSPLGLRWHDRHRKFLHIGATRKQWCNGQSTFFPPLY

SEQ ID NO: 125900 - protein, 68 aa, Triticum aestivum
  Clone ID: PAT_TA_20318.pep
RHHKLHGDIKCSHLHRNPTYVHSVASDSCYQPRNYNCPFILHPALYQNDPTHAKLALQTQPLPSLSSH

SEQ ID NO: 125901 - protein, 292 aa, Triticum aestivum
  unsure (1)..(292): unsure at all Xaa locations
  Clone ID: PAT_TA_20319.pep
GLQVCVFYFTRKPPTAPFDLRFDXEAPKVALPQGMMAPVNSFNTLFHAQGFXWGLMMPVSVSSMAADVIRGYWAQRILWEIGGYVAFYPPTIYRKDHVQAYPFAEEKDLHVNVGRLIKFLNEWRSNKQSLFEKILDLSYAIPRVRFWMEQDVRLTAAWLQDLLAAGYRQPRLMSLEIDRQRATIGEGDMKEFVPKKLPSVHLGVDEIGTVNYEIGNLIKWRKNFGNVVLIMHVSGPVDRVALEWRLLYGRIFKTVIILAEHSNAELAVERCPLSHAYKYLPKVFARYGGADG

SEQ ID NO: 125902 - protein, 137 aa, Triticum aestivum
  unsure (1)..(137): unsure at all Xaa locations
  Clone ID: PAT_TA_20320.pep
FSKERXPSTRLQHNARHGRRGGAASLLERLERPEETCKSSNGGHRGDDGRAVPVTEPVHLDPQPPMGPVVFNRYNDVVIAVPGAQVLLKPGEQLECVPVGEASSSLQYKLISQLLHISIIVGDHPQKAEVGADSRPC

SEQ ID NO: 125903 - protein, 109 aa, Triticum aestivum
  Clone ID: PAT_TA_20321.pep
QQIPVAVALVALQEKQIPVAVAVVALHRQQVPVDVPATSGPGSALFYMSSSDLLELDEEQWFGGMDAGSYYASLAQGMLVAPPDERARPEDGEQSGVQTPLWSQSHLFN

SEQ ID NO: 125904 - protein, 159 aa, Triticum aestivum
  unsure (1)..(159): unsure at all Xaa locations
  Clone ID: PAT_TA_20322.pep
RRGRRLGRRRRRRRLVAARQRRCRRRQRGRRGLRRPRDLLPPVPGAVAREVRTQVDALHHCFSWRHADRATAKRATSVLAELAKNEEMVNVIVEGGAVPALVCHLKVPPMAAAVEEEXKPRPFEHEVXEKGAAFALGLLAVKPEHQQLIVDAGALPLAG

SEQ ID NO: 125905 - protein, 287 aa, Triticum aestivum
  unsure (1)..(287): unsure at all Xaa locations
  Clone ID: PAT_TA_20323.pep
NKPTRPIEESIPTQDASELEMANDASVHGHECHEEKHEGETSVIEYRTESLNTVAQNMETRLSQAIAEKKKAEKLLEELEKASRPSKAETRETISEEERYMLRKVGLQMKPFLLLGRRGVFDGTIENMHLHWKYRELVKIICKEHSMEDVTYAARTPSAESGGILVAVERVSKGHAIIMYRGKNYQRPSALRPKSLLNKKDALKRSVELQRHKSLKLHVLNLSKNIDYLRGQMQTEGHPVALSNQMNSGHENKGMHDLCDNSGTSGEXKQMPEVAPECFEPRGEECS

SEQ ID NO: 125906 - protein, 66 aa, Triticum aestivum
  Clone ID: PAT_TA_20324.pep
SAGFSTALDSGGNYMVLDSGSGALCVTVMGSRGLSIIGNFQQQNIQFVYDVGENTLSFAPVQCAKL

SEQ ID NO: 125907 - protein, 135 aa, Triticum aestivum
  Clone ID: PAT_TA_20325.pep
EVKAAGDNIVGVILLQELPHLSHLGVRARQEQVVFVTCEDDDKIADMRFVEGKHVRLGASSSDVELSVSDEEASDISSEAAIIQKPSNEFSSALTTDESSLLSEPKSYTSGENGSSSVLELAEASIESSGAKAKT

SEQ ID NO: 125908 - protein, 138 aa, Triticum aestivum
  Clone ID: PAT_TA_20326.pep
GPHRHHGEQAGNPFVFLKRFGIMVAQTKAFFDSRPAAATTSTTSRSSPSAPAFGSTAAPVLRQSTDITRTKLWLMLLCIWLLVIATTSAKSLATKWFTLSPKLLKQRTCYMNLGQNGRWRHEVVCLQRMCQLVMVNQD

SEQ ID NO: 125909 - protein, 122 aa, Triticum aestivum
  Clone ID: PAT_TA_20327.pep
SEHGFRQQEDYPLLPAGTRHLSLAHAWQYDDARRLLKPQELSGKESHRRGSHRPAPCSPCSAPPGAGPACRGRCGGRVPVAQNQGSAGRNPCHIDFVRCESSHFLRFGNSSPPLQSTPKSRT

SEQ ID NO: 125910 - protein, 102 aa, Triticum aestivum
  Clone ID: PAT_TA_20328.pep
TTPWHLGSMAGSALKMAAICAVLVILLSGVGQPAMAYVDGLACPSAATPCRADCFPVCNDSAPLVCNKLCGLTPSGLGVVDKACVDHFFTACMAICKNMCEP

SEQ ID NO: 125911 - protein, 273 aa, Triticum aestivum
  Clone ID: PAT_TA_20329.pep
TGGGTPSGLHRGSRVLHDGEPGPTAKRQRPSHLMPSHSSGLQSPVMSSHSVPSSSKWGPSSASRGKRAKSTTPLALPSMDPTSLISRKVFTRWPDDNNFYEATITRYNPATGEHALVYDMGKTTESWESVRLCDMRPEDIRWERDDQGISNRDSWGPSGPLLNRNQNNNGRGRLSQNEHPNKYGPPQNGINRNIGEIDVPNTQSVVIEVERVLSNPSMHEIEKAKKLLPDQEQSLLDAIASLDDASDSESEDKAMEAQMGSGGDHTGRNGIAC

SEQ ID NO: 125912 - protein, 410 aa, Triticum aestivum
  Clone ID: PAT_TA_20330.pep
MASVGAVRPSSRFQNDTSTSGDADRLPNEMGSMSIRDDRDTEDIVVNGNGTEPGHIIVTSIEGRNGQAKQTISYMAERVVGNGSFGTVFQAKCLETGETVAIKKVLQDKRYKNRELQTMRVLDHPNVVALKHCFFSKTEKEELYLNLVLEYVPETAHRVIKHYNKMNQRMPLIYAKLYMYQICRSLAYIHNSIGVCHRDIKPQNLLVNPHTHQLKLCDFGSAKVLVKGEPNISYICSRYYRAPELIFGATEYTTAIDVWSAGCVLAELLLGQPIFPGDSGVDQLVEIIKVLGTPTREEIKCMNPNYTEFKFPQIKAHPWHKIFHKRMPAEAVDLVSRLLQYSPSLRSTALEALIHPFFDELRDPNTRLPNGRFLPPLFNFKPHELKGVPMDILVKLIPEHARKNCAFVGW

SEQ ID NO: 125913 - protein, 228 aa, Triticum aestivum
  Clone ID: PAT_TA_20331.pep
MAAVGVTSPAAPATVSAAVCSSSTRRRVHLVPTRFFAAASFSGRCAAAADGGAAASEDLAAAADGYPDAGTDVAGGAATSTRPPYSLISAANVQKAMRGLAITDADHYGRLGITRLASTDEVKAAYEKRCEQLNKQGLEEEEISKEHDLLKESFTILSTEEERRLYDWSLARNGQPERYVWPFEVDPMELAPDPPKEPEDEFPTKLVGYFLLTWFIISVACSLILNRS

SEQ ID NO: 125914 - protein, 68 aa, Triticum aestivum
  unsure (1)..(68): unsure at all Xaa locations
  Clone ID: PAT_TA_20332.pep
GTSHAGALSPSPAADNGXXFSPPSPPPPFGINISPTGNPDQQNAAAGKAAGIAGTAALIIGTMLYSLV

SEQ ID NO: 125915 - protein, 46 aa, Triticum aestivum
  Clone ID: PAT_TA_20333.pep
LTRDWASGESARRRFRFTCNDDVESLSSTGLELEPWRPSPSRIGTG

SEQ ID NO: 125916 - protein, 110 aa, Triticum aestivum
  Clone ID: PAT_TA_20334.pep
MGRKVCIYLAILALLLVAGPGAKAATFAGGPASMDAAVAIRQRMSAMKLEDVVAPELTVDLEVHRRILAINVGQSALDGNRPSCIQNCPARGDSYTGRGCLKRYGCNGGS

SEQ ID NO: 125917 - protein, 245 aa, Triticum aestivum
  Clone ID: PAT_TA_20335.pep
MLAYLLHAPAAAAPSPLALRGPPAAASKTPFLPPSFAPPHRRAAAAVAFSAAAVGPIAASLLEGPVLLWAGRLCVYYALIHIGLAGSPRSPFLSHEIRGEDGAGESDLGFSKWADKLRGGAPGDKEGQDKWKLVSKWKPTTKGTLKRMYRVPSKEEGRRILKEIALVLSEDDNFVDASTHKGCQIRRESAHGESVCCYNVRALFDELPGPHLVLEITPFPVGTLTESDYRKAERLEMVLRMSASL

SEQ ID NO: 125918 - protein, 132 aa, Triticum aestivum
  Clone ID: PAT_TA_20336.pep
PALPGTPGGARPARRHRPRPPRQTPPGHRPRAPRPAARRGPGAGGPRAACRTRRRRRASAAARATPPRAPRSPPSPCRTLGRGSRGCLSLARSPLTTCGCLSHLACWAPWTSSYLRVGTLPGVCVCGSRGVL

SEQ ID NO: 125919 - protein, 148 aa, Triticum aestivum
  unsure (1)..(148): unsure at all Xaa locations
  Clone ID: PAT_TA_20337.pep
PPTRAQGVGQMKNELALIAKLQHKNLVRLVGVCLEGGEHLLVYEYTPNRSLDTILFDPEKSKQLDWGARCRILNGIARSLQYLHEHSQLKIVHPDLKASNILLDADMKPKISDFGLAKIFTDDETRNATCRAIGTLGYMSXEYAMRGH

SEQ ID NO: 125920 - protein, 199 aa, Triticum aestivum
  unsure (1)..(199): unsure at all Xaa locations
  Clone ID: PAT_TA_20338.pep
MAAKEPMRVLVTGAAGQIGYALVPMIARGVMLGADQPVILHMLDIEFAAEALKGVKMELIDAAFPLLKGVVATTDVVEACTGXVNVAVMVGGFPXRKEGMERKDVMTKNVSIYKAQASAXLEAHAAPNCKVLVVAXPSKHNALILKXFAPSXPEKNIXCLTRLXHTRALGQIRRDWCQFRPEQRNSPGYPPAPIKMTVF

SEQ ID NO: 125921 - protein, 116 aa, Triticum aestivum
  Clone ID: PAT_TA_20339.pep
MEGSFPASSLHPPAVAPATTRCAPWVLLDSRAYFAVCKNATTAEATTSTSHMVKVSFCLSDPPAISHFCVFGPELKHEDFMMEPLVLFSAKDLVLLRLAFTVGPRSTHKDSRTSLF

SEQ ID NO: 125922 - protein, 234 aa, Triticum aestivum
  Clone ID: PAT_TA_20340.pep
MAASLRSPPPVPAASAFRRCRAAAVVCASSSPSSSSSSAVSSAPKARFVARRSESTSVQQLARPLAEYMGLPASQYSVLDAERIERVDESTFRCYVYRFRFFALEVCPVLLVRVDEEPNGCCIRLLSCKLEGSPLVEAQNDKFSASMVNRVFCNSSSEGSTLQQLTSDAISEVAIDIPFPFQALPVEAIESSGRQVLEQLLRVMLPRFLKQLDKDYQAWASGDSSRKPLGTGEI

SEQ ID NO: 125923 - protein, 102 aa, Triticum aestivum
  Clone ID: PAT_TA_20341.pep
VAMETLEGVLRESKARFFSGRDGPGYLDIMLGGLLGSMRATEEMCGLQTFDPTTTPLLAAWAELFCALDAVEPVMPRVERLVEYAEATQHLAPPCPAPPTEA

SEQ ID NO: 125924 - protein, 365 aa, Triticum aestivum
  unsure (1)..(365): unsure at all Xaa locations
  Clone ID: PAT_TA_20342.pep
AGLRXTTVTYNAVIDACGKGGVDLRFTLGYFRQMLRDGLCPDRKTFNSLLSACSRAGHLEDARAVFDEMIHLGIGRDIYTYNTFIDAICKCGNIELAMQVLLDMEAKKLKPNVVTYSTLIDGYSKLEKYEEALKLYEKMKSLGIRLDRVCYNTVLAIYVKTGKYAEIAIVCDEMEDSGIEKDTVTYNSLINGYGKQGRLDIVSFLVQDMRRRGVAPSVLTYSTLIDIYSKAGMHGDAFNVYLDFKESGLKADVVLFSSFIDTLAKNGLVEWALSLLNDMTEMGIKPNVVTYNTIIDAFGKSKVHAEEDPEVGDMGIVGVYNGQIIRAANPVTRHSAIDVRMKRQLYFNEFSEDGANKVPNVGKFC

SEQ ID NO: 125925 - protein, 92 aa, Triticum aestivum
  Clone ID: PAT_TA_20343.pep
PSGQGRTLKLYSAYKIGKEHCHQHHQQKTDWATATFFLKRNFSVLHHLDTFGSNVYYPGKKNEMINTYSCAMFRNPSYCSAQLDIFPRSYPW

SEQ ID NO: 125926 - protein, 186 aa, Triticum aestivum
  unsure (1)..(186): unsure at all Xaa locations
  Clone ID: PAT_TA_20344.pep
RSXTPXNXPRTPAKKGLHFPNLEKINSXALHGENGVGILQNLEKINFAFLHTLGRRSLTRRPPGRDLAGRNHRPSPKTGPLDGHPQNRALEEQREIWETVLDLGGGDHPGHHGWARRRGDCLLLGARPCRLTKKWSSSSRSTHPGDGSVLEGSGFTGAAPDRVGGDRNPSHYGVGIRARPAMAMAT

SEQ ID NO: 125927 - protein, 59 aa, Triticum aestivum
  Clone ID: PAT_TA_20345.pep
FDDEVICPGYEKVIKGEGMPIAEQRGARGDLRVKLEIVFPEQLTDEQRAGLAEILKVCT

SEQ ID NO: 125928 - protein, 125 aa, Triticum aestivum
  unsure (1)..(125): unsure at all Xaa locations
  Clone ID: PAT_TA_20346.pep
MFKTNQPQSLQSASGSISTTMYRKSHAGPVAFKDFHVSVLTEEDGVIETQIRVTISSKMTDSVFEKVLSKHIAAAQPLPGFRRLKGGKTPNVPKEVTLHLVGXSKVKRAAMKKMINRAVAEYVEK

SEQ ID NO: 125929 - protein, 147 aa, Triticum aestivum
  unsure (1)..(147): unsure at all Xaa locations
  Clone ID: PAT_TA_20347.pep
VNVVDQDGREEEVRRALPMMPVRVLLAEGDDSTRHVISALLRKCGYHVSAASDGVKAWELLKEKSFKIDLVLTEVELPLMSGFLLLSTIMEHDAVXXNIPVIMMSSNDAVSMVFKCMVKGASRFPCQARYERNEVXELVGNXVWXKL

SEQ ID NO: 125930 - protein, 121 aa, Triticum aestivum
  unsure (1)..(121): unsure at all Xaa locations
  Clone ID: PAT_TA_20348.pep
MWHEARRSERKVHDLMDGARRRAQRRYAYLARRRGDPHQSLQVSGARCRVHRDDSLYQATEDQQGLIPWNGKQDILIDRFDGRALLDFIRDSSSRAFQTQEKSEEEEXLEDFVNFERYRDL

SEQ ID NO: 125931 - protein, 167 aa, Triticum aestivum
  unsure (1)..(167): unsure at all Xaa locations
  Clone ID: PAT_TA_20349.pep
MAPKAAEKKPVEKTPAGKKPKAEKKVPASKEGGGDKKGKKKAKKSVETYKIYIFKVLKQVHPXDIGISSKAMSIMNSFINDIFEKLAGESAKLARYNKKPTITSREIQTSVRLVLPGELAKHAVSXGTRRHKFTPPDWPSPFVLLMEYGVPRIVTVVLVCCTVPVVG

SEQ ID NO: 125932 - protein, 116 aa, Triticum aestivum
  unsure (1)..(116): unsure at all Xaa locations
  Clone ID: PAT_TA_20350.pep
SSKAHTWMFFVTPSKSCRRNAYKKKKETWFAFLAGVLVISDPPTGCSRGSAQSDARRCAQLRSTGSRASRPPAPPRRASPAHPPPPPRLTPAPAGGHHPRALTARGPLSGXAXXQY

SEQ ID NO: 125933 - protein, 229 aa, Triticum aestivum
  unsure (1)..(229): unsure at all Xaa locations
  Clone ID: PAT_TA_20351.pep
MSMIAAATEGQAQAVTKAGTTRPARKTMAAAAMNTAMVPAASTNPATTTMMVRTRTPTRTTTVAVAATTSPALTISLAAXINLALMTTLAVAATTKLVPTTTVPVATTTSPAPTISVAATTSLARTTMMVATRTPAPMPAMAKAVTXTQAPRTPPRTTNQASRRTTAAARTPPILMTMTAVAQTXSSTDVATRSPAPTSTVVATASPAPMGMPLEQATPALMITRQKSS

SEQ ID NO: 125934 - protein, 109 aa, Triticum aestivum
  Clone ID: PAT_TA_20352.pep
GSGSTGAIKLGLGGRPGMSGPVDRSGRPGAGFEGFTHDDENEESKSDEDNSEGDNKAKKGSFKKRAISAGNKFRRSLRRKSKKKSGNLASIEDIRDVQELETVERWRQC

SEQ ID NO: 125935 - protein, 188 aa, Triticum aestivum
  Clone ID: PAT_TA_20353.pep
GGRSVPGGAPARGATDSQGWGSHRSREVPLPPNPDFPKGKLPPAPGGPRPPNLDLPRGERPPAPEVLLTPNPNCPRWNYRWPGGNLPPPAGMPKVASPLSRSHLPPNPNCPRRPATEPDIPCPRFHSPKSATPTSSPLVISLVLACHVLLGRRPVVCPRALNVVHGHTLTPFKRGPYPSYGVLTRNRQ

SEQ ID NO: 125936 - protein, 201 aa, Triticum aestivum
  unsure (1)..(201): unsure at all Xaa locations
  Clone ID: PAT_TA_20354.pep
IVVYQESSLFMGLSYAISSVSIFDEYTNDVLDMAPGSCFPRFVYQKNEASVESTRGPLSRPASFRDKQDGKKAPARVTSFKSSFDEFNPFKLLDHLFEECHHRGEALVAEGVITPKDIEETKSGKGGSGVLNVGLPAYVILNXTLRSAKADSDGLILRDGXEITSDNRPKNTLFDWVXDLLMAQSQSXREFTEEEETSTVR

SEQ ID NO: 125937 - protein, 137 aa, Triticum aestivum
  Clone ID: PAT_TA_20355.pep
MGLAMGKLMLGKIIVETPKHEVLHAGDGYEIRKYPPCVAAEVTYDPKEMKGDRDGGFQVLANYIGAFGKPQNTKPEAIAMTAPVITSSGGGGEAEPIAMTAPVITSSEPEPVAMTVPVLTAEGREEHAGKVTMQFLL

SEQ ID NO: 125938 - protein, 251 aa, Triticum aestivum
  Clone ID: PAT_TA_20356.pep
MPMPCAMHSIGGYVFRIHLKAGHVTCTVKHKEMKGDRDGGFQVLANYIGAFGKPQNTKPEAIAMTAPVITSSGGGEAEPIAMTAPVITSSEPEPVAMTVPVLTAEGREEQAGKVTMQFLLPSKYAKAEEAPRPTDRGVVLREVGERKYAVVTFSGLAGDKVVAEKAEGLKAALQKDGHAVTGPFVLSRYNPPWTLPPLRTNEVMFPVGSSVRPPARLMLAATVCVLLFRLLAAPPFRCTWRVTCWVRWHNK

SEQ ID NO: 125939 - protein, 117 aa, Triticum aestivum
  unsure (1)..(117): unsure at all Xaa locations
  Clone ID: PAT_TA_20357.pep
MAEHLFEDIFNVTRIDPDGKKXDRVIRIEAKSEQLEMYMQLDVATDVYPMHVGDKFTMVLAPTLNLDGTPDTGFYTQAGRKTLADKYDYVMHGKLYKISEDISSEKEATKVYDFSEL

SEQ ID NO: 125940 - protein, 179 aa, Triticum aestivum
  unsure (1)..(179): unsure at all Xaa locations
  Clone ID: PAT_TA_20358.pep
APTLPPSPPLLAAQPTPIRAGPSPGRLLPVASGKIAENLFGDIYPRAHDKKFDRVXRIEARSEQLEKYMQLDIATDVYPMHMGDKFXMVLAPTLNLDGTPDXAYYTQAGRKTLADKYDYVMHGKXLYKISEDNSSKDKGPTKVEIYASFGGLLMLLKGDPSSAANLELDQKLFLLIRKV

SEQ ID NO: 125941 - protein, 211 aa, Triticum aestivum
  unsure (1)..(211): unsure at all Xaa locations
  Clone ID: PAT_TA_20359.pep
MTAVFVGLMGIPDPLKREAAXVVVEGLKKMGIHPVMLTGDNWRTAQAVAKEVGIEDVRAEVMPAGKADVVRSLQKDGSIVAMVGDGINDSPALAAADVGMAIGGGTDIAIEAADYVLVRNNLEDVLTAIDLSRKTFNRIRWNYFFAMAYNVVAIPVAAGALFPLTGLQMPPWLAGACMAFSSVSVVCSSXLLLRRYRKPSSHRAADNCRVD

SEQ ID NO: 125942 - protein, 188 aa, Triticum aestivum
  Clone ID: PAT_TA_20360.pep
RNAVVRVHDGGARFSCECGLFEHMGMLCCHAIKVLIHLGVRKIPSFHVLKRWTVDVRENLPLHFLHYQKDQGPPRLSSYRHTALHLTALEFVQLGDSNVDAFDRAMDILIAGNAELTVLGSDQRTAKVWWDQTQIGDSAPTQGYGSLLAPRHMCPKCHSTECGLIRFKGTGQLTATCPIGTGSNLELI

SEQ ID NO: 125943 - protein, 173 aa, Triticum aestivum
  Clone ID: PAT_TA_20361.pep
MATVLFASAADGVGTQDAPKHLHFYMHDAYTGPKPTTVLIVNGTGQPLKGSGGGARFGDTVVMDDRLTEGPTLASRVVGRAQGFYVTASQGDPAMLVAMNVLLAAGPYNGSSLTVMGRNNIAMPERELTVVGGTGVSRMATGYVLWKTASWTGRNAVLELDAFVYVSPAAAGA

SEQ ID NO: 125944 - protein, 241 aa, Triticum aestivum
  unsure (1)..(241): unsure at all Xaa locations
  Clone ID: PAT_TA_20362.pep
IDKCLKGINIHHILEPECSSEYNGNSDSGRTLFDYGGAELGLSDISSECREKGYSMSGIWANNRSVREALGVHKGTVPLWLRCNHGTPYTTDIRSIVEYHRSVTSRGYRSLIYSGDHDMTVPFISTQAWFRSLRXSPSVDEWRPGYATGQLLGYXRLYANNXTFATSKGGXHTAPRYMPQGMLGMVHNVSRVRPSPPPHAPSSSSRCLSSSPLHSFLPLPLHNMSFLTLMDIPGPSLPDIP

SEQ ID NO: 125945 - protein, 229 aa, Triticum aestivum
  Clone ID: PAT_TA_20363.pep
MCCVSYSDPSPPLPAEEKSKEEEQRCSAAMEVDAEASYSYGFLPQGRHQPYYAPPPPPPEDGELWEYFPCPFCYIEVEMPFICSHLQEEHCFDTRNAVCPICAENLGKDMSAHFRFQHSHLLKRRKPSRPSSSPWPAAASPPAYEVNPYMMSSRPCQDPEPDPLLSQFICGSGDQTETEPGSRDKKSQRHRPSSGHPAAGVQRPVSQLELEERLQRIEFLREIITSTIL

SEQ ID NO: 125946 - protein, 403 aa, Triticum aestivum
  unsure (1)..(403): unsure at all Xaa locations
  Clone ID: PAT_TA_20364.pep
MAATYPMPDPPVLNNYAITQRFDNSATETAGRDKSIGYLDIFVHQARDIHNVCIYQKQDVYAKLSLTSDPQVSCSTKVINGGGQNPLFDEGLRLDVRSVEASLRCEVWMLSRVRNYLEDQLLGFTLVPLSDILLADGNLAQEFSMSSSDLLHSPAGFVRLSLSYVGSSPDVIEISSLNKSASAVTDCGNGSLDPCEIEKMEFPDLNMVNENEMMVSKYFEMDCDSAAKAETCKLPQHDADEPGPEVSKITPKEYPDESPVSCVSTTGSSPELSPMTQSVSEPSETAVAAASSTGSQREKSQGVTXRDGEADSSEAPSKDEVAQPAVISVNLQPRESVVQQDIVDMYMKSMQQFTDSLAKMKLPLDVENGSPSADNIDSSATEKPLPSPSSKGPRVFYGSRAFF

SEQ ID NO: 125947 - protein, 114 aa, Triticum aestivum
  unsure (1)..(114): unsure at all Xaa locations
  Clone ID: PAT_TA_20365.pep
GPQXDXLLKFKAVRLGXESWVRFLQRSDWEILIMDAILDVRAEDGKRQTMRVTVADNTAAPPPPADCRTCKAPGNADTRTEAYTIADAAAYIGATSGSGVTCSGMLFGGCSGHS

SEQ ID NO: 125948 - protein, 172 aa, Triticum aestivum
  unsure (1)..(172): unsure at all Xaa locations
  Clone ID: PAT_TA_20366.pep
PRPGLALAGLGFAAPLPRPGAPRPRRPKPGRRASSAASTFAKPLRGLRAAHLSYGGQLRGALLRPCMPDSSFPGLVAPPPPLSPTSRCWACLPPPSGQALLEVDHWPPRLARAARNGSAHSWSSSCGSDVHAPHTSCAYGFRGPHAHVTFGGTPGSSAPPHHRFGCVPWWXG

SEQ ID NO: 125949 - protein, 227 aa, Triticum aestivum
  unsure (1)..(227): unsure at all Xaa locations
  Clone ID: PAT_TA_20367.pep
MRSRSARTFLGRNDPPGYKTADGPSCCLLGLGRGGHGLLGPRSRVGTRARARQPQGPRRVGVETSTATKDIAEEKAIVPVPDNSEAIVAVVKDAEGTRGSSERDAYLTKIMSEKRTTLINAWEXESEKARAENRAAKNLSFITSWEHAKEAEMEAELKKIEEQLEKKKAAYKEKLKNKLAMLHKSAEEKRAMAEAKRGEEIIMAEEMAAKYRAKGEAPTKLFGLLKA

SEQ ID NO: 125950 - protein, 307 aa, Triticum aestivum
  Clone ID: PAT_TA_20368.pep
LIQWKEVGIANLAGVISLAAGLLMWVTSLHPVRKRFFELFFYTHQLYVVFVVFLVLHVGDFVFSISAGAVFLFMLDRFLRFWQSRTKVDIVSAACRPCGTVELVFSKPPSLRYNALSFIFVQVRELSFLQWHPFSVSSSPMDGRYHMSILIKVLGTWTDTLKRIIADVQEQKTRSDSDSDQSQTGRITASIEGPYGHESPYHLMYENLILVAGGIGISPFLAILSDIIHRIGQGMPCAPKNVLVLWSVKKTSELSLLLAVDAQSISSSVCDKLHLDIQAFVTQESDPPLEDGIVGDDQKAPGIFVKN

SEQ ID NO: 125951 - protein, 90 aa, Triticum aestivum
  Clone ID: PAT_TA_20369.pep
LSSLAGRKLLGGNCECFEKQAKVLSSSPFEFPKFQNNYNKYYAMAMQSRSVITKNGSVYRLNHSHRFLSNVKSPRTLSWHNVASPVKACR

SEQ ID NO: 125952 - protein, 202 aa, Triticum aestivum
  unsure (1)..(202): unsure at all Xaa locations
  Clone ID: PAT_TA_20370.pep
WQVGASCEEGEGCQRHVFSRQEKPASVPVLSEWIPSLGLCFKCGERWGRNHTCSTTVQLHVAEXCCSSSASTWCSATSQPPLPTAAVYDTGMAISGQALTGGVSPHAFQLRAWLQGHEMXMLLGFGQLHSFVDHSLPSLWVPSLCFNPGASNCKRRIDHIYPVRTFPYNLEEDRPSTLDILPSHKKKIAYLHLKNCIHSKKK

SEQ ID NO: 125953 - protein, 163 aa, Triticum aestivum
  Clone ID: PAT_TA_20371.pep
MKEELHKPPTRPLIFSSHMIFTLVFVRTYHKYGSKRLIKLFAWLMAIIQSLLIIASRAHYTVDVGSAWYTINLVVFFVDKNLPEMPDRTSGLSLLPVSTKDKSDRMKEELHKPEKDNKMKDEHHKLLNGNNVDSTDRRQWMPMNGKHGEDMNHTLSDAAPNGT

SEQ ID NO: 125954 - protein, 308 aa, Triticum aestivum
  Clone ID: PAT_TA_20372.pep
PPRPSPPGGTLLGESLLFTEGVGSKRSLRDIDLKRNTCSVGIVERIEYDPNRSSRIALLRWIEGVPQKDPAYKAERAPVNYIIASHQMEPGSMVVNSDSSKPSTTGSLMRPAHNANSILRFQELFRKASQEGEEGTDDQAKDAAVPAAAPLMPADLLDLNSKVGNCMPLSDIRMGTWVHSIELRHGQGAKLVRAAGAYAKVVKESATQCLVRLPSGVEKLIDSRCRATIGIVSNPTHGARKLRKAGHSRWLGRRPVVRGVAMNPVDHPHGGGEGRTKGGRPSVSPWGKPTKAGYRTVPKKPKAQLSRD

SEQ ID NO: 125955 - protein, 195 aa, Triticum aestivum
  Clone ID: PAT_TA_20373.pep
RRHPPWIALSSPPPSWFAPPPPPSLDHSAAAHHFHDTPPPPPTPSPTRLQPSGRIRSRPARSTRPTTSSALSHDIHPSTSTDLNKISPSPPAHGLDSARRRHEMQSTSSPPPPCLLTSAIDGRHCARGLLYMPWPGSPNPLCYRILGSPLDPSPSASPTFSGLPGTGLPLPLSATSACISSTTNPLRSSSGPRRA

SEQ ID NO: 125956 - protein, 185 aa, Triticum aestivum
  unsure (1)..(185): unsure at all Xaa locations
  Clone ID: PAT_TA_20374.pep
VTVVEGEHKVPLLQAHSHSHAQSHGHELVQPQGREGEVSDHVRSVVVSQILEMGIVSHSVIIGLSLGVSRSPCTIRPLVAALSFHQFFEGFALGGCIAQAQFKNLSAVMMASFFAITTPTGYXAGAGCPHFYNANTPGLLATNLARVRVGRIPCSWPAAFLPAILGPRTLGPWPLAASPLSQVPH

SEQ ID NO: 125957 - protein, 214 aa, Triticum aestivum
  unsure (1)..(214): unsure at all Xaa locations
  Clone ID: PAT_TA_20375.pep
SVGLDIAHGMGYVHSQGIVHRDVKPENIIFDGDCAKIVDFGIACEEAYCDPLANDPGTFRWMAPEMMKHKPYGRKVDVYSFGLILWXEMLTGSLPXEDFDSRPNQPLLFFDKNXRPAIPATCPAALRXLIRQCWACQARXKPESREIFNYWDNSKMVLERXGTLDNXPNSNCQGEHDPKEMANHWPTSSTTPSHHDPPAPPNHPPSSPHRQPVA

SEQ ID NO: 125958 - protein, 213 aa, Triticum aestivum
  Clone ID: PAT_TA_20376.pep
TRPDDPEDEGFDIGNGNDERIGAAEAKSFKLLNELSDLLMTPKDMLIEKSIRKEICPSVGLPLGPTARSDLPPPAACPDPVPSIVLEELKSESLLERHTAKHAISAFPCIAAPIAYRTPSQLDVEEKVSVVGGSAKLDRRASMVQRRGYTSDDDLDDLDSPLASLFDKSAPPSPSNGTTPFTAQQRGASMENARFELLREVWLERRGSDPVNL

SEQ ID NO: 125959 - protein, 93 aa, Triticum aestivum
  Clone ID: PAT_TA_20377.pep
MAEEDKAPSDAMSTVAEEAPVTAERPVRADLEPHLPKPYLARALVVPDVYHPEGESGEGHEHGQKSVLQQHVAFFDLDGDGIVYPWETYRGVR

SEQ ID NO: 125960 - protein, 138 aa, Triticum aestivum
  Clone ID: PAT_TA_20378.pep
MAEEDKAPSDAMSTVAEEAPVTAERPVRADLEPRLPKPYLARALAVPDVYNPEGAVEGHEHGQKSVLQQHVAFFDLDGDGIVYPWETYGGMRSLGFNVILCFIAAIAINIGLSFPTLPSWIPSPLFPIHIKNIHKDKH

SEQ ID NO: 125961 - protein, 243 aa, Triticum aestivum
  Clone ID: PAT_TA_20379.pep
MAEEAKAPADATSTVAEAAPVTAERPVRADLETHLPKPYLARALVVPDVYHPEGESGEGHEHGQKSVLQQHVAFFDLDGDGIVYPWETYGGMRALGFNVIVSFVFAIVFNIGFSFPTLPSWIPSLLLPVYIKNIHRGKHGSDSSTYDTEGRFMPVNFESIFSKYARTAPDKLSFGDICRMTEGNRLNFDFIGWIVSKGEWILLYVLAKDEEGFLSREAVRRCFDGSLFEFIAQQRREAHDKQH

SEQ ID NO: 125962 - protein, 192 aa, Triticum aestivum
  unsure (1)..(192): unsure at all Xaa locations
  Clone ID: PAT_TA_20380.pep
TFSTTYATSPAFINNNGGQAPFVVDWAIGNETCDVARKKPGSYACVSDNTECFNSLNGPGYICNCSNGFHGNPYLHDPEHGCKDIDECKLPQLYRCTNGGVCRNRLGGYDCPCKFRWKGHTKAGTCXSHFPLTTKVAVGAVRGXLLMSIISFLIILYNKKKKVKKSYKNTGQHRLDQATILNTQSQGWVNPN

SEQ ID NO: 125963 - protein, 151 aa, Triticum aestivum
  unsure (1)..(151): unsure at all Xaa locations
  Clone ID: PAT_TA_20381.pep
ILKDNEGALLNLDQEQPALRFYVGGYVFAVSVHRVQLLLQVLSVKRFHHQQQQQQAQSNAQEELTSAEINEICXYFSRRVASEPYDASRVASFITLLTLPISVLREILKLITWKKGFPKAHGDIATAQRARIELCLENHSGSASDDRTETP

SEQ ID NO: 125964 - protein, 117 aa, Triticum aestivum
  Clone ID: PAT_TA_20382.pep
IQEVTVFFFEITVRISVSSSTGECNGRLKSQCSPRVLPIRLAAHPSNNPSITWLPSHGGTINSAISCRSLYLTSAATFHFIWRLQAARNSAVNSSELKHLSGAQHSSQVALRVSLDH

SEQ ID NO: 125965 - protein, 98 aa, Triticum aestivum
  Clone ID: PAT_TA_20383.pep
FHINGLQFSDNMNFVISRNLQSWMECSLGCLTYGSAHAQLGLSKFASLSTLYTLTSNKNFCQCYSIISLCNRYRNLPEFEYVTRFKFFFQFVQLSCIL

SEQ ID NO: 125966 - protein, 326 aa, Triticum aestivum
  Clone ID: PAT_TA_20384.pep
MIKAEPELRGQLRGGGGMLQQRCDSCRSAPCAFYCRADSAALCAACDADVHSANTLASRHRRVPMGAAAPASPARGPFVVRPGAVQSSWPSREGRSSYYDAGEGGGEVLLQGTSWLLLYALRGSVADAPAFGDALVAHFLELGRAGEKDASSKEYRGHGVESHEGSHELVVPGEPVAQLHERQGFTAEMSYDAQNSNHGYGFGATFQRSLSMSSSPDNSSTVQDVTSSYMRSSESSVDLFSAAAHMSPQFMGMAMDREARVHRYREKRKMRRFEKTIRYASRKAYAETRPRIKGRFAKRADADLEVDQYFSAAALSDSSCGVVPTF

SEQ ID NO: 125967 - protein, 168 aa, Triticum aestivum
  Clone ID: PAT_TA_20385.pep
AGGPSFPTQAPRPSQAPPARPRYNPILKVVAQKLIVSLFHLHMSSRLSMTAGVHRPPRHPQLLGRHPNRSDRSTRPGLSHLLDHPSPVGRVRSCGMPRSPGARSRAAPGLREVGDRPTHHPSGLAGAPSWDGSAAPVVDEELPLRDLRRGDHRGRRGVTGVASAGVGW

SEQ ID NO: 125968 - protein, 192 aa, Triticum aestivum
  Clone ID: PAT_TA_20386.pep
METTASWRLLPAASSPRPSLLQARRQASFPSSLEQPAISKSRILCLLHDKPAPTAQSSQLQKLASVLQCGAVWAAVQAPAALATVSGEEDLDLLGILPPVAAIAFVYLFVAPPIIMNWMRLRWFKRKFVETYLQFMFTYLFFPGLMLWAPFVNFRKFPRDKTMKYPWSKPKEGTPLFKDRYPQIDSFREKYY

SEQ ID NO: 125969 - protein, 314 aa, Triticum aestivum
  unsure (1)..(314): unsure at all Xaa locations
  Clone ID: PAT_TA_20387.pep
XLASLTCLELGDVCKEIGLPSGVLNIVTGLGHEAGAPLSSHPDVDKVAFTGSYATGQKIMVAAAPTVKPVTLELGGKSPIVVFDDVDIDKAVEWTLFGCFWTNGQICSATSRLLIHKNIAKEFVDRMVAWSKNIKVSDPLEEGCRLGPVVSEGQYEKIKKFVANAKSEGATILTGGVRPKHLEKGFFIEPTIITDINTSMEIWREEVFGPVLCVKEFSTEEEAIELANDTHYGLAGAVISGDRERCQRLAEEIDAGCIWVNCSQPCFCQAPWGGNKRSGFGRELGEGGIDNYLSIKQVTEYTSDAPWGWYKAPA

SEQ ID NO: 125970 - protein, 520 aa, Triticum aestivum
  unsure (1)..(520): unsure at all Xaa locations
  Clone ID: PAT_TA_20388.pep
PAPARPTAPVPPRLPAAATLAQIPNRQLFIYSDRRELALGRRLRFSNPASEAEIGHVQYVSSKDADVGEAAAPADLPXMRFRECYCTLGSVGAKQQFSSAANMIXRRPDRVWPEAPDWXSPLRKWHXDVGAVARHFEFRAXSAKSMMKCKYASVTLPAXFNSALHPEPLSLGGPTKPXKERHPRAASEGSPAGAGGCSAVRVASVIGGLHCLHLGRRRLQNGRPPGQLRAVGGXGQACRGQCRGHPTCGSHGCSRDEVNVQYIMVCSWTTLRHVAYVXVANKRSYLLLDDTYTDQLIERYLFGCYWTYSLICCQAVRLLRQKNLARXVVSEGQYEKNMKLLEXAKKEGGTLRPVVSEGKYEKISLFVAHTISEGATILTGGXRPKHLEKSCLRRHSLLTEINTSREIWREEVFGPVFCVKEFSTEEEAIELANGTHYGLAGAVISGDREPWRGYKREIDAGCIWVNCSQPCFCQAPWGGNKRSGFGRELGKGGIDNYLSIKQVTEYTSDAPWGWYKAPAN

SEQ ID NO: 125971 - protein, 128 aa, Triticum aestivum
  unsure (1)..(128): unsure at all Xaa locations
  Clone ID: PAT_TA_20389.pep
ASXAISSFHPDAPRSRDGPPTTAEMSTSTSQRAPPRPLALAPLPSLATAPRTTSSSRNAVGDEGPADATMSGAASSTSKRSTELGRLLSINGDGAALHCCRWLSSARVRARTGSDGYTTTRTQLCMMG

SEQ ID NO: 125972 - protein, 704 aa, Triticum aestivum
  unsure (1)..(704): unsure at all Xaa locations
  Clone ID: PAT_TA_20390.pep
GAAEARPKRNFKIEMFKHRVELDPKYAERTWKVLEHAIHEIYNHNASGLSFEELYRSAYNMVLHSARASLLRGPGSPLASRPEGLSDPVEAAQGGLFVEELHAKCIDLALALQMTRHIPLYSARSVLPPPHRPPARVLGLCLGGDHLRHGPMGPGRLLGHPSSAYSQRKMGEVINRGLMRSITKMLMDLGPAVYQDDFEKPFLEVSASFYSGESQEFIECCLHGRGYVXTDMKTSQDTMQVSYAKKSEEVGDXYSVVEHSHIANHMHTTVHTEHSGLVNMLIDDKYEDLGRMYALFRRVPDGLSTIRDMMTSYLRETGKHLVTDPERLKDPVEFVQCLLNEKDKHDKIINVAFGNDKTFQNALNSSFEFFINLNNRSPELISLYVDDKLWKGLDRKPQIEAGLVRLMLMMLGGVRYSIASRVAGPLQARFLPNPVIIKKRIESLIEREFLERDKADRKLXSLSCIKSQHVNVKRYFMSRWLPCIPVNISXLGLEFGFIWVRPCPLKITWQLFKGTADIKATFGKSQKHELNVSTYQMCVLMLFNTSDGLSYKDIEQATEIPSTDLKRCLQSLACVKGKNVLRKEPMSKDISEDDTFYFNDKFTSKLVKVKIGTVVAAKESEPEKQETRQRVEEDRKPQIEAAIVRIMKSRRVLDHNSIVSEVTKQLQARFLPNPVIIKKRIESLIEREFLERDKADRKLYRYLA

SEQ ID NO: 125973 - protein, 142 aa, Triticum aestivum
  Clone ID: PAT_TA_20391.pep
DGAAAAEHKSVEIMRKFSEQYARRSSTFFCSDKSVTAVVIKGLADHKDQLGAPLCPCRHYDDKAAEAAQGFWNCPCVPMRERKECHCMLFLTPDNDFAGEDQAISLEEIKEATSNFLPHNILPSLLIGVRFTPAQTRNKSQH

SEQ ID NO: 125974 - protein, 160 aa, Triticum aestivum
  unsure (1)..(160): unsure at all Xaa locations
  Clone ID: PAT_TA_20392.pep
MMSITSTAAAGTPVCRPSVSRGGRRSRCAVRAQAAGDGGAAADGASSEQKSLEIMRKFSXEQYARRSSTXFCSDKSVTAVXVIKGLADHKDQLGAPLCPCRHYDDKAAEAAQGFWNCPXCVPLRERKECHCMLFLTPDNDFAGEDQAISLEEIKEATSKY

SEQ ID NO: 125975 - protein, 178 aa, Triticum aestivum
  unsure (1)..(178): unsure at all Xaa locations
  Clone ID: PAT_TA_20393.pep
ERSTNLDWYKGPTLLEALDQINEPKRPSDKPLRLPLQDVYKIGGIGTVPVGRVETGVIKPGMVVTFGPTGLTTEVKSVEMHHESLLEALPGXDNVGFNVKNVAVKDLKRXXVASNSKDDPAKEAANXTSQGLIMNHLVKXXQRYXPMLGXHTPTALHCCSRGDLIAAGWEVVAPPLPA

SEQ ID NO: 125976 - protein, 69 aa, Triticum aestivum
  Clone ID: PAT_TA_20394.pep
VIGYRSCKDASAHSFGLQCCKHISSAYLICCKDSSAHFLVLSAQTKPICLPHLIAPKGLKCRSRVIVNM

SEQ ID NO: 125977 - protein, 222 aa, Triticum aestivum
  unsure (1)..(222): unsure at all Xaa locations
  Clone ID: PAT_TA_20395.pep
MEVDVAATTLGVGGDVSSPSSLSLLCGLAALLVLLWAVSRAAETCWLRPRRLSRALRAQGLGGAAYRFPAGDLADNGRLNEEARSKPMPPCHDIVPRVAPHLLNIVKEHGNVCITWFGPVLRMVIAEPKLVREILSDKSGHFEKFTNKRLGKLIALGLASYDGEKWATHRRILNPAFHLEKLKSMLPAFSTCCTELISSWESKLAGSDGSHEIDIWXDFQNL

SEQ ID NO: 125978 - protein, 519 aa, Triticum aestivum
  unsure (1)..(519): unsure at all Xaa locations
  Clone ID: PAT_TA_20396.pep
RRVLHTCYTKVSPSAPVENPKLVAWSESVADLLDLDHKEFERPDFPRFFSGETPLVGSVPYAQCYGGHQFGSWAGQLGDGRAITLGEVLNSRGERWELQLKGAGKTPYSRFADGLAVLRSSIREFLCSEAMHGLGIPTTRALCLVETGKSVVRDMFYDGNAKEEPGAIVCRVAPSFLRFGSYQLHATRGKEDLEIVRRLADYTIRHHYPHLENIKKSEGLSFEAAMGDTPAIDLTSNKYAAWAVEVAEHTAYLIARWQGVGFTHGVLNTDNMSVLGLTIDYGPFGFLDAFDPSFTPNKTDLPGKXAYCFANQPDVGLWNIAQFTGPLSAADLISKDEANYVMERYGTKFMDEYQSIMTKKLGLSKYNKQLISKLLNNLAVDKVDYTNFFRLLSNVKADRDIPETELLVPIKAALLDIGKERKEAWISWVQTYIEELVASGVSDEERKATMNRVNPKYVLRNYLCQTAIDAADLGDYEEVRRLLKVMEHPYDEQPGMEKYARLPPAWAYRPGVCMLSCSS

SEQ ID NO: 125979 - protein, 80 aa, Triticum aestivum
  unsure (1)..(80): unsure at all Xaa locations
  Clone ID: PAT_TA_20397.pep
MCAGASSIRGTIKDAAXKFIHLRXGLTSHGAREIGSDGNFKFRGXHGSYVVQLAXTATGKMHKAFSVEKGDTPLVLDMDV

SEQ ID NO: 125980 - protein, 111 aa, Triticum aestivum
  Clone ID: PAT_TA_20398.pep
PASPPPPSFQFPHLPPIFSAPSSPPPPPPPPAFPFPLPPFPQLPPFPHFPPLPSLYSPPPPPPPPPPPSFPWPFPPLPFLPPTASPSVPSPPPSRHYRKDPSTWSSSKTQP

SEQ ID NO: 125981 - protein, 121 aa, Triticum aestivum
  unsure (1)..(121): unsure at all Xaa locations
  Clone ID: PAT_TA_20399.pep
RVNSIRPVFEEAATDLGKSEIDSEVVEKVWDRIAPGLASRFDAPYSVPLIAPRPLLLLNGAEDPCCPIAGLQEPASXRVAEAYEKAGSAEKFKFIVDPGVEHMLTANMVKEASXWFDRFLQ

SEQ ID NO: 125982 - protein, 195 aa, Triticum aestivum
  unsure (1)..(195): unsure at all Xaa locations
  Clone ID: PAT_TA_20400.pep
MEPVGGGGGGASSAAERYRAEAARAFQHYLDRAAPHTAGRWAGTLLAAAVYALRVYYVQGFYVVSYGLGIYLLNLLIGFLSPMVDPELEALDQAGPALPTRGNDEFKPFIRRLPEFKFWYAITKAFCVAFVMTFFSVFDVPVFWPILLCYWIVLFVLTXMKRQILHMVKYKYVPFSMGKQKYGGKKGPSTSGSKD

SEQ ID NO: 125983 - protein, 360 aa, Triticum aestivum
  unsure (1)..(360): unsure at all Xaa locations
  Clone ID: PAT_TA_20401.pep
MHPVSTQRLAPVPNANHQRALLPPSPLLLRPRTSTRSSASARSAPRAVSPATPTTAATNDPDAGAQPDKWEEFAARVSGEWDGFGADFTVAGDPVELPANVVPDAYREWGVQVFDWQTQCPTLADPAAPGALHYRLVRLLPTVGCEADAATVHTSHQRHVSSATAFAYGGAGGSYVATWPKGPSAVLEVEHCNAEVRVRLVQTVALAKDAARLRGVKVFSEQWYGPYRNGDQLGGCALRESAFAAGERLPASEVXGQWESAARSSGALDPVTGKFAGLEPDHEPRRTARDGAGVVTLLPKQLWSSLKVSGGDGDGDDSDVVCEVGWLLGHGSAVTSTCVLSRDGDVKIAAAQETRVSEAT

SEQ ID NO: 125984 - protein, 78 aa, Triticum aestivum
  Clone ID: PAT_TA_20402.pep
GANLSVCRPFQKAPAAAAQRLPRPFNFFLRRSCDLLMNGTMCFHLLHVCFRSCIWVFLISQSLILFLLRMMTDKRMFT

SEQ ID NO: 125985 - protein, 339 aa, Triticum aestivum
  Clone ID: PAT_TA_20403.pep
TSDRDEKVICYIVNTAEYCHQTSGELAENVAKIISSQFSDKVDMSDVQDEFSAVITKALMTLVHGVETKFDAEMVAMTRVPWSTLESVGDQSEYVNGISSILSSTVPALGSLLSPTYFQYFLDKLAASLGPRFYLNIYKCKHISETGAQQMLLDTQAVKTVLLDIPALGKQTTVAASYSKFVTREMSKAEALLKVILSPVDSVASTYRALLPEGTPLEFQRILELKGLKKADQQAILEDFNKHSPSIKHPTITPTAAPPVPTATASVPMAPVPLPTQAVAASPSMSTALTGALANREDVLARAAALGRGAATTGFKRFLALTEAAKDRKDGPFRKLFNA

SEQ ID NO: 125986 - protein, 213 aa, Triticum aestivum
  unsure (1)..(213): unsure at all Xaa locations
  Clone ID: PAT_TA_20404.pep
MATAAASSLLSPAAKFALPSRCPSAKTAPRSVRFPPVRAQQEVKEEEPAATVPPLQEEQATAAAAAKGPAQSLPRQPLAESKNMGREYGSQWLSCTTRHVRIYAAYIDPETNAFDQTQTDKLTLMLDPTEEFVWDXDETCQMVYNEFQNLVDHLRGELQLSGSTRFVTSGSDLEHYXIRKLLYDGEIKSKIRYRVTTFSMDQPPDTTTTRHLP

SEQ ID NO: 125987 - protein, 107 aa, Triticum aestivum
  Clone ID: PAT_TA_20405.pep
WKAAKVLVRRGANWKISDRKHSEISETEDLSKGKRRAGLVAKVLRDKKKGKGAALPGNIHPSSGILIKVPDDAAIEAPKRPRSCEPVPIAQSAPILQLPSSSTCSQP

SEQ ID NO: 125988 - protein, 154 aa, Triticum aestivum
  unsure (1)..(154): unsure at all Xaa locations
  Clone ID: PAT_TA_20406.pep
MAVGKNKRISKGKKGGKKKTVDPFSKKDWYDIKAPSVFSVRNIGKTLVSRTQGTRIASEGLKHRVFEVCLADLQGDEDQAYRKIRLRAEDVQGRNVLTNFWGIXFTTDKLRXSLMKKLADINRMPIVDVKTTDNYMLRLFCTGSQESPTSQDNC

SEQ ID NO: 125989 - protein, 57 aa, Triticum aestivum
  Clone ID: PAT_TA_20407.pep
NSAAYLQQRQQLLNPLAVANPLVAAFLQQQQLLPYNQFSLMNPALSWQQPIVGGAIF

SEQ ID NO: 125990 - protein, 149 aa, Triticum aestivum
  Clone ID: PAT_TA_20408.pep
VGSPAHGSSPASPSSASPRRSGRARQASARRLPSRRNLMPRLPRSARRMPSRRDLMPRLPRSAHRMPSLWDLMRRPRRRARLMPSLWDLMRRPGRRARRMPSLWNLTPMPPGRASRRRPRLWILGHRPRCASNDNDVVLATMLLCGARL

SEQ ID NO: 125991 - protein, 335 aa, Triticum aestivum
  Clone ID: PAT_TA_20409.pep
MADASPQAERPRLRRLGFVHVVAVQAAVCIAALYALARDHSGSLRPRVDAVESAVRRVAGPVARRLHGVPLHVLAFVDHKVDDAVQELGRHLPPAVKSASAQACHAVHAVPELAREIADGARRSGVKGVAKDVYGMVQPVAKGLYVRCEPVAKDLYVRYEPAAEHLAVSAWRSLNGLPVFPQVAQVVVPTAAYWCEKYNRVISFAAGRGFPGARFLPGIPIERIAKVFGTSPTGERSPDAKPTGLDAQTSEERSPDAKPTGLDAQTSEERSSDAKPTGHDAQTSEERSADAKPMGLDAKTEEESSPDAKPVESDAQTAGESQPEAAKTMDLGAQA

SEQ ID NO: 125992 - protein, 144 aa, Triticum aestivum
  unsure (1)..(144): unsure at all Xaa locations
  Clone ID: PAT_TA_20410.pep
RGGSVGSRSLRRPSGRSLYQRRRLPPRPPSSDSLPGAXPPRPNPPPGATPPRAPSHIPLLGDWIGXGGACPCRPAAPAPTASPTGPAAPAAPPSPPPLSQTQPSSRRRRASCDALATLMRWPPSLGRGGKLGIPLKKSFFLPAI

SEQ ID NO: 125993 - protein, 297 aa, Triticum aestivum
  unsure (1)..(297): unsure at all Xaa locations
  Clone ID: PAT_TA_20411.pep
FWLLLVHTEKNSSALVGAVGGRSPASELPPLGSEIIRVLTNPRKXLILAVARPYPEKNITTLVKAFGECRPLRELANLTLIMGNREAISKMSNMSAAVLTSVLTLIDEYDLYGQVAYPKHHKHSEVLDIYRLAARTKGAFVNVAYFEQFGVTLIEAAMHGLPVIATKNGAPVEIHQVLDNGLLVDPHDQHAIARCTPISFFXDKQLLGPRCKRKWGWKNIHRFPWPEHCQDSWPRVIXLNPXTCFSRAMETKIKDLSKERSVHPYCVILPTRLAWYNKILLEVHLRNVSSQQVVCHS

SEQ ID NO: 125994 - protein, 250 aa, Triticum aestivum
  Clone ID: PAT_TA_20412.pep
MAALRPAPRAAIGDRGPSAVRRGSRRPSYLSPASPCWQQGNILNRKSKCTTRKLLTTVTGAKGDESEFDSVNAPLEPQTWEGSFLCGLLKNQPQIFLVAAAKQLQRLSIQRKDTLTRWEHSIGSSEDCLHRRIAEMKDQECRTAIEDVMYMLIVHKYSKIEVPMVPNLSKIISNRRLHIWPPREADLESIHGPEVLGQIKEHLTSIIRWVHRNGPKINRSTFRVKDLQLEFLQPIQLLNAQLATTRKKNS
